United States Patent 9,328,346 (POLYCOMB-ASSOCIATED NON-CODING RNAS) - sequence listing, part 43

SEQ ID NO: 7643 - RNA, 52551 nt, Mus musculus
cagaggagccggguaagcggagagaagaggccaccagaagaccguagaggggagggggcgggagggggguggggcagccuuaaccacccacggccuggagccugggaggacaaggagcgacgcugggcuacccgccucgucacaacuugcccggaccagacacgcuuuaucuugcgcccuggaagaaggagccgccugccucuugcugcucaguugcuccucggccucggcgagccccgccucugcgccagcagcaaucccgggaucuggaucccccgugacuccccgugccuugcagcgcccggcuuucgcccaggagcgcgcagcuggggugagccgaggucuaggaugcuccgggcguccgccggacuucagccacacagagcaucucgcaucucuguuggcgaagucgggccuucuucccuauucugucugcugagauccgcaagacugcagaucugcagcuccccucaacccggcuucccaagccuuugucuuuucggguucaucaggccagcaguacagugcagugugcccagaacauaggcugcacaggauugggaacccagucuggggugggaguaggggaacaggaaaguaugcccccugccuuccuguuccggccaucuuguggaggauucgaccuaggggguaaggauggcuaaccgcagaugcccuaagcucauggacugccaagaccuugggccugcaccgguucuuacugggucugcugcggaagcgcgggagccucucccagguucagcuagagagccuuuggaacagagcaaagguucacccguuuagcaaggcaaaggcaaagaaaauaggaggguaugggccuggagccauuaucuuuuuuacugaacaccuaagucagucgaccguuuuuuugauuuuuguuuuuuguuuaauuaaccaagcacauucuaaacgcccuuuccuuucugcacuaggugcuugaaacacagcggugagcgacacaccuccccuguucccgcugauccugccagcccaguggauggagcccagaauccacaaaccugccagguccguaacccacacggggaaacugagggcuaaggucagcagauguguucuaagcuaggcaucaaauacaugaaagaaccagucuuuaaaacggucuauauucuuagggcuucugugcuagguugcaguaaaaugugauuuucuuauugccucagaaucuugugaaugugugccuuauaugaaguguauguuuuauuuccuggacacuuucauguggauuuauuuauauuacuauggaaagugcucaaaauaguugguuccaacuuuacuuccagauaguuacugugaauuguauuuuccuuucuucuguucacguauuugguuguuaggaaagaaaaaaauuuuccugaugguugguccaagcagggccucccugguggauugaggaaugccuggcuuuuccucagcuccuugaucccggagguaaccacaggcagccuccagaagaccccuacaaugagaggccuggggucugcaagucgcugcuagaauuuuuuaaagaaugcagcaccaacacagauuuguaagguaaauacuguagcccgguaaaucuucauagaaagcugaaggucgaagaucccauccguuuuuaacuucaccguuuuaagauauguugaaugacauuuuuuuuuaauuucaaaaauggaauggcaagcuauugcauacacugggcgaguuaucugguuuguguucugacaaguugucaacgcugagcugccagcccacagagggagagcaagaccuuuuaaaagaacguuggaaguaaggcauuuagagaggcugaggaaagaacaaguguaaccuuacuguggaguaaugcacaaaacgcauccuuaauuuuaaaaauacaauuccauuaaaguuggcaaacgucgaugcauacauccgcauaauuaauaccacagucaaaauacagaacgccccaccccagauuuucuuccgguccuuaaccccucacuuaacuuuauacuuacuuuguugcuacacguuuccccaaccugugaaaaaaagacaaauguguauuucuaaucucagaaccuaacgcuagcauagggauggauggccagaagaccacagcuaggacuuggagacgugaccccacgcauguuuuagggacucagugggcccccucuugaaaccagggaggguggugucagggaagguggcggccaagagaugccccaccacacagguagacgaguccuguggcgucuccugcugguccaagaggucuucucuguccuucuggucccacaggucccugggcgcaugcugaacgcgcgugggcggacacgcccuguacuccaggucggggcagggcgcugccauagcaacguccuggacgcccagauccuaggccgccgccgccgccgccgcagccgcagccggggucugggccaucagaggcucacgaggagaguggcggcggcggcccaaggcggccagggcuggggagacgacucugcuccgccccuccagcgcaagccuaggcggcggacuggcuugcaagcaugguaagaugcacgaggccggaggugucugucccgggaugcagggcagggacggucgggguucgccuggacucuugucucuccaucccccgccucccgccgcgcugucucuucuuccgcagcccuuccagaagcacgucuacuacccucuggccaacagccccgaggggccugacgccucugccauaggcgcggcucccauggccuuugucccccccagcgcggccucgggcccccugcccuucuuccaguuccggccgcgacuggagagcguggacuggaggcggcugagcgccaucgacguggacaagguugccggcgccguggacguccugacacugcaggagaacauuaugaacaucaccuucugcaagcuggaggacgagaagugcccgcacugccagucagggguagacccagugcugcugaagcugauccgccuggcgcagcucacgaucgaauaccugaugcacucgcaggaguuccucaccucgcagcuaaaccugguggaggagaggcugcgccugagccugcucgacuaugagcagagcaagcagcugcucaccaagcaggcuggcgagaucaagcugcugaaggaggaguguaaacgcaggaagaagaugcuguccacgcagcagcugaugauagaggccaaggccagcuauuaccaggugggacauugugcagggccaguucccuuuaggaacccauccuuuccauuccgcacagagauuuuuuucccccucaaagaaaacagauuaaggccaaaacggugacuuuaaucaacagcaaaaauauuucauugccuucugcagccaccaaggaauuaauaauuaaauaucuaauauugucugcaggacuuauggaguuauccaaauguuggcuguugagccuguuuccucuuuacaauagaugcugugaacaguccaguugugugcacauggcuauugaaguuggcccccaaaagaccuggacuaggauuuaauaugugagccccuccccaccuugaauugaaguguuuuucaaaugacagaaaagugccaaaauagagccuuaauggauccuucacccagccccucuuaccugcaucggcccacuucugaguccccucugucccuguuugguuccugcauaggaaccaugucacagugaguuagacugcugaaguucucaaugugugcagguccccaggacaagaaugcuaacauuagcacugaagcacuuuuuauauucaaaucauaaucucccucuguuaugaauuaggcauugagcccaggcuaaauauugcaauuuugaaaucaguguacagguugagaaaugcuuagggucagaaauguuuugaaauuuggaauguuuaauaacauucaucuuacaagguacccaggggcugggacucagguccaaacauuugugcuuauacauauuugcgugugucugcaugagcgugugucugcaugagcgugugcaggggcuugaggaggccagagagggucagcucuccuggaccuggaguuaugagugguuugugagcaccucagucugcuugcugagacucuaaccuggggccucugcaagagcaguggaggcuccucagcccaugagacccaaacuaagacccaucacuuggaguugggaguggaguuuuauacuuguagggugaugucuaugcuuuggcgcauuugggguuuagaugaggaggcucaucuacauugugaguagcugaaggaaggacaaacuuugauuaaaaagauaguaaaggacagguuggcagaauuggucuuauaauacauuuaggauaagugcucuuuaauuguucuugggaacgugggagcugacgcagguuucaagguugcagaagugggugcagggcagagaagugccuaagacaaaucccaggaacucugaaagcaguguauggcguccuggggagcagcugggaaaugaugcugggaggaaggcccagggucuggccuuggguagacaccaggaggcacucgcuucaaaggauacuccucaguaguggcuuuacaaacgcugcuugaaauucacauaccuauaaauagugcugagguugcuuucuuuuguacagcgaauagaaucgguucuuaaacauuuaaaggaagugcguuguucucuagguugggucacagucuagugaaauauuaacacaucuagcaaaauguuaucucucauucuuccagucaccauagaaauaauuguuagcaaagauuuucacaugcgaacuaugaguguggcugaaagcucucuaacaaauacgaaguaaaauugacgcgugaauacguaaagguaaggacuuuaucaaaccaguggcgccugucaacccuuagcacaggugucucucugaaugccagcguugacucugguggggcagguguggguucaugugggacagacgacaucacccuuuccuacuuagguggacagguguucugcuaucugugaaaggacacaccuuucuuuuuuuuuuuuuaauuagguauuuucuucauuuacauuucaaaugcuaucccaaaagucccucauacccuccccccacuccccuacccacccacucccacuuuuuggcccuggcguuacccuauacugaggcagauaaaguuugcaagaccaaggggccucucuucccaaugauggccgacuaggccaucuucugcuacauaugcagcuagagacaggagcuccggggguacugguuaguucacauuguuguuccaccuauaggguugcagaucccuucagcuccuuggguacuuucucuagcuccuacauugggggaccuguguuccauccaguagcugacugugagcauccacuucuguguuugccaggucccggcauagccucacuagagucagcuauaucaggguccugucagcaaaaucuugcuggcauaugcaauggugucagcguuuggaggcugauuaugggauggacccccggguauggcagucucuagaugguccauccuuucgucucagcuccaaacuuugucucuguaacuccuuccauggguguuuuguucccaauucuaagaaggggcaaaguguccacacuucggucuucguucuucuugaguugcaaugacacgccucucuuaguuucacaguuagacugcauaggucugaaugagauuccaggucaauguugcagaaauguuucauuucuaagcacacuguccucucuggaaacagggcauuagcagcagcagcagccugucaggaugaggaguucccugagauaagacagguagcaugugugagggccccguggaggcguggauucaguuuuccuugugacuuuccggugcugaguuauggcuuccuuuugucucuucugaacccucacaccacuuuaagaguucacugaguaguggaggugaagaaggccaaggcggaggugggggugcacggggugauucggguguucaaagacuacaucugugaauggagaacgcacagcaaguguugagacuccgggugauacuuggucgcuaaaacaauuuacggaagauacuugaguuagguuagucauuugacguuaggauacagucacagguuuuaauugauuaauuaaaauugauuaaucaaccuacugccagaaaaauaauccaacccagggcuuuguggcacguguagguagcccucuacuggaacaugggcaaacuacaccacagaagaaaacuugacugucccucugccaauaacuauacugagcuagugcaggucucagaagccuguuccuucuccaggcuggagugcugaccaguuugauccugugcaggucuuaugcuggcggccaugguucacggaugcaauggccucaucaugucuaggagagacugucucuaaggaaaguuccugauacccgguuuuuacgaucuaucuuucuuuuccaugacaccuccccagcuguugguuaccccaugacauucauggcacuguggcacuaauuggcguaucuuuccagggugauugcuauuacgguuuucaggacucacagcucgguaagauuguugaugccuuuucucccucagcagccuccacggcaccuuaaggcaccgugaaaacuagccagcagcaaagaaacuuccagauuagugccagcgugauuuacccaaguuccguacccaacgugugggccuuacaaucaugcucuaguagguaaccaagagcaccugcaauaaacuguauuguguugaggguuucugggaccccuagcaacucuguagggucuccccacaccugccccuggguuuuuuguuugauaagguaaggcuucuuggaggagcaccaucccucugcauaggguaauuagaugaauaucaguuguaggauggaugauaagucugagcuacauauaccuaauggaauuuuauuuaucuguaaggaaaaaugaaauugugaacuuuguaugcaaacuggucaguauaacuuuacuaauuacuauucuaguuuaauguauuuuuuauaguuuuacuaacccagacccagaaaauaaacacauuuucuuucucauaugucgauccuagcucugaaucuguagaucagguuuagcaucgaguaccuguagcagccaagagacuagaacgaggaacccuuaggagaggagaaagugcaucaggggggaggacagacaguaugaugugggggucaagggggggagcuuaaguggggaggggcagggaagaguacaacagacacaaaggaagagagguaacacuaaggauguguggaaaagucacauggaaaccuacucuguuauaagcuucuuguuuguuuguuuguuuucgagacagaguuucucuguauagcccuggcuguccuagaacucacuuuguagaccaggcuggccucgaacucagaaaucugccugccucugccucugccucccaagugcugggauuaaaggagucagccaccaccgcccggcuauaagcuucuuaauauguguauauuuuuaaaauguacuuauuuugauuuuauguguguggcucuucugcuugcauauauguccauauaucacaugcauacaauacaagcagagaccagaagagggaagucagauucccugggguuguggugauacacaguugugaucugccauguggcaacugggcucaaacucgaguccucuguaagagcagccagugcucugaaccacggagccaccuuuccagcacgcacucacaugcacgcaugcacacacgugcgcguacacacacauauuuacauuuuuuuaaauuggagcuguguucuaguggcccagcauuccucguggccuuccacugccugccaggagauuaugaugucuuggggauucugauuccagagguguggaaugaggggcuccccuuguuaagaaacagccacaccuuucuggugcugugguugagacuaucaacagaauuagauucuguaggaaaaugugaguucaauaagucugucuguccucgggcuacaaaaggcuccagauggacugagaugugagagugagugagugaguguguguguguguguguguucucucucaaucucucucucucccuccccucccccucccucucccuccuccucuucucuucccucccuucccuucucucuuucucucaaacccuuccauaccucagucuaagauaauuuguugagggacugugugcauuuucagaguauaagaaaucccuugacuuagaaggcuguugucaggacugagacagaagaugggcgugugaaucauuuauguacugacggacacguugcaucccguggcgccucucuucugaccugucugguagacuaugcuguaaacugaaaagugugguugugcugaggaaucaggcuacgugcuucugcuuccacggagaacaguaaugcaggcucucucuaggcagaguggguucaaaucccaucccuacuacugucucaacugcuagaccuuaacaaaucaccauuuguacauagguuucugcucugcggaauggggauggaaucauaccuacaucguagccauuguuaaugagcuuuguguggccuugcuuaacguauaguuaguuccuuuuuuuaaucuuuauuuauuauuuauuuuauguugugaguacacugucacugucuugagacacaucggaagagggcaucggauccuguuacagaugauugugagcuaccaugugguugcugggauuugaacucaggaccuuuggaagagcagucagugcucuuacccgcugaaccaucucuccagcccuaguuaguucuuuuagccaaaaccuaagacugccauacagagagcccuguggcacccaagacaagcaccagagcuggcugacugcaagaugacagaagucacaugacugccagcauuuuagguuuucuccaccucucucaauuccagaggcuuuggguucucugcagagagauugagcagaccaugcaaucaaggacaccuucagacaucccaggcccauuuccuucucuuugucuucaucccucugcuucaagaaaucacagaaauuauguaguaaaaaugaaacauuuaaggacgucugcuuccugcaggcccuuuucccauuggaaccugagugugacguguuuuaugcagucagaauguauaaaguggucacaaugacaguguauauuguccuuuuuuucucagcauuuuauuguauaaauuuuacaauauacagaaaaaucaaaauaaccauaugccggaucuccauauauagaagauuuuaaaaggaaaaccaauaagaacaaaccauggacugaguaauaauaaccuaaaaagaauguguaggacagcgcagcugacacacaccccgccucccagaugcgaugcgagcugguguuugcucuuuuuccaugcucuacuuuggggaacguuuaagagagagagauaucgguacgggaccauccccuggaguguaagcaacccccagaacucauacccuucauuuuuaaaaauaguuucccuccauccauuuccagaggaaauauuucugucccuguauucucuuuuauguuuuuguauaccauuuaucuuugaaauguuuuucugaaaguauauuuucauaggagaauguuuuuagcuucaaaacauuucacacacacacacacacacacacacacacacacacacaccccuacaccuguauuagcuaguaagucugccauaacaaaugccaucaauuaguuggcuuaaguaacagaaauuuauuuccgcaaauauuuggaagcuggaaauccuaugccaagguuuaaucguaugcagggcugguuucuggugagguuucucccccugccuugaacaaauuggugauaagaagacggaaaccccacguacaagcagcaucgcuagggcuuccagaaauuaccagaagguuugcuucagcugucaaaaaagaaaaaaaauauauauauauauaucccacugacucauuucaguuuggaagggcauuccuuacauuacauaaccuuacauuugcccuuugaaucaauaucauagccaacauccuguaucuuuuaggaagaaagccaccauaagccaugcuuccgauccccaguuuuaacugugagcagguggggaaacucacggcagacauuugaguuggcugcuuucuuuccagugccauuucugugacaaggccuuuaugaaccaagcguuccuacaaagccacauccagcgccgccauacugaagacucucaccucgguaagcgugaacucugugcucagagucguuuuccuucccguucccuuccccuuucucaacgagacguggcuccgcagggcaucccucaauccucuugaaagaaagucucauaggcuuggaguaaauauugagccccuuaggugcguguucacggugcccuaccuaccccacagcugggaguggacuggagagguccagggucaagucuuguguucuaaagagggcuaaagaggcacuuaaacccaguaugguguuuuccaagugccaaaugcaaagacaggacggagggagaaucugcucagguguucucugaagcucucugaggaggccaugucuaaccagcgugagauccuaugaagaagccacaguccgaugagaauggaggaccagaguacauggaccucaguacugaggggcaggaggagaggcugggauguguguuuaaggaacagcaaggagauuggaggaguggggugaguaaggcagagguguguagagggcuggaggcuuggaggacugaucucaagagcccaugguggccgguggccugcggccagugggcauugcaucaguacggugacaagcccgggggugacguguguuguggaggagaaugaagaugugaguagugcccuaaagagagcauucuggcugucgaugauagaaggaggucgagauagagauaaagcuauggucugcaagggcaauagcagacgcuggcagaauaaggcagugcauagagguccaagugagagaagagagaguccuggaccaggugcuucuggggcagagggggagaaaaagaacacguguugacacaaagccuacagagcuaugacuugggggucaaagugagagaccuaugaggaccuacuucuguuuagaagaauguuuucugugacagagggcuaggggguaggagggagcuuaaaagugagaggagauaggagcguuuucacuggacacacuuauacauuuacaucugugagucacauggcugguguuugaaaauggaggcccaggguagauggauagauagaaggaucuggaagucacuggaggacugggcuggcugaagucaucuaguuagagaucagaagacccaaggucaauacuagccgcccccgccccuccccccauaacuuuauuccucaagaagggcaggaagagaguggcaaugagggugacuuagguaggcauugucuugaacagcaagggggaaaagguuccggaaagguggcaguggucaaguguaucagauguucgagaggcaaagaagacuaggaugcagauggggaacgucccguagcugcacagcaguuggccuugacaucgaaaccucaaggaacugauaaagaccacaugucaguuugaaugaguugagagccagugaggaaaugcucuuaaccaaucuguuauccauguguccugggaaggaaagccagagaccugauacaucaguugaaauguagagacaagagaaaugugucuuaugugggaguuagcauguuugggugcugauagaaaauaaccagaagguagaaaaaaagacccagaaaugggagagugcucugugguuuacccaaggagucagguuucccacagacucccgucuucucaaagacuggagcguccccuccuccccaagcaggccagacuuugggccaccguaaccuacagaaguguuuccaacaguugugcugauuuucuuccacuggggccagucuguuuguauuccugcccacaaugcuuuguaguagaagcaaaucagauggcagaaaguuucauuguagaaccgugguggaccaccgaucugaguaagugguguauuggaaacauggaaguguugagcgguuuguaaguggcccaccauucuucggugugaaacugaucucucucucucuguuucaguaucuuaucccaccucauacucgugucagagagcgcuucagacucugaaacgaguauuguuucuucaggucaucuuugagauucugacuuucugcuuugguucccauaccuuucaugucuacacucacagcacauguauaccauucagucauguguacauccucguguaaguacauguacauaaguauccuuccuuucaccaccuccuuucaguucuucgcuugcgcccuaguugacagacgacugccccagcuugcgucucgaauuccccagcccucucagugaucgcugauaggggacuucggggaucuugggugggagugcaaaccacggugacuguauaguuucaguacugugcuacuuguaggugaagcucuugcuucucugcuuugagugagacgaacaucucugaaaaaguccugagcacucgugggucagaaccaccgggcucacucccugaacaaagaucucacggugacccuguugaauaaucagccuuaguacagugaguggcggaaagaagccacugaaacuaaugaagugucuggucacagaaagggcuccagacaaacaguaaagagcaggacugggcucguggcagucccaagggagagagagcauuuuccuuugucuuauccuuagaacugugccccgugaguguucaggugaauucauaagaaaucguuuucuaacuagaucuucucuugcacagaguauaauacaaaggcccagaccgacaggcuccagaaggagauugacauguugaaggaacagcugcagcucacuaggucucagcuggagucugcacagcacucucaugcaguucgcuucucuaaggugggacacagggcucuguccuggagauggugcaaugacaaguacuuuaaugcagggaaagaggcaugcuggcuucauggugugugugugugugugucaguguguaugugucagugugugugugugugugugugugucagugugugugugucagugugugucaaugugucugugucagugugugugucagugugugucuaugucagugugugugugucagugugugucaaugugucugugucagugugugucuaugucagugugugucagugugugucuaugucagugugugucaacgugucugugucauugugugugucagugugugucagcauguguguaugagagagaguguguguguaucgucuguguaugauauauguguguauugagcaugauauguguugcauguauguaugcauacucguaugggcuggaguccuuauuccuuugagacaauaucucucacugaaccugguuaaggcugaaugcccucaggccucagcagugcuccuguuugugacucgcacagcacaggguuguaagcucguauggggccaugcuggguguauacauugguguuggggauuugaccucagauccucacgcuucugcagcaagcacuguuaaccaccaagccggagcgccaggcuccaaaugugguuuguuuguuucuguuuacuugcauuuauuuauugagcacauguaugugggcguggguguguucuuuacccacugagccaucugccugcuccccaucugugcuuugguagggaagaaucacuguguauaggccaguggcuuuggagaguguuacuacaggucuaauucacagaagaaauacuaacagauuuggggugaagcuaugauuuguuuaaaaaauuugcacauguguuauauccagagccccuagugacauaaugcuaaaauaauuucaggacuaugaaaugcagaaaucaaaagaggaagacuuucugaagcuguuugacagauggaaagaggaggagaaggagaaguuacucgaggagauggagaaggucaaggggauguuuaugagggaauuuaaagaguuaacuucuaagaacucagcauuagaauauguaaguaugcaaccuagacgucuucauaggaucgcuugcuuuaagauggguguuagcauggcaucauagccaggggucaggucguuuacaugccaaguauacaccaccccuccuccccgggcaucccaggucgcaagaggcgcugaggagguagagcaggugagcgagacuguuuuguugugaguggguggucuguccccagacccuagaacagaaccccuguggguguaucuguuccacccaagaggaaacuuccucaccugguuagguuuaaauagccuuaaaccacaaacccuugaacgaauucuagaauguuccaaguaguggguggaaaggcugauacagaucaccaaggcagcagaagaggaagaguauuugcuagcccucuccucgguccacaccugaccuuugaggaggaucgggucucuaaaguaagcaggaaccggcaagggggcccugugccgugugggaacagcugugguccacagacaccuccacauccucugugcugauccaguuccugaggagaaaaggagggaaaugaggucgauccuugggcucccucuaggggcggacgaguuucagaagcaaaacuaaacacaacaccagaauccuuuuauuuauuuuccuuuccugcucaggaucucguccaagacgccauguuacagugggucauuccgacuccuuaggcuuuucuguggccggggauaguuugucagccuuguuguuguggaagcuaaagaucugaagugcggguuguuuguauggcaagucccguugcugggguucaucugacuagugacaggguaacgugauuagucagcguuucuguggaguggaucucggagacagugugucgcuucgucgaauuguaccaaggucacacauggucuccguggucuaaggcuuucacuuuggccuugccacccggagcuguaguauugguaggaaggaacuucuguacggagaaguuucuuugcacuuucagcgguugcagugaacggacaacgaaguagugguauaauguccgugauguuaacuuuaucgccuguuguugucugagauuuuuuuuuccauaauuaacuuuagggaaauuaaaacauuuauaucccugguggauuuacugguauggccucugggcaguguucgucuucuauugcaauaucguaacuucucagaagugucacaggcguggugauacaccccugcaauccagcacugggaggcugaggcggggucagccagaguucaaguccaguugggccaaggcagcaagaucugccuuaaaaaaaauaaacagaaagaggagauauacccaguuccucucacagauguuucugucaagaauuuaaagacccaucgucagaggucagagguuggcuuggggagugggugagggggcagagagauggccagcgaguaaagcagcugugugcaagccggcuucaguccgcucucagucccugaaaugcgcagaaaggcagaaagugagacuggacuacgguuguccucugacauggacaugggcauacccuggcucccaguaacaaaccauuuuaaaaaaacaugagucuccuucccauuuuuuccacauucugguggagauaucaaagaucagagacugguagaaaaagagcaaagcggaggagacaggcaagggguguccggagggagagggauggcugaacgcggcuuugugcuucuggcuucuucgcuguugccguuaagucaaugucugacguuucucuuggugauucuuuucauccauagcaguuguuagaaauacagaagucuaacauccagaucaaguccaacauaggcaccuuaagagacguuacugagcugagagaagaccaucuuccguguccccaggacuuccagaacaugcuacagcugcuugacagccagguacagcacgcguggugaccgcggccacaacauguaacauguaucuaauuacgugugugugccuccaugagcuuaugugcacggcauauaugcagugcccauacaggccaggaggagggcacuggaucccuuggaacuagaauuacaagugguuuugagccaugguguggauguuugaacccaaguccucuacaagaccaguaagaacucuuaaccauggagccaggucuacaucgccuugguuuuucucuuaaugaguucguucccagcaaacguuuuuguucuguuucuuuuuuuuuuuuccugucucacaacagaugccuaauuuauaguagguguugacucacaggugugaguaugggauaguaguucacacuguuucaguuucugcccacaaaaaugucacucugaauuagucaguucauauuauuauucaauguuuuccuggcugcaguuauagcucucacuuaaaaaaaaaugugcauugagccgggcgugguggcacacgccuuuaaucccagcacuggggaggcagaagcaggcgaauuucugaguuugaggcuagccuggucuacaaagugaguuccaggacagccagggcuauauagagaaacccugucucggaaaaaaaaauguguauugaagcauuaagcuuccauuugguuugcauauagcacugcgcugacaaacugguaucucugauauauuuuguuuucauuuggaagucauacuccauaaucacucuauaaaaguuauuuuaucucaaugguaaaggaaaagaaauuaaaaaucaaaaaaggccaauauauagguuggugguauagccuugugaggccuggaauccagucaucccucuauguugguaggagguggggauuguaacuguggguauuauaaccuacaaauucaaccauguuggaaaagccuuugagucagugagauggcucacgggguaaaagguuuugcuaccaagcgugaugaccuagguucaaccccugggacccaacuggugggcggaaugaaccaacucgcacagguuaucuucugcccuccucguguggugcagaggcauggaugccuacgugcacauaccuggaaagcaagcauagcacaaguuuuaauaagaguaaaccugugaaguuuuuaagcaguaagagccuuuugaaauaggauugcuguuucuuguuuuaaugccacaucuugccugccucccuccaaugcaccgcucgccugcaugugugguuguccugucuagucuuucagugacacagccccccuccacucacacacuuuucagacuucuucacgaguagcaaggccccguuucccacccgacuguccugcacagugauggugucccuucagccuagcguccucuuuuuagaacacagcuccuuguucccgcggcuuucuuugccggcagcaaccucucuguucucagaauccuucucuuacucauucccugguaguacuagagcaaacuuccacaagguccccccccaaaucuccucucgacuagaccgugugguugggucaccugagcagagaacuuacacaccuucaguaggaauucucccguggucaugugcaccccuggccucuacagugcagggugucuuuuuaauccucuuccaagcugccagugguugcucagccacgugacugccgugaguaggagauuagaagcugacauuuaccuuccacagaccacagugucucccgugcaccgaguugccuguuuugaacccaggcacccagcaacccuaguucuuugaccccuuagcgucucacacuagcaucugcuguuuucaaauaaugucuuacuggcacacagccauacucacucccugaaauccugcccguggcucuucuccccugugcuggcuaguuuccagucaacuugacacaagggugacgcuggagaggagggagccucacuugagaaaacaagguccagaggcugacaaacccuauagaccgauuucugaaccagugauugauacggaagggcuuaagccaugugagugcggccaucccugggccgguggcugagcagaccguguggagcaaggcaguaagcagugcccuccauggccucugcguccuccccugcuugaguuccuguccugacuuccuguaccugugucccuucccaccccagcuugccuuggucaugguguuugagcccagcaauuguagccugaauuaggacaccuccauacccagagugugacagacucccccgcccccacuuuguaaccuaaaauacuaucugugucguacaaacaucuacaaaucccagccccacaguacagccagagacaugggugugagcauuacggccacauacacucuaaaaaugccagcagggauuuuacuagcuugucgggcuucauaggcacccgguaaagagcaggcuccaguguggaauggguuucuguguuacagguauaucauuuguuuuacucuccugcaggcaagcaaguggacagaucgauuucaaguucucaacgaagaacacagcaaggaaaaggggcagguaagacaguuagccacccacccugccacuuuguccccguguggagagugcaacccagggacgcucaagcacacccaugcacacacauagacacacacaacacaugcauacacauaugcacacacacgcacacaaacacacaaaugcacacaugcaugcacgcacacacacauguggccgcacacacguauacacacgcacucacaugcaaacacacaggcacaugcagacacauacacaggcacagacgcauguacgcacacacagagauacacauauauguguacacacacgcgaucacacaacacaugcacacaugcauaaacuggucaucuuugaaaaguuucuaguuuacuugauaauaaaagugguauuuuccuacuuaacauuucuggagaaagauguaacaaaauuauaaguauuuauaguuuuugcuaccaaaauuaacugcugcugcuccuuuguaaguuucucuucaguuuucuuucuauucuauaaauguuaaaagauuuuaaacuauguuauuuguucuuuaagaguuucccacacauauacaguauauauugaucucacccauucccagcucuucuccuccagcuuguucuggacuuggaccuuaucagugugucuucuccuccccaacuucgugucuccuuuucagaauauguuuacaaaaauaaacucauugauuccagucggugcugccccuaggcacacagguauagggcauccacuggcaacuguauaugucagaaaauucauuguuaauguuuccacuggggaaagaauguaucaagaugggaaaucuuguuuauuuuugcaacaguuauuaucuuuugaauacccuuuguguuccauaaaauagucuuccuuucacagaguuagugcuaagaacuucuuuccuacauacagcacuaagcagaauaucauauugcuaaagguuuuauaucauauaacuauaacauagagugugugcgggcacacaagagcuagggaaaaguaacuuagaugagcauagaauuuuccaguuuuuauuucuuaacaacaauggauacagagagaaggagggagggaggggagaagggaagggaagaagggagggagggagggagggagggagggagggagggagggagggagggagggagggagggaggagcagauugcaaacaguauuaaaacuaaaugaaaacaaaacaaaggaaagacaaaaacacaucagugugcaggcacacuaaucugugagcaugagagugucaucgcugacgagugaucccauucggaucuuuacugagcaagaacuaggcacuacacucuucagggcucaaaacaggggucagucccuguccuaagggauggacucuccauuguggaaguugggacacugagguugggaaaggagagaccagcgcacagucgugagcagagcuuguucaaguugggcggcagccacauguggguaaugcuuguguugguugcuauaacccagcuuucugauuuccagaugagguagccugacagcagcuugggguuaucucuguaacaggcuaaaauaaauuucuuggguuugucacaguuguaguucgugguacacucguccaaccagacaaacucuaucccaugucucccccuuaacccuaucaaccgucuuuaauguccucuauuucucgccccuaggccauauguuuccauuaccccuguccuuccuuacuuagccuuuaucauccuccuaacagcugcaggccuaguauugaucucuuuuucauccacuguccacaaugugaacaaaauaauguggccucucucuuccugaaccugcuuuuuucaacuguaauagcuuccugauaauuuccaaaauauuccgaauuuucaaaaacaauauacgugugugugugugaugugugaacgugugugcguguucccauguguauggguauguauguacucauaugugcacugcaugugucggcacagguugauaaugaguaucucucccccagucacuguuccgauuauuuacuaaggcaggauaucuugccuaaccuggaacuuggugacugggccaguuagucuggcuagcuggcuuggucaagagacccacugucacuagcuccugaguacagccgccugcuuagcugucauuuggugcuguguaucugaaacuugguccucacgcuuguguguacuuuaucugcugaucuuucuagccucauccuggucuuuuuugggguguguguguguggguguucuggaagccuuccuuuuaagcacauauuuuaaagggcuaacuaagcaagacaagcccagucaggauaacuucucuaucuguuagcugaaauucagcugcuguggguuuuaacugugccugcaaugucccuuuugcugacuucagcuagaagcacaccgugaagacccaaggcugggcugugcacagcgugugcacacucaugcccugcagguuaugcugucccuuugucugcccguucagcuguuuagaagcuguuuucgucucugucucacuuguacccuaacaaagaggugaacucaaccaaaugcagucaucucugccuaauuauuccacaugauuggugcccacuugucccacagugcacauacuguguuucucuguuuaagggaaguugccugugccagcuuguuauugcuuuacuuagguucuuggcagccuuuuuuuuuuuuuuuuuaaauaacauugguaggaguucaaagggagucacauauaaaccguggugugaccuucugacccagcccaagagcccuggagacauuuuauggucacacagugacagagcuggcugguguuaugagugagaccacauaggacagcagagaacuugaaaugauaggucucucucucucucucucucucacacacacacaggcacaaggacugcaugcuucaugagcuaguaucugucuuguuuaagcucucugaauccccccucaucuucuugucuguaccuuugucaccuguucuugacucugcugucacaaugaugucaccccgugauuuuuuuccugggucccuuugcuucuuggggauuggcaaaacuccucaguuuggugaccugguccaggcaauuuaaaacugccuguacccagcucaagacaucucuggccuacuuagauacccaccuuggcauacauguaugcaacuaguuaaaauuaaaucuuuuacaugaaccaacaagcacaguaggaagugcccauauggacccucacaucaggcacauucacacccucacaccaggcacacucgcaccccaacucgcacccccacacagacagaugaagccugcuuuuaccagcccacucucucuccacaucaggcauuagaugcacacuguccugaggacgaauuaccaagcucagaggcaaaauuuuuuccugauaauuuagggaaugcccuguuaaugcaauuuuagugguugccaaaacagaguggcaaaggaaaacaaaacauggcugagcuugguauaaccucccuuggcacuaaguuuccgugugacuucaugugccauugugaggaagugcagcagcucagggacaggucugcaccagcucaaaguuugaggguacagccuaccacggcggcaggaaagucggggaagcaagagcucucugcagcucauugcaucacaccucacagucaugagacaaggagauggccaucaguacucagguccccuccccguucuuagucagcccaggaccuauuccacaggauggggccacccaaguucgaggugggucuucccacccaaauggacuucauuuagaaaauuccucacggacaagcuuagaaguuuguguccauagugauucgaaaucucauuaaguugacaagaugaaccgucacacgggcugaggaguuggcucagcauuuagaagagcuugccacacaaacaagaggacagggggucagauaccugggaccuacguaaaugcuuaguggaccugucaacucaccuugauuucagccucagaaggcagccucggaaggcaguucaggguuggacggaggagcucugccugcauaaggugaggagugauguugggacacucccaguaucaaccuuguccccccuguggacuuggcacacacaaguguguacuuacacgacugugcacccacacacacaaacacccagacugugcacauaagggaaaaaguagagacuacuccucauagucucuaaagaugcuuuaccccccuccauucauuccucccuucuucucccucuuccugaagcuccuuccuguuuagaccaaggauuaggcugguuguugggaauguaaacugaauccagugagcucuugggcccacgguugccagaacuaacguguuacauguagaugugagggcaggggacaggacuguaugaaaagcucaccguggagguggcaccagggcucugggagacaccuuuauccuuaaucgccgagcagcuguaucuauuauuuuauugaaugugccccaguugacuguacugccuaccucguccccuuuaucugucucauaucauaaacucccuggaagaggggaagucuaguacagccagggccuugacauggacugauggaagauuuccugagucacuuggugaacagagaccguauaaaacuggaaaaaagguuaagacgggcacauaaaaucugaagaaaaaaggaaaccauccgugcagcuugcagacuaaugcucuuccccguuguuuccccagcuccugucccacauagagaagcuucgaagcucaaugaugaaggauuuaagugcagauaaugucuucuacaagaggcggguagaagaguuaggccagaaacugcaggagcagaacgagcugauuaucagucagaagcagcagguacagcuggcgggggucggggggggggaggucggggagaugggggggcgugggugggguucugcacggagggcccgugggcagcccgaucacccuaagaacacagguuuaggucccggcaucugaaguugaguaugacagaaguggaccguuuccuccauguguccuccugacugcuugcaagaguagacguguuaaaauauauuguuuccacuuaaaauauauuguuuccaccgcuacuuuagacacagagauacuucagguacaaaaccagagguagaugaaggugcccugugaucaccuggagaagcagccugaugccuaugugugacucuucugcgacgcuugccucugcuaggaagcauaugcuggggggauuuagcaagaaggguaccuggcugcgaccagucuguccuucccuagcuuagaaugugaacugcuagcagacugucuuauguuuugcagauuagagaauuugccaguaaaccauacagcagcaucagcgagcugaaaggugaguggccgugaugggccaugcccaagccaaagugguuugccugacagccucgggugcugaucuucugggccugaugauuuauguucacuaagguagcaugcuacuugauauuuuaaucugggauagcuguucuuuggcuguuugaagauuugagaggguuuuggguuuuguuuuuguuuuuguuuuccccauaauccagaaaguugaagaauuaaaaucuaaacucuuauuuaaaauuuauauauuauucagucaucaauuaugugcaauuauguuuugguuaguagucauuugacucuuuuaaaaguuuuaaaauugcuauaugaguguuuaaccugcauguauguaugugcaccaugugugcacaguaccuacggaggccagaagagggcaaugcauaccccuggaacugaaguaacagaugguugugagcugcuauguaagucugggaacuaaauaaacccaguuccucugcaaggguagcagaugugccuaaccacugagccaucuucccaguccugcccuuuaucucuugacuuauauacaugaaacagagucagaaacagggcuuugaaagacuuugagcucagccccugucuuggcacuucaugccuuuuugugagucuguauucaguuucuucaucucuaaaggaggaaauauaauaacaacugcgcuaaagccuugucacaggauuaaacggaguaauucgugaaguauacuggcuacaugccuaucagaauugacgcuaaacacuuaguccugaaauacuguaaagacuggcugcauccacucuccauugugguuuagggucauagcuugacucuaagcauugugguggcacuugugacauacgagcuauagcagcaucuccugucaggcacaaucuagaucagaagggagaccggaacuaaaagccaggcuugaacuuucgcuucugcuuggccccugcgugccucggaacgcuuaagaaucaauccucgcugugugggagacacuggcaaggguuugguaacggaauacacagcugacuuuucuugcgucucuuuaugagaaaaauguuugguaagcgaaacaaaaccaaaaaaacaugggagggggugaggucaugacuuccuuuaauuucucuuaggacaacgagagcugaagugauaaggaauaucacuuuauauuuauaucauuuagauauaaacaauugacuagaagucauuccaggaaaauaaaaaacugaacugugaaagaauuugagucaggcuggucgugguagugaaccccuuaaucccggcacucaagaggcagaggcaggccaugucugagcucuguggguucgaggccagccugcucucuagagggagcucuaggacagucagggcuccacuggacugaccgcaacugcugcucagucgugcuccuccgauccugcaguuuucguuuuuaacuuuuauuucugccaucagggacuccuuuaacccgacaaacacuggaaccuaaaucggcugcaccaaccacacccaguaagugucagcggagggccggggacuaccuaccuuccugcucaguuuugcucgcuugcuuaauuucuuagaggcuuuucuuugagaagcaauguacuuggucacgaacagugauuccuucucaccccaagcuuugacugagagucugggauuuagguuaguugugccugucaugugguaguuugacuuauaaaggaagggguaaaacuuuggcaucacacaaguucacauugugggacuucccaaagcagccuuggaagaucguagcuggcggccacagcacacagauggcugacacugaugcugaggaguuuagcagauccuccuguccaacuggccagggccuggauuuguccagaugcaguuguaaaccagcaagaucaaaucuugggaaauggcaguaaaucuuuacuaggcauacauaaggaccugcguuugacccccaucacccaggaacaagcuuggcacaguuagcacaugccuggagacccuagacaggagucucuggggcuuguuagccagccagucuacucaaugugcaagcucuagacucagacagagaucccggcuuaaaagauacacuggauagccagacaugguggcccaugucuuuaaucccaggacucaaggggcagaggcaaguggaucucuaaguuugaggccagccuggucuaugaaguuagucccaggacagccaggacuacauagagagguccugucaaaacaaaacaaaacaaaaaaaacacaaaacaacaaaaaauaagcuggaaagauagcuuagagguucagagcaguuacggagauuggagcucagauccuagaacccauaaacaaacaaacaaacaaacaaaauauuaaaugaauaauugaguuggugcccaauugaggaauccauuugcugcuaauucccacauuccacaggcuaacacacacacacucacacacacacacacucacacauacacacacacacucacacauacacacacacacacacucacacacauagacgugugcgcauacauacaaaaaaaaccuuuucacacuuucuuuuccagugauagugaaagaauuuaaaucuuuuaaucucuguucaggaaagagagaagaagaaaaggacucuggguggaggcagccagagcagguccuguuuaugaacagcaguuccgggugcugcgugcaugggguguggggcacuagugggcucaggacugaagcugggcacagagcugaccccacuccugugagcuaggcaucaggagagggcugcgcagugacuguggcgcauucguuacugggcgucuuuagggguuuggcuaacagcuuacaccagucagucugggaggggggguguugguaaguggggcuucuuuuaugaagcugcuguugccuccugaugccaaggggauuggaaggucaugggaggaggggagcuagauugaucuuaggaaauaaagaaaaugcacacuucauggaaggauggaacgcuaaaagacugaguugaacaaugaucaaaggaaauaccaccaagcauacaaacagaaaagaagaaauaacagcaaaguguguuuggagugauuuuucuccaaauggaguguccagauagccugaggcaggcagccagauccaaugggauaugagaagucaguuauuaagaucuuaauguaguaaagaguuuacucuucagauuuucaaauaauuuuauguuugaaaauguauauagugcuuguaugguuuguguguguguaaauuuauuuagagaaguauguguaaauuucacauucuauauagugagaaaaaguagugaugucccugggaugaagagaauugggagguagguggguccaugcuccauauguaggggacccuuagguagggguggcuuacucauucccaaucuuuccuccagcguggagaccgcuuuaaaaauccaggauucuaggggugacaaggagaguguuuucaggagaggagcacagguacccuaaaauuuaagauaagaaaauccaagucgcaaaggaagggucagcauagaagugaucuaaugcacccaucugauccauuccuggcaagauggacgaccuccagcgcccaacacaaggcugauggaugugggcugcucugugaugcagacuguggccagucaucugggacagauguucuucccugcugucugcugcugucgggagugaggaguguagguuagcaagacccuggcgugaucagagcagacccuagccacuuugggccugugacugucuuccgucguaagggagguguucuguagccugcagcagcccauuagcagacggucaguuuuaacacagucauguccuuuggcuuuagauccugacaguacagaggcggaugguuacagucaaccauuggacugaaugcaggguccccaguggaggcguuggagaagggacugaaggagcugagaggcuuugcagccccauggggggagggagcaacagugucaacaggccagaccccccggagcucccagggacuggaccaccaaccaaagaagggauagaaagggacccgugacuccagccuuggcagaggauagauagccuuguuggauaucagugcgaggagaggcccuugggccugagggguucgaugccccaguguaggggaaugccagguugggaaggcaggugugggugggugggggagcacccuccuagaggcaggggaggagggaugggauaggggguuuccgaaggugagaccuggaaagggaaacgcaaauaaagaaaauaaacaaagcaaaacaaaacaaaacaaaagcugaaguaccauccagaaccuuucaguugguuuuccuguaaaacggguaaauaucgggauggucgcuacuuuauuuacauggcaagaugcucgucugaagcuguccagcucugguauaacaucacaaagcuagcuguagaugaugaagcagugaacucggcuguguuucaguaaccauuuaugaaacaucagccggcucgauguuucccacguuuguagcuucgauguagauuugcaugaguugcaaaugaacccagaaguccuauuuucuaagcuuccagucauuuauggacagagaggaguggaacaguauuguauuuauucuaaagaaagaaaguguaacucuuuaaaggcuacaagguuaggacuaauacuuucaagguaggauugggacucaaggugaacuaguggaagaaaccauaaaccacuagguagcuguuuaagagggcuugggggggagggggggagggacggccgugcgaucaggcacuucaagggcucuuaggaacagugaaacucuggaagaaaggcucaggaucuuucggaacugaucaaagcuuccuuccgagaugaaaacaacccaaaugcccaucauguaauagacaccuggggucuaguuaaacacugggcugugacuugaccgucggguaacgccaauggugauguaucacacagcgaaaucaugcgaaccgaaagaagccagaacauaguguguaguccuggaugugugaaauguucagaagaagccaagucacagacacacaggggacaaucauugucgccaggggcugaagagauggguagagaaggagcuaacacacauugccacugaggagacugacagaagugcuccgagggugagugagugaucgugcugucacaacccugugcauauaccgaaagcugcacgcacaagugcaugcacacacaggcacacacgcauguacauacacacacacacacacacacacacacacacacauacacaaguuauuauuucucagagaaguuauuuuuagagacucgagguuguagcucagugggagagcacucaacgagcgugcacaaggcccuggguuuuaucccuggaaccuccaaguaauacuuuagaacaacuuaagaaaaccuaaugaggccagcagggcagugugugcugugugaggugugugcuuccugugggucgucuguaucuuuuuggagcguguacagucaugcucacagucagaugccuaggcuguagugaccgggccagugagcuuucucuucugcucuguuucagugacugccucggccacacagaaucuggauggugcauccagccugaccaugguacaugguagguuucaccaguagucuuaauguuccgugugcauuuuucacccagaguuagauaauucauuaacccagauugccagcgggcaugcgauuauauaaaacaggaaacacuagcaacuacaaagcaguuauuaaaacugcuguuuucaccgacaacgugaccaaaaaaaagggacauaccgucaaagccaaaaagcacacaggguauguguguugcuggacuuaccgacagcaguuuuaacaccaguacuucauuuauuuaugauccuugaagaaagugguagggacagaggaagaacaagguggcucgauacuagaccagccaaccagcacacgccacagggcaugcgaguuuguuuuuauaacuuucagcaugguagcuagucaccuuuuuaaaauaaacagucucaaugauuggucaggaaaaugcagaaaaaagauagaaaccaagggcaacagacuggaccaagccccagggaugaaaacgcugccagaaacugguccucggccaggacaguggaguaguacgcucaugcucugguagacugauggcugucugcagauauggcucuuuuccuauugcagauauggcucuuuuccuauugcagauauggcucuuuuccuauugcagauauggcucuucuuuuccuauugaacuggacuucuuacagguuuuccuccucugcucuuuguguuuuccugcggcugccauaccuuacaaaggaaccucaagagggccaccuuuuccugccucaucuaccagugguuuaaacucuaauaauuacuguccucugcuuugggcuugaacccuuuaagagaauagacgugagcaaggaaguagcugaaguggcucuguagauaaagcacuugccaugcaaguguggggacaggaguuuggauccccagaacccacacuguaaucccagcacuacugaggugaacugggagaugggagaguccauggaaucucccuggccagcagcccaaggcccgaagcaguaaagaagugacugaaugaaaacaaggugggagacgaggacugggaccuaaacuguccucugacgaccuaugcaugccaugcccucacaccuaugcuuacacaugcacacacaugugcacauacacauacacacucacaugaacacauaucacacacauauguacacacacacucacauacauacaaacacgugacauucacaugaacacauaaacuuacacaugcacacaugaacacccaugcacauacacacacagcacacaugagcauaugcacacaauguacacauacagaacacacacaugcacacacauacaugcacacauucaugcaauacauacaugcauacacauacauguauauacauacaaacacacacaucacacacgcaugcacacacauacacauauagcacacaugaacauaugcgcacacauacacacauuguacacacauaugaauacccgugcacauacacacacagcauacauagacauaugcacagauguacauacacagaacauaugaacacacacaugcacacacacacacacuuauacaccuaugcacacagaaccaugcaggaacuaaagugcuaauuaaucgauauuuaagaguuaagaggguaguagaagcagagaaaggcagagagagggagagaguagauaaguagaggccagccauggucaugaacacguggagagagaggggaagggaagagcccaagagggcaagggggaagaaagaguaagagagggaggagagggcaagcagccacuuuuauagugggucaggccuacaugguuguugccugguaacuaugggguggaguuuagacagaaugcuaacauaaccugcaugugcaaggccaaggccaggugcagcagccucaggaauaaauggaaacaaagucuguccuuaaggaauuugcagucuacaaaauaaccaaauaguugccauuguguuauuacaagggaacagauagacuauggugauauggguugucagucucuggcaauuugagucauggaggcaaaaaugaauguguuggaauggcauucuagguagggcagacaaugggcagaauauguagcaggcaaacacugacuauaguaguggcacagcuaaucacuuagcugagcacagagcacacagaagagacuugagggagauguugguucugauuauucaaggaggacuaagcacaagacuccacuugucgagguguuucuguggacaugcguagccuuuggauguccuugaucaugcugggcaugaaggauuggagagcuggauuauggagacaguggcuuggacagaguauguccaaagaaucaaggcuggaaagagcagcuugggcuauugguaacuguggaccuaacaguucuucccuaagagcuggcuacuuacagaagcagaaaugauucaggcaacagcuccaccgagggacaugggugcaugggagcaugcgcgacagcucgcuaaugccuggaaccuggagcacacuccacggccugcagggaacucaucacauuagaguuuuuuccaaaugacuguucuagacuucuggaaagcucugauggucucuggucuggucucagaggcuucuuuguagcuugucuugucugagagggacucucagcuuuuauugcuuccugugguaggaagguguuaugccccagcucugcacgaaacccgugagagcucaagaacuguggaggccccugcaaucgugcaugcgagccuuuuauuuuccagucagacuuggaucgaaaaccuucccacagugagggacaggagugugaccucgagcguggauggccugguggauggccuggcacuuauauacagcauaguuagagauucuuugacugcuuagggugacgggggggaggcgggugaaagagugucaggaggaaaagugcucuguggucucugagcugcaggugggugagcuguguauccuguaagccagcuugaugguugccuguugccggugccucaaucccgaaugccgccacggccccugccccagcaccuuccccaugugucuuucaucccuucccaggauggggcuugguuugauagagcuccuggcagauuuccuugugcagauggauaaaagucaugucccugguaaaagucaaccgggcaucguauuucccagucuccaacucauguccugggugagaugggauagcucucuccacuucacccuacuguaaggccaggcucaucuccagccuguagccucgcccugggggcucucuaagacagagcuggaguuuggggccuuggauaucuguaagauugugucuccgugugacugcuuacccgcucuugcuucacacucgaguuuuacucgcucuuuucaucuuugccagcuucuccuagccaaaaguuaagaguuccagcagguggccaggcauaggugugugcuaugaaguucuaauccgucccucuuggacggacggucuggcuucuacuuggcuuuaucucugcuguuguauuuuaaacagauggcucaugggaaagaacuuuuuaaguuguaucucaugugucagcgagagauuaaggcaugagaggcuugaguccucgaaauauguaauuuaaaaauaauugaaguuaauagagaauaccuagaaaucggagaguuccugaaaaaguggccaguuguugccgccucagccaggcaugguggaccaugcucacaacccaaccguguaggagguggaagcaggaucaagguuaaaggucacugcucacuauaaagagaguucaaggccagccucagcuauauaagacccuaucuuuaaaaauaaauaaauaaauaaauaaacuaaaauaauaaaaucagaaguuauugccuuaguauuucccaauagaucuuugcuauuuaggcaaaauauaucgggggauaugugcauauaguagcuuguauauaccuauguaugucuguauaaauuauuuggaagcaaacaaauguauucguguaacuccuuuucuucuucauugacagagcaaguguucucuucacacauacuggaaccaauagaagaacuuucuucagaggaggaaaaagguaacgaagcuuugggguuuccuuguucacucgggucuggaccuugguagugcaugucugcgcuguauagcgcacgguacugaaagcaagagccgccuagauguggauuguguguuucgaccugugugaugugcagcauuuuguuauuuugguccccuaaucuucugcuugauugaauuuucugcggguaaguuaaugagagauuucuuaugucaggaaacggaaaagcagaaauccuuuauuuugauacagauggggcucguguaucguaucccugacaacgugacaccgugugucccagaguggccucucacaguguuagccugaaacgaaugagaacguuuccauuuccagauuaccguucuguagcagugcuggggcuggaacccagggcuugcacaugcuagaccagggcucugccugggagccauagcccccguccccuaaucacucuuaacgucaaaaaugaacccaggauguaagcaccggguacgaaauagagcaaauaauauccacaguaugcgaugcgggagcugucagaggccuuagaggaaugauuuugcuugcauauuucuuuuggcauuccuuaaaauuacuuauauauuuuuaaagcuuaugaaaaauuguguaauuaucuuuucuuauuacaaaaaucuguuuuugaggcaggacuuuguguauuccagcugugcuugaagucugcuucaucacgccccucccucccucccucccucccucccucccaaggguggugaccaccggugucugccccaaacacucuggguucuuuugggaguguguuuuguuuuguuuuguuuuuuucuuguuuucuuuuuucuuuuucuagacagggucuccuuguauagcucuggcucaggaagagaggugaaaaaauaaguauuccaauauguagaccuugaaaaauguccuauuuuuuaauugugugugugugugugugugugugugugugaagaguuuucuaaagcacuggcaguuaaucagccucacaaauguugaaaguguaagauuuaaggcaaccucugacuuguaauaacauuaccauauauacuuuauauuuccagcugagcgaucaagaauagcaaaauauuaaaacugugucuuccuguaggguuucuuuuuuugcuauuuaauaugcaaacuaauuuggcuaauuuuguuuuuagugaaacuuaauuaauaggugaacauuuuggcucacacuuguaaucuuaccauucugucacuggcuuugaggccagccugggcuacagugagaccuugccuuaaaaaaaaaaaaagaagaagaugaaagaaaaaaacauuaacuuaacagaauaugacuuagugcugugaucagauggguaucuggagaacauguuaagcaagagacauuuuguguaagaucuuucacagauccacgucccaucugcuaaggcagaugaguacuggaagaugggggcguuucuugcagccagccugaaagaagaaacacgucuugcaagcgugaggaaggcauuuguucagugcuuuugaaggaaaugaaccuucuuggagguagaauccagaaugauaguuuauuugacaaacuucuuccaaaucuggcuuuggacagucccuaagguugucaccugacagauauggcucucuuuagucaggucuuaagcucccuuguacagacuggccuucauugugcagggccaugccuuuaggcucagguuccaggcucccuugaaauagacauguuuuccaugggcgguaaaguagacuagagugagcugcggcugucaucgccgggcucuguucugguucgguaaagaggagauacaggcagauuggacaugggaaguagaguauuaccuggccuuuuguuuguuugcuucuuuguuuagcuuuuguuuguuuuaaauuauaugauguuucccuuucuaaggcuuuguuaaccuguuugagguuugguaaagacucugaaaggggagaauaaacauaaacuuugauauauacuuaggauucacuaaguuaucucuuuaaaacuuaaagaaaauuuaaauaaauuggacccuuuuuucaucauaaaauaaauucuaacuaaucuuagagacauuuugggaaauacucucacugauaaaacaguaaagaaauauauauuauaucaacuacuuaacccaguuaacucuaacuuagguaagcagucaggagucugaaaccacugaaguucuggcacagauuuaaaaguuacagaagcucaaagaccuaggcauuauaaaacauccaagaccuuaaagucuuucugacuuaaaguugugaguuuucauuuuccacuuggaauggguuuguauaauccuuuuuaaaucugccuucuaauaaaaccauauuucaggucgagaaaaugagcagaaauuaaauaaaaagacguccuuaaggaaaccgucgagcaccagcccauccccccaggagcugaggacuaaccuggagcgggagcuggggaauaaacuaagaagcuuugggauuggcgcgguacguccuucgcuccccgagcguuugcuccuuaggcucccuucucuaaaucaggacccaacucuguacgaucuagagacuagaugcuaagaggacucagguuagcagaacccuggguggcaucugcuagaaccuggugcacuccuaagaccuuaacaaauacaaauguguucauaaacggaggggauaagacuuggaguaagugucauuauuacuucuguuguauauaaagaucaggugacuugacuggguucacgcagcuaguaaggaggaagccagcgugugugccugcgcgcuguacaguauucuccgucuuccuccucugcuggugcuucuugucuguugugggcaccagcaguuccuuugcagacgcucuugagacuagaguucuguguuugcuguucacauggguuuucugggguuuaguuuugaucagagccuuagccaugguuuuucuccuaguguguggagacuuuuuuuuuuuuuuugcuuguuuccaagaacugcaggugugcacccgcaugguuguucaaaauuagaaacgguuugacuuuauuuccaggugaaggaguugauauuauggcuugugugacccagcuuucccauucaucccauucauuugaaaucaugcuuuugucguguggaaacccugugugcgucuggauccgcuuagcccuucaguggauuuccccugccuacucauuuuuuuaaauuuuauuuauuauuauacguacguacacuguugcugucugcagacauaccagaagagugcaucagaucccauuacagaugguugugagccaccaugugguugcugggauuugaacucaaucaagaccuucagaagaacagucagugcucuuaacugcugagccaucucaccagccuaccccuccucccccacuugcuuacucuuuauucacuugcugacuugcaagucaccugacuccacuuuauucacacugacuugcucguaggagccgcacacucuccugccuuggugggccuugcuuguguuaacguuggucuuacuacuccagauaauugccaguucuuccagcucuuguuccuguugaacuuuagaaaaacgcucccacuucuagaucagccaugguucaguucugauggaaacucuuugcuauucugggugucaauuaggaaagacuugacagcuguauagcaucaggcccuccccuccuaacuacaagguguaggaagacagacauuaacccugaugaucacggaaaguauuggaagccuuugacccucuuaagagaccagaggguguuagacagaucagaugaaugauggaggacagaggaaacguggacaugacauuuaucugaugacagacauuucccuccugggcaacgguguggggucgugauggggaacacagaagagaggggaggugaagggagauuggggggaggaugggcuccugagucaggcgcuaacuagugcagaaccaaccauguaagugacuggauccccaucagcugcagagucccucggucaccucuguaacuacacuaacacacuucagcuguacaggacauacacauaacuguacaggacgcuccucugcggggugagcgcugagcuuucccagcuggcauucaguuucucacaagguguccucggugccugagcaucuggaaauggccaauugccagguuuugucuccaccauucaugagagcgaagcugagccccccccccccccaccuucacccuucucugcaguccagggccucugauggcuuuucuuauugggaguccucuagucuugguggcuucauuugcuacuuaccgcacagcauuccguugugguuuagccagcccuaaacaggcacagcuguauugcaagcuccuuauagagcccggagaguuuguugcgugcuggauuccccuaccuaaaaugacccuggaucccaaaagaacagaguuaaugccgaggcaugcccaggagugaaaacacccaaggauaaugacaagggauugacacgacaucucguuccuucagaacauccaagguauuccgugcgagaucuugaauagaucgcuuaaagccaugcaaguugccagacaugaccuagcaaaacaaaugccugacauccagcaaauccgagaaucccucgagcaccagcugaucuguaagauggaggaaaaagugucacucucuucagguaggccugccgcaacggccuggcacuccacagccacaaacgagagcuaaguuugacagccucuuuauaaguuuaaauguccacggacucuggcacuggcagcucucuacugccuguacuugaagugcugggucugacucccacuuugggguggaugaguacguguaaacuuaggacucaggaggggagggcaaguagaucgaaaguucauggauguauagcagauucaaggccagccugggcuacgagagaccugucucaaaagaaagggaaaacaaacaaacaaacaaacaauaauaaugaagcccuugguguggaccccagacccgagagaugccuuguccuuuucuguaacacaugggcagugccagguuaucuaguuaggcuuuucacuuuaccguaaaggcaguggagacucaugaaggaugcuucucuuccagacaggcaccaugucccuuccaugaccaccuuuccacccgaagaaguacccaaggcaacccagcuuccccacaaaagcagaccguuggucagacagagaacuguguuuacugauaaagugucugucccaaagugaguauuuucagcuguaagaaaaauaaaaguauuguuugucguagccacaugaaguuacuguaaugaggcaucauggacuagaucagcgaaacggcuggaguuuguuuuggaggcuggaaguucagaaucaggguguucagaggucaaguucuauagucagagcuaauaucucauguguguguauauauauauauauauauauagggaacaagcucuggucuccuccucuuuuaaaggcaguggcuucguuacuuuucaguugcugugacaaagcacuauggccaaaguaacuuauaaagaaagugucugauuugggacucauggguccagagagagucagaggccaucccagagggcaauguggcagcaggaaggcagguaggcguggcacuggagcagccaaugagaguuugcuuauaucccaguccacaagcagaaggccgagaaagcuaacugagaagggguaggucauugaaaacucaaagccugucuccagggacacaccuccugcucuucccuguuuaccaacuggggacuaagcagucaagcauuugcacuuuggggggccauuuucauucaagcaaccacagguagcaacgccaucauggggaggcaacccugugacuccauuugguccaagaguccuggcccuggauaucaucacacugcaagucagugaguggcuacaggccuugagugugcagugaugaaucccguugccucauaguuguugaucgaugaccaaagauagucuguguuuuuccauagacauuugcaguaacuguaucacucacuugucuaccucccucuuguucauuuuauuuuuuuauuuuagacuuaagaaaaauaccaaagaaagucauuuucucagaagguuuccauccaccaagugaguacugguagaggugccagggcugggugggauggauguaaaguuuucacgugcugcucucguggugaaguaggggcccccugugguuaaggaaagccacggugaccauucgucaugguuguucuuuguaacucccucagucaccaccuucacucaguagcuuuuccacaugauggcauccauuaacaaacaggagcaccccgaggcguuugggugcagccucucccagcauacuuucuucauaagcacauuuaagucguguagauggcguuuuggugucagcuggaucugacauucugguucccguaagggccgaugaggaucuaugcugacuccuguugaggucucuucaaugcuaagaaucucuguucacucaucagcugauaucuaccuggugccuguuuugagcccaauuuaagaaacaauucugugaugugugacaaugcuuucuuuuuuacaaauuuggggagaagguggcguugguuuguuuuuuagacauggucuuacuauguggcucuggcugaccuagaacgcucuuuaacuaugcuggcuuuaaagccacagagaugcuccugccucugccuccuguguaccagaguaaaagguguuggaugccaucccuggcuuagggucacuuuacaaauuaaaugagaacacaucagagggaccugauacucgcaggcauccgguaaauugccgggauguuccgaguaacacucaugguucaaugccaucauugccugaguccagagauagcaacaccaucaaaccccucuucucuggguaccacaaaguagugauaaacaacgguuuaucuuuuuaugaacauaaccuuauggaaagagcuugguuucgugggacauguguggccgaaccaacacgcacaggcagaugugguguacagaauuuagacauucuacaaauguucuucaaauggacacucuaaacuuauauuucgcuuucagauacaggugggugguaguccccaagucagaaguaaugacauuuaaaaauauaaaacaguguagguguagaaaucuuuuucaaucacuaagaaguguuuuccuuuggcauuuacgagcuaagaauauccaggcugugcguguuuguguuuagggguugagauuguacacaucugaguucagggaaaccucaguccauuuaacagcucugcuucgugauuggccgaucuggguaacucccucagucuugcacguggcuuugacuucacugccucauugucuguggguacacgguguucccuuuaguguaguuucuggggacugucugaguuggucuguaauaucuuaaaaggcagccacaccacaucaauauagaagauucucgaaaaacuaaaauuagaauugccauaugacacagcuguuccauuucugggcaaaugcccagaggacucuuaagucccgccacacaaaauguauucaaacauacgcguuucuuucuucacuguguaacauagcuauaaaaauguccauucaccaagauaagugacaaggaaaguguggcacagagacacagcggaguuuuguucaggaaaacuguuagaacuggaaauuacucuuaggcaaaguauuccauaugcagacagacaaauacugagugcugucucucgugggcagauccuggguuuuaauauuuauguauguagauauauguguguguguaggggggugacguaucagucauaaaacuagagaagaggccacagauggggaaaagcgguguuaaggaauguuguggaggggagagauaagaagugggggacaggaugcgugcuacugaaagcagaagggggagggguucugguguagggagggaggggccuaggacugcgagcugagggagaggaagcaaagaaggcaaaaacagaaaacaaaaacaauccccaaacacagccagauguguggucacuaaaagaaccagauuuuuaaaaaggaagaaaaaaagaacaacuggcuagugaguucugacugagggaacagcgcccuuacccccuguuuggcucugacucacacaggacgccucccuucagcucggaagaggagccagaugaagaggaccuccuccaugcuuaccucuccccagacucacuugccaccgcugccacacagccaccuaaaagcagcaugagucacuuuggaaagagcgcugucaaaagugacacggacuggacggagggaagugaaauggaugacucggacuucucuccuaagcugacaggugaacccggacccccagaaacccuucugaaguguauguagcacagugguccccucucucagggacaccaggcgcugggcaucugagcugggauuggcccaaaggcacagcggagacccacccaccuucaaguggaaggggaagaaccaguuagggaugucugaguguauggguuuccgauagcugcuguaacaaaauaccauaagcugagcgaguuaaacagcagaaagauauugugcccauauucuacagacugcauaaacaaacucaggguccuuggaacagaacacuuugccuugugguggcucucgucucugucugucuuccugucuucuuccugcugaguucaugucugugcugguuucuagguuuuguaacaacuguucacauagaucacggaccacccuuuuuuuuuaauucugugagccuguauguguguuuggugcaugcauguauaugugugugcaaguguguauuugcucacauacacaugugcacacauguacaaagggccaaggucaauguuggguaucuuguuuuuugaggcacagucuccuacugagcccagagcucgcugauuuggcuguugagcuccaaggaugcccuuguguccacagggauccccgcccagcuggcuuuuaugugggugacagcgauugaacucaagucuucaugaauguaugcaaggacuuuacugauuaagccaucucccccagcccugugggaccacuaucaacgacuucauuuuaacuuaauuaccucuguacuuccaacuaagaucacauucugagcuaguagggggugagagccucagcguauguuuugagagaacaaacuucaauccauuaaucugggauggccaaaaauggcugcccuaaugcaccgaguuugacaggguaauuugaaagaaagacaagcuuccagugugagauuucugauaaguugccaaggaaguagagccaaucgauagucuuuuuaaauagauuuuuuuaaaauauacuuuuaaaauuacagauuuuuaaacacaacagguuuaauuauauuacgcaaaacuuuuauauacuauguaauuauauaacuuuggagaauauaauggauacauuuaaaaauaacacacgacauuggaaaguaguaauuggaaaauacccauugaguuacaguuucugucacauaguugaaugagaucacccauccgugauuucugaguggaaauuauauagcuucaugccuaggcaauugugauuucuucuuuuaagggaauuauauauacuuacccuuuaauuuuauguguauacguuuguguguguguguguguguguguguguguuuaugcaccauguguauucagaugcuugcagaggucagaagagggcaucagauccccugggacaggagucacaggugguugugugcucugugcugugggugcugggaacuauaccagguuauuuaugugcaggaacugccccagguuaugugcaggaacugccccugguuaucuguaggaacuuccccagguuaucuguaggaacagccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugccccagguuaucugcaggaacugcccuagguuaucugcaggaacugccccagguuaucugcaggaacugccccagguuaucugcaggaucugcaagcucuuuuagucccugaaccuuuucacuccaaccauauuuuccccaaacccaaaauauaccaguuaguccauuugaauaauaaauaguuguguguaaagcugagacuccuuuagagcuuuggggcuggggagagauacaaguguucaaagccuuucuugacgguaucuguugcucuucuaggaaccuccauuacgauacagacugacacuguugagaccauggcuuuaccccaaggaagugggaauaaagcagugccgggaaugaacccugcugacacgguuaucaaaaaggaaucguugcaagaguuaaaggugagacugcuggcuaccgaauggauucguccuuggagggacuaguuagugaaugcauucuguagcaaaguaaaagccacugcgguaaagggagacgcuccgccuucauuuguuucaggauugccuuuucuuuuuucuuuuuuucuuuucacaguucgguucuguagguagacaauuguggagucugucugugcugucugacagcagguguggacugaacaaugugagaucugaaauuugagccccaaagugcuaaacuuuguaaacacuggcguccacuaacaguucccagacuuggagaucuuggauguagcucaguugagccugcaggagcuagagguucaaaucugaagcacacacaagaaaguugccaggguugguggagcggcccacacagcaccagggaggcagacgcaggcagaucucucugcguucccggccagccuggucuacaggaagaguuccaguacagccagggcugcacagagaaacccuaucuugaaaacaaagaaagaaacaaaaaaaccccaaagcaaccacaaagaguuucugaguuuggauaauacuggauuugggauuuucagauuagggauguucauagcccaugaaaugucugcaaauauucccaauccccaaacccuaucuaauuugaaacacguguggcccauguaugucagggaggacuguguagccuacgacaugcugucugugucucacacugcacguggguccacagcuccgucaugcguguaguuugacgccugcagauguuagguguuuuggaacuacaaucuggagccuccacguguugcucaaggauucuucugacaccuggaagaagaugggggcuuuuaaggguugucaccaccugggagucagucauuggagaagaaggauggaggguucugggacauuucuaacccccagagugucuugaguggagcucggcuguugcugcccuggucagcucccguguagacuguguccuccaauucgagucauucuccucaauucuguagaugacccacccucuucuguucauccccgggacgccgagggcccugcugcgcuuccuucuuuaguuacugcuuuguuugugugcuaacacgaaccaagaaaacgacaucggucaagacagcaggucacucuuuggaaagggguugguagaaguguguuucaugguucuucuagucggaggcaggggagucacucucugcagggcuccuuggugaccuaucucacccugacuuucagaguuaccucccccuacaauccuuguggucuaggacuuucuaaauucacaauugauuuuuuuuaaagugauauuuguagcuuucaggauguguuuucaaauccucaucauggcucagagaagcugccucuguuugggcacccuguguccuucccaacucauccucuggcaucagcugcucagccuaaaccaggaggggcgccguuccuuuaggaagcucaccuucuucucugcgucucuuucagugcacagaugcugaugacgaggacugggauauaucguccuuagaggaagagaagucucuggggaguaaaauagagcagagggagccgccuccggccaagcgggaccccagcugcacccaggugcagagggccuggggcccagugaacccucgggaauucaaggaagaagguugguggguuucgcccucacacaucggugggugugguucuuuagugugugugugucccugugggugcccauuucugcacacacacauggcggucacagucaggcuugguauuguuccugagaagccgugcaccuuguguuuagagacauggucucucguuggccugguacucaccaaguaggcuucucaucccugcucucccagugcuggggaggcagugugcucuaacucauggugaaaacgugaguuccguggauccaauccaagucccugcgguugacuggcaagcacuguaccgacugagcucgcucuccggccccaacguguuucagcucuauaagugucugcucucaugacccuuuuaucccgucagacggaagcaugaucagaucacugucacagcaaugacagggucagaguggagcacagagacagaauaaaggcaaaugacacagcguuacaacucagauaugaugcuaguccuuaugguauugggcgcaucuggaaaccgguaacguucuuccucggugcacagaucauuguagcuaugcucuaccaucucacugaacgcccugauguggguuuuuuuuuuccccuuacaaugucuacacauauucucuucacacagacacccccagaaauuauuauuucgggcuuccucgugggugagaacguccuucuuagaauccuccaggaauccuccagggccaagaauacacagcugaggaauuuaauaagguguggucccacccaccacucgcccauuauugucuggaaucucaucaggcaaccugggcuggcagguuguaagaccuaaauaaacaucuguuccuggggcagggccuuucccuucucccaccgugagauuccuggggaaaugaccaguucucugaaguccauuguuucaacagucugauugucagauugaguaacacaagcagcuguuuagaauauauccacaugugcuacaccaccauggccagcuugauagacagacagacaggcaggcaggcaggcacacagauaaucagagugaccuuaguacaugguaaaugugaagacauagaaaaaguccccuccaugguauuccucaucaccuuuagcauguggugagccauucccacucucucaguaagagacucaaaccugacucuugacuugacagcuuggguguuagguacugauguccuacuaagacagagagaguucacuaccacugucccucgcagcucuuguguucacuggaugaauucugugcccuuauuuguaauuuucugccagugccuauagauuccauagucaugucuccugucuucagcaggcccucugugucccacuuuguccccacucuccccuccagagcgucagcucugcaguuaaucucacacugucaccugauaacaugucugcaaaccacugccauuaugaaguuaucucugcuaaggauccauuccaguuaaaaaacaagaugauguuugagauacagugccuuguaaggaacagaaccaagaggcugccucaaagacaggacccugcauuccucagagaacauuccagauucaaacuagaacggaguuuccccacagcaugcuauucccauggcucuuuuuuuaauuaacuucaaauuaaguucuucuacccaggcaaaaccuauguuuaacauuuaccucuagaucuuaaacuagagguuagccuugauguguaguguuuuauguuccuuuccugcacagucuauuugcccacaguuaauaacacaauacagaugugcugagaacccucaacauccaggcucucugcuggacuccagugggagagaagcagggcacaggacacaggccuugccauccaggagcuugugugcuucaggacggguggucacaggucacguccugugaggagaugcagaaauguggccgacucgugggcguguuuucuaucagccuucucccaaagccuguaggggcuugggggacaaagcuugaaaaagauucagacccuaggugagaaacagcugaaguugggauuaaaaauguccuaauuuaacuucagauccccccucuucuuccucuuccccauccaggacuucaugaaaacgaaccgagcacacucaagagcaacuuagucacugugacugacuggagcgauguccuggaugucuaagcacggccucgcacaucggaagccugugccgaggccgccagcaucagugcagucaacagccuauaggacucuaaugcucuuaguguuuccaaccauagcaaggaagccgguucugaacaagggugucucuuaugacacguaacacagugccgagaacaaacugucagcuguccacuguguaaaaacaacguauccuuuaagucauaaaaacucuuuucuucaguacagaacucucuaguguuaaauguauuuuuuuucgacuaacuuuuaagucuuuuuuuuuuuuugacugauagcaggcuucaguuugaauuacuauagcucuuuaaaauauauauguacugucccauugguaguucuuauguuaaaacaauccugucgucucuucaaacugaauuagcgaacucaaugaucccaugaaugguaacaguuagcuaggcccaugguaaauacauuuccuuaaaagucccuuugaucccacugagcucugaggcccugucagcaugccguuacuaacgaguucuuuucugcaguguaaccuucaucuuggauguuuuaugaauaaugugcagcuguuguaacugccaauugauuccugugagauggucacuagaaaaagaugagccguuauuaagucacccacaugucauuuuccuguguucaguccccagcccauaguauaaaauaccucagaacuaauuuauauucuugaauaaugaucuuggcaaugaucagaaaguuuauauaggaauuguuuggguuuuuuuuuucuuuuuaaacuuuuuuccuuuuuuaaaaaaauauuuuuuauacuuuguagaacuauuaggacuaucuccaaaaacaaaaaaggaaccuauuaauggcuuguugauuuggggucuccugucauucaccuacuguaccaguaaaguccuccaucacacacugcgacuguggcugcuuauuaagaaaaccgcuuggcuagcuuuauaagagggcaaagcccuggcaucuaacaaacccugaccuugaaauguaucucugugacuauuguggcuaccaucuagaaaccuaugugugcccauuccaaaccaugaaaaaaaaaauucucccaccucccugcggggagcuguugugugcaaauaggcucacuuuauguguaagcuuaucuaaaagcuuuaggaaucgagagucaggccaugaguugugggcagagaucaacagccuucccaucucucacaucaacagguuuuuauugucacuacggguuuggguagaaaucaagaguuguguuccagacucugugucuaccacagguccccacccccacccccagcccccaggacagguaaggaccuggccaaacccaacauuuaaauucaguugguguuuguaggucacaaagcccaguccuuuaacuuauccguguuuaggguuuccccuucuuguccucauucaguuguuuuauuccuuuuccuugacagagcuuaggcggccccucccugaccaccaugccuucacaccccacucucucuacauucucagucuagcugcugucuucaccagcucaucugaagaaaaaaaucauuuuaaacgugugccuacacagcacuguucccacgcuggucugcgguuccuaaccugucuuuauggaagcaaaauauaugacacuggaaaauguuuuaauugguuuuuuuuguuuguucguuuguuuuuuuuuuuuuuacuuuuuuaaaaaaaaguuuccuuuccuuuccuuuccguugaaucccugcaaacaguguccucuauuuccuuuucagucuuuuacccucugggaaagucauguagucagccaugugacucguugugggcgauuuauagcauaugacagaaguaccaguucuuacaacuugaaaccauguauuuuacccuagaccagcucacgcccugguucugacacuacagggcucccuacucuacguuucuucacugcacacgcaggaaaauguaagcaccaacgguuaaggggguguguaagggugaaugugcucugaccuauaagcugugugcuagugagaacaauuacugccuuuguggguaagugacaugcagggcuggccucaggaauucaccuguaucuuuguuccaaaaccaccugaucaaguuccaugccuugaaaaauggccagugucucagugaccuagugaguguugggugcagacccgugggacacaggaaaugagagagccaggcccacacaggccccagagcuuccuuagcuggcuuuagauucagccgccaccaguggccagcucagcuaguggucacaugcucucgcucagacaagcccgugugguuuaugguccacacacagggcaaaggcaccuuggccucaccagcccuuucuuuggccaucaugacaaaugacagcccugacggacagaaccaagaaacuagaaaucaacgacauggcacauugguugugugauuguuugacuuggauacuggaugaggggucugagauuaucgcuguccccuucacacgacaccauccaucgucugcacacuuguguuugaucuguggguggaacgagggaagcucucagcacauuaaggauccaguggcuaccauucccugagccuuaugaacuaaggguacccaugucuucuauguguauaaaauauacacacccuguaaauaaccuguuuauuucccuuacagaaaggcacagcagaaaaugauuaguauauaacuauaagaacauuuacauccaauuaacagucuucaaauuuauauuuuuaaaaaacagcuuaagcaguaauuacaggagagccuuggaaggacuauugugaggacaguucucuugcacaacaaaacucaggaggcagcuugccagagcucuuuagacauaggcauuuuuaucaaacuguuuugaagggccugugguuuuaaaaucuccuucuccgccuugauacuugguccgagaagacauggcagacguggguccguuguauguguagcccauucugaaagguaaagcacacugggguugagucuguucuacaugcagagcaaaggagaaauggauagaaccauugacaguagcccagaguuaacucuuccucuggucagcucucgucccucuucugccugcacgaugaagggacgcaggauguucucguguguucuaauauuccuucucagaacuauuuuuuaaagaucauuuuuuuuccuggcacucagaaggcauuguggaggcuuaaacaauuccugccucugugagauuucagugaggccaacuugaagaccacacuuuuccacuugggcuugaccucccagucauagaaccagcauuagaacacagccaugggaaucuuuaaacaauagcaacuguaucccuacccuucuucaauuguuacuuuuaauucuaagcgucccacgaauugucccauacguaacgauugagaauagugcauuuuuaacagggcaguuuuguuucucguuccuaccugggugucuuguuguugucggauauugaaaagcaaaauaugacucccccaaugaugcagagagaagcuccugcccauccgaugaagagagcagccccuaauucauaccugugagagaacgacaggagugucacagccagcccgccugcuagcuaagguucccacccacccuuccccacucuaagcuuacaaaggacacaguaacauguuccaggcacuaggaugcuucccgcucuuacugaaacuuucuggccgcuccaacuuccugaccggaagccagggugaugaggccagguaaggucuaagccugggccuccugacccaucagcauguauccucugccuucugccuuuacuuuugcaaacucuccauuccuuucuuguguuccacuggccaaauuauuuagacauacuguaguaaggaaaaggaagccugccuccauguuuguuccaguucaauaacuaucaagagcuugcugagugugaguacgugaaggugcaaggagccuauguggagaggcuuagggaaagaugggagcagcaucucugcagccuaguggggaugcucaucuagaaguaaccagcgaccaagcuucuagguggcagggcacgaagcaaauguagacaugacccagacagcccuucucgagauaagaagcccagcaucuaaagucacaaagaugaggucacuuguagacagaagaaaucccuucagguaaggaacagccacauacaacgugucuacacacacggacacacauguacacacacauacacacacacacacca

SEQ ID NO: 7644 - RNA, 4981 nt, Mus musculus
ggaccugugguagacacagagucuggaacacaacucuugauuucuacccaaacccguagugacaauaaaaaccuguugaugugagagaugggaaggcuguugaucucugcccacaacucauggccugacucucgauuccuaaagcuuuuagauaagcuuacacauaaagugagccuauuugcacacaacagcuccccgcagggaggugggagaauuuuuuuuuucaugguuuggaaugggcacacauagguuucuagaugguagccacaauagucacagagauacauuucaaggucaggguuuguuagaugccagggcuuugcccucuuauaaagcuagccaagcgguuuucuuaauaagcagccacagucgcagugugugauggaggacuuuacugguacaguaggugaaugacaggagaccccaaaucaacaagccauuaauagguuccuuuuuuguuuuuggagauaguccuaauaguucuacaaaguauaaaaaauauuuuuuuaaaaaaggaaaaaaguuuaaaaagaaaaaaaaaacccaaacaauuccuauauaaacuuucugaucauugccaagaucauuauucaagaauauaaauuaguucugagguauuuuauacuaugggcuggggacugaacacaggaaaaugacaugugggugacuuaauaacggcucaucuuuuucuagugaccaucucacaggaaucaauuggcaguuacaacagcugcacauuauucauaaaacauccaagaugaagguuacacugcagaaaagaacucguuaguaacggcaugcugacagggccucagagcucagugggaucaaagggacuuuuaaggaaauguauuuaccaugggccuagcuaacuguuaccauucaugggaucauugaguucgcuaauucaguuugaagagacgacaggauuguuuuaacauaagaacuaccaaugggacaguacauauauauuuuaaagagcuauaguaauucaaacugaagccugcuaucagucaaaaaaaaaaaaagacuuaaaaguuagucgaaaaaaaauacauuuaacacuagagaguucuguacugaagaaaagaguuuuuaugacuuaaaggauacguuguuuuuacacaguggacagcugacaguuuguucucggcacuguguuacgugucauaagagacacccuuguucagaaccggcuuccuugcuaugguuggaaacacuaagagcauuagaguccuauaggcuguugacugcacugaugcuggcggccucggcacaggcuuccgaugugcgaggccgugcuuagacauccaggacaucgcuccagucagucacagugacuaaguugcucuugagugugcucgguucguuuucaugaaguccuggauggggaagaggaagaagaggggggaucugaaguuaaauuaggacauuuuuaaucccaacuucagcuguuucucaccuagggucugaaucuuuuucaagcuuugucccccaagccccuacaggcuuugggagaaggcugauagaaaacacgcccacgagucggccacauuucugcaucuccucacaggacgugaccugugaccacccguccugaagcacacaagcuccuggauggcaaggccuguguccugugcccugcuucucucccacuggaguccagcagagagccuggauguugaggguucucagcacaucuguauuguguuauuaacugugggcaaauagacugugcaggaaaggaacauaaaacacuacacaucaaggcuaaccucuaguuuaagaucuagagguaaauguuaaacauagguuuugccuggguagaagaacuuaauuugaaguuaauuaaaaaaagagccaugggaauagcaugcuguggggaaacuccguucuaguuugaaucuggaauguucucugaggaaugcaggguccugucuuugaggcagccucuugguucuguuccuuacaaggcacuguaucucaaacaucaucuuguuuuuuaacuggaauggauccuuagcagagauaacuucauaauggcagugguuugcagacauguuaucaggugacagugugagauuaacugcagagcugacgcucuggaggggagaguggggacaaagugggacacagagggccugcugaagacaggagacaugacuauggaaucuauaggcacuggcagaaaauuacaaauaagggcacagaauucauccagugaacacaagagcugcgagggacagugguagugaacucucucugucuuaguaggacaucaguaccuaacacccaagcugucaagucaagagucagguuugagucucuuacugagagagugggaauggcucaccacaugcuaaaggugaugaggaauaccauggaggggacuuuuucuaugucuucacauuuaccauguacuaaggucacucugauuaucugugugccugccugccugccugucugucugucuaucaagcuggccauggugguguagcacauguggauauauucuaaacagcugcuuguguuacucaaucugacaaucagacuguugaaacaauggacuucagagaacuggucauuuccccaggaaucucacggugggagaagggaaaggcccugccccaggaacagauguuuauuuaggucuuacaaccugccagcccagguugccugaugagauuccagacaauaaugggcgaguggugggugggaccacaccuuauuaaauuccucagcuguguauucuuggcccuggaggauuccuggaggauucuaagaaggacguucucacccacgaggaagcccgaaauaauaauuucugggggugucugugugaagagaauauguguagacauuguaaggggaaaaaaaaaacccacaucagggcguucagugagaugguagagcauagcuacaaugaucugugcaccgaggaagaacguuaccgguuuccagaugcgcccaauaccauaaggacuagcaucauaucugaguuguaacgcugugucauuugccuuuauucugucucugugcuccacucugacccugucauugcugugacagugaucugaucaugcuuccgucugacgggauaaaagggucaugagagcagacacuuauagagcugaaacacguuggggccggagagcgagcucagucgguacagugcuugccagucaaccgcagggacuuggauuggauccacggaacucacguuuucaccaugaguuagagcacacugccuccccagcacugggagagcagggaugagaagccuacuuggugaguaccaggccaacgagagaccaugucucuaaacacaaggugcacggcuucucaggaacaauaccaagccugacugugaccgccaugugugugugcagaaaugggcacccacagggacacacacacacuaaagaaccacacccaccgaugugugagggcgaaacccaccaaccuucuuccuugaauucccgaggguucacugggccccaggcccucugcaccugggugcagcuggggucccgcuuggccggaggcggcucccucugcucuauuuuacuccccagagacuucucuuccucuaaggacgauauaucccaguccucgucaucagcaucugugcacugaaagagacgcagagaagaaggugagcuuccuaaaggaacggcgccccuccugguuuaggcugagcagcugaugccagaggaugaguugggaaggacacagggugcccaaacagaggcagcuucucugagccaugaugaggauuugaaaacacauccugaaagcuacaaauaucacuuuaaaaaaaaucaauugugaauuuagaaaguccuagaccacaaggauuguagggggagguaacucugaaagucagggugagauaggucaccaaggagcccugcagagagugacuccccugccuccgacuagaagaaccaugaaacacacuucuaccaaccccuuuccaaagagugaccugcugucuugaccgaugucguuuucuugguucguguuagcacacaaacaaagcaguaacuaaagaaggaagcgcagcagggcccucggcgucccggggaugaacagaagagggugggucaucuacagaauugaggagaaugacucgaauuggaggacacagucuacacgggagcugaccagggcagcaacagccgagcuccacucaagacacucuggggguuagaaaugucccagaacccuccauccuucuucuccaaugacugacucccagguggugacaacccuuaaaagcccccaucuucuuccaggugucagaagaauccuugagcaacacguggaggcuccagauuguaguuccaaaacaccuaacaucugcaggcgucaaacuacacgcaugacggagcuguggacccacgugcagugugagacacagacagcaugucguaggcuacacaguccucccugacauacaugggccacacguguuucaaauuagauaggguuuggggauugggaauauuugcagacauuucaugggcuaugaacaucccuaaucugaaaaucccaaauccaguauuauccaaacucagaaacucuuugugguugcuuugggguuuuuuuguuucuuucuuuguuuucaagauaggguuucucugugcagcccuggcuguacuggaacucuuccuguagaccaggcuggccgggaacgcagagagaucugccugcgucugccucccuggugcugugugggccgcuccaccaacccuggcaacuuucuugugugugcuucagauuugaaccucuagcuccugcaggcucaacugagcuacauccaagaucuccaagucugggaacuguuaguggacgccaguguuuacaaaguuuagcacuuuggggcucaaauuucagaucucacauuguucaguccacaccugcugucagacagcacagacagacuccacaauugucuaccuacagaaccgaacuguga

SEQ ID NO: 7645 - RNA, 43775 nt, Mus musculus
cuaccgcuguuuuccgccgccgggcgccagccgccgcugaggcccgagcgcugaccgagcgagcgagcgaguggacggggcgcuucgcugcgggcuguuggccgcgcgggcugcugggccgcgcaccuuccugcucuucggcucaggcgcccuuggacaugguggcccccggcucggugggcagccggcugggcgcgguguucccguuccugcugguccugguggaccugcaguacgaaggugagucccgcccugcucccggggcgggcuucgggucccggucccggcugggagcggcgcuccggggcgcgaggcuggguccgagcccgguuccgguuccgugggcugagaggcgggacuggcgggccgcgcgcgcgaggccgguuucggcggccugggccagcgcagccgggaguccggcguccgggggacccuggaucgggggugccgggaggaggcgaaacggcggcaugcacgggacgggucccgguuccggaguggcgggccagggcccuuuccgaagccagucccauucccucacgaccccgcgucgggcgcgcaacuuaggcuggugccuggagaagcccaccucugggcucggagcucccggcgccuaacuugcugggcuggcuguggcuucacaguucccagcaaggcgacauucaacuuuguccccccacugacguuacuuuuucuagucaucgcaaaaaaaaaaaaaaaaaaaagucucuuaaaaaaaaaaauagggagcgcuuacguuucacccugggcuccagacuggaauguuggcuacucccaacagaauagcaaaaaauagaggccuguccuaucuugggugucagagcggggaggaguuagacauugaagccccaaaugcccacugaacuucccaacuugguuacggugcuguagugacaucuguccugggcacugcucuguacucauuccuguaagucuggggauaguugucauggaaagaguaaacaguugaauauuccauuuggagggacugaggaacugaaauugggaacaguuuaugaugaaaccaucauagaagucuaugcggguuucuuucuuucuuuuuuuuaaagacauaugcuuagguuuuuaaccauuaaagguaugguuuuuguugguuuuggcuuccugaucaccauacguucuuugaaccccaaaucagaauguguacuguggcaauauugagaccaauaauuugauguuggagccagccucaaaagugaggggauuggaauuugaaggccuggaccacuuuaguaugggucauauguucuaacuuucuuucauuuucuaauucuuuccaucugcauugauugugcccaguuaucauuagugacuuauuuuaguaacuuaagggaaaguugucuaugcucuacuuagugucgauuuaacuuacucuccagacaugggagugcuuauuuuuguuugccuuaccucauccaggagcuuguagaucaagcaccuuauucgaguuucuguucuuugcaggauuaggacuuuuagcauuucaucucucuacugugguauuucuauaagaaaacuccgaguuuucccgucaggaaagcaccaguggccucucugaggagaaagccaguguugcuuuuccaggaguauuaccugugcagaauggcaggugauggagaaggaaagagcauuucuguaagccagcucuuauuccacagagauaugugauagucucuguguuacacaucugggagcugguguuccaagagcuuaaugaaaauuuaucuugggacuggagaaaugguuaguguguuuguuggccuugcagaagacuggaguugcauuccuaguaccagaucaggaugcagugaguuaguuguaauuacucacaacucagucuucugguuccacaagcacccaaagaggggugugugugugggugggggguggggagagagggagagaggugggguaugagagaaugagagaacacaugcacacacaugagcccuuguguguguguacacagaguaaagaaaaucuuuaaaaauaaaauuuaccucuguaugaaggugggaacaggaaauuguacauagcauucacuucaagcauuuuaaagucggacggccgagcaaaaucagccuuuuaaguuagcaauagaaagugacagggggggugguuuccuggcaggcucaguguaguggucuucccaggugugcuggcucauaccugugauuucagcaaucaagaagcuaaggcaggaggauuaucaucaauuaaagaguguuaggccacucugagcuacuguuuacuuugucuaaaaacaaacccaaaaccaaaagaaaacccaagaccaaacaacccuccccuaaacaaaacagaacaaaaaccaaaaauccucaaauaccaaaaccugcuuuuccucccaaaacagugguucuccagcuugauuguauaccagaaucucacauagaauacuuguaagaguugggcacacuuacagaacgucugauuuaguaggucuugauggaaagugaaauuuucauuucugagaggaucccagaugaccacauuuugagaaucacugguguaauaaaguaucuguaggaauugaauuagagguuaugcuguuuguuagaauuggugaugagguuauuaagauacagaguagcaaauuguuagcuucuguuuucuuaaauggcuuaguuauaucuggguccauuagccucugucuugaggaggcaugcaggucaggugcugccacacugcacuuaaggcugcagagagaagacauaagggagaguucugugagaacaggaaacgugaaacacaguuucguacuguagagauggaguggcacaccucaguggccugcuuuuuuccugauuuaaacugggcuuuucuguuguaauccacaggagggaagcauauaucauuggcugacucuucaaauuuccuuucugagagguuuugaaagaaagcuagagcaggagaaauagaauuuuugaguagaaagaaaauuguagggacuggagguggcccuguuaagaggcugccagcaucgcacaagcagcuccagggagccgaggugccggggugccuucucucucacacuagagagacacacgugagauccaagcagaggaagacaucuuagcacucucacauuacaaauaagauuauuucauuuuauugcuaguggcuuggugaguugaguaugaauacagacaaaaaacauuuuguugucuuaguuuucuuuuucucuugaccuauaucacauuuccuguucucauagaacuuucccuuaugucuucucucuccagccauaagugcaguguggcaccaccugaccugcauguguccucaaaacuaaggucaaugaacccaguuauaacuaaccaccaccccacccccagggucacacugugcagccuugucugcccuggaacucacuguguagaccaggcuggccucuaacucugccucugcugggauuaaaggugugugccaccuugguagacugggaaccaguuuuuaaaauuuuuuuauuuuuuuauuuuuauuuuuuuaauaguauguauuuuaauagcaaacuuacaggaacagcacagaagacagacaacauuaaaagcccuuauuugcaugaggacaucucagaaaaggauagugagugguggaaucuacugggugcuaacaaugcuacagacacuguuuauugccaccaacaaggaauuuaauuaauuuuuuaaaaaauccaaaugcuggcauuguccagaaaauguuaacauguuuauuuauaauugcuaugaaguugaaauguguucacuggaacaguuugcuugcauuaaugcuuuccaucuugcauuuauauuaaaaauucacacacaaauaaacauggaaaaacgccaauacccgaugcuguccccuauguuuccacucgcaaucauauacuuagguaccuuugaccccauugggguugggguggggaacuacugacaacaacaacaagaagaaaaacaauuucuugagaaugaaauguuuccccucauagugacucuuaagcauguucuccgcguguguggcgggcuagcuggauaucuuuuggcauaauugcugcauguuugguguggauagcacaguuugguccuuucagaagggccaaccagcuaggccucacuugccuccugcaaaucaccaguagucgcacgcuggaagcgcaggucuguuuugaaguccugagcacuuucucgcaccagacgcuaacaggggagccugugagucagaagcucaguggccuucugagagcgucugcugugccaccguaccaggccuguaacgcuguaccaugagguuucuucaccccucuaguagagggugcacucuguggcgaggcuuuuguagccaguuguuuccucagugcuuuagcaccgguggaucugcaggccuuguguguuuugucugcuuuacuggagccacccacgguuuggacaccuccuuccccuguacuguggcuggccagagcucagcaagcaagaggcagcgcuguuagagagcugugugcaucggacaccaggaagccaguuuuuaauucacugaauaaauauaugauuaaaccauauauuuuggccaucaugggaaaagauuugaaagucuuugcaaacaaaagguuguaauagauuuuauuuaaaccgauaaauuaacaguauauuugaccuuuuguaugauuucuuugguauuaguuaaauaugaagagaaaaauuuaaaugcaugauuuuaauaguuuauauaaucagauggucagauaacuuccuaaaauuauuuugaacuguuucgcaagguagauuauaagguuagcagcagugucagcguuuagcucaucccaccagcuggcguuggcugagaggaugcaugggauugcaguugccuccauucuguggggcagacuugcucuaagaugagaugcccuggagcaaguagguuuuauuuucccaugugaaguuuuuuguuuguuuguuuguuuuuguuuuguuuuguuuguuuuugagacaggguuucucuguguaggccuggcuguccuggaacucacucuguagaccaggcuggccacgaacucagaaauucaccugcuucugccucccaaaugcugggauuaaaggcuggcaccaccaaacccggccucccaugugaaguuaauggugauucaguucaguuucuauugucaugaucuuuuaacuauuuggggugugugugugugugugugugugugugugugugugugguguugagacagggucucacucuuuagcccaggcuagucuggauggacucuggaauuugauaugcauaucaggauuggcucaggcuuguggugguccucuccccuccgccuucugaguauuggcauuacaggcuugccccacuacaccugcuuucuuuggauuuauuaaugaacaguuuaacuuuguuuacauagaaauucccuggaacccaaucaccugcccuucauaacucaauucuuuauuuuuucaaucuuagcuuuauuugcuuucuguaucuuuagaaacuagcucuuuuaacauugcuaaauaugaugagcuaguugcuuggagucuuggaauauaagaaaagacucaugugucagcuaagguuaagcuauauggugcuguggugagguauacaaaauaaauauguugaggcuagagagaaggcuuagagguuaagagcacugacugcuuuuccaaagguccugaguucaauucccagcaaccacaugguggcucacaaccaucuguaaugggaucugacgcccucuucuggugugucagaagacagcuacaguguauccauauaaauaaaauaaagucuuaaaaaaauaacuguguuaccuuagaguugacaaaacagggaccauaagacaggcuuuggggaaccauccuuaccuuuuaucuguuuucuucaagcuuagggggccaucacgacaaccauguuauuacaaacacauucuuauguuuuucugcucuuguauucuuuggcuuuccuuacccagcagauccccaagcccaguaaauuuaaguuuguuuuauguaccuaaaggauaaacacagauggagaaaaccagccugauuguuagucuccuuuuaagccccugagccucaaucucaacugcacacucaguguugcuuguacucuaauucuucagucugccuguucuugaaaaaucagugacuuuaaaccuugcccugaaauauccaaguccagcuuaaguuuaauucccuuucucuuacucccucaccucccccccccaaccccccacacacacacacaggauuucauuguguugccuuggcuguccuggagcucuguagaccaggcugccucucugacuccggagugcugggauuaaaguuguggguuaccaccaacuggcuuuauucauucuuaacaacaacaacaacaacaacaacaacaacaacugaguuggaggagguugagggcagggcagaguugggcuguguguuagcacaguguguggaggccggaugaaaacuugcaggagcugggucucuugcuccaucaugugguaugggguccagggauuaaguucaaguccaccaggcuugguggcaaagugccuuuagucacagagccagccugaaggcuggccuccacuuaagucauucuaagauggugucuuuguugaggaggagaacaacaucuuuuuucuuuuuuuccacaacacaauucuggcucuuaucuccaucucugcccacauuccucaccagucugaggaguuuuagcuggauuaguaguuuggauuuugagaaguccuaggucacuuaacuugguuuggucuuuaaaaauaaaagucguucaggcugguuaugaacuugcauuguuucccaggcagguuucaugcucagcauccugucuuagcuuggccucugguggguuggaggcaugugaaaaggaagggcuuucuucagacaaguuguuucucucuuuugccaucacuucuccccuccagcauugcaacaugcccuuugcaucuaccgagucuccaacauucaucauuugccccugaagcuacugaguuguauuuugguucuccugguaauacacuuuuauuuauuuauuuauuuuaaagauucuauuuauuuuauguguguggguauuuugccuacauauaugucuguacaacaugugugugccuuguuuucuucugucgcaauccucagagaauaacacuauuaguuagucuaucuuuuuuccuacucuuccucuuuacacuguugaccccugauugacaggagaaaccugcucagucagggcucauucggaaauuacuugauacuugauugucuuaucucuuggaaaauagugcucacacaacguguagcaauguaauaaaaauuguggcucagaauagaguauagauguuguaagacggccaacaaucuauaaggaaccuuuuuuagacauuagugucuugauggaucauuuaggaucaguuauuaguaauuggacuugguaauuauauguguuauagacuuaauuugaagacauauucaaguaggaaggcaaauauucauuuaauuuaauaaauauugagugcucaccauauguaauacacugaacuaugugauguucauagaggaauaguuucugcucucugacuugcuuuucauuaaugcugggcuaaggguggaucagaguuguaagagacaggcuaacugugaagagcaguguguugagaagcaguguguccugcaaagcaagugugcauuugugaguaugggaaugcauaguacagggggagcuagaggacuccugcucuugccaggcgggugcagaggugcacaguggaggcagcgcuguacaggaccuguuugguuuugguugcuuguuucuucguacccugugguuuugaagauagaaccuaggaccuuuuuccccuaagcuaagcuacaucccuagucccgggacagaaucuugaggagugggaauuuucgaggugggcaguugggaagggcugcuccauggaacagugaugugaacgcaggaggcaggaggacauacaguacguucugugaaguacaaccaauccgcuuugcuguaagagcagaaagcauguaguggaggaaggaugacgguaaugacccgggaccagcaucagggaacaugggccucaaguguguucucugccuuuaaacuuggaggguugucgugaugacccaguaauaugaaaacaaaaggauuguucuggaugcagcauggaguaagggcuugggagaagguaagacuggaguugggaaccucuggagaguaaaagggcucuccagcucucccagccuguagacggcugcauguucuaguacagaaacaguggcugaaguguaccaaaggaauuacaguuuucucugcauaguuauuggggagucaugagaauuugcauagacagaguacuaaguuacauaaccaaauagaaauuugauugaauaaaauuauaaauauagaucaaagguuuacucugaagggauggggaaaugagaaaugucuccuucagaugagauuagauuuguucagagugguauggucauaaacuaaguguuucuuuccguuguagaaaacaaaagaaauguaaagaguauccaauauuuaggggcaauguguaguauaaugugacauagcaguugaaaagaacauuacaaaugcauucuuggcucccacuggacuuaagaaugaaccuacagugcugaaauacugcuacaugagaagacucuuacauguguggaaaauagacgugggcuuuggaaauggauuguuuggcagucauugugaaucuauggccagaacugucaauuauuugagccucaguuauuucaguaauaagaguaugaaagauguuuacauccuggaguugggaaaauuaaauuagcuaaacacgcagaaguaccuagugcaugguagguuuauuuaaacacagaaguaucuaaugcaugguagguuuauuuaaacacagaaguaccuaguccaugcuagguuuauuugcacacagaaguaccuaguccaugcuaggcuuuuaguucuuuuuguuuguuuguuuguuuguuuguuuguuuuucaagacaggguuucucuguguagcccuggcuguccuggaacucauuuuguagaccaggcuggccucaaacucagaaaucugucugccucugccucgagaguguugggauuaaaggugugcgccaccaugccccgcuaggcuuuuaguucuuauguuacuuguuuccuucuuggucauuguuauggauggaucaggaaaucaucuuccuguuuuuggagacagguucuuacuguauagccuaagcuggcuuugaacucaugaaagccccuugauucagccaaucaagugcugggauuacaagugugcagcacugggccuggcuuccuuuuccuagugguuuaucucauacuuuuacuuccucacuugagaaauugagaacuuugauuuguuucuaucuccgagagaauauaacagggaaauguuugaaaucuucaugcaaagguugcuguaaaugacacgugccccagcuuguccucaguguucacaucuggguucuggugugggcccugaggcagagguagucuuuggcucagucagggcuuucaccaugauugacccugggucauuuucuagucuaaucuacuacaguuuuguacacuccacucucuugcauuagugauguacauucuuuuuuauuuuagguaggaaguauaaauguuuuuggguauaauuuauauuagaaauuaccuuuaaaagaucaaaauuuagagguaagaacuaggguaggggauaguuuagugguguaguugccuaguguguauaagguuugagugugaugccuaggacuauacaacaaagacaaacuauauuaccaacauguccuguugguaauauauuaugacauaauauaacaauucuauuauacuuuuuucuauuauacuuucaaccuauaguucaauaauguuucaugacuuuuaagcaauuaaaaucuauuuuuaguuguaucuguuugaguacgguuguauaugugccauggugcccucugauggucagagaacaacuugugggagccaaacuucagucacuacaguuagugacaagugccuuuucucuaaguaagccaucucaucaaauauuuauaauaguaauaauuuguaaacaaaacauucuuuaguuuacuucgcuaauuuaaaaauauaaauaguauauuaacauacuuuugcuguaaaaaagugaucaguacagcagaugcauuaucuuuugaaagcauaaauaaaaucuguauaauggauccagcaugcugucuuuaguuuacaucaccacaguacucucuauucauaucugacuccagucugucuuucacauugcagucaaaguaaucuuuuaaaaauacaaauuagacuuucacuuucuuguaaaacccauucuaggggcuuccuuuaucacuuacauaaaaaucuaaauuuugcucccuagcuugcaguuugaucuguuuguccauguucuuuguccuucccuccuugcugucuguagcuuuaucuaguuuccuggaaguugaguuuuucccuaagaggcgaggcucguugcagugguuugguugcuuggaugugauuuuggcguguguccuucagcguuacucuccacuccuguuacuguuguuuuagcguagacauucugcccuugggagcugccuuugaguacuguauuaaugacuccuuuccucgggcauuuugucaccuagcaucagauuggcacuuacuaaauuaucuuguuuauuucuuguauccauugcauccuugcugcuagagcugaguuuaaauagcuguugagaccuuuugaaucuguguauauacauuuuaaacaacuaaaaaaaaauacaugugguacuaguuuuguuuucuuucuaaguguuaagcuauguaagaauuggcuuuauagaugccuguauguuucagaaguauggaguaccagucagucugaggacugauuuuguaaaggugauuuuucuggcugugguacuuuauauuuguuuuagcacaguuugaagcacucaguacuuggaguccauccauggcacaauucagagagugugguugaauguuguuucucagaguccacuaagcuaaacuucccugggucugccagugugucacuccuuacucaucuguguacaugagaugucggccuaguugccauaugccaccucuccacuguaagccccagguuugcuucccuucagaaagucuuccuuaguuucugaucugugucaucucauacacuauaguuagauguaucauacucagauuuucuuucacuguuuuuauuagauauuuucuucauuuacauuucaaaugcuauuccaaaaguccccuaugcccucccccgcccugcuccccuacccaccccucccacuucuuggcccuggccuuccccuguacuggagcauauaaaguuugcaagaccaaggggcccuggccgacaaggccaucuucugcuacauaugcaccagcucuggggguacugauuaguucauauuguuguuccaccuauaggguugcagaccccuucagcucuuggguacuuucucuagcuccuacauugggggccccuguguuccauccuauagaugacugugagcauccacuucuguauuugccaggcacugguaaagccucacacgagacagcuauaucaggguccuuucagcaaaaucuugcugucauaugcaauagugucugcguuggguggcugauuauaggauggaccuccaggugggacagucucuggaugguccauccuuucaucuuaguuccaaacuuugucucugcaacuccuuccacggauauuuuauucccuauucuagggaggaaugaaguauccacgcguuggucuuccuucuugauuuucuuguguuuuggaaguuguaucuuggguauucuagguuucugagcuaauauucacuuaucagugaguacauaucaagugacuucuuuugugauuggguuaccucacucaggaugauauccuccagauacauccauuugcccaagaauuucauaaauucauucuuuuuaauagcugaguaguacuccauuguguaaauguaccacauuuucuguaucgauuccucuguugagggacaucuggguucuuuccagcuucuggcuguuauaaauaaggcugcuaugaacauaguggaacauguguccuucuuaccgguugggauaucuucuggguaugugcccaggagagguauugcuggaucuaccgguaguacuauguccaguuuucacacacagauuccuugucgaguuaagaaauauuguuauugaauuuacagaaguagcuauguugccauuaaaucagaugacucauuguacuuuuggaguuuaugaaggucagauagggagcauaaagaugaauguuccaauucuguuuacauaaauauguaauaucagauugcuuguaugcuguaaaaaacuagaagagaagaaaaaagugcuuuauaguuuuuaaacgguagagugagcuuccuuagacaaagaaggggaagcggcuucagguaaaagguugagaaggaacuggauccaaacaugcccccacuauagaugcuaguauccgguacucacugaugccccaguguucacaggcgaacuuggugagacugcaguuugaauucugcaaucuucacacuuugauggcugauuuuagcuagcccagcuuugugacugcuaagguggggguggggugauuauucuagaguuguuauggaaacccacaggauggcuuaguugggacauucuucucuaaguacuugagugcauagaaaagagucaucccuuaucgcagcccuuguuucaucauuucugccauuauggucaaauguaggagaugucaauguguugugacagucagccaaagugguagucuaaccaguguugaccagaguggucuacagggcaugggaggacaggaaacaaucagcaggcgcagauuacagugccagucagcuaaugugcauggauguguggacgaugcugugaguugugaaguuagaucuuugagugugcauuguccuuguugggaggugguucagggcugaggcugcccgauugcugaggggcuggggcagagaaccaggaagucuccuuccugcaguucucucuagcuccuuuuacugacaaacacaacauuguccucacaguaaaggaggaaugccugaacacucuagugaauaauggcagugcaacccuugaaaaagggauucugaguaaagagaguuuauagauaauuggccuacuuagucagauucuucuauuuaaaguaucugauaggcuccauuuucaccaagaguaagauccaaagcagggcauacagggcuuuguguuugauuucauauuguucguuuuguggcucuucuguagguauccagaucuccucgccaucucugggcagcauggacuuaaggccuuugccuuagcugggccuugugggaaaguuccuucuccugucugcaugucggacuucuuacuuucuccaugucagcuucccaaggaaggcugccuuggacauuccgucuaugaguggccucucccuguugacccuucacgucauuuguucuauuccagagucauuuuaccugauauucuguauagcuuacuguucauugugucugucucccacuguaaugucugcuacuggggggacucaagggggaggacucacucaucccagaacugugccugcuaucuuguggaugcucaguaaguaacugaaugucauagcggacuguccgcuauccauucguuaaggugagagguucuagcauagcaaagcaguuuuuguuagaauguaauaugugucugaguucauauuugugcaugagcguguaugcaggugcacaugcauguguggcauguguauauguguauauguguacucgugugucugucuauucaugugcguguggaagcaagccagagguuaauguuagguguuauccuuaacccugcuuuagauuuuauuuucugaggcugguucucacagaguggagagccuucucucugguuuguuaccagccagcuugccggaggcuccuguuucuuccaugcccuccugguguuuuugugguagcugggauccacucugguccucaggcuugcauaauaccugggccaucagccagcuuuaacaaagugguacugacugauuauccagaauagcuucaccaauacuguagucuauuucucuuuuauucuguguacugguuuuauucuuucauuggcugaguugaauauagguauauuuugggagauuuuuacuugcuauaaaaugaaacagcuucguccaauauggcggcacccaguggcagugugaacugugaagaguucgccuaguuccaggaauuacucaaggugaugaggacaauugauugcagaauaguacaugaauuaaacacuacgguuccaacagcuuccuuugcagggaaaaucgaugccagccaaaccuguaaacagcuguaugagucuuuguuggcagcucaugucaguagggacagaguuauaaagaacuguauugcccagaccucagcaguaguaaaaagucuccgagaagagagaaaagaaccuggaugacuuaauguuauuaaagcgacuuagaaaagaacagacaaaguugaaaugaaugcagucagaacuaaaugucgaaguggucaaugacagaagcuggaagguguuuaaugaacgcugaguucacuucaagccuccaaagaaugaguagagagaguuuuuuuaaaagccccggucaucucauugccugggcaugacagaugucggcagggccagguuccgaggguggucucugagcgagcaggcugaggccuuugguugguucagccccauucagccaagaccucaagucuaauucucauaauuauaaaauaaucaauugcuacuuuauacugauucuguaaaaaauguuuuguaacuauuaaaauaauuuucugaaaaacaaaacaaaacaaaaaaaccccaaaaaagugaaacagcuucuaugacuuuuauuggguuucaucuugguucauggaaaguuaacuuauuauccuguuacucaacuuauuauccuguuacucuucaggcgcugaguguggaguaaaugcggauguggagaagcaucuugaauuggggaagaaauuacucgcagccggacagcuagccgacgccuuaucacaguuucacgcugcaguugguugguauccuaacccugaucacucgguugcucucuuaugaguucuagucagaacuuccauuuuggaacacuucaaccauuauuacuuguuaaauaaaccauuaaacauauuuucaggguucugggugaauuagauuaauaaacagacacucaugaaugcauaugucucuaacagaagagguaaccgaggaugcuggagggaaggcucaguggucaagagcauguacugcucuuccacaggaccuaagguuaagucacagugcccaugacuguuggcuuaaacuaccugucacucgagcugccgaguacuggccuccacugcacacacacauacacagacacacagacacacagacacacacacacacacacacacaaaugcacgcacacaggcacacaccacacacacacacacacacacacauacacaaauguacgcacacaggcacacaccacacauacacauacacauacacacacacacacacacacacacacacacaaauguaugcacaugggcacacaccacacauacacacacauauacacaaauguacgcacacaggcacacaccacacauacacauacacauacacacacacacacacacacacacaaauguaugcacaugggcacacaccacacauacacacacauauacacaaauguacgcacacaggcacacaccacacauacacacacacacacacacacacacacacacacaaauguaugcacaugggcacacaccacacauacacacacacacacacacacaaauguacgcacacaggcacacaccacacauacacacacacacacacacacacacacaaauguaugcacaugggcacacaccacacauacacacacacacacacacacacacacacacaaauguacgcacacaggcacacacgcgcacacacacacacauacacaugcacacagucuuuagaguguaaagacauuuauaaaaacagguaacuguaugaacuaaccgguaccccccagagcugugucucuagcugcauauguagcagaggauggccuaguugcccaucaaagggaggagagaccccuuggucuugugaagaucauaugccccaguauaggggaacgccagagccaggaagcgggaguggguguguuggggagcaggguugggggauagcauuugaaauguaaaugaagaaaauaucuaauaaaaaaaaaaaaacagguaacugaggcuuacucauguuaaacauaacauaacauuaaacauaacuuaagauuuugacaauuugauaaacuguucugcagugggaguaguaacuguagagacucguaauugguuaaauguagaggauaagggacuguugacugcucagcuguaagugggacuccuuuaucuuuaucccuggauuuaccgcaccuguuggagauuucagguguggggaggugucaugaggugcccccgcuuucugagcacugagaggcauuuagugguugccaggagaaggagagacauucuugagugguguugccacuggcuaaggagucuguucuucuguaaaccaucuguuguuagccaauccaggaccuauaacaacccuugagagccucacugggucgcaagacaugaagguggaggagggaggauggggagaugaaggugagugaaugucugcugaauggaaucugcacacagcaucucuguguggcaaaugucaugauaaagcgcauuguguuauagcauaaagcauccagcaagaaccaagacauucuuccgucguucccugccuucuuaggcagauuucacauagcgugcuauacuuugggguuaucaauauagucauuucugugauuuuuauuuuauuuuuuugagauuugaaauuuuucuaguucauugauucuucaguauuagucagauucuaguugucccuuaugguguuucucuugggugacuuuucuuucuuucuguaacaucagcuauuaugacuucuaaagaaaagaggugagucuuugcuagccuggaacuuacuaagucacccaaauugaccugcaacucacagagcucuccugccucugcaugcuggcauuaaacacggucgguaucaugcccagcuggcguuaaacauggucuguaucaugcccgguugggaagcuuucccuguaugacuuacgggaucacuguuaaacuaggucuuucgauaggacuuugcucagagucgucuuuuauuuacuucuuuuccccuugguuuguggugguaaaggcugguuauucaguuaauucccaccaaguacaguucccagaagaaucagccacuccuguucacuuuaaagacagaaaugcagguaggcuuuaguuuggcauuauuuuucuuugcaaauucuuuuauuuacugucaucugucugucugucuaccugccugucauccauccauccauccauccauccauccauccauccauccaucuaucugugugggugagugugugccugucucagugagaguguggguagaugagggacagcuugugggaguugguucucccuccacuguguggcucaggcuaucaaccuuggcauugggucuuuuuuuuuacugagccuucuuguaggccccaucucaugcuuuucuuaaacucugauuuuuauugauaucuuuagaguaacaguagacacacauuuucaccuuguccucuuuugguagcacuguggcauuaccuguccagguuuguaagguaaugaggauaaggaacccuugggucugaaauccuuucccugguagcucuuacaggguguccuagguguguggcguggaugacugagcaaguggucaccuguguauuuguauggcacuggguauugaacgcaaggccugugugcuaggcaaguucuugcuuuaacccugaccuaccccaucaucccuaagguuguaaauuaaugaagggcugucugaaauguuagauuuccucauuuuucugcaaagaaaaccaguauuacacauccuagauuuuuuuguccaguacacaauaaaacagcaaacaaauuuugacauguaauugacuaugucauggaaagcucaucacaugggagccucccugugaaaugagggcacagacacugcuguucagauaugacagggacaaggaguccagugucuuuccaaagggaauaaucaagguuaaagacugcaaacuucuuuuuaaacuuuuuaaaugugcuuauguauguguacuaugcauauacugucuguggaggccagaaaaggguguuggaauaccuggagcuggacucagaggcauuugugagucaucugaaccaaacuugguccucugaagagccacuugugcgcguaacuacugagccggcucuguagcccugugaaccucuuggguacgguuuuguucucccuucuauugcuucucagugaaugagugaaugaaugaagacuuugaccuaguuugagcuggcuggagcaagaauaaagauuuacauauccacgagaaggggucagucuuagugcuccccacugccagaguuuacagcguuggcugagcaugguggugcaugccgguaauuccagcuugggaggcagagcuaggaggaucucugugaguucuaggaccacacagagagacugucucaaacacaauacaauuuauaaauaacauugauuauaauuuaccuucuuuagguuuuucuucaaaaaugauggucuuuguuagggccaagucacccauacuugaauuguuugaugcucuaaggaagaacuucaaucucguucucuuguucaguuuucuuuuuucucuucucuucucuucucuucucuucucuucucuucucuucucuucucuucucuucucuucucuucucuucucuucucucuucuuucuuucuuucuuucuuuucuuuucuuuucuuuucuuuucuuucuuuuuuuaaaauuuuuuuucuccuuacacugcccccucuuuuccccgcccugccccgcgccccagagcuuuguucaguuuucuaauuauuuuguauuauugugcugucucccuaccgccaaacucagucugauacaagcuagaaucuucucagagaggggaaucuguugagaaacuucccgccaggcuggacugugggcaagcuuguaagguauuucuugauugaugugugauguaggaggggccaacucaguguggguggugccaccccggccuggugguccuggauguuauaagagugcaggcuguggcacaugccuuuaaucucagcacuugggaggcagaggcagguggauuucagaguucaaggccagccuggucuacagagugaguuccaggacagccagggauacacagagaaacccugucuugggaaaaacaaagagugcaggcugagcaagccaucaggaacaagucagcaagcagcagcccugcauggccucugcugcaguuccuccaggucccugccuugacuuccauuagugauugauugugaccugagaguuguaaacggaaaugaucucuuucuuccccucugccucccaagugcugggauuagaguggugugcuuccaucgcucgucugccauucuuaguaaacuuguaaacuguaauuuucucaggcuuugucaaaagcagcuaauauuuauucuuuuauuuuucagauggugaccccgauaacuauaucgcauacuauaggagagcuaccgucuucuuagccaugggaaaauccaaagcagcgcugcccgaccucaccaaagugauugcgcugaagauggacuuuacugccgugaguucuaaguucaccaagcuugcucagggggagcuuaaggggacuggcagggguaaccugguuccugaagugaguauuggcaccuggggcauuacuggaggauuucagauccagaccugucacuuguucgucagugucacauggcuauacauagccagcugggagaaucccuggagcuugagaacuguagccagauggugucucaguagcggcagcaaguaauagcaaaacucaaagugcuguuggcauuagcagucuguauggauacugcuuguguuggcacaggggacagaggcaugcacaucucuuccuaguccucccagugagcuaguuucaggacagucagggcuaugcagagagaccugucccaacaaaacaaaacaggucugaacggaacaguaacaauaugcuagucaggguucucuagagucacagaauuuauggaaugucucuguguauugagggaaaugauuggaauggcuuacagucugcaguccuacugacccagcaguggguagcugggaaugggaaguccaggaauccggcaguugcucggucucacgagguugggcauuucaaguuagaauccugaagaaguaggcuccaacagaugugcuggcuaguaagagcaagcaggcgaagaagagcgagucuuccuucuuccaauguccuuauguaggccuccagcagaaggugugacccauauuaaaggcguguaccacuacgccuggauuuggaacuuggucugucccaagaugaccuugaauucagaucuacuugccucugucuccugggauuaaagguguguacuaccuugccuaggccuaaauuuuucauggccauuaugcccaagaucugaaucaaaagcauaugucaucccaaaucaagauccaggucaaaagccugugccuuccagccucaugauccggaucacagaugugcccuccauuucucgguugaagcauuccagguguaucaaguugacaaccaggaguagccgacacacagggcauacuaggugauucuucucagaagucuggcaguauuaacuuugugguuuagaaagacaaguccaugugaaggaaggaauguggacaugauguggagagacuuaagaggcugaguaggauuucagccaacugaccacaguuucauuuaagaaugaguuaggaagaauuaaacagaguuacccauuuuaggggaggggggcuuggugggucccaggcauuguuagcgugguucuuccuggcaucacuguacaagcuucagaggcucagaaucuuacagucucauauccugagggcuggcaaguccugugagggcugucacacguuguauggggacuccguuggugcugcauuaauuaguucugucaaugugacagcacagcuaacauaaacaacuuaugagagagauucauuuuaacucacagauucagagcuuucaguauucaguacacaguucuuggcuccaugacuguggacccauggugacacugggcacuguggcagugggaguuuagggaagaggaacuugcugacuuuauggcuagcaggaagcagagaauaaccguaguccaggauaggauacggcucccaaggauaacucucugugcccugcuuccuucagccaggcccugacuccuaagguuuuuaccacuucccaaaguggcaucaccaacugaggaucacauaacaacacauaugggccaggcaaauuggccuaaaaauuaacuuugugaccauuauuuauaauuugccacguuccuagaaggaaggauccaagcugacuaauagccauguaaugcauguuugauuugaaauguggcugcaauauuauuuuaaaauagaauucccaacuaucauauuuuguugacuuuauuacuugauacagcuuaguauaaccuuuuacaaagguuaaauaacccauuuucuuagcauuaugauuagucauugacuagcugaaauggccguaaugguauuuauguguguugguguauuugauagaggguuagggaaauuuuauguucuaugaaagugauacauaaacuuacauggcaaucuaugguuucuguucuuuguuuuagaagaaauuagucauccgagaguaggcauauguugaagggcugggguaauguguauuagaagagaaggauuaucagaagugaaggggaagagacacugucauccuggcaauaauaaauacuuacauugaagauugaaggcuuagugaacagcagaccuauuucuggagcuuugauagucucacggcaacuuucuguggaaaacauuuaguaugaugucaaaaaguaucuuuuaaaauuaagauagagggucuggaauauaucuugaagguagaacccuuguaucuucuuuauggguccuuguguuugacacccagcuuaauuauaaaaaguuauauaauugauguaccauuaguuucacacuuugaggaguuggugacucucaggauguuuuuaggcuguacguugucauugcugucaucuaguuccaggacauuauuuucacucugaaaagagaucuuaugucucacacagacaaacaaaagagcucccaaaacagagccuuuguguugagcaaaauguuuuuaaagaaaacacacuucaauaagaauuaugcauauucuguaguuauagaaaugugccucaguaauaaggcaaacaaacauuggaaaaagaaauauuagucacuugauuauauuauuuauucuuuauuuuaaaaagauuuagaaauccacagcacucagcacagccgcucuuuuuccucccaggcaagacuacagagaggucaccuacugcucaaacaagggaagcuugacgaagcagaagacgauuucaagaaagugguaagugccuggcuccaagaagauacuagugagagagacacacagaauugacuuuuugcugggagccagccuugacagucagguacugaaaggggacacagcauuggacaaaggucaaaggcuggugacuucuggccuuguaacucucucuuacuguuuuggggcccagaaacugauaggugcuggcaauuuaacucucacuauccuggggucaaacgcugauggcuuuuggcaauuucacagagaaaguaagucaggugcacgcacacgcucucgcucgcucucucucucucucucucucucucucucucucucucucacucugcacaggccugaccaccagugucaucaguuucacaaaugcacaugcauacuuauaugcauaguuauauacauacacuuaucuacauacauguagacaaacauacauauauacauacuguacagacagacauauauauacacguuugguggauggagcagagccccaccagccacacuuuauuucuuuucucagccuccuuauagcuucuuagacaaaaguucuuuauaaaauuaccucauagauaaaauguuacacgaaagggaauuacagaaggguguagauaguaaguucagagcagugcuucauucuauaagcucaguauuaguucacagcaacaguugcacauggccuugcuuuaucauggugcacaccuguggccccaaccuuggaccugaccuagaaugaauguuuuucuuugauuacagauuuguauguguaagccuguuucucuucuuagugcaguucaugaaagcccauuguauuccuucuuaugcagccuuuauuuacuauucuacgaggagguacauucuauucuugagucuaauuuuauuacaucucucugauaaaacaacuaaaaacauuucuuuaagcugucuuccuaaaauuauuugaaucaaaucaggaauucuguaaagucauuaauucaucuaaauagcauuagaauaugacaauucaucuucguguugaucuguagggaauuuucccaguaggggugggcugauguccaggaaaccuuaggcuaagugauagaggcaggaaaggcacagcagcagcaggaagcaauccugggacaaacucugugggucugggccucuccacagugcacccaucacagccuugcaacacagugggccaucuccagaaaacucaccugcuugcuauagccuuuccuacauggcuucucucaauuuuuuucuuuguaaauaagguauuuaaauaguaauuuuauagcuaaaaaacccuuauguauauaggaaucauaguuccuaaauuacuauuuaaugacuggcaucaaagcaucauuuuaacaguugaaagauacuaugcccgcaguugauauaugugauaacucaguccuuacaggcucacucacuuuaacguagccuccauggccaucuaguaacguuggccagaacaugaugcauagccucaagucgaggaggcuucugggacaauuugcacuugugauucucacucaguagcuuguuacagcauccgggguauguggguauaaaacaggcacagaaacaaacauuuacugacggugaaugaggggacuuacuuucaaacaacucuucgggguccguaauaauuuuaccauuuauucacaagaaagacagacuguacaguaaugagauaugugcugguuuguuuuaaagaaugaaauauugcgacugagaagaugguucacauauauauaagugcuugcugcccaaguaugaggaccuagugccccuguaacaggcugugugauugacauugugcaccuagaaucucagugcuggggagugagaaaggcucucagagccuggugaccagccaccuacuuuacauguaaucucuagcuccauccaauuauuuucuguaaauaacauggcuucguucuuuaugacugaguaaguucaugguguaugcauaccguuuauuuugaaucuguuucucugugaugggcaucagugcugacucugagucuuggccuuugugaauacugucacagaagacaugggcaugcaggugccucuguaugucacagaagacaugggcaugcaggugccucuguaugucacagaagacaugggcaugcaggugccucuguaugucacagaagacaugggcaugcaggugccucugcaugucacagaagacaugggcaugcaggugccucuguaugucacagaagacaugggcaugcaggugccucugcaugucacagaagacauggguaugcaggugccucuguaugucacagaagacaugggcaugcaggugccucugcaugucacagaagacauggguaugcaggugccucugcaugucacagaagacauggguaugcaggugccucuguaugucacagaagacaugggcaugcaggugccucuguaugucacagaagacaugggcaugcaggugccucuguaugucacagaagacaugggcaugcaggugccucugcaugucacagaagacauggguaugcaggugccucuguaugucacagaagacaugggcaugcaggugccucuguaugucacagaagacaugggcaugcaggugccucuguaugucacagaagacaugggcaugcaggugccucuguaugucacagaagacaugggcaugcaggugccucuguaugucacagaagacauggguaugcaggugccucuguaugucacagaagacaugggcaugcaggugccucuguaugucacagaagacaugggcaugcaggugccucugcaugucacagaagacaugggcaugcaggugccucuguaugucacagaagacauggguaugcaggugccucuguaugucacagaagacauggguaugcaggugccucuguaugucacagacgacaugggcaugcaggugccucuguaugucacagaagacaugggcaugcaggugccucugcaugucacagaagacaugggcaugcaggugccucugcaugucacagaagacaugggcaugcaggugccucugcaugucacagaagacaugggcaugcaggugccucuguaugucacagaagacauggguaugcaggugccucuguaugucacagaagacauggguaugcaggugccucuguaugucacagaagacaugggcaugcaggugccucuguaugucacagaagacaugggcaugcaggugccucugcaugucacagaagacaugggcaugcaggugccucugcaugucacagaagacaugggcaugcaggugccucuguaugucacagaagacaugggcaugcaggugccucuguaugucacagaagacaugggcaugcaggugccucugcaugucacagaagacaugggcaugcaggugccucuguaugucacagaagacaugggcaugcaggugccucuguaugucacagaagacauggguaugcaggugccucuguaugucacagaagacaugggcaugcaggugccucuguaugucacagaagacaugggcaugcaggugccucugcaugucacagaagacauggguaugcaggugccucuguaugucacagaagacaugggcaugcaggugccucugcaugucacagaagacauggguaugcaggugccucugcaugucacagaagacauggguaugcaggugccucuguauguugauuuauugucuuucagauauacucagguaguauacugcugcucagauguaggucuacuuuuuagccuuuggaagaccucaauacuguuuuccacagugucuauacuaauuugcauucuuaccaacaauguauaagaaaaaccugaauuuugauugugguaaaaauuagauauuugguaaauagcugucaauugcaauuuaauuuuaaagucaaguauaaaucuuugguaaguucuuaauaaacccuccauuaauagcagaauauauauagguaauagccaucacaaucagucccuugucaauuugacacgcaauuauaucuccuuauguccaaaugaaaacacuaacauuguauaaccaucccuuguucaacugcaaacacauaagcaguaaguuuagcugggugggaucuugccccaaggucaccacuccauuaaucuguacaucuccuggaacaagggacuuagcuucuacaugggacuuuacuuacuauucuauuucguggugcgccuuuaauucgauacauuuuauguuuuuccuuucuaagcuugcugcacuugaucaaacacucuccauaagagugaaucacaagguagaguguaugcuaagcuguuuagagagauuuccuuccucugugcaacucaucuaaauuucuucacuucaucauccgucagacacuugagacagggcagaagcagucucguucuuuacuagaauaucccaggagcagugucuacacuauaaacuaaaauccuccuguggacacuccuaggccaggccacaguccacaucaccuucagcagcaccguccuucacgguccuacuggggauggccuaguaagcccuacuuauaucguuccccugauuuucuaaucacagccccaaagucccuacuccucaaacaaagacauggccaggccuaucacagcaauaccccaauccuugguuggaaggaacuuggagcuacguaaaugauaaugaaugugacauugggggauccccaggcugagcuauucuagauacccaaguuguucuguaucugggcuguuaugaauagugcugcacuggacauuccaugcagauaacucugccaagugaugguuuccuuuccucacuaugcagggagaaggguagcaggucauauagcaguuguguuuucaaaaccuacauacuguuuccccaaauugcugcaccaguuuaccugucugccaguagcuuuccuuuucuauguaugagacaucccacuuccugcuagcugggcucucuuugacuguacagaguacaugggguaacugagaaggaguggccuauuuuggcucauacuuugagaaguuucaguccaugcucauuuggccccuuguucuuaccucuguucugaggcaauccaucauggagggggaagccugucugccucagggucaggaaacaggcuugaagcuugccuccaaugaccuaaaaugucuacaggcccuuuccucuuaagauuuccaguacuucccaacagcaucaagcagaggauuaaugaaaagccccuuuaacagacgggcccuuguguggagggcaugcauggagcacacagauacauaagcauugcagacaacaaaaguguugaucacucaggguccuccuaauggcggauguggguaccugucuuccacccagaagucuggaaguagaugucguuaguuaccugcugaccuuugcuaaguagagccaggccuuacccuaaccacccagaauguuuauuugagacucuuucucccuagacuuuaucauuagcuuuguuucacagccaacacaacccauccuuagggaacugugacauguccuuucuagccugcugcccucugugcccaucgcagucagagaccacaccagauccuaggcucuuaaacuauagaacccauuuuuaugguagaggucacauguacuuugugagaguuucagugcagucaugccuuaagcuuuauuguugauauaggauugggauaauuauuacuaagaaacuuuuuuucugaaaucauacuguauuuaaaugucuaaaauaaacuggcuugguccagccuccggagcuucgaaucagcaccaagucagucaggcugcagucauuuuacuguggccauaguguggccugaggagaucucccccccccccccccaccaccaccacauacacaccacacacaccccuaccuaccuuccuucggggggacauucuaggcccuaagcucugcaguggguucccaauaaguguaagguggcggcgucucugugguuuugaucagucuuucccugaugagaagggauguggaguguguuucuguguaccugcuggcaaguucuuuauguuaaaggccuuagccuguuuuuucccuagcagguauuguuuuugaguucuaugaauuacugauauaaccuuaucuaauaauauuguuuauagcuucucccuaauauuucauuugccuuuuuaccuugugucuauauaaccuaaaaacucagauuauguaaauaaacauagcacucuacuaaauuauaauuuuauuuuuaccucaaauggaucaaauuuagguacuuuaauagcuauaacuaauuuuaguagagaauguucacauuuuaaagugggcugguguguaauucaaggggaaacgaauuauugugguuuuaguuguuauagcguucuguaagaauucugucucugagcuacagcuccccucauugugaauuuauguaucacggagcagucacgaaaguguuaggaguacgaaucagugguagcgugagggccuggguucaggucccagcacugaaagggaacuuguacuugugauagugccugcugauucuuacacgugagaguccuugccaugcccugauacaugucaccuucuuuucauuguuaaggaagugcacagagcauguaggaaagugauuaauucaggauuuggguaacuaacuuguucauugauuuagacuuuauuggaaaguaauccuaaaaggccugccgagaugcucaguggguagcugcaugcuguuaugccugaccaaucccuggagcccacauaugggauuccgcugucugcacucauacugugacauacaacauauauauguaaauaauguuacaggucaacugguuauaaaauacguaggaaaguauucauaacuuugucagugaggaauggcaaaacuucgauccguguuacuccuguguguguucccugcugguguggaaugaaucacccaauaucagcaacccuuccuauugucucaguuugugggcguggucugauuggcucuuccgugcagggcuugugccgugguaucuggaaugguaagaucugugugugugugugugugugugugugugugugugugugugugucauagguauuggauuuguaagauuaacucuuguauuuuguuguuugguugcagcucaaaucuaaccccagugagcaggaggagaaggaagccgagucucagcuuguaaaagcugacgagaugcagcggcugcgcucccaagcgcucgacgccuuugacggugccgauuacacugcugcuauaaccuuccuugauaagauuuuagagguaaguuucucagguccugcagcugaugacgagucuggcacuacuuuuuagaguaaggcucguguuagaaacugacuaccaaaccaagagagggugcagucugaccuuugugcucuuagcucuuaaaaauuggucauauaaauuuggaacuaauguguuuuuuuaguaaauauuaguacuugcuagugagaauuacauuuuguuguuguuuuguuuuuugagacagucuuucuauuucuuuguagcucuaguuaacucaaaacucucuguagcuagaccaggcuggcucgaacucaacagagaucugccugccucugcucuuaggagaguacuaugcuagacaauggguaaaagacccauuacuuaaagaggaaggaaagaugguguuugaaaacaaagaggaauacuuucacagugagaaccuucuaagggagaaggcagagagagagcacuacaacaggaagcaccaaguuuaggauuuccuugccucagaaggauuucacaagaaagccuaaauggaaauaaucagugcaauuaccauuuucacagcucuuuaacuuaauauuggcaguaaacaugugauauauggauucacuugauaauuaaaguuauuugugugugugugugugugugugaugaugaugauguguguguaguuguguguacugugaugcccuugaagaggucaaagauucauucuguggcaucagcuuccuucucccaucuuuaugugggucguggcgguuagacccgccccuaggcuuguaugcaagcaucuucacauacuaaaauaucuugcuggcucuuacuugauaauuuuauagaagaaaucaugugauaggacauagaggaauucuguuuguuuguuuauuuauuuuuggguuuuucaagacagggucucucuguggagcccuggcuguccuagaacucacucuguagaccaggcuggccuugaauuuagaaauccgccugccucugccucccaagugcugggaucaaaggcgugcgccaccacugccccacuuauuuauuuuuuuauguaugugaguauaguguagcagucuuuagacacaccagaagaaggcauuaggucccauuacagaugguugugagccacuauguggcugcugggcacugaacucgggaccucuagaagagcagucagugcucuuaaccacugagccaucucaccagccccuuuuuucuuuuuuuaaaauaaggauuuauuaucaaggaaggaaagauguaacaucuuaaaaauauuuaauguagugaucaaugcauugucagcauuuuucugagacccuaggauggcagcuggggauauagcucaggugguagaguuugcccgcauuugcagugcccacagugggaggcuuggcauugaauuagcuggaucuuggaucauagggcaugggaggccagcaguaugcauggcauccugccucagcaaacaggacaagucaagacuuacaaaaaagaacucaguuuuuauuaauuauauugauucucuucaaauguuugagugggaauaaucuaauagugaaugcuguaggcuuucucucucucccuuccccuccuccucucuucuuccuccucuuccucuuucuuucucucuugagaaagguuucauugugcacuaagcuuggcuggaacucagcaucccaaugcuauguuuucugauagucagagcuguaaacucuguagucugaggaugaaggccuucgaugcaugugcaucuccucucccugcugagaguuuaagacacacucgagagauuaucacacucuaucgucucccguaagugugucaggguucuugacaccauuuauaaaacagugaccagaucacauggacugagggguuuuguguauaugaguguguucaugaauguguagggugcaagagucaauguguauaacuaugugucuuaaagucuaguucuuuuguuucuuaagguuuguguuugggaugcagaacugcgugaacugcgagcagaaugcuucauaaaggaaggagagcccaggaaagccaucagcgacuuaaaggcugcuucaaagcugaagagugacaacacagaggccuuuuacaaaaucagcacacucuacuaccagcuaggagaccaugagcugucucucaggucagcuccuucacauccauagcuagucuuucuaagguuucauaucaugucaauagaaauauuaaagcuuuuaaaaauacuuauauccuauauccacuugaauauccacuuggguuaccccuaggguauuauguauauauaauuuauacauccuacaguuaaucugccugaaauagucuuacuaauaugaggaugcuguuuuacuuacugaagcuaaacuggaguauccaaugcauaagucugugccauuuugauuacugugucuaugagaccaugugucagcauguuuucaucaucccaaagaagaauacuuuaaugaugauuucucugcuucauacagagaacucuucaauaauuaucuuaacuuggaauauuucucuuuuuaaaaauuauaugagcagugaaguucgugaaugucugaaacuugaccaggaucacaagcgguguuuugcacacuauaagcaagugaagaaacuuaacaagcugauugagucagcugaagagcugauccgagauggcagguaagagccuuuccuuaucugccugguuaggacccagaugcacugagcuuagcaacaccaccaggauuguauacacacguugaaaccggcaagaccucaguaacaguaacugcauagcauccuuacuagcagccauaugcuauuucagguuugucgucuucugugcauuaggcacugagagugcagaaaugugacugcacuguuuagucguaaagguuuaugugggaggcauaucgaucaauaccagugcuggcguauagagcugacagcaaagugcuagaguggaacuuuacaggagaagcagaagagcccuuaacccggucuguagccgugagggccuggagucagaaaaucucuggaguaaggugguagauaguuaaauuguccucucacaaggugccagcacugggguguggggcuugaugggcugggccaggacuguuggagagaagacuuugugcacacuacugcuuaguagaagguggccucugauaccccacacuccucugacgccucuguagcugucaggagaaugcuuuacacaauuuccucuagugucuugcaaacuaaugucuuggaucaagauguugauuaauucuaucacuacuaaagucccucuuagguugccuuuuauagccacaacuacuuuccugucccuagcuauccuuagauucuaguaacagugacuauauucuuuguuucuauaguuuugccauuuuaaagagucugaaagaaauggaaacaaaaccaauguaaacguuugagaugagccuguauucuccaaucucugggcauauacccagcuucuuaaauuaauauucccuuucuauguguuggugaauguuaccauggcaucacuauucacuauugucacuuagcauucgcucacuaaagaucacccauugaaugaugcugcuuucuuucacuuguacgucuuagguuggagugacagcucaguggcagggugcgugcgugugcaugugcggucuguuuugugaacauuuucuggggagacgugaacaaguguuugccagugacagagcacuuagcuaguuuggugaaguagcgaguuuccuggaguuagaggagcauggcuggcccugaagcagcucugccgcuggguuccccuaagaauggagaaugaguucccacagagucuccucauuuaacuuugcacugccugugugcccuagccacaugcuuuaaacuguuuuuauuuaguugugaguguaggcaaauacaugcccuggagaauaugucuggggcuuuuuccacccugugaguuuuggauuaaccucaggucgucaucagucuuguugacacguguuguccacugcucccccagccccgugcuuuagagacuccugucuuuccccccagccccaugcuuuagagacucugucucuguauucaacagguuucucuggauuaaggcuagagaauuuauuugaaggcaggucuugugcucuuuccauuuacuaagccacgcagugaaaggagaggguggucugcagcuuuggaaauagucuccuaguuacucacugguugcuuauuucauagauacacagaugcaaccagcaaauaugaaucagucaugaaaacagagcccaguguugcugaguacacagugcgcucgaaggagaggaucugccacugcuucucuaagguaacagcugacgcucccagacagggaacagcagccacauggacuuaaaauucgcaugcuuguucagugcacacacuacugagccaucacucuggcucacaaugcuuguuuuuaaguuuauuuuggcauggaguacuuaacuuaggaacuugugcuugacagacaagcacuaccacugaggcgcaccuccaguccaucuuuucuuuucuuacuuuugcuuuuaggaugagaagcccguggaagccauuaggauauguucugaaguuuuacagauggagcccgacaaugugaaugcucugaaagaccgagccgaggccuacuuaauagaggaaauguacgaugaagguaaccuggagaggacuuugaccugcggugucuaacaguuaaauuguaugacaccagcacaugucaguugcauuuuauuuugaacacauuuaucugcagauggcuaagaauuugaaaaauucguaauuauucugucuuaguggaucauaauagguauagcaucugaaguaagagaaagaauuugauugaaaccaggucaguggaauauggaaauauguaucguaucauaccuaccuaccuaccuaccuaccuacacagugcacauacauaugucuagcaggaugauucugugagcuccuagcucugcaauauuaggguacacugagcuaagaggccuugcuacuagauguuaugaggaccucaaaaauuggcaauccuggagcauacacaguaguugaaagauggaacacauuacauguaacgucuuuuaccacauuucuaacaguacuacaugaacauuuaauuaggguuuuuucuuuucuaauuuuuaaacuauuugaugauuucccauggauuuuaaucagaauuaaucucccauucucuccaacacaccacccuccuuauaucauuuuaacuuuuauuuuuaauaguagauuggccuugcaggaacaugugcaugugaggcagacuugaaucauguauuguuuaccauuuuaaagauuaccucccauaguguggaaucugaggaaauaaaacaaaaauuacauagcuacuguaugcuugugggaaguauuuuagguuauaaucagucccuguuuuuaaucaugugcauacaggaaacaaccaauaauuguacacuuuuuauaguaagacaaauaugcauacuguaacuuaauaaauacgacuuagaagacuuggcggaugggguugguaagguggcucagugggcaguggugccugcugcaagccugcugaccugaauucaguuugggagagaaccacuguagguguucccuggccucccaugugcuguguggggcacuucccccagcccucaauuuuaaaugaaauaacaguuuuuaaauuuaagaaugaaaaugugagcugggcauugguggugcaugccuuuagucccaguucucagaaagcagaagcagguggaucucucugaguucgaguccagccuggucuacagagcaaguucuaggacagccagggcuacacagagaccaugucuuggggggaaaaaaagaauguaaauguguuuuaaguuaaaaaugugucugaauagcaggucuguguaucuuaacccuuugcucucaucccuucagagaguacguguuccaagguuaggguggucagugcuguggauguuagcugugaauuaaaccucacuaguauuugugauaguuuaugaacuaaguuggaagaaauccccuguagcugaaucucaguaauaguauccuaggacgccacaaggguauaaguugggcagccucuaggucagcugcucacaguggcuugucuagugauacuguuggcucauucucagugcuaaguugucauuguaucauuuguucacguuucuucucucacucuuuauacaguuaacuguugccaagauagauaaauguuauccaaagagauuucuuuuucuucacuauuuuuccacaaauaauagaauuuggucucaaaauccuuuaauuuguuuguuuagaauaugugugccaagcuuuccugacuaagcccagucuugguagagcacacugcacauagucuguaguuguacucaggggcuaagaugugcuucauggaggaagaaaagugcaaaggaccaauuaaguucuggaggaaacuuuuaagauucuauaaacugacauaguaaauuuaguucuacaacucggccacaucagagacccagcacccagggcuguuacugaaggccaguuucuagucauugucuagucacaucuagauuucagacucccagggauagugagucuaugagucuaagggaagagucugugaguuuauuggaaauugucuuacuuucuuugcggugcagugcucauuuaagucuuaguggugguaagacuucucuguauaauuucaaacuacuuugaagggggugugggagacgacaugggagggugggcaaguaaagcagccacagcgaguucugucagacaggagcgagaaccccauucucaauuaagaauuaaguuuaaacaaaauuaugaaaaugguacucuuuaggcucuuagaagcagcagugggugagggcugacaaugaggacuucgaucuguguugguagaauacauaacggcacugaauagcaauucucccuaacagcauuauccuaaacaugucuugacagccauucaggauuaugaagcugcucaggagcacaaugaaaaugaccagcagauucgggaaggcuuagagaaagcccagcgguuacugaagcagucacagaaacgagauuauuauaaaaucuugggaguaaaaaggugaguuauuacagcuugcaugcuguauuuaaucaacugcuuuaaaacuaauguagcucuuuuugucuuauccugguucucuuuguuuacucauguuauuucagucuuauuauuucuaacaaacuuuagcaucaugaacugucuucaguauguuacaggcagccuuuuuauaaagaccagcagagcucuaauagagaggagcuggugugaaggaaggcuggggcaccaauaguuccuauccucaacucuugggacaaaagauuaacacaaugacuuacacuuuaguuugguuggagugggaaggaaaaugaagcccuccccugggccuaaaguuauaguuguacuguuauuauaagacccacuuuccaggguggagagagaacuuggugguuaauagcacuuggucuugcagaggacccagguucagcucucaguaccuguaugcaugauaaggcucacaaccaucucuaacuccaguuuuggccuucucuucuggcucucugucauugcauacacaugauggucacacaugcaagcaauauauacauaaaauaaaaauuguuaucuaaaaaaacagacccaaguaggcugucagcuuuuguaguauuaaguaaacuuaaccuaaaguaagggguucaaaauagaguuuauguaugugugugugcgcuuuauucugauugacagggucucacuguauaauccugacuggccugaagucacaaugaagaucuaaauggccuuaaacucagagggacucuugggccucuccucugugugcuucugggauuaaagcuuacacuaccaucucuggugugaaagucuuuuuaaugcccagaaaaaccuaaauccugguaguguggagacuuagaaagagacagcuguaaagaccuguacuguauucuaagaugcuuagugagugucucaggaagccuuggguuuuagcucagugauaguggacuugccuugcauacaauucucaguauuugcccccacccaucccuauggcccaaaaaggaaggaaaaacaaaguugacugucuagaacaguaugcuaaguuuuugaucuuugacuuacaucuuuggaauuucuagaaaaagaaggcuguguacagucaggucucccucccucccucucucccucccucucucccuuccucccugucacacacacagagcuuauaguauuuguuuguugugcugugaugaaccucagguugauauauaugcaaggcaagcucucuaccacugaguucugaaacaggucuaucagcacagcucuuguguguguguguuuuguuuuguuuuguuuuuuaaugaaaagaaauuggacccuuucucuucuacaugaguuugggaauccucagguacaugguguaguaaaaagaauauugaauguggaauacuuuuuucuugacaauuaacuaaauaauuuccuccauccuuuagaaaugccaaaaaacaagaaaucauuaaagcauaccgaaaguuagcacugcaguggcauccagauaauuuccagaaugaagaagaaaagaaaaaagcagagaaaaaguucauugacauagcagcugcuaaagaaguccucucagacccagguaccuuugcucuugaaguggugcagugagugagccucucugccuguucccaucccaggcagggggccaaugauguguggaguggcaugggcgagcuggagggcugugggugcugcugagugcuguggucucaccagccucuuucugccucagugugagaacucucagagaaaugguguaguggaaagaauagugaauauggaauauguuuucuuucuugaucaagcuccucucacuucuuagguuuuuuauuuuugcaaucaugugaaagaacaacacugaacauaacacacaaauuucuuagacuccuguuagcuuucuugguacuaaauuucuaagugucucaggagcuuggugaggaacccaguacgucaagcuggcuuacaaaagaugagaggagccuagaucaucagcagggccuguugugccuccguggacguuagcagcagucuugcuccaagucacgugaacagacauucugguugacaaguaugugaaggagacaggcuaaggauucguccauacugcucuucugugccuuugcuaugcaugggggugggcauucuaauuucagcuagaaagguuuaacaaugaggaaaucaaguuuugccucuugagcaaaucuuuucuguguauccauuuauauacuacagcauugaaaugccuuuugucccuaguuguacucuaguaagcacuuuguuauugaacacaguagguguuggucugcuuuucagaugcaaagggcauugcaaauuguagugcuguguacuuguagagcagagccaggcuccuccuuaggaauuuggagguguuaagggcguccuguccccucccaccaaucuugagagugccucauuguguucuucacgugucuacauuucgggaggaaacagccuuauggaauguuguguuccaccuguuggccagauagcuccaggaagcuccuuaguuaguuuguggaggggacucagugaggcucuugccugauggacuucaucuggguguaagaguugugacgagcugcucggugcccagcaugacuuugggaguugucuuugcaauugcuuucuacaagaugggaaugagaagguauggauuugaguauuaaagccucguacccauaucuuagauuaauaugugggacuuaacuugcuguuuucuuuucuagaaaugagaaagaaguuugaugauggagaagauccucuugaugcagagagucaacaaggaggugguggcaaccccuuccacagaaguuggaacucauggcaaggguuuaaccccuucagcucaggcggaccguucagauuuaaguuccacuucaauuaaaccagcuauuuuacugcuccucuucuuuauuauuauuuuuaacauuaaaaacaaauuuuguuugggauucuaauggaaacaaaauggaacaaaucuuuuaguuuguccaugaccaaagaguuguuuuaaagaaaaaaagcugagcuuauuguagacuuaagguugaugggccugucaaggugggaagcaaggagcuaaccguauuucugacgaagcagccuauacuaauuugugacuucugggagaaguggucugagauacuuauccuguggagguguucagaaaagcguuaaauagacauugauaacccuggagcagacagauucuaugcaggcuguguauuaaccgugaggaggagcugugaucuuugguggauugugucucaguauucuuaaaggaguguggacagcugagcuucauuuuuggaggaacaguuaugcuuagacuuuggucaguccauucacuugcaaguauuucuguaccaguguccucagcucucacugcaggaggggagaccgucuuccaggaaacuuaccagcaggugguaggcuguauguccagguauagacuggaaguauuuuuguuguuguuuuauaucuauaggagaauaccaauuucacuugaauuuaauuguuaaacuaaacagaguaaguuaaaguauaugaaagcggcucugugguucucuagacaacacuguugaaagucaguuugaaaugcuuuuuaagaaagugaaguuccaaguuguuuggucgaaauucccugucacaaaauugguuagaaguggaaaguugcucugucaacaugggcagagcauuaugguugccucucgcaagcagugcgcugaggcagcugucucuguuguuuuccuugcuggguuuuggacuggcuguucccuggcuguuucuucugugagaagaaaguagaggcuugcaaaucgauucaacucuggcuguguaccuucuaucauucacuuaauaagauggcacuuccuccugagacauucccgucccucuuacuuuaaagcagauacuuaagaaauguacuagucaguauuuguauacuguauaauuuuugccuuaaaaaucuguugcuaaacaagaauauugaauacuuauggaacuacugaugcuguguugaaaacuuagaagaauuacucugguaagaauuauugccucuauucuagaaaaaaaaauuuuaaacauugugagauauuuuaagcauaaaggucuaauauauugcuuuuaugaaauuaaacauuuuaguuaauugugggaaggaagcaugaauguagcagccaagcacaaaucauuuuguuaaccuauagucauaucaacuugagcagauauagaaaaagauuuuguuaacugcaagaacaugaauuacauaaguugaguugggcaaaacauuuuaagugcuuuuugccucuacuuaggagccuuuuucuuaccaaaacacuuaacaaugcauuucaaaauaccuuucagcuuucauuuugcuucagugucucacaguucaaggcaggcaagaaaacucacagcuuuuauccuagcuguagagacaggcagaggcagguggauuccuaagaguuugagccagcuugguuuacauagugaguuccgugccagggccuccaccaaaauauuaaaucaguucaagccagugugaaacauugaaugaaaaauaaaagaacauuuuuguguguuuuucagaucuuaguaaucuuauguuaacuacuuaccugacguugucuuucagucugacucacuccuuuugugaugucacugacaguugugaacuggagugacggcaccucugcuuugcacagcccaguguucaccagcagaacaaaggaggcaucucggugcuuacacucccacuuagagcgaugucagcugcccguaguguggguugaaggugggcugcauggacacaggucccagaucuagcuaccuccuaacuugcuucccagaaggguuuucuuuuucucuuuuuuuccccuuccuacuuguaacaacccaaaguaacugaggauuaggcuuugucauugcaaauuuuggugccaaaggcauaugccguggcaggagguuagugagguaacccuccugugcucauuagugagguagggguguccagccugccccaggcgagucacagcgucagaacaguaguuucugcuaccugccugacauugcaaggcaggcacuguggaaccacauuacugaaaaagcauucucugccuuugucuuucccucuguuugcagagccacuuccacauuccaauuucucuguuuaggaacugcagguaaccuguguaguaauucugggaaaaauaugaccaaaggucacuuuggcugaacuccguucuguccauagacguccccuccucuguggugagcuuccuaaguacagugucacugggcuguguccagugcucgucgcucuggaagaaggaaaggcaccugcuguggggccacggggccacuccuuuuauuucucagcucuaaaacuuuacucuuucuuacugugaauagaagaaaaccugaaaaacaucucagugguuuauuaaugugaauuggauguaacgucuuaaguuaaaaauguagugaguguuaaaagucuguuuuuaaauagcaguaugcagauuugucacuggaguucugauaaugaauggaauuaaaauucuuuuuuuuuuaacauaagcaggcaugguggcucaggccuguaaucccagaauguggggcugcaauagcaugucacugugacuuuaggccccauuucaaaaauaccaaacuuaaacacauccccaaaacgagugugagagaggauuacagauaacuaaguaaaaaaugucaguggucaccguuaucuauuccugggucagaagcuggcaugugccaugaaggcggcaagcuguacuagguaacugugacuccgcaggcccugugggugccgaccugccuuacagauacguccuggguaaguggggggccaagaugguuugcuugacuguacuggacuuugcuguaggaggagggagggaaaugguaaucgcuaagagcucaucuuuuccagaucguaucauuucucuucuauuaguggcagaguugauucuguaauuucaaaugauguucaaaggggagguauuuuuuuuuaaacagaugaucucauuugcugaaugauuuaagaguaaaauuuagccacugcguggcuuuguguauaguaacaacagguuuuauugcacuaucuaugguugaaauaccugugcaaagaaaugcagggcacaggggagguaaaaauucaagauguuugauacguuaaauuauuacucuuaaguuuauauuuguuuuaaaugggacacaucuuacuuaauccaucucaauuuaguguuuuaauaaaaaaagaacuaaaauuauuucaacuugggcuuacaugugucaauaugggcaauaugaauaugggcaauauuuuuaugcccguguauuuucacauuuaauaaaaauauuuauggucauauccacuac

SEQ ID NO: 7646 - RNA, 28811 nt, Mus musculus
gcggcggcggcggcggcagcagcggcggcgggagcugggcguggaggcgcgaggggcggggcgggcggcauugcgggcccgcgguucgggcggcuccggcucgaggucgagcucuguugcugcucucgcccucggggcugcaucguccucccgcuuggcccgcucacagggccgcgcacgacucguucagcugcagccccgcugccggcgcccggggcgcugccgcggccgugagccgacgaguccguaagggcggcggggccgcggggucggggcgcggcgcgcgggcgcaggucuaugucgcgggcggcggcggcggcggcggccgcgcagggacgaugcgcgaguacaaagugguggugcugggcucgggcgggguaggcaaauccgcccugaccgugcaguucgugaccggcaccuucauugagaaauacgaccccaccaucgaggacuucuaccgcaaggagaucgagguggacuccucgccuucggugcuggagauccuggacaccgcgggcaccgagcaguucgcguccaugcgggaccuguacaucaagaacggccagggcuucauccuggucuacagcuuggucaaccagcagagcuuccaagacaucaagcccaugcgggaccagaucauccgcgugaagcggugagcagagcggggcacacggggcucgguggcugcggcgaucccgguccuuggcuugcccgggcuacaccaccuccuccaggggcucagauuugugggcuuuguuucacaagugaaauugggcauccuguuaacccucagcccagcccuuugucucuaggacguugguagcgcuucuucgggacccuagaaagaacaaaguuucaaacuugcaaggaaagaagggaugaguaggugggcgcuagggaaaggggagcugucuuaguguaggcacgccugugaagagugagcgcgcgcuuaaaugcacccguaagagguuugacagccgaaauuuguacauacauaucuugugacagugucaauacuaaguuaggggggaccuuucucguugcggaaaagauuaaauguugccaggagguuggcagaaauggauuagugcaaaacuuuaaagacacauuggcaaauaauuugaagaccacacaacauucaguuggcuuggcauauagaagcacacuugugacauuuacgcggagagcgugcagauucaguucucuuucucucuuaaaagcuagccuccucaucccccccccgcaccccccccccgaaaaaaaaaagaacagggaaggaggcuauucuuggaaaacaaacagaaguuuagucugaguucuggcuuguguaucagcuaauuuaaaguuaaugcaaaaaaaaaaaaaaaaagaagaagaagaagaagaagaagaagaagcaaacaagcuuuuuccugauauaaaguguucaaaggauguauuuuugcauguggcuggugaccugaaugcuuuuaguguuuguucucucuuaaguugaugcuaugcauuuuccccuuaaccuuuuaaauacugaaagucuaacauguuacuacagaguucuggcaucauuuucuaguucuucuuuacugauaacgcuccucucugguccuuauuaacuaauacuacugacagucuuccaggauuauuuuaccuguagcuacauuugaagucaccauugaagguuuagguagaaacaaucacacuuauccaucauuugggguuuauacacuucagagcucagagcaaguuauuuguauucagggaguacuuaaaaauuccuuccaagugguguuuuuuuuuuuuuuuuuuuuuuuuuuuagugguggguuuuuaacccuguacagaggucaaaggaaaugcccucuccucagugccugcuccagccagacuagaaauuucuguauucccgcauuaaauuccaaaucacaaagcaguggcuaugauuaugaucuuuucccaaaguuggugacacugguagccuuaacuucucuaguguuauuuuuuagaaauguguuuccuugugugguacacacguguggguguguuaauacguuugucucgaaguuguuuacagaucaugauguaagugcugcaguugucccaccuucacacccagugcaugcccacacgucugugcuaagauccccaauggcaugggccacaucaugucggaguuucuguuggcuucguguagcucacguuucucaguuauaaugaugggccaguuuauuuacuagagcaguccguuggcaucucaacccaggacaacagacugagauugggauucuauucacccagggucacuaguugcagcucuugauguaagaagagcagugaugagcugaguugaguugagcaacuuccugugggguaaauguugugucauuagagccucucuggacccacuuucuuuuuuucuucuuuucuuuucuuuucuuuuuuuucuuuuuuuuuuuuuuuuuuuuuuuuuuuugagacagguucucuauguuggccuggcuguccuggaacucaccauucauaccaggcugaccucaaauccauagagauucuccugccucugccauggggcacugagauuaaaagguccguguccagcuugggccccuacuucuauguccugguuuuuguaccucacccuaaguucaucauuugccuuccagguccgggugagcuguagguuauucccauuguacagcaguguauaaggcaauacucaaaccugcugugggggcacgcaacuccucucaagagaaagcauggguuuacauuagugcauuuucuacucuuugggggaccaguuccuuaacuacucaguugcuauaggaaguauucaguaauuccaucuucugcccauugugugccagcugucugcuuuacauaugacauacaagagcuuuggggcgguuaguuacagugccauagugcaguuggcauaacugaaaggcuauggcuugauaacucaccaauuacugauaaagagaauuuuuaagaugucugaguccauauagccucuucuacacaggugugucuuucagcugcuaauacauuucuucaaccagcuaacuauaaaguauuaucacuuuaauaugccacacaguauuaaacuuauucagcuccuguacuuuccuaugcuguaucuuccaagucuguuaggacuaaacaugcaaguguuugguugccauauguaccguaguagaguucauagcuuuuagauguuugugguuuagggaaauacuugcuuauuuuauaggccugaguuuccuuuucugugaaagggaagauagcauccccucccagugucaugagggugacaugcugccggguguacaugggugcccauguggucguugaugcgcagaaaagggcgaaaguccuuuuugucacucuucagguuugucccucugaccuccauugguuuuauccgugacauaucauugcagccuuagaggaaauaauucauauuuguaauugugguuuaaaauuccuugccuguuacaaagagugcuauggaagagcaauguaaauuagucuuaggaaaauauuuuguugguuuuguggaguagcuucccuuauggggagaucuuauggggggaaaggcagggaaaugaacauguaacacagcuccacaaauggagcuucucacuguauugauauggucuagaauaucucauuuuaaaaauauuaaaaugggcccuuaucucuuuuugaguuagguguguguacgcacaugcauacuugugugugcauucaugcagaggccaaagguuggcaugucucauucauuugcucugaaccucauuuuguuuuuaaacauuuucauuauuauguuuguguguggaggccauggcacauguauggugauacacauuugaaggucagagggcaacuugacuguccccccuguuuuggguuccgguaggcagacuuauguggcaggcaccucugcccacugauccauugccuuagucacuagucuauuguugugaagagacaucaugacagaggcaacuauaaaagaaagcauuuaacuggggacuugcucacugcuucagacacuuauccauuaucaucauaguggagagaauggugacaggcagggcacuggagaaauaguugacagcuacagccgcaaacaucacaggcagagagaggcagccccgggaccuggcaugggcuuugaaaaacucaaagcccagugacacacuuccuccaacaaggccacaccuccuaauccuucugauccuuucaaacagugccacucccuggugacuaagcauucaaauacaugagccuguuggggcauucuauucaaaccaccacagcucccucuuuuaaaaaaagauguaugaauguuugccuacaaauauagauguguaccacacauauauaccauggaggugagaagaggguaagaggccuccagggaacuguaguuacaguacgaugccguguuggugcugggacugaaacccaguuguucuguaagugcucuuaaccucugaccccuuucaagccugcuuccuuaguuucuaagacagagugucucacugagccuggaccuugaugauuugguggacagcaagcucgggguccucccauuucugccuucucggguacugguuuauagccgugugcugcugaguauuuuauuaggcuugagggcucugaguucagauccugaugcauagauggcaaguauuucuccauuccuguucccccugccucccuuuucccucccucccucccucccucccucccucccucccucccccuuccucccucccccacucccuccacucuucaucucucccuuucuuucacacacacacacacacacacacacacacacacacacacacacacacaauauacauacacuugcauggcacacacacaaacagaagacuucaaagucaagugacaaaucuaaaaaugucuuuuguguaaaucauaugccacuucuuuuccuccuccucucccucccccucuccuuccucccccuccccuccuccucuuccucuucuuccuucuccucuuccuccucuuccuuuucuuccuccuccccuuuuuuuucuucuuuuugcuugacuuuagaucacacagaaaaagaauaauaagcacuuagauuuuaacagaacaagaauucguacugauugcauuauuuuaccuucuuaccugucucaggauuaguggugguccugacuugaaguaucuuggaaccuaccacuguucuaggucuguaucuuaggauaaggcucauagacucugagcaugaccuuuaagugcacaugcucaggucccccacuggccgugcagaugcaccuccccaccagcauccccgcuuucuuuuaguuaaaaaccucucucucugacuucuccugccuugguaccuguugucuuuuuguagaauuaguuuuuacccauuucuucacccuggcuugaaauauuucuucuugaaugaauuccucuaacuaaccucacaccuggccccccucaaccacacaacagccuggaggcuggcacccuguuccucucguccuguuguaguguaguugcacauguuuugcugggaugguuugcaagcauucucacugacucaaugcccagguggcuggccugagaccaacagcgcacaggaaacaacaacaauacagcaagagaggaaucuucagagaggaaagcacuuggacucaguuuccccaggcauuuuaguguuucgaguugauuuugcagauggaggagaugcuuucugcaagagugcuuccagucaggccagcaaggaagaggucagaggucaggcgaacaguaaagucagagaggauguccucuggcuggaggaaauggcauggggagugcacaggguagauucuggguguuaaagaaaccaggacaacuaaacuagagacuuacauagaccugggggagggggcugagggcagguaacugauuuuaaaacuuaaagacagaagguuaguuagaccaauuauagaaauaacaacagagaugagaugguagaugguguaauggugaugggagacucagcagucuugagcagugcgacuuagugucuguaugauaucuaaagccugggcuagcaugcugacuagagaaagacagggguaagguuguccagaauucagucaucaagcagugggagagggaaaggucaaaggugcucuucacaucugaagaugggugagugagauuagagcagagucacagaaaaugccauuucagcccagaugacaaucguuggaauagcccugucugauaauuagaauauuugaaaaggccuugaaggucagguuccauaugaauguccgaacucggcaucaccugcagagcccagauugagacuagccgacaccugcuguguagagcacaagugaguagauguggcugggaauaggaauuagaaucaaaugcuuauagucaaggacagagcuggagucacagggcaaacaaugaaggccgcacacagugugcucagcuacaagccacuaagacuggggcaggcuucaagucuucuuagaaaccaacacugaaucccaagcaaggcuccccagguaaagagccuaaugguugugagucacuuuuuaaaaugaaugacugugucgugaaaaguuggugacuaaauccugucaaucaaacauugaagaguuaaacguaggaaaagauuaaugggaaauguugaucugcuuaaacagaaaacucaagaucaagaacuguaaggagugugguuaaggaucugguggcacaggcggguaggauuugcugaaggaggcagagacaggaggaucuggaguucgaggccagccugggauacacauuuuuccagggcuauacagagaaacccugucucgaaaaaaaaacaaaaacaaaacaaaacaaaaaagccgggugugguagcgcacgccuuuaaucccagcacucgggaggcagaggcaugggaauuuuugaguucgaggccagccuggucuacagagugaguuccaggacaaccagggcuauacagagaaacccugucucggagaaaaaaaaaaagggggacauuagcauuaaacaccucagcaauaugaaagaacucagcugcuacauacagaaaugaggagagggcauugaguuccauagccuucacuggaggaacucggaguuacaaauguaacacacuuuaaaacacuucucagacagcuugcucuuugaaagcucauugauuuuuuuugucuggcguuccccacacacugguagaccaucaucacagucaucacauugcccggcccaagcuguccaucucccccuucauucucuugagucauuaguuucugcgugcucggaauacuuaaggugugucuucuugguaggucuuuaagugccugacacuugcuguauucccucugcaggacucagaacauugcauagcaaacguuaguuuaagauggguuuugcucucuguguuccagaggugguuucuugguugguugcuuuucucuuucuucucgaggaggaaacuuguguuuuuuguucuuuuuucugaauuguaaaauuauaacauaauaucacuauuaugaugcaauaguuuucuuggcucuccuaggauuggacucuucaaacuuaauuaacauuaaggaagaucagaggaacugguaaaaaauauuugaaaauaacccaaccagcaggagaacuggcaguguggcagacuuacuugcuaacauuuguuaguggugauaacacguggaugacuuaauggccaugggagccucuaggagguuacauaaggcacauuaaagcgaaggauaguucacauuuaugcauauuucuaagcaaggacuguuggacaaaccaaaugcacauuauacuugaucuuugagaugguggugguggugguggugaugaugcacagcuuuucuguagucagcauagaucucguacccuagggaggaaagugugaguccacucuaggcuucaccgugcuguugugacuccuguaacugugguucucuagccuuaccuacuucuuucucguguguuuauuguuuuccaggcuaauggcguaaaguuaucaauaauuuuuaaucgguuaggaaaacuaauagaguuugacuguaagaacaccagacuuuacaacaagacuuaaaacuuacagauagggaggaaguccaggcugauacuugcuguacaggccacaguccgucccagcauccccuggaaaagccgggugcacacgcuuacccaccuuccucucccucccaagugcugagauuaaaggugugugccaccaugcccuaccuuuuaauggaauuuauuguaguccacaggaacguauaauauuguacguacauaaaaugcaaacauauguaaaauuuaaagaaaucggaaauaucugagaacagucacuauaaucuuauaaugguacauggugaguccuaaauugcuuagcuuuguucuuuuaaaagauggacaucucuuuggaaauggaaggccuaauacgccaacggugucacuuuuauuccaguaacagccugaauguuuaaaguuaauuuuaucaaucaccuauaugcuccuccccuaacccuugccagguguaaccccauucuuacacauucaacuuuguguccuuuaaaaaaacaaacaaucuuuugaaagcacucugugcugcccgaauguucugggaugugugcuuguccacuggagcaugguuaacuuagagggaucugucucucuuccuggcagcuaacagucaccaggagcuccauggccagggugggacugagucaaccuccuugccuguaugugggauuugcucugccuuagguuugcacagguucugugcacguugucccaacuuuugugaguucacaggugcagccacucuacaguguccagaggauaagcacuguuuuguuauagucugccaucaccucugguccuuacacucuuccgccuccccuuucugcagugaucccugagccuugauggggguugggggaugugguggugguggacuauuuauucccuuuaaggcugacaguucugcagucuuauccguagcaccuuggccagccgugggccucugcgcaccaucuucugagaagcccagcuucucagaugagcacuggcaggugcauugaucugugggcacaacacugagccauuaggaguagguuuaaucccauauccguguagcagccagcauagcaucagguucuccugcagggucaaugaccuaccugucucucuguagaaucuuggcucaguaauggugccaggcauggaugggcucuagcuuguggaguggggcuucagugcagucagaaacaucucagcgucugaaauagcauugcagauguggguguggcuugugggcagucacugcugcaacucacaugguucgguucguagcaucaugaaagcuagccaaaaggaaugaagcuuccaggccaugccagcuugaucuuaccauguuguagcucaaggaugugguaucucagcguugggggucuuacagcccaggucuagauuguaaacaagaacaguggcaacaucuuguaauguuuccuggucuacaagacuccacuagcccauaucuaaaugauggagcucacgucuggcccugggccuuuagguugccagccucugguguccagugggcacuguugccccuauaaacaagucuaguuuuuaaugaucuuccauuuaaauaguaggcuauuagugaaagaggauguuuugaaguauaugagugaguuugagugcgguuauggguagguuuuauuaagggcaugguuugggaaauccugucacuuuagcacuggaaauuugaugcggcuaaaauguuggaguuguacccuaacucacagguugcugaagaguguuucugaguucaugguuuaaaguagacugcagcuguuuagcaagcauacuuaaguuguacauucuuguucauaauguugaaauuuucacugaauugcauagguaggcuguggguuuugguuuguauauacgauuuauuauuuuuuuuaggauacauuuaugauuuaaagacauaccaaaugauauuuugaggagaaauacaaugacuuaauaacuuuuauaugccuaagacccugggggguaaugaaaacaccaucuguuugcuucucuuaguccagucaccaauugccuucacgucuucuuacccaaggccauauccacuguccccucugcgcaagacagauacacaggccugaaaccaguugaguauuuaaaccccucugagcaggacagacacccagggcugaaccagugugcauuuccucucgcuguguggcuugcacuccuuuucaguucauuuaucaccacagcgcucucaucacacaugauuuggagacugcugucuuagguaacuuuacuccaggaacacuagcuggaacugucuaaugcuuccagacaguucuucucuccuggguuuccuaguuuccugccaugauaccuuauugaagaaugugagagagugggcagcacaguuagaaggagaguugguguauagucgugcaaucuuguucauccauugaggaaagcugcccccugccuguuccaaaccuaaagcagagugagggauaccgugcaggaugagcaucuguaccugaaaugucaccugaagccagaaguacuccccucucugcagccuucugaacccugauggcucagugcagaaaucccacaccugccuucaugugaccaccugcgcucaaaaaccacagcugcacuacaagugcuguaugcgucggugugggcaauaugccuaaguguacaugaaacuaaggaauuucaugucuagacauggguuccauccacaagauacggcgacccuccccaagucuacaaucugaagugugucugguccgcaugucucagauaagagguauucagccuguggugaugguggaacuuuguccacaccuacaucucauggcugggacaugggagggucagcugugcugguucaggaaacccgugaagacagguaaaaaggccgcaguugcugauaauaucaaaucacuuaguaaaaccacccagggggagcacucuaagccucugcuuggcacacugacuuuaacgaguugcuuccuauacuuacugucaccucagaaguuaauaauucagaguggaaauucugugucuuauuaauuauucauuacacauuaauauuuucuucuuuaccugaagucuuuauggcucacuaagugaaauauuaguguuuuccucuguaauuggucauauguuuuauuauagaucuagauaugcucaucuuccaguuuucagugaaugccucaaauauccuauacaauucucaaaugugacauuuuugauugugcagagugaucagaccuucucaucuaugcgacugacagugaguguugcugcgguugaagcugaacuucagcucuuacuggcaauuuaguuuccacaucugcaacaugguuaugauaaauaacuaaagaaguagugaacauaaaaugauucuuuacauaaccaccccaaaaugccaauaaaacaguuucaagggaaaucacagaaagcaggcugagacccaggccucuguuucuggggaaccgucuagguucccguggagcugugcugggccuguuccucugccucagcccucacaagcugugcacugagacuuacauuguaggccuuccgugcucugaguucugggucuuugccugccccuugcaaacuuaacucugcugacaaggacuuuuuagcugggaagaaauuguaguggucuuuacuauauguguuuuaauuuuaaaaaauuauauauaaaaacaaucagcguagaauauuaguguuugcuaaguaacauuuuucuucuugagaaguuggagaugauaguagaucuuuucaugaaugccaaaagcuuuaacacucuguggcugguuauauauaguaaaguguugacagauuuuucuuaauaaaccaauuccagaaaaaguuuuaucugacuuuguauaaaaaccaucacugucaacaucaaauaauauggcuuaagccacccgauuugcauagcauugcccugggcauuaugcagaauaaauacaguguacuaucuuuagcuaaugugccaaaaugugcugucagugaauauauaucugacagcucuaacuuauaccgaaguacagccuuaaaacacuugacuuuuaaguuucgaaauaucguccaccagaaacauugcuuuuaucaggaccaccuuucuuggugaagguuuugcucaucuaacucauuaaagguaaaaaaaauuguccuaagaacaauaauuauauauuuacauugggaaaugccuuaguccguugaagcugcuauaacaaaauaccccagccugggugacuugugagcaauagaaauauauugcccacaguucuggcggcuagaaaaaaaucuaaaaucaaggugccagaauauucaguuucuggugagggccuguucauagauggcuccucuucacacaaaugcaugaaacuggaagagaaaacuuggaugucucucaggccuuuucuaaugcugcuaacauagcaucuccuggggacagccacucaccugguaaagcccucauaucuucauucucacuguggagaugacguuaggcucaacguucugaacacagugcguagucacuauaguuuuaucuccuuaaccaagauaaaaauuccuucuccuccuggugaccccuguucucucuucuccuccuaguaaccucuguuuucucucaccauucacuuuuccggcuuugggaaccaacagucuaagccaacuuaagccaucaguuaauaagccugguuagaaaacguaagggcuggauguccguuguuaaggccuguaguuacauauaugcauaccugaaggcuagcuagagucacaugcauacacacaugagaacccuuaccugacaaagggcguauaugcaugaaagccagcuagaaaaugacccagacuucaaguugguaguuuuguuuuaaggagcaagggcugagagaguucucagugacuuugauucagccuuugugugcuaacguggauauggaaggcacgguucugguagucugccacugaccagaguuggaggucuguuuguggccuuaccccagaaguauuugugaggagccccugcagugcugagcugcugcuagaggggcugugcuaggggagccuccagcuggauuccugggcugagcaagguguggugcggccccauccacuagcagcaucacgccaacagcagccagcgugguggugucuccgucccugacaggucaguaccucaguagcgacaggcagacuguuuauuuccgaggcuccccaagcacacacaccgucuggugaaaggaaugacugaggaaggagaguucuuccacugcucucagcagcacauccuuucuucacagucuguggcuuccagcagacccuuugaauaagugcugcugcguggcucuggcccuuuccccacaggcgaccacaucucauucccuggauccuugaggcuuaugucuaugcgcugcacauuccucuccgucucagaagcaucccacaguccaaugucugggauccaacucacgaucuucugggcuccuccaagggcuugggucacuucuccagccaugcccuuuguagcacacacauugucuucuaggcuccagaugccuguacuccacugcugcugcugcucuugguagucaucucaugguacuggcuucuccaaaaugcugcugccuuccacuguaacuuggauuuaacaauagccucucauaggcucucuucauggugcuaagccucaaauccuuugcaugaccccuucaguccuaggccaucacuugcaacugaggcugcaccuucaccaaugaccuuccauggccucacacagugccgagcccaggcugcucugcaugaccccuucaugccuucaaaaccaguaccaccugggugacucuuacacaguaccaagucccacuguagcaggagauacaaccuugguuaucucuggaacacagccucugugcucucaaaaaaaaacuucccagaagaugucaccucaaugaugcuggucucuucuuaaucaccacuaauuucuuagcuccagcuaaccagcaucaauagucccaguaaugcaaaguuuuugcuuuaguaguucugguaucuuguuaaucacagcugauucuucagccaaguuaaccagaaccauagaaucuucacaauccaaaauagcgauggcucugaaagagucuuuaauuuucccucugaaauuucacaagccaggccuccaucuucugcacuguucucaacauuaucuuccaagcuccuacacaauaaauaucccacagagcucucaaugccgaauggauccuccagcccgaaguuccaaaguccuuccacaguccuccccaaaacauggucagcucacaggaauaccccacuauucugguaccaauuugucuuagucaggguuucuauuccugaacaaacaucaugaccaagaagcaguuggggaggaaaggguuuauucagcuuacacuuccauacugcuguuuaucaccaaaggaagucaggacuggaacucaagcaggucaggaagcaggagcugaugcagaggccauggagggauguucuuuacuggcuugccuccccuggcuugcucagacugcucucuuauagaaccaagacuaccagcccagagauggcaccacccacaaggggaccucucccuuugaucacuaauugagaaaaugucuuacagcuggaucucauggaggcauuuccccaacugaagcuccuuucucugggauaacuccagcugugucaaguugacccaaaacuagccgguacacacaccuagaaagacuguaugcuuacauugucccagugacaugucugucacuugaggcagcaugaaccucuugaggaaacuucuaaugugauacccaucaccucacuguuacucucucgguacgcguaagcauccgggagcauugcaacagcgggcgggcggucaaagcuauggcccagacagugccgcuggccguggcuguuguuggacaacgcccacugguguuugguagguuaagacuuuaguggcugcuaauauugugcagagcuggugaguuucuucucuccuuuccugucccgauugucuuaccacggcaucagagacgugcuucguacccugugacagcaguguguggugagaaagagaugcauugauaaggaaaaauacuuguuuguagaagaagcuagauugucagcuuacauggauuagagggaauauugucuccuauuuuuuaacuccuuuccauggcaauuaaugacauuuagacuaaauaauuagauuuggucacacuugggccaaacaauguaauccagagacaggagggaagauacuuagcaacagaguggauauguuuuuauaguucuaucacuccaguuaagauucuagagcucucuugcuagcaaaugguuugaaggaaccuaaagaugaauagcuagcaucccuguagaauuuuacagcagccauacuugacggggugauccgugugcauugcugagcgcagagucuggcguaagccaagcccucugcagaugcugguuguuaguaaugcucuuacucucaucaccauugacauuauacauuaauauuucugucucacaggccgagagcccugguuccagaaggacaggcagcauauccaagggaacaaacagccuuugcgguccuguaaauccaagcccaugucucugccuugugcccucuguccugguuucagccuguggccacccuugacuauagccuuuauuccaggcucuguggagccaccagacauugcuauaggacagucgggauggggaguggaccauaaaagcaguguuuuaauuaccauggaauuggcauagagugggugagaaguaggugaggcccgguagagacuggagcucaggagugagcuguauuagaaauggagggguuugagcauaugaaaauagcagggugcauuuucucccagccaguaaccugcucagccuguccccauaaccacugcuccucccagacagcuguuacagacccucauaugggucucugauggaggucagagaccucccacccgccgugcccugaguggucucuuguaacucucugagucugguuuucacguguguguuggcucgucgcugucauguauugggcacucguccuucucugcuugcuaccauaagggccccacccuggcaguguggugcagugaucagacccaccucccccuucacuugcgauuuucuucuuuucccauuguucacccguuacuuuugcuacuucagaucuaaaguucuguuuucauaaccugagcagucagugucaugagaguggcucuggacugccuagugugguuuguaugacuguuuccauuucugucagagccuuuguuuuauagaaaucuuuguuuuauugaaaucuggcauuuaugcuuguuugauuucuggguguuuugagguaagaucuuggcuagcccaggcugaccuugaacucaugguaguccucuuaccucagccuccccagggcuaagguuaaaggcaugagcugccauaucuuguggcuguuuuagcuuuaaguuuuucuuggugguggugggggaggguaucuauugauuaauuauuuagaggaaagaaagaaauauauuuaagucuuuucaugagaauugauguguucucucaggcaagcacuccuuugcucauaauuccuaaugccuuagcucuucauaguuucaagcaucuuuaagcccaccucauuuagggguaacuuuaacaaaauuauuuauuucugacacggggugcugagaagguaugcacucugguauaacggagacacgauugcucacgcagcucccguucauacagcugucagucuggucauccaagaguuggccugccuuuaaccguagaucucaaauccaacauucacuuaaaggugaaauguguguguuauguuucagcaccgugucugacucuggccaacugcuguggccuaccucauugugggucucugugugugucuguguaugucuguguccaugucugaguggugugucuguauaugugugugugaaauguccgugugucugugucugaguguauauguguguaugguguguguguguguguguguguguguguguguguugcuuuuagcagacucaaccaguuugauucccacucaguucugaugacaaggcuucaggcuuguacuugaaaauaccuccucacagauccacauuccuggcaugaauugucguuacuucuaaugauaaagagccaguugaaugcaaucauagcuacauuuuauaauuuuuuuuucuuuuuuugggugagacaggguuucucuguguagcccugggugcccuagaacucacuuuguagccccggcuggccucgaacucugccugccuuugccuccugagugcugggauuaaauguaaaccacccaguuuacauuucccccuuuaauguggguuuggaaaugcugcagcaucuugggucuccuaaagauuuguggugcacuuuggaguugugauccugaaggaaacuuccagaacuauugucauuuucauguccagggucaugcuguucucuaauguuggccuucccuagucgaggauagagauucaguggcacagcagugauuggcaggauucagcuaaguaacagaccuacugaccaaccuaacugugcaugcuauauuauuggaacaugauuccccacguccguguguccucaguauauaguauaaccuccugaagguuucucugcuauccugauugaaugagaacuuguuuaacuauguuaccagucuccucccuucagucuauuuuuuacugagguagacuuugaugcaguagaguagacacuccuuaacccuuagauccauagcuggaugcugugccgaggacucacagccccucccaccugcacuucucuucccugcacucagcgucucuggguuccugugaacuugcauggcauacauaccacagagacuccuuccacacccugcagaccacagagccuguucuggccagaaguagaguuucucucagaguuuuagcucugcacaggguucucacagaacgacuagauaaaaagagacgggaagaacuggaaaccucccacucccuuuggccccuuuccugauucuguuaguuagaaaaacaguggaguauuuguuuccuguaucuuguugcacuuuuucugggcguuuguuaccuuggucuugcacauggugcugggguggcuuuuuaaugcauggaaaaugccugugaguuucuuucuaucgucacuugggccacccuaauagaauuggaggguucgaugucaacccucauaauuucugugagaaagcugacauuuacauaaguugcauggagccccugacagcucuaaacacacucuuggugucaucuuguuuagcuuacguuacgcuuuucacuggacaaguucaguguccacucagacccuggagggagucaaagcaaaggugugacagagagaagccguuagaaugaugggaaugacgaaagcaucugagaacuaacaaguuuagaggaagugugcacccuugcuuagcccugcccuucuucccagcucaguacuggacaggggauggcgccaggccuggagguggcuauauucuuagcauucagcacugugagugcuguauaaauuccugcuguccacuggagauucugugugcagccacacagcaguuugaugaacucaucaauggguuuugcuaauucaaaggcuuuaaaaggaaaaaaaagaacaugcauagggguuuaaaaaauauacauuuuauauaccuuuuggugcagaaaucacacuuacaaggacauucaucagauugcugguuauguuugccaaaaaauggcacuaaugauaauaagaguaaauuaggauaugguuuuaggagauacauacauacauauauguuauauauguggauauaugcauauuauaucuauguaucagucuuaaaauguuauacuguuuggccaucaugauaugcuguauuuauugaaauuaagaacuccauaauauuaagcaaaaacaaacuacuaaaugguuugaucucuucguauaaaaauguauucuucuguuaauaugcaugaguaggagaagucugaaaguuuauauacuaaaauaguuauggugcucauucucacaagggagauuaagagucucagucucucucccucucccucccccucuccccccucucccccucucccucucucccucuauucuucccccuccucuuucucuccuucuccucuccacuccuucucucccuuucccccucccucuccuccucccucccucccucccucccucccuuccucccucccucccuccuauuuaaauauuggugggaauuaaaacagaaguuagggccugugaaggggaaggaugcagacgucccaggucugaacacagcaaacuuuuaaacucuugaauucuuaacacuaacauuuaacgaacagacagaaggacauagccagcugcccauagcaugaauucugugucaugggagguguucagaacacugcagagacaucuggcaaggguggccacagaguggcugacacauuugaguauugcucuuugccucaggccuuuuuaagagaggagauuuuaacacuggggagaaaauugaaaaagggaacuaagaaaaaccuuucuaguucucuuccaaacucaaagagaauucuauuccaaccagcuuaugagcaagaagagccugaugaaaaccccugugagacacgcccuccucuuaagugcuaaguaugauagccucaaaggaggccagugggacugacugcauagaucuugcuaguuuacccugaugagcuagugaagacaagagccuugauuuuagacuugcugcaugugaggucauagaugguaggcguagggugccauuugggaucagcgucaccgaugagucugcuggugccugacaucucggaagcucagagucccucugcagacuucauguaugugaucucacagaaucagacucaguagcucuggaacaggacccaggaaucaguaccuagacucuuacguuguuuuaauaaccagccaagcuuagacagucccagaauaaaguguacauaaacacguguauugggacaguuaugaagcaacaccagucuauugauaagccauugauauuuagagaacagccgcauugagaagcccaucagcguuguauagcuaagcaauguuuugugcaauccauuaagcacagcugcuuaaaagagcuaguuuuauuuauucauacauuauauaaucacacccacgaauauaacaaaagcauguaaauucauguuaauaagacaaauguuucccacagucuacaaacaaacuaaugggccaccuucugaucccgucuauggcguccccuucaacaacgaaaguuaauggugguucauaaauagaguaauuuuggaauuuggcacucucaacuucuucccgaaugauauccauugaaaaaggagaaaugaagaaaaucacggggcugcuaugagaaucaaacaugagaguauuugcugucacauauucgcagaguaugcaucccucuaaauaauaauaucagcuuccguacguccugugucugaugaagucacuuccagcaccccgcccguccccaguucuguuucucggguaaccuguauugggaggcugagcaggcaugggagggguugcacagguggauccccaaagccauuugcuguuccuugaacugacaggugcauaccuacaagcucuugacaccuacgucauaucucacucgggaguuacccccccccccauacuuccguggcagauuccuuacuccuucgcuuaacguuguaugacaccuccccagugaagccugugauguccugugcuccuaacaugcucucuggccugccucuucugucucuaauaaacccuaaguacuuaccuuuauugcuaauacccauuuccucggcugagcuauagucagcaugagggccgaugucuuuguuguuuccuguguauccuaggugggcauagcaguauguacgauguaguaggcucuuagaaaauaaauauggugguggaugacagagucuaugauccaaaguccuauugccgcucucccacuguucugcuaccgcuacacagugggccuuugcucagugcagcccaugguucccacagaguuagagcuucccgcacacugugugcagaaguauugcuccucagcucuuggugcauccuuccuacuacugugagucaaaugcacugacaguaacugcuccauacucuggucccacaggauuggcuccacccagcccucagugugcacuuugauaucucgucuaaagaccagcccgccguauguucucaccacggugccagacacucagccaauaaguguugauuguggguugggccaccaugucugaugugauuuuuaacuuucagguguaagagagcuuuagauguaguccaacaaacaggcacuugaaagacuguaacauaucaaguucacaugacuagcuaaguggauucugaggcuaaagucuuggucugguuugggaguugugugcugugcuucgucagcauagggcuuucccucuuuccaugucuucuccuccgagucccaggagauccagguuccuccagguguuaccuuccugugucggacucuuccugucauccccgccccucccgcuaguguuagcaucuucuguaaggcccgguguucugagauuacaucucugcuuguccugucaggcagugcggggcugauucaugcuaugcuuuggcccccucucucuuucuaguuccaccucacagcccugaucccuuggcccagcucguuucuccuccgcagaucucuccaucucuugcugauuucugauuuccuaacacucugucuuuuggcaagccguguucuuauguaaguggugauggcaggaggggguggguccuguucugugcugucugaucugaauuccuguauugucuccucuggcuuugaaagcaucuuugcugcguuaagugggagcggguaccccagcucuauuuuaccaacugagaucagacacagacaucaggaaaugcugugcucagcccugcagcuucuccuggcaagggugaaagccaagccuccauccacagccuaguguaugauauucccacugucccaaacucgaguguuaacagagagacaaagucugucaugacccaucugauguuuggaaauggauagcaguuguuguugaugauuuguuuuguuuuguuuuguucuuaagauuucgaucuguuugucagguuucuugaucagguuguuaaucugcauuucucuagcauccuuaauauccugguggccaaaaagaccgcuguccguucagucaguagggguagacagguucucggauacugacgacguuuuccccccaucacugcaugugacuaauagcuauuggaccuguguuuguaaugcugaacagugccaagaacucugcugacaaccuggucaaggagaccuauugauuguagguuggccaccaucucuuggaacuuuaaccuccagacugaagagcacauauaucagcuaagugcugguaacuugauacuuuugcagauuuugaaaaguccuccuguuucaauagaaccugucuauuucaacuaaaaguaugucucucuuaauauaaaauauugauacaguauuguauuuaagcuuaagauuauucuuuaagauacuuuucuuuuaccuaauaguagaaaaugauuuguuuauuuguuuguuuguuugagaucaagcucagacuggccaccaauacacucuguagcugagggugaccuugaacuccuggucuuccugccuccaucuccuaagugcuuagauuauaggugugggccaccaggcccagcauuagaaagcaaugucucagcacuuaccauucucaaugaguauaguuaacggacugaaguuagaucuuaacuccaacucaauaaauguuauuugucaccauuuguaaauugcuucauuaacaagcaagacaugucaucuugugcucuguuggcaugugugcccccagaccagaaggggaaaaccaccacauccuugaguguaggacagaucagaagcugaugcugauauggguggcagugacagcucacugccaggcugcucauuuccccaggugcaagcuggcaaugggucuguguccugcagcuccaucacccauacccucugugcccccagaggccagcgaguacacaaaaguguguucaagagaguccugaaugaaaggaugcgaaggccucacaucauguguggcagccacagggacacccaggugccucuggagcagaucagagcugccugcgguccccagaagaagcagaaugaugcgguccgcauucuaaaccugcccugauacagucccacuccucuauccuuauacacacguugguguguucuugccugggccugcauuuguggauuccggaggacaagcuugcacauccuccugaggaccgccauccgcuucugaagcagggucucucauuggccuguuguccgugaguuaagauagauuggcuggccagugagccacagaaagccucccccuagugcugccccagagcugagaugaaaagcgcgugcaacugugccuggcucuuugcuguggggucuggcgauuagaucuggggucuuaagccuacagcaggcacuguaccaacugagcugccuccagcccucuggcuuugagaguuaggucuguucccagacucagucauaccccagccugacuccuuucugcuagaacuacugaugcgagcaccacacuggguguucccacuuaccuuccaguccucuguuuugcugccuggaauagacagacccccauggugguaucaguuuguucucuugccaaaggaaagccuaaguguccauucgggauauacuuggcuuuaggguaaguagggagagccaucuugacaggacaaugaaauugcacagcucuuaugugggggagccuacccacuaucccauuuccuaaaugugcuguaguuuaauccuuaaacuguaaaaaaaucaagcacuuuuccuuucagcuggcugauuccauguggaacagggugggcuuugguuugaugcuuuuccucuucaugaauuccacuacaguuucagcuuucuuuuuuguugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugaugcuguuggugguggugguguugcuuuguguucaggagcuauuuagaacaugauuuguuuuguauucuuauagaauauaguaaaauugucacugguaacaauucuguuaccaguaaagcuaacgauugcaugacuggcugagauuuugaguucgcaucucauggaacagacgacauuuaaacuaagagaagucagucugagaugcugagagaaauuccccaaguauaucugaaaaggguacauaauugguuuuaaaggauccauaauugauuaauugaaaacaucacuugaaaagccaauuuauggucccuucugagagcaauuucagaaugcccuagguaaacaccaagccaacuggugcaaguagcuuuucauguggcuaaagagguuaauuuauaccacauuagagaaagaaagagaaacucuguucucccugcuaacuaacugcugcaaucccugugugucuuuucagguaugagaagguuccagucauccuggucgggaacaaaguggaccuggagagugagagagaaguguccuccaacgaaggccgcgccuuggccgaggaguggggcugccccuuuauggagacuucugcuaagagcaaaacaaugguggaugagcucuuugcagaaauugugcggcagaugaacuaugcagcucagccugacaaagaugacccaugcuguucugccuguaacauacaauagcauccgaacauggcugccccggacaggauucgucuaggcucguaggcaacaguaaccuugucuacugcacugcaguuuguaggauggguggugugugaguccacggugcacugcaaccuucaggccggauggccagcugaugccucugaguaccuguggguuccgugacuacagccuccacuucuguccucaguccuuguacaucugcaaccugaaggccccaccgccaagcuacagggugaccucauuugacgugaugauggcauugcuguugaggugacagaagccacuguuguguaaacuaaaaauaaucaugagagagaaaccagaauuccuaugaucacuaacaauuaaaauauuuuguugucuuaaaaaaaaauaaaaggagaaauauuuuccuacaagaguacugaagucaggaacggauggagcuucuagccaguguauuccguccaguaaaacagcauugcagggagacucugcucagcugacacguuucuaguuuucaaauugaugccuaaucguagauguuauccuaauucgugacaugaaacucacucacauaucaguccucaauagaguaaaagucagaacaaggcugugugaagauccagucuggcuuuagaaucuguuguaucaccugcucugccacagaaaauagucucucauagggguuuaugaaaauugagucgcacacccacccucuguuaauggagagaggauggucuuuauuuacugaacaagacagaagcaacugagauggagagccagucuuacuaacgagccuuguagccgauuaaccaucgcagaaggaaaaugaagccauguuacacccacacgcucccguuugcagacaccccacaggacaguacagacaucuggcuuuguuugugcgugcgugcgugcguguguguguguguguguguguguguguguguguguguguucgugaaagcugccuuuaagggccacgguugcaaugggacccuuggcucaccugcuuuggaaauccagucugcuguaucacagcuuuauuauaggcacuuaaaacaaaaacaaaaaacagauugaacaaccuaugaaaaauuugggcuuaaaaguagaguauaaauuauuuuagcgagggaaggaagggacacaaaaccucuuaucuucccuuuccuggagaaucacggaagcuuuucaugugugcauuccgcccugauggccggaguggcuggcacacacugccugagugagucuucuguuucgaaagggugcuuaagcucuggcauuuuuggccaugaaguguuuuaucauuugcaugaguaauggcacaggaaaaaaaauuucaguucaggaguuucaggaguguggaaggguucuucucaccucccuuagcggcguaagugcuggcgagcgucuugauccugcccucugaagagcaguguggccuucagaaccgcagugucagugagccuggaggcacuuagggccuacgcguucucaggcuccacagucucgugcaaguaaccacguagucucacguguaccagaaagaagaguguguuugugugugcauguguguuuaucguuccuaagaauuuggcacaauucaggcuaucgccucgacugagaaucuauacugcagaacauaauguauaagcaagcaguuuuuaaauuauuagucucuuacaagccauuggaaucucccccaccccaaguauuuaguagcuggcuuuaaguuuacaagauagggggacaaggucaaugguguuugucauaugugagaaaaaaaugauaauguggguaaaaccagguuguggguguuagagagucuuagaaaauucaugaucuucagcgccauuuucuccacuuaggaaggacaaaaauguccauuuuauaggacaaaaaguccuaacaguuuucuugaaacaaagucuauuauguaaaaguugauuuuugacucagacauauugaaaaauugaacuaaagaaguauguuucaucugcugaaguagaaauagugugagaccucugagaccucuaacuugucugacucauucuaauuuuuagaaucucauaaugaacagcaauugaugauacugcguauuagaaggggcugcacagaucccacagccucacgucacggauggcccaugcaaacauggaaagggugugaagccugagaaagccgggcaaggugugaagugggagcuuuugccaggcaucugggcaggcucuuccuaaggcccaguguuuacaccagcccuucauagugccugggcaucacuuccccaggccaaacuguaccacgcccucucccuguuccucuggugcaagucugacugacaguugugcaugauggugcugagauggggauaaaaacccaaggacaggaaaaggacacuugucagcacaagaaauggcagggcgcaaaggagagcuggcccagugauauuucuuuaaaagcccaauccaccuagcaaccagauaaaugaaaguuuguucuaacaugccuuaaaaauaugguuugaccccaaagacccacaauuucuuuagcuauuacuuaguuuucuuugcuuuguuuuuuuacuuuucacacagagccagguuuuuguuuuguuuuagguuuauuucuuuuaugguguaacuugcggguucuuuuaagcuguggcagcggcgguaaccaacgccuuucugcuccucagcuuccacaggacaagccagcaugugcugggaagccuucuagguguuucuguacaccgugagaggugcuuugaacucccacccuuugcuuuguagaauuagggcuugcccgugcacuccaguugccacucucugggguagaacuacugaugcuugcuugcuuuuugugucgcccguggacggcuguggugcgccguccagugugagugcugcugcugguggcugugaagguguguuguccuccacugcuguuggguugcuuagucgcuuaguuucuccaucaguagccccccucccccguuagcacuggcucagcuuuaacuguauccucagccaaucagauguugaagaccauggggguccucuuguuuaauuuguccucguguaucuauuaaaccgugaucaggguuucuagaacggcugcaguagauuuugaaaacagacuuacuguuauugauugggguuccccagagauccaguucacaguuaauuguuggacucuaauacaacugaccauugaaaaaugaacaacggcuuauuguuuuguaacagugucgggugagcccugacauuucaauugaaacaugaauugucauuagaacucaaugcaaauucaacaguuguauuuggaguuaaauuauuuuaacaaauaaauuuauuuaaugaaaaucugg

SEQ ID NO: 7647 - RNA, 774 nt, Mus musculus
caugaguagacucaggcuacagaagaggcuugccucuaguguccucugcugugggaaaaagaaggucuaguuggaucccaaugagaccaaugaaaucaccaaugccaacucccgucagcagaucaggaagcugaucaaagaugggcugaucaucugaaagccugugacuguccauucccgggcucauugccagaaaaaaacauccuggcccaauggaagggcaggcauaugggcauaggggagaggaaggguacugccaaugcucggaugcccgagaaggugaccuggaugagaaggaugaggauccugcgccggcuucucaugagauacagggaaucuaagaagauugaccgccauauguaucacagucuguaccugaaggucaaagggaagguauucaaagcaagcggauccucauggagcacauccacaaacugaaggcagacaaggcccacaagaagcuccuggcugaccaggcugaggcuugcaggucuaagaccaaggaagcacgaaagugccgggaggagcgccuccaggccaagaaggaagagaucaucaagauucuguccaaggaggaggagaccaagaaauaaagcuucccucaugucuguacauaguggccuggcuguggccucacuuggaucagucacuaaaauaaaacaagccuuuaaaaaaaaaaaaaaaaaaagaaaagaaaagaaaagaaauuagggaaacaacucccuucacaauagccacauauaauauaaaauaucucaggguaacucuaaccaa

SEQ ID NO: 7648 - RNA, 464 nt, Mus musculus
agacauucagcugguuguucggggagacguaccuuccaccuuagaccauggccaaguucauucguaacuucucagagaaggcaccgucgaugguggccgcugccaugacuuacucgaagucucaauuggccacauuuuggcacuacgccaagguugagcugguucccccaaccccuagugaaaucccuacagcuauuuggagugugaaaaaaaaucauucaaaguguuaaaacugauaacuucaaacaccuuacagugaaggaagcugugcugaaugguuugguggccacugagguguggaugugguuuuauaucggagagaucauaggcaaauguggcauuguuggcuauaauguuugaaaaccaaucuuuaacuucugauuugaguucuuauuugaauguucuuggaccauguguaacaggacugcuaucugaauaaaauacuagguguugaaaaucaacca

SEQ ID NO: 7649 - RNA, 93673 nt, Mus musculus
uggauucacuccauccuuccuuguuugcugcagaagcggcagcuuaggaggagggcagagcuggugcccagagagggccuacggccuuaggagcagugaagcgaggggagggcuggguaagagucgggacgcgguuuccuucuauugucuucccuuccuccagcaccccuccgcaccccacuuuucccuucuugugcgcagcgcagagauggcggggcccagcccuuccucuguccagcuaaguuuccacagccggcggcccaggcgaggcugaguucaguacccaaggcagugcacacaaaccgcccucucuacccuugggguuucuuccuugaucuggcuggaaacuucguacagugaggacgcuccggccggggcuuuuggaauaggccccaggcuaggccccucuggggacaccccgagugcagacucuggccucuggagggccagggcggguggagagggaaggguaggagugggcggugcucuucgcucccccaaacucagcucucuuccgcgcgcgaggcccaccccgcgguuccgaaggaccccggcgcacagcacccgagagcgcccgccugcccgccgggccccggggaccccgccugcgcgcccgcagggaggcgcgacugcggccuagggcgcccggcggcuccuccccucccccucccccucccggaagcgcggggcgggguccccggccgggccgcgggggcgggcgcgggggccgggccggggcggggcgcggcggacugugcgcgcccacucggcuccaggcggccagcgcucgcgggcccaggccgcccggcucgaccugagcaccgcggcggcgcagcgacgggaucccuggagaagcagccgcagucucgagacgucccccgcgccccccacugcccgccccaggcucaguguauggggccgcggcccgccaaccuucguugagaccguccccggggugcgguggccucgggcuccagagcccgccccgccacccgagggcugcgcgcggccccgggccugcucgccgcgcggcuccgcgcgucccgggccaggaaguggcggcgccgagcgccauggcccacuccccggugcagucgggccugccgggcaugcagguagguugggguggcccggucgggcugcggccagggcggaagcgggcaacuuggcggugucaacacgcccccccuccccccaaccagccgggcccgcuucuccgggaucuucgccgacucgggcggcggggaucucggguguaugcacguggaggggcuuuggggucugcggccuggggccgagguggggugcaggagcuuugcgcuccccaaguccgacgcgcaggccgagcgcccaucccgggcaggagucugaacuaguguccuuggaggccccgcuuuggugccugggcccuaugugggccugggacagggauagcggcacucugggguccguccucaguuagcaaaagucccuccccagaccccucaagcgggagacccgagcgcagggcgggagcgcgccccggcuggucacaguccgggcgggccgcagggcggggugcaggaagauguaaccucgcaucggagccuguaguucuggugcggaaagugcgagguugcaaacucgggaggcggaacccacaccuccgcgagcgcccuggugugcagagcccagguucaucccucgggugccaggacuccgcugcuggacuuucacuuugagaccgguuggcauccagaggaacugugugcuagcgggcuucuuggugcacacuuuguaucuucuuagccugccagugacuuuuucuucggaggggaagggggcggugaggggacggaguugaauuucaaguuuauauggaugcacgaacuuuuuuuuugcuauugaggaugguuuucugcacuuugaaaaacaaucacuugucuguucaaacuuguaaaguuugugagcguauauaauaaauacagacauaaugauugcgauuaagauagcaagaccagucaaaguuuugcuuucccaaggaagugaacggaagaguuuugcuuaaaaaaaaacaaacaaaaaucaacaacaacaaaaaaaaaacaaaacaccucagaauauccaagguuaucaguuuauagaugcagcaggcgccuucucucuggcuucaggguugagccgcauggaccuugcuugccucuuacugcuucugccacuucugaaaauaguuccuaucccucuuuucuucuucuuuuuucuuuccauaccacguaaggaaaaugguuuucuuggccccgguuuugaacucuggaaaaauaggaauucaaaguuaccacuucaguggccacuagaacuugagucauuuuuaagggauaauaaaguuggaauugagaagugucacuggaaaagugcucucaaaguauuccugagucucaccuugccugcguucuaaaacuugauggugcuggccgcuaguugaaagucaccccaggccuccugcaacucuugccuugguuugacuucagagacaagacaucagggucaacugggugacaguuucuuaccuguggccagaaggaccucguggcacauuucuucacguuuucuucauucuggcugcuauagugauuuaccuggcuccacccugaagccucuucacuagccccaaccuuuguaaaagaaaguguuugaaaagauacuuaauguggcaguguguggggucaguaccaagugguucccagcuggauucugcuucuguuuguuuuaaagaaugggccaaaaaaucuucauuuugggaaaaagaaaaauucaauaacuuuacccaaaaaguguauuucauacguguucuugaaaggaagauguuuuaauuuugcuuuuuggugugaagacgauaaccuuuuuuuacuaguauuaauuuuuuuugucuguucugguuccucagaggaggaaaaguggcuucccacagucguacccgccccuguguaugucuucaaaccauaugauacauuuuugguguauuauuggagacuguuccuuccuucccuucccuccagaaaagaaaaaccagcgcguuuauuuucaacuuggagucaggagcugcagcucccugggagcuguuuugaggauuacaugaaaggcagaucuggccuugacucuuucuaggguaaaacuggagaggaagagagaggcauucccuauugcugcugugcuuaugaacucccuguccguccuggcucggguuuaggaggaacuggguuaguuugacaagucgggugugguaguggcugucuucaaucccaacgcucaggagguggaggccuccuggaucucugucaguucaaggccagccuggguuaucuuagagaguucaaggccagccuggguuaucuuagagaguucuaggccagccaagguuaaugcugagacacugucucagaagaagugcacaaaguuuggcaaggcagaagugcagauucagacagcccgagggaaaaaaaagcagaauucaggaaugcuuuagaauaaagacuuuauggccuguaaucacuuuauaucuguugacuauuacugguacugaugaagagaagauaccguuuuauagcuuugugaaugagagaguauuugaacggaccaagguaagguagcauuuuagaugacauacagugauuagaacccaggucuucgcccugccuuugcaaauaauauauaucauuuuguuuuagauuguguuugcugaagaaagaaauauaagaugaaugauuuuuucacucaguggcugugauugauugacgacucuaaugaucuuuggugaggaguugaaggcuguauaccugacuguuuugaugagguuuucuaaggauuuucuuuccucuuuggguuauuuuguagucugugagagaacuagaaaguaagacccggccaggugccuuuagucccaggacacagagccaggcagaucucggaguucgaggauagccugguuggucuuuggaguguagcugucuugaaaaaacacguucugagcugacugcaguagaugaguguggcuguuauguccuuccugccuucuucaggaacauucacuguuuugccauguugguuccagugaaaaaaguuuaguuggaggugggagggaccuaucuagugcuuugaauuuccauuaaaucauggagcaaaagaauuagcuuuaugcaagccaggcaagcgguggcucagaucuuaaucccagcacuagggaggcagaggcagguggaucucugaguucgaggcuagccuggucuacacagcuaguucuaggaugguuagguaaguuauacaaagaaacccuguuugggguugagggaucuaaaagaauuagcuuuuugcuuauaaaauucuuugguauaaaaguauguugugugcacauguguauguagcaugugauacagguauauaggaguccugggagguuggaagaagagcuacaggaaccaaacuccagcccucugcagcagucuaccucugcaggcugcacauuucugucacagaauucugcuagccguuuuuaaagccuuucugggcugugacccuuguaagacagagacuuggcaucaggaccagaaauuaaagcuucagaguguagcacuguuucuugcuccuuguaagucacuacugcaguaguggggguuggggguggggggggagaagcugauuguaacauugaauugauuccacagcccacugguucauguggcuccaaguucauggcuccaaguuuaaaauacacgaaguuagauaagucacauauguaagaaggcuggaguuaauucagcaugucucgaggcuuugaauuuaagagacccucguguuugcaaguauagaugauuuaaagguguaacgaagaaaacuuagauuuugcuugcugauguuuuuauauccugguuucauucccuuuguucagcuccuaggcugcaagcccuagcugugagggggcuugugugcaggguagccaggaagaugcucacuagcacauuucuagcugcccaccccucugugagacucaaugcccauaggccguuguguacagucuagucgcccucuucccugcuucguugggacauaccugcucuuguugcccuguuuggaacuguacccuggggggugguuuggugucugaguggccuuucagcaaaguugugaggucuagguuucaagaccaucucaggugaggcugaacgcggauggagguuuagcaucuucugguccugauguagacagagucuucagaggaugauaucaagauauaggucccuggccucaaguggucaggagcccuugcagggcaggcccugagaagguucugguaacuggggcccaggagaccaggugcauguuuggaaagcaccaaguuucuguaggauggagagguggggugucuacgggccugcuggguggggcugaggccuggagacuggguuggguauuuuguucuuugaggugucuguguucucagacauaggugaucugggaaguggguucuggguguccacuagaaguuaucagaguauuugagcagaagaugccgggguagggaauacugggggcucaaauguuccuggauagcuaagagagcccuguagaauuuuuacagagcucaguggcuugaauucugugaauacgguauguauggcccugucaugugcuuugcuuuauucuguugucuuguguugugcaaaauaauugaggaaggucggauauguuuuucuguuacuuaaguccuuuucucuccaggacaagcaaguucuucaugcucuccaggcuggcuuugaacuucugaucuucuugcuuccaccuccccaguguuuggaauaucugauugguuuauacagugcuggggaauccaguucuuggcuucaugagugguuggcuggcacuggaccaacucagcugcggcacagucuugccucucuuaagucauuuuguaccugugucuguuggugguguuccuuguugcuaagacuuuguuuugcuugaacguauguguguaugguuccccuggcccuguagcuuucuaacaccgucccacugagccacguaccauucucauuccugaaaggcuuucucauuucuuugucuuuuuugauaggguggggaaggucaagauuauguguauguguguguauguguguguguguguguguguguaugcaccaggaggguauguuauacauacacuccucagauccccuggaguugggguuacaggcagugcugggaacuaacccugcuccucuguaagagcagcuuuucugcugagccaucucuucagcuccaagauuuaaaaaccauucucucugugugcacauaugcaugcagaugugcaugaccucauagucguguuggggucagaggacggcucuucagaguccguucucuccuaccaugcgguugguaggugaguuacaacggggauugaacucaggauaucagggugguagauucaucuuucuauuuuuuuaagcauuaaauagcuuuugggagguuuuguucuagucccagaucagggaauguacuuuucugguuuuguuuuguuuuuugagacaggguuucucuguguauuccugguuguccuggaaccggggaacuuccaacucagauacgccuuccaguggcuggguuaaagguaugugccaccaugccuggcucagggaaggcuauugauaauauuucauacaggcacccaguuacacucuucaagaaagcaggcagauugucacuguaaauagugucuuccggcagcugugacgguggcaagguggccuccuggcguccagaucugugcauguuuguuccucuuggaacggcugugcucucaguggaguugagcugcacuggugcacauuuuugucuuaguuucuguugcagugaagagacaccgugaccacugcaguagcaacucuuauaaaggaaaacaucuaaucggggcggcuuacaguuucagagguuuaguccauuauugucauggcagaaagcauggcggugugcaggcagacauggugcuggagaaggagcugagaguccuacaucuugaucugaaggcagcaggaggagacuggauauagcucgagcauaggagacuucaaagacuaccuccacggugacacuuccuccaacaaggccguaccuccuaacagugccacucuauggccaagccuucagacacacaagugagucuaugggggccauuccuauucaaacaaccacaggguugauggaguucuuuuguugguucuuggcaagcugcagugugcgcagcuagugagccuguucucuauccuagugugguuuuauggggcacacccuccagaccaugguccaggaggugucugauggucucuugccacacaguuuuauuugggugauuuuucccaugauucagacuugccugcuuggaaacugguaccuacaggaagcgggccccacccgacccucccugcuaaugcuuucugugugccuuagcugggggugauuaucacuaauggaaucuuguggcuggagugcuugcaggaaauagaccuguauucuguuacucugcugcugcaauggagaacuugggcuugccuugaaucuguugguaguagucacuucuuguaacuaauuuuuacagugagauuuacuaaaugucuugggaaaaggauacauuguuauuagaacaucugacugggugagggcugugcccaguccugaguucuuggaacugggcauuguggcuuaugccugcagcuuugggaaguuaggcaagaggugugcugugaguuaaguucuggccugcagagagucaguuccaggcagaccuggacuauagugggagaaccguuaguugcucuggguaaaacaagauguggcuuagcuugcuacaaaguauacuguagccugcccagagguuuaugcugccagcaacacagugagacuuaagugaccuuccuccuguuuuguaaggguuugugguuagccagagaaacuguugcgugcuggaguguugucugagucauugguggggacauuguaaguuuuaugugaaugcuuaccaaauguguagcuagggcuugccuauuuaaaucucuuccuguuuuuaacucuaaggcuuagaaagcuugauauaccucccuuuccuuuguuugguuuucaguuacuuagguuuuguuuagcuuuacuuggaaacagcugcauagauuagaugcacgagguuaccuguccccugccuccaucucauccugauggaagccccuacaagucucucuaugcugacuuagccaccacuccuuggcuuauccagggugaguuuagaaacuguaugcucuguagacccagaguucugcagaugagguuugguucugucaacuucuuuucacauuagaucugacaacagugucuauacagucugcagccuggacagugguagugaagugcacgaccucgucagaggacucguguuuuuccagauagacuucaccaggugucaggaccuccuucuaggaaacucagcuggaccuuuuaaccuccagagagaagcugggaugcuccucugcugggcuguggugcuccucugcuaggcuguggugcucccuugcugggcuguggugcucccuugcugggcuggcacccuucaguuugcuccacuccuccuuucugggucucuugaccuuggaugccuugauuauuuuguugcugucugcugauaccuguuuucuggauuccagucuuuacuggauucaugcgguuggguugauggguacaguguauccuggacuccccuccagugaguuaggauacagguucuuucuucauaguuaccuguugguugaguagugggacauagcauaaaguuguugguuuccuucaagaauugcguuuuugguccuaggggcugagacaaacucucauguguuuuaggcaaacacugaacuacggagcuacaucuuguuuuuguuguugcuguuguuguuguuguuguuguuguuuguuuuuguuuugagacaggguuucucugugcuguccuggcuguccuggagcucacucuguagaccaggcugcccuugaacucagaaauccaccugccucugccucccaagugcugggauuauagccaugcgccaccacugcccagccacaucuuguuuuuuuguuuguuuuaagucaggauuauguuauguagcccaggcugacccccagcuuaaccacccugagccuggggauacagguauguccucugugcccuggccuccuccagggagguuuaaagacauuuacuaaucugcuguguucuagcuguguucugcuggagugcagugugcaccaggacuagauuccacccacauacgcuguccugccccugagccuggaaaagauuccuuuguguugugauguuccacaguggcgucuuggcgugaguguugucauauuuuuuuguacaggcagucaggaggccuuuacagucuggcagcugcugucuugugaugagguuugggguguuuuuuuuuuuuuuuuuuuuuaaaagaaauucccuuuuggaugcuguaccuucucaucuggucuuugaaugguucuacccuuuaaagcuguuuucugucccuugucuuucugacugguuuucugggccauugucuccacuuuucaaagccccccagugagcauuucugcuccuguauucuuagacuccaagagcuuuagugauucucugaguguuccuuauuagugugcuuccuccucugccugaaaugucuguuuuauuuccaaggcauaauucuuucaagucuccaguuuuuccuuuauuggguuugguggucggauuuuuuuguuuguguguuuagugguagagaccaccucuaacacucacuuuucuuuaugacuggaaauugcuaggaccucaagccauuuuucuuuucuucuccuuccuuccugucugucccccuucauucuccagggucuccguauguagcucugaauuaggaucucaguauguagcucugaauuaggggaugcugcccaggcuggccuuaagcucugauuuuucuuaccugagccucaugaguguugguaugugccaccaugcugucuguggggaguuaacuguaauguuuucugucugucaucccuacugaacaagacaguugggaauggccuuguuagaugcuugccuuuuugaacauguuucuggagucuguucuuugcacucauuuauaucucuuucaucugcuggaagccccccugguggacuguacagguguagacagguguagacgaaguauccguguggugugcugucugguuaggaguccugugcaucccuuccugcccuggaaaacaccuguacuuguucuugaggugggagaguagggcccuagcugggcucuggagaggaggaagcccuucagcugcauggcuccuucuuuaucagacuugcccugagucacugaacucagguaccucuguggagauagcucugugggagauuaguuacauauuacugggcaaaagcacuguaaggaaggguuuaacuuuugaggagagagugcaucguggaguggaaacuaguggugguggugggggcgugggaggcagcuggaugaacugucuggaagcaaauggauguugcuauucagcgggcuuucccuuccccuuuuuaaucaacacugaauggacccuuagggugccacuaugcugccuucagugugggccuuccgcgacuuaagccucgcagaugcacgcagagauaugccuccuagguuauuaugccucuaggucauuuacagccugcucaccagaagcccacaagaaguccccugaagucuguauggguaccugcuguugccagcuucugggguguugggguucagcucuaugaacugguucucucugcuuucuccacgugucuucuuugcugucuucugcuguggcuugagacuccacauucacgagcuggaaucuuagcuuucagauuuauguguucaucauguuggauguauagcuuuugggaagcagggcuagacaagaccauggugcaucucggugaugggccaggucuguggggagaggggaccccugagcugacuugcugcccuuacugccugaccgugggacuuuccagcauuugaggcuaugagaagugagcuccuuuuguaaauuacauggucugcaguguucugucuuaguaccaggacaggcuugaguucugucucucugcccuuucuucuuaucugcuuucuagcaggugcagucuccuggcuggcaggugaaacaacuaagucucaccuuugucuggaugaaaaggaugacaaugaaaaagaggcaucuggauggguccagagugaacugggccaagcgggaggggagggggaugguugagaaaaagaacagagaaggggagaaggcuaaggagaccaagagagcacguggaaccaggagggagugcagcuaaaaugcuaguuuauauaggaucagagaagcugggggaaggggcacuaagcucagccccugggcuggagguguuuggaguaggagguggggugagaagugcugggaggagccacagguacugggggcuguugggagaucugggaggagccacagguacugagugagacugccccuggguuucuuugagaccuaaaauuaaccuugcaguauuuauaucaauuuggaaaauacuaaagcuuuaaaguaugcuacucuuggugggaagccuugcaggagggaggggccugauuuuauuggguguuguacucauuaggguggugacugggugaccugcagggcaguggggaagggcugauacugccagguuuguaaguacagagaauggaguagggaggacuccaggcuuagcugcaaggagagcgcuggcuuuggguaccagggcugucuuucuuguuucagaccguuccagccaucuauuucccagggugcuccuuuuuaaguauguauauacuuuuguuauaguuuuggggaugggacccagggccgugggaaugccaagugagccuugcuauuuuugggaaacaguucccugagcuggaggcccggucuucuggcugggcaggauguacgguuugggucauagugcuuguuucugugaacugugcacgggacugcugcugaggggagacugccaaggguguccagccuuguaaaccaugcaacgggcaccaaggagcuuggcuucugcugcugguuucaagccuguuaugugaccgcagguugucuugugugccuucaggcuuguucucuuguucauaguuaguugacuucuugguauuagggauugugguguggaucucucuuuaucuccuuccugucugcugaguuucacagggaucgccuaagaccaucggaaaauacagauguuuacauuacaguucauagcaguagcaaaauuacaguuaggaaguaguaauaaauaacuuuaugguuggggguggucacugcaguaugaggaacaguauugaaggauugcagccuuaggaaggcugagaaccacugccuuuaggcccuucuugggcuggcucccugaacugucagguauuguucagaauguguuguuugagcagugacugcagaagacuuucauuacugcugggcuccacucucugugcccucugauugaagaggugggagguaggauugcaguucuaugaagcucccaggugugucacugccccuaggaccacacguggagagccaccguguuggggaauucaacacccugaaccccaccaaguccuugcuguggagucccacucccaccgggaaagcagcuuggguggcuucacagcacagggagaccagggcuuagccaaauccagaccaccgcaauccuggcuugcacuuuuacuugggaagacugacuuuggacccucugguguagacguggggcaaagaggucuuuaaguuguaagacuugggcuugugguuuuguaauagggguuucugaacccuugggguggcagcaguguguguuccaugucuuuuugacccugggaaaauucuuuuuaaaggaacacaucuuuuggaaauugccuggccuauuagguuauccgggcaccuguguggagaccguuucuugugguucucacgguagcugcucucugguucuucccacuaugagguaaaugccagcagaaagucaaggccuaugguaauccccagcuucugggcuguuucucagcugucucugugcugggucgacucagacucccauacgugagccuuugguguccuggguuugcaccugggccuuuucucagccugcaguccguggcugucccucuugacugauggcaccagcuccuuggccuuguggccuuuuggugaugcugggacacaggaugccugugggagugggaugaaugaggugugccagcgucccuuucucuauguggcaugaugggcucgcugucaucagcaucugcucucgaaguuucacuuuuaacaauggacagugcguauguuugcuuguguguguguguguguguguuugcuuucaaacucuagggcacacacacagcacaugguugaguuagugagcuguuuuaagaaggguagaugcaaagcuuagcuuccucauucggagaaagacugugaaguccuccugaaugccuucaucugcuguuuuuggggaaaggugaacuuaaagagaagugaaaccgcgcuguuuccuggcagcauguuagcaggggaggagugcgcacaucuaccucgaggggggugggguggggagguaaacuguuuccguguugaccugggccgucagggcuguagcaggugugcuggguggcauuucauuuccccagaggccugaagcagaggccuguuugugcauacacagcgcgcagcaguuuuucuucacuguguuugaucccugccucugggguggggugcuacuguucagcaaauguuuucuugugcacaggagugagaagccccucccacuuguguaagcuguggccuuccguaggcgccuauagaauguggcguucugcuuccccgaggugacuggaaaggagcucugcuguggcagcaguccugugcagaaagugucaucagcccacccuccaugugaacaugacuggugugaagagcuaagaugauagcagcuuaaaucguuuaagagugcuagacuuuuuguuguuucguuguguuuuuaggcuggguuucucuguuuuguagcucuagcuguccuggaaccacuguguagaccaggugcugggauuaaaggcaggaggcaccagacacugcugaccgcccccucccccuucuuuaauguauggcccguugcaugggacauuucagcuguagcuggguccucauccuuucugcagcaaagucugcguagccugcccugcuggaggccugugauaucggggggccucugagacuuggcggagggccugguguugcuuaucugcuggcucugccagccccuuuccugccguggccaugcuguuccugaguagucuguugaaaauggugugaacugggugugaggacuaggagaggagugggcacucccuucccccaggaaacacccacaccucacccuguauuuucccgcaaccugaauauggggguuuccugcuuugcccauuucccccugguacucacaacauaggugccuguccaugugucauuuagaacuagauggaaaacucuccugaauuuccauagucuuaggaugauguauuuuagguuccuaacagguuucuauccuucucuaauacaaggccugccucaaauccagggcagaauucugucugucugugggugguugguuguucaugcuauagcaugcucauauguucuaguucucuucacugugugggacccagggaugcagcaggccaauaggcaugguggcaguugucuuugcugcuucagccgucuugcaggaccuucagaauucgaguuagaaacacacgcguguacauuuuguccacacgccugcuugggaagcauugaguuuucugugguuaauugcauugcacacauugaacauuuuauuuauuuauuauauguaaguacacuguagcugucuucagacacuccagaagagagcaucagauuucguuacggaugguugugagccaucaccaugugggauuugaacucaggaccuuuggaagagcaguuggcgcucuuaaccacugagccaucucuccagcccccgaacaguguaaggccaacugucuuuuaaacagugggguggaugacagugcuuuagguucuuggugacuuugcagcacaugcagaggccagaugaaggcaagcagcuagaauuguaggguggagguuuuagaguuguauguguguuccucaugaguggguuuucgugcacauggguauguccuggaguguguguguguuccacauaaguagguuugcaugcacauguauauguucuggaguguguguguucguucuuccugcauaggucugcaugcacacgggugugcucugcagugugaguauggaggccagagauaauauuaggugucauguuuuaucuuacucuuugagacaaaguuucucauugcauugagcucauagguacaacuagacuagccagccggcugccgggagcuguguacugggagcauggguguuggacaucaaacuuguucaugucuguuuuugcaugucacuuugacgaaccgagccaucucuccagcuccacucuuccccuuugagacagggcuuccuauaugcuaguccaggcaggccuagaacucaccugguagcuggaaaggaaaaacuugucagccuccugcuuccaccucccaaaugaugggcuuaccagcaguugugccaacaugcccaauuuuagaaucggguuguaaauugucacaaaaccauuuggugacgcuuguuuuaaaauagccuuuuaaaaaacaacuuuguuuggguaaauuuuacauguauggguguuuugccuacgugugugugugugugugugugugcgugugcauuguauacaugacaggggucuguggaggccagaagaaggugauaggucccuggagccgcaguuaacagaugguuguaagcugccauguggugcuaggaaccgaaccuggaccuuccaugagaacagaaagugcucauccacugacuuaucucuccagccucucauuuuguuuuucagauuuuccuucuauuuauuuauuuucuuccucccuugccucuuucucuccucccuccuuucugacaugaucuuaaugaagaguccagggugguuuggucuuggauuacaucagccucugcaguacugggauuacaggcgucugcugccaugcccagguuccuuccauguaugcuugauugucuucagcgacuugacucuuaaacuugaguuauauacaguuaaaggaaaagcauugucaggcuuuguaaagaucuuccuguuuuaaccugcuuugaucugagcagccaagaguagcccaauggccauuuauuuaccuagcaguauuuacaauagauuagcgagagguacauucuuauuuugacuaagauugauuuuuccccccuucuuuuugagacagggucucuuuguguaaaacccuggcugucugagaacucaaagaucugaucgccucugcuucugagugcugggauuaacggagugugccgccacacaucuggcuuuugugauuugcuucucugguuuccaaaaaggagcaccuuuuuccuacugguuuuucgagggugagcuaguucagccuguacccaaaacguaagagcugggaggaagggaauuguuguuuugauugguuuuguuuuguuuuaguuuugcuuuguguguguguguuuuuaaagauuuauuuauuuauuuaauguaugugagaaucacugucuucagacacaccagaagagggcauuggauccccauuacagaugguugugagccaccaugggccuuccaagaaaaauuugauuucuccuuuugaaaaugauaguucaaguaagcggcagccuuuaaugaucagaggaaaggauaugcuuugaucuaauuauuagagaaugaaagguucucacagcguccugagggguggguggagcucugggauuuggaggggaggcuccuaugugucccguucugacugugggcauugggguuggaaccacaggucuacgugcagugcaucugcuagucggaggcacggauacagugcagagcauuggccguggccacguggcagcauggaggcuaacaaggagccaugccugagcuguucucagaggauuucaucuuuuuguuguucuaguucauuagcuggaucucagucuguguuccaggauggcucagaacuuagcaugguacaggcuagcccuccucucagcacuuuaccuguccuagccuccggauugcugagauugcaggugugaaccaauaugccugcuguagaggauuucuuuuccgaccgaugaggcgacucagagggugaaggcuuuuuauccccaagucugaugcccugagauccagcucugggauccgugugguggaaagacagaaucacuucccuugggcuguucucucagucccacacaugugcuggggcaccuccuccccaguaaauaaauauaaugagaauuuuuuuuucaagacagggaauccaaggagguuguauggaagcuuagggacuugaagugucccugagugcucagacucaaacaaggaacugcacuuuucuuacuaagugaaaagaagauggcaaaugugaugucagagguguuguccugccuuguggcucagccuugagccuacuuacgguaugaaauucuugggaauauuucuuuacuuagcccuugaauuuggcaguguuugaguugaugaccagcuguggauuguagcgcaguuuuguggcuggacuggagaggaagaagccuggcccgcugcugcuccucgugaguagggaggcgucagugugggcugaggugcuggggcagaagggcagacuuggugauggaguuugcagaguccuuggaaggccuuggcagugauuaauaauaggcguggagcugccagcuggcacagaacguggacugugaagaaccuguggugacagaaacuucuguaagcggauuggaggcagaggguguggacagccacauccauaaaugggucuggagcauggggaagaguccaggccagggagagauacgcuaaguaggucaccagugguuucaagcaaccuaggaacggguguggcugaaugaccgaaagggaggcgcucuugugauugccccacccagcucuaccagcagguccuggugugcucuccacugacaguucuaggcugagcccugaugcccacaugaccacagaguaguagugccugcuccagguggagucacuuugaaaguuuaaaaauugauuuguuuuuagguuuauggguguuuuucuugcaugcuugccuggguaccaugugcauguaguguccauagaggccagaagagggcguuggaugcccuggaacugccauguuauugucagcuggaauccaacccaguccucuggaagaggagucagagcucauaacggcugagccaucucuccagcccuccuuugaaaaggucugguggagaaaaucauaugucagagccccgacaccuucuaaacagguuucguuuccgaccccgaaucuccuugccagguaguuuaacggaugucaguuccucaggaagucagaacguaacaucaccgugagcuuacaguaacacuuaacaggaagguugcuggaaauccuggucuugggcgaccacgucuacaggaaucugggcuggugccuuuuguagauucauucagucuuacgggcuuucagcugggugggugaugcucugcuuccugaauuggauaguguuuucugggguuggauacucaugauuggggcuuaagagucucuguguuggaggauuuugcccccaacuugggcaagagggugcuaaccccaguuacuuagucagaaaggaaaaggggagacucguuugcgcaugccugaaaagacuagcuuugucuuccuuguucauacucauguucucccagggaccuugauccaugccugcuugucugaaugguucucagcuauccugagguuaucccggagggccaggaacacccuuuaccaggaaugcuggugcagguuuuuagaaaggugcuucuuggccuggucuacaccaugucccuaaccccugggcaaagaaaccagccaggugugcaaguguuucccaagguaggguagagaagucccaacagggagaucuuccucaagugggaccuucucacaggugacuuucucagugaagaacauugccagguaugcaagaaagagccuugcuuaagagcuuugucuauguaggagagcaaggucagccuugaugacauagccuuuuccugaugagccaucugguugaccccagggcucacauauuuauuuauguuugguagcaguaggaauuaaacccaggaccccaacauuccaggcaagagcucuucuauugaacuaccccccaguccauggcucauccuugaugugcaucuuguggguuuagacaagcagauaguccugugggauagugacguaguccuaagguucauuuugucauuuaugcauugcuguuagguuuugcugcgguuauuuucugcauauaccaguuuucuuuguuggcugcuuuaguuucucaccagagcccaaagugcauccuggagugggguaagccuccuccugagauaacaguucacuuaaaaagagcauauacuuucuggagaggaaggccccagauaguauuuucuccugucacuguaccaaacagccacccauaggaagcaugacagugguuccugagcuaagaccccuuagccagucugccuuagagaaagccgagugccuuuguagaaggcaguccgccuagcagcugcugucuaccucagaucagcugugcaugcuuguuaggaggcaucaggagcgagccuaugggcuguuaacauucccucagaagcagggguugggagggauuucagccacuccucaaagccacuugccgcaugcgauuuggcccugguugcauguggucucuggaggggcaagaauauagaggcugaagagaauuagcagagggaucucgaucuguguggccguggggcggagacuugacugcagcugcuggaggugcccacgaaggugaacacauugguuccucaugguggacuuggguuuguugucgagccucagggugugaggguggaugaggucuaccucucccucaggaaggaauucuccuaaccuggaggugcagagucgccuuccacagacaccugagcccggucuaaauuuccucuuuucaggacaggguuucucuagcccuaguucuccuggaauucacucuuagacuaggcuggccuugaacucacagagcuauaccugccucugccuccagagugcugggguuaaaggugugugccagcaccacccagauuugaccaggagagucuuacugggguuguuaagccucucugcuuggucuggguccccucugauuuuucucauaggccccuucccagucgagucuuuggauaagcuagcucucuccagaguuagauggucugccuccugccccucucaucuuuaagucuuucauagacuucccaaggcccugaauuuggugucugggucccaggaaccuauccacuguccugguuccuauggguggcuguuugauauggugauaagggaaaaugcuguauggcgccuuccuccccaaagagcaugugcucuuuuuaagugaacuuuuagcucgggaggcuaggcuggaggaucauguuucaaaacacugagggaugggguguagcucuugcuuagaauggcuacgcccuuugcccacuccagcuuucuccacuccaugcccauauauagguaaugugugaucaauaggaaaaagaaacuguaggacucccaugguuuuacucagguccuuugcaagagcagucagugcugcuuuuaacugcugagccauuucuccagcccugcagauacauuuuaaauugagcuuaaucuguaguguaaguuagaaauagaauagcuggauucugaaggcucgucugauuauuggcaaaaaguguugaguuggaggugcuugaagcaguagacuguuuaaauggcuuaguuuuacuuugcaagagucuagccuuugaacuaaacauuuuaugcaaaaaaaaaaaaaacaccaaaaaaaccaaaaaacauuaaaaugugcccguucaccuaguagccaggaguguuuucucugagaaaggccagggguuugugggagaccaguguugggaguggaggcuggacuuuggcgugguccuguggcuacccuguguugugugaagacagaccuguuguaggacagaguuguuucugcuccucacaggaacaggaacuacacacacuuucacuuugugccaagaauuuuaucagauuugggugacuagaagcuggauuuauggucuaaaaccuagagugcaggucuguggguugucuaaucucccugucagaggaaaccuacagggucucacuucuagcuacuguaagcucugaauguguuagcaacacaccugaggaagcaaaagcauccagccaagcaagugugggcagugacccccucccuucucugugagcuuagaccauggagccaggcaggaaaggaauagauaggcaggacuguggucucuguguccccagauuauguaucaaccuguaaggugggcaccuaauccccgggguggugguaguaagggguggaguuguggcaggagaaccaugcuaguuugaguccagcuugggcuauagauugaguggggaagagaacauuugggauuauuggugaggguagagaccucacacacagcauuaguguuuguuguaaaagaggccugagggagcuuccuguucccuucugcaaacucugaggaacagaccccugccuugcaggucugcuagggucuuggggugaaggguuuucauccuccagcgcuguaagcagcgugcuuuuguugucuguaaguucccugcucuaagacacuuuguucuugcugcuggaauagaguaaaguauagcaccaggcuaguggagggcacugggugaaucuagcugguggucugcuaugugaguuaucuguauagaauugcugcccaugacuggaggcaucucuguaacuguuuggagcuuaugugggagcugccugggagggucagauacauggaguaauuuauuuacuuuauguagagccucaugcuacaugaagaauacuaaguauguacagucaaguauguguuugagggguagacucuggcgcuugucaucucuuguguaauuuauugucccauauucagucaucaacgaaaauguccugugccacaguuaccugauucugugcuauugcauauugugcucaggaaaaaaaaaauucacuuaagguucucugguaacguuuaauggcaacauacguaauuaccagugaaaaaaaggcaaaaacaaaggcagagccuuuuugggggccagugagcuggcucagcauaaggugcuugcuguugaaccugacagcugaaguuagucuucaugaccugccugggagaaggagagaaacgacucacagaaguuguccucugaccucucuacauuugugucugugcacaugugcccugcaagugcauauguacaugcacacacaauaaauaaauccauuuaaaaaaaaucuuagguaggcgggguguggugacacacagcuuuaauucuggcacuugaggggcagaggcaggagauucucuuaguccaaggccagccuggucuauguagugaguuccagcccagcaaggcuacacaaugggacucucucuguguguguguguguggggggggggaugggagguggggaagcaacaucaaaaauauaaaaccucugaguccaaggccagccuggucuacagagugagugcugggacaggcagggcuacacagagaaacccugucuuagaaagccaaccaaccaaccaaaaaauccuucuucauauuuuauuaccaggcaaacaguauuuugugugcacuuucugcccgguuuuauagcacauaggaagacgacaguugagaggcagaugacaaggaggagguggccguggacuugaguccauguguacccacauguucuuguccugcacgucagguucuccaggggcuuuggccacuagaguagagaaucaggcucuguuuccauugaagaggcggggacagggauuggugagcuucuuccaccacgauugccuggccugugcauggaucagaacuguagcuuacagcuuggacugcacuccuggagugugcaguguguauguguuggaggcugugguacaggaaaggugugugcugugcuuuuuguuugguucaguuaggaagacuuggaacaaggccaggcuacuagcugcuugaugaauaagucuugccgcuaaaacuggguuuuaucaucuuggcuuuuaacucccagccugagcgucuucacccaaggcaugcuacuacaugaacugugggcguuuaaagcagcaaacggccuuauacauuuuuuuuuuuucuacuaaaucacucagauccucccugcccucagcauaaaaguuguauuuaaaaaccuuuagggagcugggcagucguggcacacaacuuuaaucccagcacuugggaggcagaggcaggcggauuucugaguuugaggccagccuggucuacagagugaguuccaggacagccagggcuacacagagaaacccugucuugagaaaaaaaaaaaaaaagaccuuuagggaaaaaaagaauuuccgugcugugcugcaguucuuagagaucaggugugaaaggccacagaaggggccgaggaagaguuacuggggucugucugcuuguaguugagagcauaugucauggcucaucagugggggagagaaguggagcuuugacuuuccguguuggagguuucccugugugcacucgugggauaagaccugaugugggagacgcuagaaagauaagcuggccuguuuguuuaucuuuggguuguugagccgaagaccgagaagaucuggcaggcagucugggagggugaaaaguguuggggacuugggcuagccuggugacagaagcaagccccagcucaccauuguucuuggcacaacugggccacccuuuguaaugcugaccauaguugaagcuguuuggcugugugauuucaucauuuaagaaaagaagaaaaaacaaaauuacuaggcucucuuugaaagagucacugcagggauguuggcuugcuuuuguagcucuuguggcacuggggaagcagggcuuugaaagucagaaguguucuguacuugagcucugugguggcccugugcuggguggaugcugggaccugugaugcaugccugccuccugccuucgccacagugaaugucuuggugugggucucaguguguugccaucacccacuucuguacccuuagcccuuuuauuaagagacaaaggcuucaagaugggaguggguuauagcuuccuaggaaaguuuugccaggggaucgcagggccagagacacggcuuagagguuaagaguacuuguugcucuugcagaggacugggguuugguuccuagcacccucauggcagcccaccaucuccuaaccaguuccuggauggaugcucuuuucugcgcuccauggccacugcacagauguacgugcaggcaagcucucagguaugucagcuugaauugcuagaugucgugguacugacauucaggaggcggaggcagagggauggauggaugccugugaguuugaggcuagcugguccacauagugagaccuugucucaaaacaaccauaacaacaauaggcuucgucaaauuucuuuaaacuuuuaucuuacuaacuucagcaaaacaacaaaaccauauauauauauauaaaaaaugaguuuaguaaauaaauuuuugagcauuuucaucuuguuuguucauuuuccuuauggaaagaguuguuuaaaaaaaaacacagacacaauguuugguaucauacaauucaaaguguuucaaucuaaagcauagcaugguguagaacaugcugugcuuuagauucaucauccagcuuaauuuaggguagagaauuccugucuguuagccugugugcgugaugugugcaugugcacaugugugcacaugugccugugagcccagugccaauggaggccacagguuuuggauccucugaccuggagucauuagcguucugagccacuugaugugguugcugggaucaaaaucagauugaacuuggguccucuggaagggcacugugaggucuuaacugcggagugaccucuccagcccucagccuggccuuuuugauuucuuacacucuucccccucucccaaaacagaauuguuggaacccugcuuuucccacagaauaaagguuuaguguuaccacuagacaagggaaaucgguaaccacuguuagcauuuuauuguacaucuuccuguguguacaucuuacaucuuucuguaaauguagacaucguugccucuuccccucggcugauacagaaucaguuccugcuaucugguuggcuaccugagguguaucugauuugacuccgaggagucuuuguuccccccucaggcuugugugaugaaugcuugcucucuggcugguggcuguauuuugggagguuggggaaaucagaggaugaggagccuaauuggaggaggugggucccaggguuugugucuuugauguuugugccugacccuacccugucugcuuugugaugaugaggugaggacuuuucucugacacucuuuccaugggggugugcugacguucaugggucuaagaggacuuggguaaaaccugugagugagcgaaacaaacuuuccccauuuuguuguucuuacauaauuauacuuacaaguguagcuaauauaaauagauuaaagcuuuaaaaaaagaugaaagacuucagcgacugugaaucuucccacaugucuaguuuccucuuccccuagauccuauguucugagacaggcucuggucucaaggcugaccuuggugaaucgguccucccgccucuccgccucuugacgccugagugcgucacaggugggagcugccaacacccauuagucuucuacucaccuaggucuuaccuucugggugggcauuuuugcuacucuucauuuacaaguguggcaaaagaugucugucugucugugcgugucugugugucugucugugcaugcauacacaagagcucccacauuuagcagcucuugugaucacuuuucuuuuugacuguccuggaaaagcuucucuuggcagggggcuugagacguccuugucaaccaugauuccugggugagugugucauggaacugccucuggggccacaguggugugugugugugugugugugugugugugugcucgggcacacaugacugucccugcaaccuggaauccuguguaugaucucuugguccuccaucccuagaaaagaaugugcacaagcugcugccuugcagggucuggagguuugcgaguuugcucugucuucuuucaguuugguucaggucuuaccguguggggcagaucuuugguaucuuuagcuugagacagagauaccuaauuuucuaggcuucaguggccucccccagccucauuucacgucugaguucagaggacaguugcaggaaugugccuuucauucgaugcuuuccacuugaagucuuuucuuauauuuaaacucaaguucuuguagcaugauggaguccauguuagggucgguuuuucucacgucugucuguuuauacuggguacuguucacacuaagucuagcauuaagacugaccugcagugaagcaagacugcuuuuguucaugguuuauccuucacgucaguuaccuuucuuguugagaagaaagcaacauaggugcuguggguuguuuuguuuaccuggaggucaauccuugugguugggaaagcauggugggggugagaggucaccuuguguccacaguuggagcacagacaggaaaugcagcggcacccaucggucuuuuucuuuuguucagucugggacucuaguuuguuggauggaguggcuguccuucuugagucgugccuauuuaguaugucucuggaaacauacucacugagaaagguguaucuccugggugucuggaacggugaaccaucacugugguauaucugugucuccuggguggcuggaacggcgaaccgucacugcgaaacaguuugcagguuaugacucuagcacaccuaagcuggacauuguuauuuuggugccaggacuuugaauaauaagugucugcucauaguccccuuuagugguguucccugguuucacguugguggcagggaauugcugugcuacuuggcucuugaccccauacuucauuuacguuuggucugacuggcccagccugucccauuccacagcacuggcuacuuccuugauaccauguguagaacugaagaaaucgcugaaaaggagacuuccaggggaaguugggugaugaguucagggcccucaggcucuaucaacagugauggaguccacugcuccugacuucaccgauugagaaggccgagugaagacugugaggcagauacugggcagauaggcacuuuuuuuuuucucuuuuggcuaucagggccauuucuuagaaucggcaccuuguuugcugcuucuaaccucccguuaguuucugguguguuccuuauggaccagaacacugacaagggaucgaggucuccuguguacugagagaacuggguccccucuguaguucaugagaacucagggaauugaggaagcagguuuuguguuuggagggcauuuuuaaagcuuuguccuucuaaaggguugagguugaguuacuauaccugaauaacuuagagcuacaguccagcacacgugcgccucacagggccguccagccguggggaacaaguuuguugcauuauuuauuugguuuguccuugaagugcuuuggucuuuuuugggaaagaaagagcucucaguuacuuggguagagagggauuuuuuuauuggagggugguguuuauagcuauuuuuuccuggcuggagagcagggucaugcccuccccuccccucuucccauuucuacuggccuuuuuaggcccagagcagcugaaggcaggcucuuuucuccagugcaugcugaguguuucugagauuugcuucuguucuguuuuacccacaaauauaccugcucuuaccgggcuguaguuuuggaguuuugguugagagacuacagggugugaguuuaaguugaguugcuguggccauacaugguaagcacucacaguuggaugcauagacagggaguguacuaaaguguugaguaugcuccacugucagacagaccucaugggcuguugccuuuauuuuuugcgcuugacauacagaagagaagguuuaacagagagauguauggaggugaggaaacucauuaauuugccagacucugccauggcuuaauguuugauuucuuaaugugauagcagugaaucaagauauuuucuugauucugaaaagcacaauggauuugaacccagaauuugugcuaugguuuggauaagguucgaguaugugucccaaggcuucuuguguuggaagcuugcucuccaguguaacugaguuguaaggugggcccagugggaauugcuuguccuggaaagagauuaagguaggcgugugggacacugguugguucuaaugagagagaaaguggcuaaagaagagugaagaaccauugucuuagucaggguuucuauuccugcacaaacaucaugaccaagaagcaaguuggggaggaaaggguuuauucagcuuacacuuccauacugcuguucaucaccaaguaagucaggacuggaacucaagcaggucagggagcaggagcugaugcagaggccauggagggauguucuuuacuggcuugcuuccccuggcuugcucagccugcucucuuauagaaccaagacuaccagcccagagauggucccacccacaaggggccuuucccccuugaucacuaauugagaaaaugcuccacagcuggaucucauggaggcauuuccucaacugaagcuccuuucucugugauaacuccagcugugucaagcugacacaaaacuagccaguacaaccaucaauaggaaauucugguuucugcuuguguccugggcuccuucuugccauaugcuuuccuuucuuuuugcaugugauuucugugugauacugcaggucacuugacacugcucaaggacacuauacuuuugaccaucaaaauugagcuaaguaaacuuuuuuuuuuuuugugauuuagcuucaggcauuucauuauagcuacagaaaacagauuuauauaguccaugaaguuugccuguauuucaguuaccaucuguaaaauggagggcuagaagcuggaaucagaguccucguggagauguuuuucuggugaugguugucugaaugacuguauuguuuuagacggucuuuuugucuuucaccuaacgggaaaguaggcugggaacacugcuuauucggcaguauuuauuuaggaucgcaaaccucccaaaggauugcuuauuuaagucuauccuuaaaauacuuuaaaguggcugacguacuguuuagcauuggggcugguggaaggccgugccaggaaaacaccggcuaagugcugauuuccauguccagagcguagugcagucaaguguggccuuccagcuggguagaaccuagggaaguuauaaauggccugugauugaaauccaugaggaggaugcuggagaagaguggugaggggacagaaugagaaaccauggcucuggguagucucagggaaaaggcugugcuuagggggaacccgcacagucuuguuuuuucauauguaagauuuuacuucuccgcugugacggcaccaggacaucaauagugauggaauauaucucucaccauugaccacaccgcugagcaccaaggcagcaguagugauggguguguggaaaugaacauaaugugcaucacuuucauagucccaagaauucauuggcagacaaauuagcccugggcuucagggaugcuccugcaugcaauucacuaaguaaauaagaagcccucaugcuguugagguauguccucaaaucuugucucugccaguguuugcuucaggaagugguaaggguuaggcaguuugcuucuugaugcgagacccaucccuagagagguaauaguaaaguagcuacuuaaaaguacaauguaacagaucugacgcuacaucgcuacauugagggcuuugugaggaaggguguuauuacaucaacagaagcaaccacuguacuucacggcaaucugcaguccaaggaauuuucauuccuuuggaggcaggaucuuguguguagguugaccuugaacuugaaauccuccuuggaguucacagcugugcaccacugccugucucagggcaccacagauacuguguuuccgguugcuuagaggaagaacagauguaaaaaguguguuuaagucuucaaguuucagaucacagcaaagcagcucuuccuccucuggacauauaugcucucacccuauaccagguauuuuuccagaagcaggagagagaaggcccaggaaaaggcauuugcccuuagggauccuguggucuuguuguauaaagauggaucaaaugcaguuuucuuuaaaauagcuuugcugagaugcauuuaugcuccaggacgcccacuucagaugugcaauucagagacuguacugagaacgugaccaaaggauguaccugucuuaacucccucuccguuccaucacagcuccgugcagucugucucacaucucaacccaaagaccacagcaugucuacuuuauauguuguggcucuguaacuuugccuuccucuggcuuuuucuaugaauggaaacacaugccauuggcucuuuccauauagcacggugauggugaugguugcguguacgugucucaguuguuucugugucugugguccugggaacggaaccuagaacuuugugcuugcugggugcuuuucauaacacuuagcuacgucuccaacccucuugcuccuuuuuuaucguaacagagguucucaguagucuacagcccagacaggccuugauucaucuuugaacagcagcaguuuguagugguccuguuucucuggaccuccugaccaccuggugggcagcaucagaaaaaucgggaguuuugcagagaugacuuccuguuucgcagaacagcagagcucugcuuaacuggacaaagaccucgggcccuucugacccggaagacugcuuuccuaagugcugggggcuuccgggaggacugcaggccugggagugguuggagcugagcggaaugcugcaaauuugagcagcugcacgccugggucauuugugagcauccuccuggcaacuugcccaggcacagaacagugacauggucuggccuggguccucuccucagagcugagaaucugaugggggaguuugggcugucuccuuaguguguauauaaugaggugguagggauguucccgguuaagcuacuugccuuugagcauucuccucuugggacugcaguguuuccucuugucugcugguaccuugcuggguccuuguccugcaggcagcaggaauagcgccugccucuggguuaucuuccugauacaccuagcugaccuuaccgaaugccaccugucugacaggcuuuguccuguguuaacuagcucaguguaagggaugaacaacucagagcaaauaauacagagguacagagguaaaagcccauucuaggaaaggauuucugccucagaugcacucagugaugguagaugcgugaagaugagcaguccuggccuucucuaucugaagucucccgagaagaccugcugacccuucaguagacuucuguuacuuuacaaugaaagugaauguccuugaugaauagccuguccuucagagccgggucugagggagucauggugaggcagagcgggaagaggacucacuagaguucugccaguacucucuaagucucuaagggacuugcgcuacacuucggaaggaaguaggagcugucaggguagaguuagaaugugcuuacaggccugucauugggcagcuggaauggugguaguaagacgacguguuuuuuugguguugguagauuggugcaccaaaaaugcuucugaaaauuguggcauuuccuggugguguuggccaucauccccacccccacccccccaguauaagcaaucgcuggccugguuaggcaauguaccgguuguuccauaucagccgucugauggucuggcgcaggguuugacggcugcugcuuuaagccagcaccugucagcucaauggcuugugagcaaaaagagguguguacguguguguguguguguguguguguguguguguguguguguguaucugucggugugugugucuguguuuccaugcgcccucagucuggcgcggcaccacagaguucucauuucucuaagcacgggacggcugauguggugccaguuguccaagggcacagagccucaggguuucaaugagaagcagggcuuggcuagcacggagugacuugugcaugcugcuguucuugcucugucccugaugccccccuaagcuagggcagaagacccucaugcccaccugugugaguuuuugaggagguaagcucgcucuuuaguggccuuuaaaagccaaguucccucagguaaaagaaacacuuucauugauugaagccugcauauccccaguuuggcuugguuucuagaaugcuagguuucuugacacucacuguuccugcuuuuauaaaauauucaugggaaggugaguuuaccugcaaggcggcaucagguuucauuccugguggugugauagugugacuagggugugccuugccagguaggcaucccuggaaucaggugagcagugaggaauguggcuucuacaguacuuugcugaauacugcucacagcccacaggagaccuggcuuccaccccacucacggcugugcgugagauugugcaagcuuuggccucggauuuucugcacccuacugugaaguuccuguucccuucucaugggacuguucuuuuaagucagccagcauguucuuucuugaguggaauugcugugguuacuggacugcauagacccucagcauuucucaugguucuucguuguucugcauuuuggugauaauaaaaagugccaguauucauguaccaaugaacuguauaauuuauuugugauauuucaaacacuuacccaacccaguagcucugaccucaucucugguccuguucagugucucagggaaaccccugaccucuguuuuucucucucugccucugacugacuauugugugugccagugugugcauguggguaugugagugugcccaugcuugugauacacguacaaaggucagaggaggacauuguguccuguucuaugacucccugucuacacagaacuggggucacagaugcaugugcggccacacccaacuuuuauguggguguccggaucugagccaucucuuaacucuuagcuguugagccaucuccucuauucagggagcggagccucuguugaaaguugcacaaauaaccacuaggggagcuggggagcugcagagguuuccaaccuugggacuugggguagcaauguccccuggguggggauuugguuggagaauugugaccacaggcuagcuguagcccagggccuuggguccucaggucucacauggaggggguguggggguaggugccccaggagaaugcccuggaccguccuagaagucuucgauuuacuccugucaaguaguacaacaccuagugacuggaccccguuugccacgauguucugagccuuguuuacuuucucaugaccucccagaacugaaccgucuccucccuagaguaaugggguugagggguuggggacagagacagagacacaagcuaggaagaaggccuauuucuacauugugucuguuucccuaugccaugucaugccugccacccgccccgccccugauccuccacacccuccuuggcccugguuagcuuggaacuguaaugaagaccaggcuagccuugaacuuggaaugccauugcagaucuauugggagugcuggaauuuaaggcauacaucaccauacccaacuuucccccuuauaaauaaggggaaaaaccuaaauuuacuuuuucuuuaaaaagaaaaguuuaaucauguguuggugugugugucuguauguggguaugugcacgugacuggagcuagagcugcaaaugguugugauguuggugcuaggaaccaaacucagcgcccuggugcuugucacuacuaagcuaaucuccacagccacuguuuuguuuagggacggucuuguugcauagaugaggccagccuagaaugugagugagcucuuccucugcucucugagugcuggacuugcagggcagccacucuuaccagcgcgguuucacauagguagacguuucuaucuguucacuucugaaaggguagagagguguguagguggcaggcacugugugugugugugugugugugagugcugggguggugauguucaucccgagcugaccuuugcaugagaaccugugaggaugagguuccaaggaggagcaagcaccacacaaaccaagcccuuaguggccuggcucugggagguguaaaaacgucaagugucagucaggagcccuugaaguuccccuggugagucaugucacaccguguauggggcaggcugcugcauaggacacagggacucacuugaggggucccuguaaagugugacugugaccacgguugaaaucuuuccagaggugacacugcucaaguagccaggaggcuggggcuaucuuccauagaucuguguguuugggaugcugcagaaauuucuccuggcaauguccagaaaacuccccuuaaaaggacauuugauuuuucuuaggucuuccuggcuuauaugcuuuuguauaugucuugggaguuucugcaagaauagcucauguggaggcugauugaacuugcaucuuggcccagagagagagaguuucaggcugauagauuccaccugugugaacugccaggacuaauuuccccauugaaacccucuagagauuaauacucagcuuaauuuggugacaugggguuccaggaauuuuuuuuuuuuuuuuuugcuugccaauuagcuuaaagauuuguuacccauaagaacaauaauuaggaaaucgguaugaaguuucaacuggaaaaaguucacacuaaggaaauagcccaguugugguguguguguguguguguguguguguguguguguguguguguguguaugguaugguguguucauguguuaccuguauccucuuauugagcauuuuggcccuugcuuuuggugauuucuuuggagacgacaaucacagacagggucacauugccucuuaagcacaguuugcuuccuuaacaaacuuguuccaggugacugagaaguuagaagcuugcugagucugucucuagggugaauaucuuaccuaaccacaguucacagugggaaccagggaauuaaugguggucuuaguguauagauuuggguacagguuucaauucagaucucacuagcuuugcgugcacuuugggccacauguguuuugugaaagucacuauugcagaagcuguccaucugguccccaguucucaccaccccauaugcccagcaaacacggaucugaucaccaucucuugaauuuugucaccuuggagauuuucuacaaaugaaguuauauguagcggcuggugcuugucuccaguguugguuggguggugagaggcugaguggaaggauuacaaaggaguucagggguucaggcucccaagcugugacuucagccuucaagccuuuacuggcauuaaucacugaaggaaagcaaaccaugggcucaggaaggccgccggucagagcaugggcagccucugaaaucgcuuaguugggagaugggagaaggcugcuucaagggcgagcacacacacacacaccccgugcucuugaaguugaauaucagagcugaagaggaccauaucuuucacugucaaagcaagaugggaguagcuauucaggcuuaaaguccaaaguacuuaagucaucauagaaguaguuuaaugaauucucucaagggaucugaaguauaguaaguacuguagaagccugggcccagagggcagagccuugcucuuagaacgugguagggcacugcacccuucaucuucccucagaggccucagaagcucucagugaaugauguugcucaccuagcagccugcacugaaagguucugcaucacuagcugugugugugagggagaggcagaccgguggacagagaggcagacagagagacacagacagauagacagaggcagacagagaaaccgacacaaagaaagagaacugaaaugcccacuguuggcuuucccagaggcagaggaucugucuauaauggggacauucucucagcuggucucucucauuuaauugaaaucuagucaucuuccuggguagauguucagcugcuccuggacuucugugcacaaacugaaauugucccgauugaguuagaauggaaugcccuaccuacagggcaauagagucggacagcagggucugccacagaguaccagcuguuagccauugugaccagagacugagugccagcuucacucuugcccaguucuccaagaggaugcugugacaugucacuagcugccagggcuaugugcugcauguguuaugugcugcaugugcagugugcugcaugugcuaggcaugcacagaaccacauguucauccccacaggccauuuucauuacaugcuuggcaaauggaagugagucugauaccagcccucguguuagaaaucaucugaacuagccuaucuguguaagagccagcccaucuaucuuuguguuuauaauuuuuacuaacauucuugcaagguuuguugugguuuggguaagaaagacucauauauuugaauucuaguugaugaucuauuuaagaaagguuaggagguguggccuugucagaggaggugugucacugggacccagcugggcuuuaaguuucaaaagcccaugccaggcucugucuggcuccucucugccucuagcuuuccaguaagaugugaguucucaguuucugcuucaaugccaugccugccugccugcccuugugcucccugccaggaugaccaugaacuaacccaaugaaacuguaagcaagcucccuacuguaaaugccuuaugaguugccuuggucauagugccucuucacagcaguagagcauugacuaagauauguuuauuaccauauuguuuagauggaggauuguaacuuuucacaacaaauggccagucguucagaguaacugaaagggcagaagguuccuuugugugugcacaaaaagcagaguuuaaggauaaaagaguuguacuuauggguggcaaacauuucugugggaacuggccacuuagguuuucuugaugucuaguuucugagcgucuggguugcauuuagauggacccuuccucgagaaguccauaauggcauguauccuuguuggaaccuguugggcccucucaagagaaagggcauuaaucuagcacgucagcccaguacacugugguguggcaagacccauccuauggacuuugcugguuugcuauaguuacaggcuuuuccaggggauccagggcuuuagcuauucccuaucugaacccagggaagaacuccuuugaggggguugacuccauccaggcuccccuggggaccuugagcaugcggcagaaaguuuuagcagcguucucagagaccaggugcaagcccgggcuuuggaucuggaacacuguguuugcuguuucuuuugauuaguuauuaagggucaugaccuuuguaugauuaaguauaauacauacuugagcuuuccuaaaccuuguuacagauuaaagagagccaagaagauaagguuugaaagggagugaaggucaagaaaguuguacugaaaguuggaggcagguccauggaugcagggacagcugagagcucacaggggacggcaggaaccuuugaaaccucaagccugcuccuagugacacaccuccuccaccaagaccacacggauccuucccaaacaaucccaccaacuaagcauucaaacauaugggagccauucuuauucagaucacugucccuugugugugugugugugugugugugugugugugugugugugugucugucugucugucugucugucugucuauugugugucauguguauggucaugcguguguacucucuagggcuuguggcuauggucagcuggggcucuggagguuaugaagacagcaggugacugggcucacucaacugcuccaguuggccagaacaggcuagggagauguucccuaguggcucucagcaggccagggcauggucauuugggcagugccuaguuaucggcaucacuucguauuagcugcuucauagugacagugcaggaccuccaaugauucugugggugcugggcagaucuggccuugggccaggggugaccucuuguauaugucagaacuucuucaggagcaggccacaugggucucacuauggcugggcagagcugagguacauucauggaggugcguucaagagcaggugggauugguagacagguacccuagcaacagcgucccuucacuggcuucugcaguacuggagggcgggugguaaguuguuuuuaagucuaaaaaggaaaccgcggcuuugcccgagaggaucaagcagaaagcuggucgcucugaucccugaagcacuuguugucccccaccuggcuuugcccucaguucuccugagucuuucucuaggaacggucaagggaugcugucucagagagagaucauucugugugauaccuaguguggucuuguuggugucucucuaaccugauggcuuccauuuucacucuuggugucugggcuuguggauacagaggagugagaggcguggcccccaggcuucuucggcuuagccuagagcauaagagugcgacacagcugucugugggaagagauuauaccuagaaagcgaacuguuccgggguugagacuuuugagaagcagggugggaguuggcggugugggguugguguaagcauagugacagagaggaggucuuaggucaacuggaaugcuuaaaaaauguggauuauaaaaugcacacacacacgcaaacacacacaugcacacacaccagccauuacuaggcuauaauguuuaguguccugggugauucuguccagccgcgcagggggcggggacaccugggagagggaauagaggaagcauagaaggccuggccugggcacugaguggcuuccaggauugagugugacgauuccuuuggcaccaggggcugggagaagagcugagggccagcuguggaggccaagggacuggaaaguuacaagggacagaggguguggcugaugaggcucagaggcaggacacugcaucacuggugaccagaguugcccugccagagggcuguggaugggcaggcaggcaggcaggcaggcaggcaggcgcagaggacugucaggaaccuucagcagagaagucugugaggugugaggauugccgaggcugaauggggugcugcuugccugucugagggggaggaaccugagcaugcugccccgggcgaggagccaguagacagggccagguggaaggagagccgcccagagggcugcuggugaagccuugccgagagaggauggaguccaaagucccacgguuaggguuagccuugaagagaaggaaggccaccccacuucauccuggagggaaggagguaagaggcagcuuggagcuucugaaaugcacagcagcugcuccguccggguuugauucugcuggaggagggacaccucaggucuuaacuucuggcugcuugugggguguggggugagcagaugcaugggcggaguuggaucagaugcugccccaacuccuacucucuggcgcucuuggggggauauccccaaaauugguuuugaagaguguuuaccugguaaauuccgaaagucugaaaauagagaaauuucagaguagcccaccaguuuucaaaaugguuccccacuucaggaggugacccuaagcucugagagcuguucucagacugucuuggcaaauggagggucuuggaaaaacuuacgagugucugagagacacugaagcuggcacccugacuggaggcaggauugcccaggucagggcugcuuugcaguuacgcagcacagugcugugcuucaaguacaaaugaucgugugugggcuuucuccucggagugugggagucuguuuagcagcgagccaaggaggucacgggcaaaacugcagucuuugcaguuucuuaagccguguguggcgggccacuucaucccguugugcacagaguacaacagcccuucucucucugcucuuuggugguaccucugaggcacacgucacauugugugcaccauggccagcacguggacuuuaauaacucaagaccaauagugggucucugagggcugucugcgacuguggguacugguucugccuccuugugagaaggggucgccgugaccguucgugccugguucuugucauacggucuagcauagcaaggcucccaaguuacacccuuguaagccaagugcuucuaacuucaacucugaaagcaugugaguggcuggcaccuagugacagcaaggucauugccacuguucugcugguguuggcaauguccugugccuaugaccuaccuugucacauuauaaccaucuucucuuucugugccuccuucucagcuccgcccccccuuguucucuuucuugccccccaagccaguaaugcaguuuuuuggaaggaaggauuaauaaauggcuuuuuuaaaaauaaagauuuauuuauuuuaugugcauggguauuuugccugaauacacauauguguaccaucuccaugccuggugccaaggauccucuggaacaggaguuacagacaguugugagcuggcaugugggugccugggaauugagccugguccucuggaggaacagccgguguucuuaaccucugagccaucucugcagccccuaauaauagacuuuuaaggaucagccagacguccucuucuuucuguggucugugggaaaacauggucucaagauuggcuuucugucuccuaauguccuuuugguugcagguuuugggguacugugggcauuuuguucucgacaggugcuuguucugcccccuguugggacacagagccccucagacuguuuucagaugucucuagcacuggcagugaccgucccugcuaaacccuggagcagggcuguccugaccuucccugggcauggguacuguguauaguucucuauuuagcauuagugcuuuaaaaguuguugcaagacaacagcauuugugggcaacacaacagucgcuguuuacugcucucugggcucuggcuguuguuccaccgaagagaagagcuauaaaugacaaguaguggggcuguauguaccagcgcugaagcaauucaugacaauuaggcuauggaaucucuucccccucccuguuacgggauagccuguuaaccugcauuuuagcaaauaacccgucuggagguaggacauguuggagauggcuugagaaagaaguagaaauuuugcuugaagcacuaagcaaccucauaccucuucccgugcugcccauugaacccaggaacucacgcaugcucggcaggccuuccccaccacuaagcugacugccaacccuagagcaaguuuuaaaagcagccaaauaucuaaccugacucaugauacagagucacagcuuuuuugccuuucaguuuuucugcuuucuuugcuguugucccgcacguucccuauuuguuuaaccuacacacuugguaagaagcagccuagcucuugucauagaaauuggacagcuccuccaaggcccgggugagcacacgggucagguagggugaaccagcuguggcucuggggaaacugaugucuucuccucucuuucccacagaaccugaaagcagacccagaagagcuuuuuaccaagcuagagaagauuggaaagggcucuuuuggugaaguguucaaaggcauugacaaucggacucagaaagugguggccauaaaaaucauugaucuggaagaagccgaggacgagauagaggacauccaacaagagaucacagugcugagccagugugacagucccuacgucaccaaguacuauggauccuaucucaagguaaggcuuaaaaauaacgcugcuuccauuaugcugcgcuucgccgagcagggccugacagcacagcagguuuucagagcaaggagagaugcgcugaccuuuguggccaaaggaaaccggcuuugauggcgucguuaucaccgaaaacgucauaggcagaauucuauuuuggguaaaggcaguugcuguuaggauucucuuucaaggaaggaacuguuuggguuggacuuuguuguugaagcuguucauuuguuuauagcuguagccacuaauuacucaaaggguggcugucaguagccacagauauguugguauccugaacuaggugucucgaugguucaaguuaucagcugugguuugaguuggugcuguuucuaugcugcugagguagcugagguagcugagguagcugagguagcugaguugccuucggcuuguaggaaugccaggagagugaauacucagguaaagcccaccuacuguggcagaacaugccacaugcucccugucuuuucucuguccuguuggugguaacagcuguguuacugcaguggcugaccaguccuuccacaggggucacuaagaccauccggaaacacaggugugcuuacuuuaugauucccaacaguagcaaaauaacaggcaugaaguaacaacacaaaucaucucauggcugggggucacuacaauaugaggagcuguauuaaagggucacagcauuaagaagguugggacccacuguauuaaugugcucucacccugcuuggaagcugucugucgugguacuuguucacaggaucgucgucccugacaaagcucagggugucuucaagccccuagacagggggcuucucgcugaguucauaaaagcagugcccuuaaaaguggaggguuagaagacaagaacuggcacaauaaaccuugaaaugauuuuuguggaagcuaaaacuguguguguagcagugagcauuugcugaggaacgaaugcagcgucgacucggggccugcuccuuuucugacuuuaucugcuggucacguuugugccagagugaaaggagggguguagggcuugguucucguggaaaugaaaugguugucuguggaaaguuggacuuuuggggaaccauugguauaccaaaagugaugaucaggaaauaaaaauuaaguggugauacugcuuuguugaugacggugaggaaggguggcaguauagaauugucacacuuagguaacuugagaggguccuugcagugucauacagggaagcaaaccccauguagagacgagcaugaaaacccagaucagaucagacuugggguugcugggaagucuguaacugguggcuuauuccugguguguauuuaagcccaguacauuuggaaaaaacgucuccucgggucauacaauccccguugcacaaggaaguguaauuacaccgaaacccaacucagaguaaguacugucauuucuucuaagaagaugcgucuagaaauaugcuuucuguacuagcugaagggccugagagacuguccuggucuuggccaucugggcuguuagccgccucugguccuggugguggaagcuuguggagccucuggcuacaggguauuuaguuuacuagccgcucugguccugguuguaggugcgugauguggccuggcccgacagauaacacagauccucaggcuguugcacucucaggucucggcuuucuggauagaaguacagguuuucgaucuuucccauuggaaagacaguccugugauugacauuccugguuucucuggagaucugcaacucacggaccuuaaugcuacguugucaauacuuucugaagugaggagagugacuucuaggguuagaugucacuggacuucagacauuuugcuguguggaugcuagugauauauauauauuuaaaucccugcuuccuuauuuguaaaauggaaaaaaaaaucaugauauauacuucaggguugcaaagacuaaaugcaaaugaagucuaagaauuaccugcuuagguugcucgguuccuucgucuucagauuucuucccucuuacgacugguagguuucaguguuuacaguggaaguguucagugagaggccaguggggagaaggaugccggcagagugcugggagggacauugagcuuggguccugaagcaaagcagagaagaccucccauggggaauaccaaggucgugagaagaaacucugauggcguuagccccgaguccugguuggguuucauguagguuggugauucguaacuggaugguuaugggguggcuguaaaaacucuuugccauccuuuacuacuaaucuagucaucuuauauuuuuuagcaaaaauacccaucugaaguuaggaaguuuuggaguuagggucaggaaaaauugcaguuuugcuuagaguaaguuagucuccuuuuucuuccuuuuccuggggauagagcccagggccucucacaugcuagguaagccacaaucaaaucauagaacuguuuguagauuauguuuucuuccaagguuaaagguuaugguaauuguggaggucaguuuuaaugucagucuagacucagauggcgucucauugaggauccugaaggucaguuggccugugggcauuuacucaggaggauauuuuaauuagauuaacugaccgggaaagacucgcccacugugggcagugccauuccuuaggcuagguaagcauaaagaggugcuaaguuggaguuaaauucacauacauuccauugucucuguccuugacugguugugacaguugcuuccggucuuacccucccugacuucccugcgagaugggcuguaaccuggaauugugagccacauaaacucauuuuuccuugaaguuuccuuugucaggguguuuuaucacaguagaaaugagaacuagagcgguacuauaggaaaaagcaguauacugcauccacacucuccacuugggcugauacagaaagccuggaaaugucugaaggaugaggccguaccauuaacuaaauucacuguugguuaaguuguuuaauuugggagaaauuaaaccagcuaggagauuaaccagaagcugccuccuccuaccacagacccaguaccaagcuuucuacugcaguaauauuguauacaagcucaaacgguauugagcgaaugcaggcaggaccagggggaguccuguggcauuagcgagacuguggaggagucagguguccuguuccccgccugcccccguuucugcagcuucucaguaguggugucuggaugcuguauuugggggagaugccagccuaccagaccucuguucaguggucacagccaggguuuuucuccgauccuccggcaggggcuccacuaacaggcagccccccagucuuucugcaagguuugggaaccuguuguguuugaugugccuggcacauagggggauuuuuggcaaauggugacuuaaaagaauuuuuuuuguucuuuguuuuagauauuaucucagucaaauggcuaaaauuacauguguaaaaguucauuguuagugugcuaaaaugagguuuguccuguucuuaccgguuguccuuggucucugucaucauccugacucuauagcaggucaggugugaggcccugaugugcuuuucaaacccucacuccagugcugaacuuucuugucauacugucguuauuaaggacucuugccccaggggucguugucuuuguggguucagauccuagguuuaccagugagguuuuuauuuuauuuuauuuauuuauuuauuuuguuaaaucaguuccuaaaaauuguuggggcauuuuacccacagauucaccagaagcugauguggaaaagguccgugcugaguucuaggaagggccugugggagcaucccacaccucacuuggagugccucuccucagucucugguuuuccugcuuaucuuucccucuccuaccccagagggcacugguaguugccuuggaugaacugaaaagacuggauguaccauccggagagacagagagauccuucuguagguggccggugucuguuccuggccuggauugugcuccucagaaugguuaauggccacuuuccugaccacagacauucugcauuaccacagcagagcacccucugacuccuguacggaaccucugugcuggcucguccugggucagccugacacagcuagaaccaucauuuugggagcggacaccucaguucagaaagugccccuaccagauuggcccgugagugguggggcauuuucuugauuaauggggggagagcccagcucaugcuaggcagugccaccucugggcugaugguccugggugcuuugugcaggcugagcaagccacgagaacaacccagaaaguagcaccccucaaccaauguucuuugccucagcuccugccuugaguuccugcccugacuucccuggaugauggaguugcaaguugaaauaaacaccucucccccucagaguugccuuuuaauggugguuuaucacagcaaugaaaacccugacuaagacagucuuggaggagcaccucuaguguacacccugugguucucugucuugccugcauuguguuaaaucuaaggcacguuuaugucugaagaacuugucuugcugcaugaaggaguggauccuguuucagccugacuguguuugaguacagcuuugugguacucuuccaugcguugguacccccacaccaccuuccccacacugaggguccaggugucuguggaggggucuggcugucagugcugcuggcuggcuucuugugaguggaggucugggauguccuauacaccccaugugcacaggaccacccaugugacagaagucuuccuguugagaaaucugcccccugacaggaauacagauuuguguccggaagcagucauaggagaaacugauguuugguuuggcauacuuuggcagaaucucagacacaaugguugugccuaugggauuucugugaccagaccaacuguggacccugggaaaucgagauggguccauccugcagauacugggcccacuuggaaccuuucuguggugggccaugaugauuguagguucaaguauuguuuggaggguaaugugcuggaaagagguuucagcugguagagggugggcucaggguggcccuggaggucugaggaagggaaauaguccacaguagaguggcuuugugaguguugccuguggccuugagcuguaacucuacuuggcuguagcagugugcaacaaaccagaagggggcuccucucucacugauagacacccugcugagaaguucagcaucugcaauggauacugagccuagaaguccucaaacuuuggccauuagaggaauauuacugaguaagaaacaggagaagugcugaaaucuuuucauuguuguuguuguuagcuuuuuuguuuugcuuuuuaaagaguacuuuagguuuuuuguuuuuuuuuuguuuuuuguuuuuguuuguuuguuuuguuuuuuuguuuuuggugggauuggucuuggaauagaauagagacuuauauagcccaggcuggccuuggucuccugcugccuugcuucuuaagugugcuaccaugucuagcuugguguuuaaagguuucagcggaacaugguguacucagcacugaggcucuuugcucuguacacuccaagucugcacuugcuuccuagcuguggagugaccugcuguguucucugagguugucaucaguuauuuucuuggauucuuguuucccuuuuucauuuagaggaagagagcugagguuuucagaucuugugcuccucggugguggcggcaucaucaccaucaucaccaucaucuuacauuagaucuucuaugugucuuuaauagacaggagauugucuuguguguuguguugguuuauuuuuccuguggcauaauuugucucaguauucacauaguaaacccguguacaggucuguaugcuuuaacacauguacagauuccuauaagcacccauguaauggacuucggaccagcaccaguguuccaaagaacugaacuggucagccagcugucaccaaaccuugaauucauucaccuguucgaguacaccuucugguauuucagaauguccuugaagaaccagucucauaguaugcagccccuuguuuaguggcuuucagcuaauguagugcacaagggguuuagucgcauccagucacccauugucucuuuauaucgacacagugcacugacuguuguauggaucugccauauuggcauuuugaaggcuacuuggguugcuuacaguguuuaauguucgugaguccauguugccguaaacauucacacacuguuuuuuguguaaacuuaaguuuuucuuuucccucagauaauaaacaaccuuaaguaggauugugaagucacaugauauguccugguguuugucuagagugacugcuuccccuuguguucccaucaacacuugguguuugucuuguuagucccuuuagcaggagaggagcuguugugugugguauuuuuccucaucucaugggcuucuggguacuguucacgugguaugcuguuuccauguguacuguucacauaguaugguguuuccauguagcacucuggaugucacacugugacacaggagaccauuauagucaagggcugccaggugauauucaggagagcccgaaugcuuugugugccuuugcagcagaacaccuucauuuaaguccauccgucuguccuucuucuuuucccucucccuucuuccuucccucccacccuuccuuucugccauccuuccuuccucucucuauuuuuuucuuagcuuugaugacuuauaauuuaugugugaaacaauuuuagucauuuaaaauguacaaucuagugguuucuggugcaugcccagaguuucauacucacagacauagaauguugcuuucauccuagaaagaaguccagugcugcucaucguggaucugagacuccggcagacucugaaucagaaacuauacaugagcauuuugugucagacuuugcugaguaucgccauuucagagucaugugucugaugguagcagguguauuuaauuccuaauugcugaauguguuggucuuauuguguugcuaugacacaauauccgggagccaacuuaaauggagguaagcuuuguuuuguuuccugugucagguuugguccgugguucauggcucuguugcuuccagucuguagugagcagacuuaaaugcucauggcugccaggaagcuaacugagaaaggagggcacagggccugucaguucuuuucaaggucauagcccuagugaccuaaguucuuccaccuggccccaccuguuaaaguucuucuagcaccauuagccacgaaucaugugggguuugggccacaaaucaugugggguuugggccacgccauagggccaagccacaacccugaccaaugcuccgguuguauguaaauuucucauuuuuacucuugucacuuugagagcuauuugggaggcucccaucuucagaguauggguaauguugcucugaacauuuguuuagaauuuguucuguggacagacuucaugcucccauuuccuuugacuggacccuuaggggugggagguugggucauauggaacugugcuuagcuuuucugaggaggugguucuuguuguuuucauuucuuuugauguaggagccucucacugugacucuggcuggccuggaaaucguuagguagaacaggcuggccuugaacuccagccugucuuugccccccgagugcugggauuaaaggugugucuugagugacuucuguuucuggaagcuauccagacuauuuugcaagugacugcuuaggauggugaauuguggcucuuacuucugcucuucuguuuuguuguuuugugcccuaguggcugcaaauuagucugugucugucuuucuaccuagguugcucuuaaacucaccaucccucagcuaugguaagaggcgucuucagaggccagcugucacaugucaucgggcaaauaccuaaggguauugcuuguccucaucccgucccaucuccccacgccccccccuugauuuuucuguccaguucugcagcucucaucuuucacuguccccugcucccccccccuuucuuguuguugcucucuuacuccucucacauggaugguccuugggcuuaccuugcugugaguccggcugcuuccuugggaugugcugacaucuucauggcggcuuucacccuugcacacuagggcaggccccuagaaacguggugaugcuuugguuuuuuucucuuucucuuccucuuccucuuucuuuuucuuuuuuuuccccccugacaguugagaccugcuggcucugggcugacauagacagacuuaccuccaggucaccguuagagcuguaacaaguacacuuuugcccuuugaggauuuuuuauuuuauugguauguuugagaguugauucuuccgggaaguaaaauuuaucuucaggggauucucuuccccucuucggaguaccagaacauuugaauuaaacuuuuuucccuuucguguguguguguguguguguguguuuacaucaggucacucuugaacuccuggucccugcugcaucugcuccccaagugcuggcgugcccuauuuuuuuccaguauucacuuuguugugguagcaggaaccacacaccucaagguauuuguccaaaggaagaaacacuaccgagguguguguaaaagugcacaggggaaguuucgcccauuguggaaccacuggagcguucuggcaucuugacgugggggugggggcugcaauggagucuaaacaugggauuagguacucagcccgccagcccgcugcacugaacuucaguuauuuaguugugauacuggcuuucugauuuugugcuucaguuggaccuaaugacuuuucuugucauaaaccagaggagauagguuagcacaagguugaugauagaucaugagucccagacauggagacagguuagugcaagguugaaaucaugggucccagaagugucuugccuacacggugcaucuacaauggcuuuccuccugcuuccagccaauauagggcagcacauggaguuagguguccuuguggagcauauuuuucauucagugcggugagguagcuuauaucgacauguucaguacccaaguucuuuaaaauggcuacuucugcuucccgugcugaagugggaccugaagauaccuugccuuucucuccuuucccucaguccugggucuguuacucuggaauacuuuucuuucuggaagccaaguucucguucagagcugacaggcuuguucuugaggaaaugguccauaagcaccaacacaaaggcacauaagcacauaagcaccaacacaaaggcacagugaguuccuugacuguagguaauguggacagggcuagugugugguaagaaccccacucuggaaggaagaucuuugguucuaucuacggcuuccucuccucgggaaugguagcccaugugacagugggcaugugacuggggucccugacagaucuucaugccacaugcagagaaccuaaagcuguuucuguagcuuccggcuaaggcaaggccuggccaccccagaaauagacagcccuuccuccauuaggcuuagaaccaacuagaaagaagcucuuguugggugagggugaggacccccacguucguggucuugacuaaugacucuuuauguccuuguuucucugcacacugagcuucauucuggccaccugagccucugcucaggggagaagcuuguuggugaccacugugguauuuaccccuaccugaacccgcaugugauuucagaaccagucuugccacagaaagaccagacacacgcacacuucccagaagcacacuuuaccacagacugagaaauggguaacagccauggacaggcugcacugguuucuuuuggcagaggugugauugccaucuuagcaaaggacacaucuguuagcggcuuagugaucuccagagagcuugcauuggaagaagauuuuuuuuuuauauaauuauaagggauuccugauuacgcagcugagagaagaguaauuauaacuguguucucagaaauguagggagaaacuuugauguugaacgaucaaagaccaugugggcaccgagagcacaucucaccucaucgccccucuuggucagugucuggagaaugcuucgguagcgcaaugaauggaggagagcagugggcguuuccugugggaugcucugcaggcagaguccccagugcagagggguugcugagucuggcugcuguuggagccauggggugggugagguaggggcugaggagacuuacugagggguggggggcuggggggggugucacuggguaguuacugucacagucuguguucauuuugagacugggaaacaucuuguuuuagaacuuuaauuuuaacccuugcagauuaucugucauuaacucacuuauacaacauuaauuaauggaguguuuuauacauaggccaggcuggccugggacuucacucuguggcacuggguggcauuaguuaggaucugccucccuugaucucugcaucuggcauucugugccuauuguaggguuugccucuuaagcuggcaacuacacugagacacagcccuugugaggcuccugacuggugugggagaauuaggaugcuccugguuccugcauguucccagcaugcuccuggcuucugcauguucccagcaugcuccuggcucuugcauguucccagcaugcuccugguuccugcauguucccagcaugcuccuggcuucugcauguuccuagcaagcccacaaauuaggcuugcuuucuagaacugccuguagcccucagcaggucuugcccuuccuuccugugucuuacgaacuacuuuagcgacagauggaacaaacugaacugucaguuaugaaugccagguuauuaaaaggauuuaauauuguaccaaacuuucuauuacuuggcauaauauuauaacagauuaguuaaaaccaagucugugucucuguuuuauagucagaaaauaaaaacugguuucacuggcauggcuggugacaagagaaacaacauuuugagucccuuucugcugucuccuuggaccagacaauugcugguccucuaacccgacacuggacuugcuacaaauguacacagugguaucaguauuugacauugacuuuggaagaugcugugugaguuggaugcugaggagggucucuugauuuaccuauuuggcuuguguuugaaacuccuaguguguauuagcugggguuugucucuaccuuacugaaaaccaaggcagauguuagauguuccuaguguauugaagauguggucuuccccacagguccucccagguauuugcuuuuugaaaacugccaggagaauuucacgugcgaagaaaacucuaggacucccaggccacaucucccuccugguaguuacagcugugugugauuuccauguguuuggauucauaggcuguagggccuccaugacccaguccacagaugcccguuagccaauauucacgauucaaggauucccguuuucugagcuugcccacugcuguggcuaccauacagaggaaauaccuugcccccagaaccacuuagguauaguagaaagacugguauaaaagcaaagacugguagcugagaagauuguugggggcaaaggccagucaguugugcuuggugcacccagcagaaggucaccucaggagcaguagggagagaggucagggcuaguuuccuggauccauuucugaagaauuagcagcuuauggaaaagacccuugauggcgucagaguggagaccaagggagacacuaggaaaauucuccuagaguugaaccuccugaguguccgggccaugugggugucagcucaggcugccuaugccuugaaagcauacuuuauuuuccagauaguuuguuuuucucuucagaaccaucauuuuucauuugaaagauuucuucccugagccuuugugggaggcuggcacagccgcuggguucuuccccgucucuuuugguucuuuccacucuugaggaggagagggaacauggcuaguuucagguuucaccguggcgguguuguuuaggcacuaagaguucucugugugguugcguggcacugcucagugcguucucucucgucccgcagcgagccaccagccagcugcaucucaguuccugaaaauggaacucuuucuagucacuuugguuaauuagagacgaguuugaaagcacaggaggugugaguaaugggauauaaauaucaucggagcccucuguugugguuuccuucucugucuucauuucagaguugaagcaacaguguguacaaccagguuggcuuuaggaggacuguuggguugucugauguggaugguaauguguggggugagggacaucagggcgugaacuugaaagucuaggugugugagcugcuugugauggcgcaguaaucccaggaguccaggaucuagcaagaagaucucaacucuggguuguuguuuaaauccgcagugcccuguugugugggguuucuggaguacugcagcuccuggcuggcguaugucccacuguuguguuguguaccuagcaucuguccacagggggcagcugccgcuggucugcaaugggauugcuggcuggagccucuuuuagggcuucugaggagacgcaguaggugcugcaugaguaagucugggcauguuuggguuagcagguuugaugccaugcucucaaagguaugucaggcucuugggaagguuuuauaugcagcauuuccugagaggauuuaacucuggacacccccuccccuguagaugucaucuuucugucaaaguccugauuguagacucccucuuacagugaucucucuaguccuggagcuuuggcaggugaggaaacuggacuaggagccaguguggagagguuaacuuagcacugggcuaugagccccaguguggagagagugguuaacuuagcacugggcuaugagccccaguguggagagagugguuaacuuagcacugacagguggucgucuccugucuguguguuccacauccauggauccaucuuuucagccuuggauaguguacuggucauguacauacuuuaaaaacagacuccuuuaacaacauacauguguaguauuuauaucgcuccacgugucagauagucuagcuauggcuuucggucacaugcaggacugugucuauuauguauguacaaauagugugucauauaaucuaagaggcucgaggucauaccugcagggguccuuaaccaacuccccagggaucgcugggguugauugcuguuggagcuucaugguggugaagcaguuccuuagauguguuuugucugucuuuugaggaggccuugaacuucagacucccugccuccgaaugccuccgggaugacaguuaucugucgccaccucuggggggaaaaagugguuuaaaauuuaaaugacaggauaaagaaaggagcaugaaaaaguaaccaggaaucgguuacugagauuaggauaaaaaugccaucuuuccugggagguggcacugugaggaauuggugugcauucugccacuucuuuagcacacgggcuacaaucaggggugaaaucuuaguugaacggcuucugaguaucacugucaccauaaagcuuuucugucaggacuuguguggaauuugugugaagaagugucugagguuucuccugccuuggggccauugcuuuccuuucccugcugguuagcugugaaguuaguccugggauguggcccuucuagggcggccauugacccuugcccguaggucugacucugggacugucuuucuccaucagggcuucuuguaucugcauagcccuucuuuaccuuuccugccuguuccucccggcucauuguggcuaagccuuucccuuggccucagguccuugggaaacaacuucucuuaauaggccucccuucaggagauuugugcuuggugugccucaaagcagcaaaacagugaagucuuauuuuguuuuuacaguguuuccuuuugcuuguuuuuacaagguuuccuuugagccccauguuuugggccucagguucgccagugcuggcaccacaggugcguugagcccuuguugaugagcuggucuuauguccaagggucaaugaggacaagauaaucauuuuaacucagagcacacagaggcggcggcuuugaaugcagggaacccccugagagccagcccuaacuucacagcuaaccugccggcagaguaaagcgacccacccacccaagcaaggcaggagaauccucagaaaugucuucacacacauucaacacaaguacagauguaacaaacuccuugauguagauucccgagagaccugaaacacuugggcccacgcaaacgcuuugcagccacugauaggcagaguagcaacugccagagcuugggaaagcuguggggagcugagggguggauagaagaggacucccaguguucuagagcguaggaggggaacugaggauggcagcaguuaacuggaucuuucuaaauugauagcagagaggauuuugacucuuuccccagcaugagggagugauaguguuauaccacaaaacccaucagcccgggugggagaaagagcaguuauuccagugucuccggucugcccuagauguuuguugaaaugucacaccguguuccacaacugugugcaauuaccacaugucaaggaaaauaagaauaaaagcuuuguguggaugaacaggucaaggauauaggguccuucuuugaggcuguuuucaaggaaaacuggcaguagauuuuccucauggcgguggaaggcaagcuaggcauagccaccacaaaaccccucauagcuugucugucaguguuguggccucucugguuguuaucacaggacaugacagaugacaacugcaccugccuucuugcagaugugcgggggugggggagcgacugagggagcacccucuuaugucucccagggagcacuugcugcucauuuucaagucuccccugguaggcguccuggaggcuuuccuaaauaacuucauguguuuuccccagaguccccauucuagcuuguuggaugcuacugcuucucagugaccucucgguaacagcccacagucuuccaugaugaaagcuugucuuaugacuuguaauucagcagcucacaagacugcuccugccuuaauguuggacacuauguccugaggcugcaagucagacuguccccagggugcaccuagcagcccuuacugacucagacucagacagggcuugaguauuugaauacacacacacacacacacacacacacacacacacacaccuucauccuuucuuuccuuuacccccuccccucuuagaucauugcuugagagaauaauguacggggcuggggagauggcuugguugguaaacggcuuugauaacagacuugagaccucuaacccugggaagcugggugugcagcgcugugcaccuguaaccguaguacuggggugagguggaguggucacagagacaggaggaucucugagcuggccuguuagucuaccuaauuugagcuuccagguucagugagagauccugugucaaaaauaagacggaggccagccagccaguucagcagcaaaagcacucgcuacugagcucgauagcuugagcucuuacuguccucugaccuucacacacaaucuggugcuaaugcacaugcaugcacauguauuugugcucauacacaaaaugaaugaccaaauaauaaaaaaaaauuuuuuuaaagaucuaauaaaaaaauuaaucuguugagaaggacacaggauuguugaucuuuggccccuauaucuaugugcgugcaugcggaucccacacaugcaccuauucaggagcuaucuuuggauccaugaaugaaaaacauacauguuaucuuauuuuuaaaaugacuuggcuaccucaaaggcugggcaccccuaaaccuuccccugcuaccccaggcccaaucgaggaaguggccaguggccacuuacccaaaaucucauauggcugguuggcuuugucuccugccgcuccugcgucccacccuucuuccccgggucauggugaaucuuccguuccucuuugcuuccuagccugugcaagucuaaggaucucccuugcccaaccaaaggauguugccaucuuuaaugauugcucaaaaaccaauugggugcaaggaccuuuaguguuagaacaugcagauuaccaguugaauuaaagcauuagaauccaucuccaauaccucgcuuuuccuguccaaauuaaaaaacaaaacaaaacaaaacaaaaccucuucucucagacauaaauugaguacaaccacaagaaugauguaaaucauagauaugguauacaauuaacccccaguccaucauauuuaucuauuagauacucuaccaucauuccuaacuuaaagaguuuucgauucuauaccugaauuauguuuugauuuuagcccauaacacuaucugaaaaaucauguuguuaauucuauaucguaucuuuuaaugcuaaauaauuuauguuuguuuaugggacugcaauuagucuuuaacacaucagaaauccaagaaugaauuaaauauuaccugaguauuuaggaagcaccaaacauagcuucugaaguuugacuguagaggcagccgacuaccuggacaguccccuaauuguuuauaacauuggagcaucugucuuagccuuucgacccagagccaucuggcagacccagcaaugaaguaggaauauaaaggacuggcuuacccugucuuggcagagauuauuagucgacuaucccacaucuguuuguucuuuuuggacaguauuuugucugcagaugauaaaggcaauuucugccacauggcuacuuuuuugaacggugaaggggcacccugucaggagcagacaugucucuaguugaaauuucuaauaauaaugaaaugauuaaauaucagauucuguggacugauguuuuuugaagucuaucuaucuaucugucaucuaucuaucugguauaucugaacuguuaaaccuuaguuacucuuagucauuucuauuugaguaaguugaaaguacuuuauuauaauuaaaucagaauuaaccuaaccaugaguuuacucuauggccccuaacuuauuuaacuuaaucaucuuaaacaguuuguaguaggagcuauuaaaagaauugggucaaagccuuguguucuuuuuguuuuguuuuuugagacaggguuucucuguguagcccuggcugaccuggagcucaugcuauagaccaggcuggccucagaaauccauuaucucugccucccaagugcugggauuaaaggcguguaccaccacugccuggcuaaaguguuguauucuuaaaugaguuucauagacacaaugccuaucuaaaaguaacaauauuaaucucaaauuuuguaucaguauacagauuuauaccaaugaaaaccuuaauucuauaccaauauauaaauucuguaccaauauaaaaaauuauaacuucaauuuuacaucaauuacaaagacuucuaccaauguaagaugauggcugcacaaugcuuuguucaagaauaaauuuagcaaaccaucucaucuauuuccuuccuguucaaaguuaugaccauuuccaaaauuaucccuuaaaaugacaaccuaucuauaauuuguaaaauaaccaaaaacagacacccaaauccaaggaguggggccaacaacucuccauggcuucuuccugcugaauaggggcgaugagaaauucuuuaaagcgguggggaaauuagaaaauugguuagacuuaaggaagcuagcuuuaacaucuguuauccagucucuguaugcuuagaaggcuaagggcuugguugaaguucucacuggauccaucugaaagguuggaugaggcgagaucauuuggaaucaguagcaguuccugaagcaguucuggaggcaagucaguggacagcgucaggaagcaggggcuagaagagcaggucagugcagcaucucagaggaugagucuuguuaaagcuguacauucucacaauaaaauuuuagcaccuuuaagauaauuguaugcagccagggcuauacagagaaacccugucucgaaaaaacaaaacaaaacaaacaaaagaauugaaucguauggauugugcagggugcacagaucaguuaaggaugaaauuaagcuccuuguuugaacagguaaaagacaacuuuuuauugguuauuuuuacuaauaaccaauugugauaaaucuucauuuguacuauaugaaggagggcaugaggaauuuuaaggaucccauaaccaacaagauuuauugucucauuuuagcugaaguuuuagcuagagacacuuuuaugucuaagccaguuacugggcuguucccauguugaagaaucagcagauaaauuuaccugucuuguuugacuuucuggaaaauuucaagaucuccagggggucuuccccugucauaucugauccauaucacucuggaagggguccagagccuuuucuccuuugugguauggaaggcagauaagggaacagacagggggguuucucuauauuguguuaguggggaaggaaacgugcgucauggauucuguucauggcucucaggugauacagagggauaucauaaacugaacucuaaagcuggcaguaggucaggcuguggugugcacagugaggaaguuggguauauauaucaaggcagagacuggaccguggcuuucagauuaggaguggccagcgagaaggaaguggguagcuuuggagcugggcccugaagaagggagcugggaggugguauggcugcaaagacagggcugcuguggaaaacgaauguaccacaugggcuugcaggaggaacgguggugggaagagccugccugccucucugggcagugugcuaggguugagauuuguguuuguugugugcuucuagauaugccaggcucaccaaggcuugcuguagauguguuacaccggggagagugacggggaccaggaaaugguaggauccaucaacugcuuugaaacucugaacggccugggauguuuucuuagacauuuggcugguuauuuuauuuugaacacuauuuuaggguuaggguuacuuccaaaugccuguccugcuucugugcugauuguuuauauauuuuguuauccuacuggcuucaagagucugguaaacucuggcuuugaguuuaauauuucauuuaaauccugcaaauacuccgagaggaggucgcauaggcagguuuuuaugaacuugggcagauguagggcucuccaguggggauguucacagaugaggguaaguuggauuucuguuuuaggucuucucuucucuucucuucucuucucuucucuucucuucucuucucuucucuucucuucucuucucuucucucccccucuccccccucucccccucuccccccucucccccucucccccucuccccccucuccccccucuccccucuucucuucucuggguuuuucuaacaguccuggcuguucuggaacucacuuuguaaacuaggcuaggcuggaauucacagagaucugccugucucugcuuucugagugcugggauuaaaggugugcauccugacugacuggcuuggcacaguguucuugagaauagcuaaggcuggccaucugugugagcacacacagacuggucuucaggcaauggaugguuuuagucuaauaggcccuggguugucacgguuacguggagaccaguggccagccauacugggcaccuuccuucuugugcgggggccuccuugcucucuaugguuguguggauacccuuggaguugaccuucugacagugaaccaaagccuccucccaugccuguggugagccccugagcaguucucuguugcucuuggcuauguguccuggagaggaggcaaugaguuugcucagcuccugcucgccauucuuccagagcuggugccucuguguauuacuucaaauuggugcugugugggaguccaggggaccccgcccucucaugugcugcagucaggacagccccucuccauggcguucuuuaucauuuggaugucaccagcuauuauauucacgacugccaggcacagcugcagcgccggccggccagggugagagucacauguuugucuucugcaggaguaaauuucaaacuuuagcaguugcccuuguccuggagaaaaugagaauggcugguugaguccacgguaccaucacagugaccaggagcgaagcagagcuccucgcuuagcuccgguggacuaaacaccagcaaagaaaucuuggcuuugaaagcacaagaggaugcuuauuucacagucaguuauggggcaggcucagugcccaggagauauaaaaguucugcuuugugcuguuucugaggcuggguccagcauucuacuuucuccccugaacacacuguccuaguguaauugaagaaggucccuggagacacguggcaguccucucuuggguuuuuuaucuacaaaguuggguagaaauaaaaucccaauuaggcuaaauauuuuacaaaaaugcagcuguuuucggcccaauguuaccuauaauuuaaaguaaguaucaguggacucuguaguucuuuaugucccaacacauacaugucuugcauauuuaaaccucagccuggggucugaacauuguuguggcugcauagaacagugaagcuuucuauucuaaagcugccauguuccugaaacaugguaugugguaggaggucagaaucuuaaucauauuaugcaacggacugcuuguuaaugaaagagaaggcuuaguucuagggagguaaaugggcugugguuccggagccccugcagugcggcaccaggcucaggcuuguggguuaaggacaucugcuggggaaacgcagaguggauugccaggagcagcuucuuaagaccucucagaggcaccacaguagguuuucagugcuguaauaaaacccgggcagugcugagugaggcagagcuagccuguaauuccaguagucagaggucaggagggucaggaguucaagguuauccccagcuacauagccaguuugagaccuuccuagguaaugugagacuuuguuucaaaaacccaaaaucaaacagacaaaaaucccaacucuaaacccaagagacagggagauggcuuuaaguguuccggacaaucuuaguuugauugcuagcacucaacuauccauaacuccuugcuccagagaaccugacauccacuucuggcuucuugggacacauguacuggugagcaugcauggucccccccccccccccccaggcucugguguuucugagggcaucagcucagccacuggagcuuuugagucacuccugacucuucuucacccacuaugccacaucagcaacuauagguuaguuggcagaguuuggacaaaaacaaacucccaucagcuggugaccguguaaaugucuguuccagcgccugaacacaacagugugcuucucucaccagggugacaggucacagcccucccuggccacacagaugcuacuucuguccagcaggugacggugucucagcucucagaccuuccugaguuuccucugaugugugcgcuguguagguguucauucacccuuuuguuuaccagaagcuccacaaagccaagucugcaaccccaucucacagugcucugcgacacccgccguguuuaugccacacuuaugccaggcugugugacgaccagcuuucccgaugccgcgacccuuuaauacagcuccucauguugaggggacccccaaccauaaaaucauuucguugcuuuuucauaacuaauuuuacuacuguuaugcaaauaucugauaugugacgacccaccacccccaggguugagugagacccaccaguucagaaccgcugguucaggugaagcucuggaaaucgagcaagaggaagccuuugaguacacugcagaaggagcaggaggaggggagcugggucucugccagggucuacagccuucccucccaugagcccagggguagagggacacuugagcuaaugcagaaauagaaauuugcaggcacuacucacaugccagggucugucucaccucaucuccauuggcaccuugccaggguggaugcuguggcauuuagagcacacaggaagaaagggaggugugaacuugccaaguagugggugguggugacaucuaaggaagggcagaggucgucuucaagccaggcuacaggacucauguccauccauggucaucauccaagcaaaaggacaucuuucauuccuuuuauuucuucacaaaauccaugucuuaaaaccugcagccccaaguugagcccagauccuaggucacaugccuugaucuuacaauuuugauauuaaugagcugagagucuuucaggguacagugcaaguauaaaguggaucccuuauccgaugacuccgacuauaaagcccuugcauuauucacugugaggaaucugcccuugcucauuauccugaucugggauggauuucagauuuacaaacucccauacacagggguuucuggguccaugcaucucugccaguguagggcagcuagaggugcagggugggggguggggugggggggauauaugucuuccuucacagcucuucagcuguuagaagcugggucccuccggaaucagcuauucuucugucuccguuuuugucugaacugaagucuaaggcuacauugugucuagcuuguuacacagcugcuuggcucagucugauccuaaagauugcagagcaaauguucucagugccugaacucucuuucucugcaccccuggucacaggaucagugugggaccccauucucagucaccauguucccauucuuaggaauagucccaagcacauuugcuugugauaucaagucugcuuugugcccgugcugaauucacaucuuaaggcaagcacuaccaaaacaaagagaaaugagaacauucuguuuuguggcugaucucccuaauacauacauacaagagaaaggacuggggauguagcucagcgguagagcaguugcguggcauaugagguucuagguucaauccacaguauuacaaggaaaagaaaaaagaugggaccuccacagaaaagaugagugaagcauauaagugaggcaguugcagaaagauguaaauaauaugcgugaccgugggaaguggaugaagcccuaaguaacuguguguuguugaucugggcauggccaugucagggaccccauagucccaaucucaugagaauggcaaagcggggccaucuccugccccuccccuuauguucagacaacgccaccauaauuuucuccugccagauguuuagggccugaagacugcuccccuauagagacugcgccuacugagauuaacuaagcccgcauccuuguuuagcagcauguaauaacccuuccucauguucugcuguaugcaguaaucucaccucccuguaacacuguauauaauauacaggcugagcuccgggugcugcagcuucuuuaucagagcucaguccuggccccagcuuuucccugcccagguaucugguauauuuucuuuauuccuuccuugcccuagucaggugcacccccagagcuguucuggucaggguacaugacucugcugugugacguucaacugugcauugcguaggacguaagcagcgacuaaugccuaccuuagaugccgcauccaaguacauggugggcagagcucauugccgaaguuggaagccugaggaggugcuucaaagugugaaacccacagagcggcagcgcaaagcagcgacucggcagcuugacuuguagacauuugauaagugucaguuaagguacaggcucacccaagcuacugugacauucacaccagguuguguggaucaagaugugcucagauuggguucagaucucggucuuuuuuguaaggucucuuacuucacuucuaaaauggaacagaaaagaaacaaaccccaaacauaucugcugaucuuaagccuuucccaguaaugaguauucagcaugcagccuagaguagguggcccaagaaggguguaucaaccuuaguucaggagguuggagccugcagccgugccuuggcaggcuuguuuguucaggggccucucuuuugcuucuccuguguccuuaugagaucugcuuguguugguguuucuaauaauaacacaaugcagauugaaguauggcugcccuagacucugauuuuuacuuacucccccucccccccuuaaauaaugucuccaaauacagccaugaaguuguuguguagccaucuuugaggggaccagcucaggccugaggaaggacgguccuuguccuagagcgcagccuccccaauacagguacucacucauucugucugugacggcaggcuucgggcagcucucugugauggccugaaaggaggacgggauaggauaggugucacuggcuuugggacgaaugacuuccacgugcacaccaaaucaagcaggaaccugacagaggaaagcaggccagggguuccugggguuuuuugggucaaagccuggcucucucagucccaggagccuggguuugauaacccauucucuuugcaccaaccaaggacacaaguaguggaaagcaagagaaaggugauuuuauugagucucuccaaccccagcaucucaugucugcccuugagccugggcauugacaugcugagauugaaaauagaaggucagaagcacacagaauuaaguagucccugucaggcuuggucacugucccaccauggacccugucacugucuuaguggcagucugucuuuugugaacugucuuccuggcagacaggucccuccucuugagcaucacaccccuucccaucucaguaucugggggaaucuaaagucugauaacacgaagugucucucuauaaaaugucuucucucuuuccagggcuguuacagacaaacacaaaauccaaguagaaaugccaaaucuucagccugccuuugucuuguauacccaagugagggggucagugcuuuucagcaaaaacaguuucuaaucaccuauuagggccucagaggacagggugggggguuggggcacacgauuauuacuguaaugaaacauaacaauaaaugagaacacacaugaacuagaacguaguggccuagauucaccuccugucuggaacugauuauauagcacaugcuggccuugaguucuuagucuuccugucucagugccugcccccacccucccgcccaugcugugauuacagaggugcacuaccacaccagguugaagcucagaggauuuaagugacuugccucaugucuccugguggcuuagacagucuuucagccucaguuuuaguuugcaguggucacccuuggccuggugaguggggcucaguuggcuuucugauguaaguguucuugggguggcuguugugugcauauacuggcggugugcagacuucucccagucauucauucuucccuuagcacuuacaccacgguugucaugagggacuguuuaaccuagagaugauaaaggaauguaugugggcagcuguguguggguuaccugagacagcccguuugcaugaggaacuugaguguccuuggauuguguaauaucagcuuggcucuuggaacccauagacacugguggacagguguagaccaguccuuuugauggguuuuugucauuaauggaacugauaggggaucccaacagauggcuaacuugaggugcccccuccagugcugguguugugaauauguguguguugagccuuuggguacugacuucagggcugugcagucauucugugcacaccagcagguucuaagacaggauucucacguguuccuguuuuucaaaaauguaaauuuauugaauuuguuuacuggcaaguucaaacauguauaaagugcuuucaaguugcuguacaacccugcccucuaaucucccuccuaccucaucauucuuuccacacaaaaucucuuccccacauaucucucucucuauguugaggcccacagauuuuaaccaagaucacauugugacuguggguuuagaacuguccuccgaggagccugguagguuccagguuccaauagugucucugcuguagccuaaucuccacagcaacucuguccuugucaaaaugggggaggugagccaggcuuaugaguccccaucaccgaguaggaaagaggaagacgcaguuggggcuauaguuuggggguuauucgguuauucuggcccagcagaggagggucacaguggagaagagaaugggaggagccaguggagagugggaggagccaguggaggcaggugagcuuugugagcugagaaggaagccuggaaggcagaucacucacauagugcaguuaguagguggguaagggacagcuggggagugucugcagaagggagaguucuggacauggcuuugcuaaucuagggugcuccucaggugcccacccacccuggcucuucucacacucuuccuccauguuagcuguucccuuccuuagugccugacagcuguggacuuuugggcauuggggugaaggcuguggagagagcuugguccagcuucccagggugacagaguggccacuaugcuuacucacccucugguugccaaggcgguucaacccaggguuacacucugauacaguucucacaccucuguuguugaggcuguugugaguggggcagggaauauguuggagccuuagauacaagacugcaccaaggucagucguuaggaaauaguaacugcaguguuccagacgcccucugcucuggugccacugaguuugggcagguccccugcuccccuguuccaggagaaaguuggacagaagugggcugggcuggucuuucuacaucaccuuccuucccaggaaggaguuugaaucuuuggucuuuuagcuguagagcuuugccagucaguacaggagccuggugguguucggaugacagaaaccugggucagcgccuccugcucaucaggagguguuugcuucagugagcucuggagaggccugaggguguggucaccugggguuugcuguccaggaagcugugagguaaccugagcagaaaggucgcuucugaggggcauugcacaggggacaggguggagacaaggcugccuggagcuuacuuugcuguuaacagacaaagccugggaaauucaagagaugggagcucaguuagacaagccaggacagaggucaugagggaguacaaaaacaaguuagucccagugccauuuagggaaacaguuuagagucguuccugugucacccagaaaguggcuuuccuugcaagacaguuuguuucuagcuaucaacucuaagguaccuagaaggagucacauuggccuucaccaguagccaaucgaagggaacugucaccguacuaacccggaauuuacuauguugccaagacuagccuugaauucacugacuccugcucccaaaugcugggcucacacaaaagcuccugugcccaagauaccgcugccuccuucucucuccuuguccuccuuccccuccuucucuagguuagcacgcagacagauagguuuaaguauggcauuuccuccucuagguuagaacacagaccgauggcuuuaguguggcaucuccacacacguaugccauuauacuuuguuuuuacccucccuucuccugaaacuuguggaagucuaagccagcccuucuccaguagccaugacagugaguaagcaccauguuugagcagauccagauaccuugucaaagcucugggccucuccccagccuggacucuugaccuucauguguuaguaggcuugccccuuacaaagcuugaggaauauuccuagaguaguagacgacuucaccgggacugcuuagguuuaaccucagauggcggaauuuacugccaaccccaaaaggaccaacugcugauguugcuugugcauuaguaccgcccugacguuagcacgcggccgcauugcuuccucucuguugguagugaggacugcugucacuggauccaaaaugaaugccagacagauacacgguaguugguucaagucaaagagagggaauguaggugaauuuucccacuuugagcaacaaaggcucaauccuuguggugggaaccacaugguggguagguuguguucugagauccaaggugcagugcucucccagagggacaaaaaccccaggaagggaacuucugugugucuauccccagcccaaccccagcgaguacaaaagcugucuuaaugacauaagcagugaggacuauuuggacccuuggggcauugauuuuagaacccaccuggcauacaaaccugaggauaugcaugucccuuguagagaacuccgggaggugugagugagggcagaguagcuuugagagaggcccuggaagaagacacagugacacacugguaaagggggcuggagagagcauuuggugacuuaugugggugucaggaacuguggauguggccuuagguucugggggaagcuaggcuguucugagcugucagggcuggaggaggagaggagggugguggugguggaggauguugaugaugauggagauggugaugaugaugauggugaugaugaugaugaugauggugaugaugaugguggugaugauguuggugaugauggugaugaugauggugaugauggugaugaugaugauggugaugauggugaugaugaugguggugguggugguggugggugggaaguguucuguucuugucugugugcucuuuacaaaucuugacuugguuccagguuuucaagcugggcuguguaugagggacacccuggaaagugguuucaagacggaaacgcccucaguccuguucucuaacagggcuccauuucaguccugcccugaagauaccguaggaggguuuugugcguguagugguuuugugcaguuguuauuuacacacugugcguugguugauguuuauaauaugugugggucuaaaauaauaacaaaauauucuuuccacuuaacauaauuuuucuaguuuugcuuuaaaacuaacucucucuuguuuuugcgucugcaggauacuaaguuguggauaaucauggaguaucuugguggaggcucugcccuggaucuggugaguaccacucuggccauguucucccuccugguuugaacaggaacacuuccauuucaccuuuuccuuaaggaggcauaaaacuaucccuaaccuguuuuuguuucuuauauagaacuuaaaguuacaggccugcuugugaggccacugggagagcgggccauuucacuauaagccaguaaucuaaucuguagcagcgaugagggcuuuuaccuggaauuaauuauuuuaucuaaguccgcuuggcuaauguauuuuucagaccaaauucaccaacuuugguagaguagcuauuauuucuguaauagccaccaugguuuuucccuuuauuuuuauuguauauguaugaguguaucugcaugaaggucuguacaccacuucaaugccaggugcccgccgaguucagaggagggcuuuggaucccuuggacuggagucacaggccguugugagccucuauguggcuucuggggagagaaccugcgucuucuuggagagcagcaagcacucuucauugcugaaccaucucucuggccccgucauugugguuuuacaguucggacuguaacagcuuucuccauaaucucguggcauuuuccucucagaaucagacaguguacgauuauuaaggcauggcuuuagguguuggaaaaguggucaucaggcaagauauugcacacauggccuccugugaucuugccagugucuguggugcaucagaacagagcuagccuggcuuaguguuggcuccucucuggacuugcccucuaggcugaucagcccacagacugggaaguggaaguuagggagauaugucugcugugccacaucuggcuuugugggggacucagaaaugaggcuucagucacccugaagcacuguuuacacuguguccaugccuuagaaacacuguugcccagcucuuguauccugaguuuguuguguccaugcuuuagaaauacuguugcccaguucuugucuucuguguccauguauuaaaaacaaugugucuggggccugaggggauugggucauugguaaagugcuuguuaugcaagugugaggaccuaaguucaaggcucugaaacccuagaaccccagacuccugucugcaucccagggcagcaaggcacagccaggaagagagugggcucgcuggucagccagucuggccaaaucagcgagagaccugguauccaaagcuuuggcagagagagggcuugaggauggucccugauggugauugcuggacuccaaacguacucagccaugcacgcacaaaacacacgccggcaugcacauacaauaccuacaugcaccaguguuaaugaaauuguacuccugacgccuguacuggguagguuugugaauaaugauccccagauagucugaaugcuucauuuuagcuauuaaagauuaaucuuucaugguaagaugaggaaggauaagagcugcaggucucacagaaauuuuuuaaggaaggagauucccuccacccccuuugagagcagcuccuuucuuauagcaacagcaccuuguaguuaguuuccuuagaggauaaacuucuaaaacaacaugucucuccagaaagcuaauauacuaauugaggaaauugcacauuguugcaaaccauaaagauucuuuaaaauacuguucaaagugaaaauuuaaaaaacaaguuaauaugguauaaagcuaagcuguaauauuaagugggaaaaaaaucaacugaauguauuucaugguccuuucuauacauauccacacuccacacacacacacacacacacacacacacacagacagacaaacaaaaaacaaaaaacaaaaaaaaaaacaaaaacaaaacaaaaaacccaacaacagcaacaacaacaaaaaaacgcuucacuuucucacuguugggggcaauacaggaauguagaaaauugcuuucuuuuaugaaguuauuuuggcuauuguucaccaugaauuuaaguuguagcacauacagaguuguuugcuggaacucugucugucugacagacagcccuucagagcagcuguucuaucucuaagugcuuaaguauguucacucacaggacuacaguaaucaaauuuacuugaguuggugucugugcgguuuuagaaaucacaguuggaggaaaugcagaaagaggcagccgcuuucuuugcaugugguuugagaguuccuggaccccaccauccuaauaaacaguuucuuuuuuuuuuucuuucuucuuucuuuuucuuugguuuuugguuuucuuucuuucuuuuuuuuuuuaagaaaggguuucucuguguagcccuggcugucuuggaacucauuuuguagaccaggcuggccuccaacucagaaauccaccugccucuaccucccaaaugcugggauuaaaggcgugcgccaccacucccggcucuaauaaacauuuucaaagagaagaaauggcauuccuuuugggaucugccugcucuucuuugugaauggguguggaaaggucguggugcuccuggcugagugggcuggauuuauggaccuggccuucuccguccugaguccucugguacugcuuuucugcccccacuugauucuccuuuccaucuuuaucacauuucugucuuuuuuuuuuuuuuuuuuuuugcccccgaacccucaaagaggaaaaagaaaaaaauacuucaguaaugaaauaugguaauuauguucugaauauugaaaaaaaaaucagaacuauugacaguccucuuuaugcauuuuagugaaugcugcaugaaguugggggccauuucuuugagaaguucaaacuggcuuuauuuauugucucuaauugauguggaguuagccuguugccugcaggagcucucugaggaccuguaagggaagagguaauuguccugaugcugcugugaccagcuuugcuaaaaaaagagaaaagaaaacuacccccaccauguucucgauccagcaugaaggacagauugacaggacagcucagacauuaagagcaaugaguauggaaaaaguguauauuugauuuuuggacgugcucaaucuguugaucuauuuuuuuuuuuuuuuacuuaaaauuuaaauaauaaacuaaaauauuuguaggacucuuugcucacucuuguucucuggcauguacucugaaaccugcugucugucaucucugaccagacugcgaccuccagggcgccaugacuuaagagagcuugcuugagcacugcagcucagggcuuguuagcuucuguggggucgagucagugcacagggcagagcgccaugccgucauggagcagagucuguguggagcugcauuugaggaugcacagggaaggagggugggaggggaagggagggcuggaugaagagcaucaaugagucgugagaggaagaggguuuagcugauuagaagaucaggcagucugcugccagggaauuugagggccggccagccuugagaucugauuaugaaggaacuagggcaagcagggaaagggagcaagcuuccuuuuuuccccagucuuauauagucugccuguagaaggcguggcucagauuagaggauggacuucacaucaaaugauucaguuaaucaaaaaucccucgaguauacccaaccauuuuuggguuuucguuaauuccagguguagucaaguugauaacaagaacagccaccagggugagcaaagaccucaguugccgcucugcaccccacacaccuuuuugggaugucacacacuaucacaaccaugagacuugcagccacaccagcuuucauuuccuugggaguaggaugcauuaguugguucugguuuuguuuuguuuuguuuuguuuuaaaauaauuuauuuucuauguaugacuaaugcuuugcauguauguauggguaccauguacgcgccuguggaagucagagaguggcuuuagauccccuggaccuggaguuuuggaugguuguaaaccgucaugugagugcuaggaauuaaauccuggcuccuccccaagagcaaugcauggucuuaacugcugagcugucucucgagcuugguguuuuuggaggcggucucuggauguagcccagacuggcuuggaacuugaggcaaugcuacuauuauggcugccuuuuaaguacuggguaggacuucagacaugagccggcacaccuggcaacacaguucucuuuuuaagaacagggcugugucuuuccuuugacuaaggugugugagcuuggguuaaaaaggcagucauugucucuucacagugucuuagcucaccugacugacugacugcacucgcucuguaagagcugccuuuaggcccaccagacugcugacgugucucacugcuaggaguucagugaagaucucugcacaagugagagugggugucaccaugagugcuuuccuuuaaauggggguggagggcaggacagaccacguagugucacaugcguguucuugcagcuccuuugaguuucucagaauaaaagcagucacucccucagucagggcuagcaaguguuccaugugugugcuguauaacacauucugaaguccuaggaauugaguagcuuuccccgcauguucccucucuggggaacuggauccaaaaaugcagaucuagacaguccugaugcgggcagcuugaggaaggaaccgcucacacgauucucacaacugcuuugugcuuuggugacauggaccaauccccagggguggcuugcagggcugcaagugugugcuuugggggcguucaaaauacagucccguggacacagggacaaguagucugucuguccauccguuuauccauccacaccaggccagcaagcauauuuucuauaaucuccucucuguccuuaauagauugaauuuuuaaaauuuuucaguuuuuugagacaggauuucacuauguagacccagcugaccuugaacucacagaagagaucuggcuguuucugcucccucaaaugcuacgaugcaucuugauaccuggcccuuuuagauuucaguuguuuaggcaaaaauucugcuuuauguaaagauaucauucaguuuuaauuauccuauauaucuagcauagauuuuguuucuuaaacucuguguuaaaguaguucccaaguggcuaaugauuuuuuuuuucccuuguuaguuagagccuggcccuuuagaugaaauucagauugcaaccauauuacgagaaauucugaaaggacuugauuaucuacacucggagaagaaaauucacagagauauuaaagguaaggguuacccguuuuuguuuauauuuuuuguuguuuggagacaggguuucucuguguaacucuggccauccuggaacucauucuguagaccaggcuggccucagacuuagauccgccugccucugccucccaagugcugcaguuaaagccgugugccaccacugcuggguggugagggcagcgcuuguuuucauuucuuugaaacacgugaaguggcagagcccacuguacuccugcccacucuugccuaucuggggucaggcugggcuguuuucaaaccccagggcagcuugcucuuagggguccucaugcccugugaggagagcaagcuucagccuccagggcgaccuugggaguagcagugcagugcguaaggccucccgccuuucuugucuuucagcggccaauguucugcucucugaacauggagaggugaagcuggcagacuuuggaguggccggccagcugacggauacccagaucaaaaggaacaccuucguggguacccccuucuggauggcgccggaggucaucaagcagucagccuacgacucaaaggugagagugcugcccccagaugcuugguccuucugaucaugcacauucugccugugccugaggugggugauggugauucugcgaccucgguuaaugucagcuuccuucucuaucuccugcuacaccguuggaucccuguuccucuggccuuaguggcugucuuuaccuuagcucauguuugauaugcuggggaccaggaaggagcaggugugaggaugaacacagcuuaggccuucugagacaugcagaccccagaugguuuaggcuguggggggucuggacaguuaguagagagggcuggccaugucugcacaugaaggcuguugaacccuuuggcacaguggaugaggggcagggccuggacagagcucugccugcucuagguaggacaucuagagaaaggaguccucagaaaaucccacagcagagugggcaggugugguuccucagugauuacaacugcuuguuuuguuuuauuucaggaucuguauucucagaggcucccaucaacaggagucugucucccucucccucucccuacccccccccccccccccacacacacacacacccgucuggcugcggcuccuugucggcucuguuccuaaugcuuucacucuuugcuuuuguccuuuaguuuucuguaaucuuguaguauagacuagaaaugacccaaccgucugcucaggucagagaccuaugcacaauaaacaugaucaucggagagaauugacuuuccugagcaccaaacuuucaaagcagaaacuauuuaacucagaaacguucacaggccgaacacggguuuucuuugcuucuuuccguuuacuuguuuauuuguucuuucauucauuuauuuaguaugauugcugacgcccuggaaagccugaggcuucagauucccagagauggagguaggcaguugugagcucccugacaugagugcugggaaccagacucggauucucgccagagcagugugugcucuuaaaugcugagcuaucucuccagccccuuaaaacaaaacaagcccuaaauuaguuuugggucuguagcugaagucggauagucugaacacacuggugaucuccugccucagccuuuguguguuagcaggccugacuugugucucugucuugucuuuccuuucuuucuuggacccuccuguguguagcagauuccuggcgucauuaaauggugugugaagcauaggguaacucccuuuuggaaccuugggugcuauuguaagguauaugccauguggcaugucucugugagugaggauauagguaucccacguucuggcuggcuccgugaacuuaaagagaaacugguggugugguagauccuguaggaguucuggcccugucauccagcacacagcaggaguacuucagguuagucaggucuuucucugcauuuguuucuuguuguuuccauaucuucuggaagauggaucaccuccauggcuacuucuugucuaaagcccggucuucucuuggccuuuuuccugaguucugucagguaggaagguggguguauugucuaccauuugcuguuuguauucgugucuggauuuugguaggagagagaccaggauccagguaguaaauuagcuugucagccauggcccuuacggcuuggggcucaggccacccaauucuguuguacccugggccacucacuuucuuguuucccagagagcuuuccugaucucccugccauaccagauaccucucugaaguggguccuugguguaguucagcuuucguuguuuuggacagggacuguaccccccuuaccugacucgucugaacccucaggugccacauuuccuaacaagcagguauguguacuggggcuugguaucugugcuguuuggagaggcauccugucuuccuagucuccauuuguugggguacgugguguuuaaacacgauuggguguuuccauggcuucugaucacaugccaaauggcuugguguccuggaugugccagcucuguguccaggcuugaaggugggcaucagaggcagacagaagacugcccaggucccugcacaaguccuggggaauggcagcucagccaagauagaacuagaggggugugggaacgcuaggcaccuaagaguucacugccacacacuucucaccuguguggguucaaauacuucaugguuugguuuagauggacuccacuagagagcccagucuggucuugaacuuucaguuccucuugccaaccaaccuucagagcugggguuacaguggccugccacuauuccugguuguauucaggauguuccaaagaggaaucucagguugcuuugcagcccagggcugucacucaguguaccggggacagaguaagcagagacaguuccuugcaggauugcugugcagucagagcgcagcuaaccucaggcagagaccaugacuguccggccuuguaaccuguaaggcugagcagggugugugaagucuggagaucuggauggagagccauugccaggggccccauugaugcauggugggacauggcugugccucagagcaugggaguaggugccguaguuacgaggacuacagugggagcacgugagucaggccugccucaguccuccucuuccugcuguguggcuuucucccuuuuucuagccaccuucauggugaugacugaggugauguggcagggauuucuggugcucacaagguuucaggagaauagcaagcaaggguacuccagguaaaggcuggagauuguucugguccccugguccccuucaucggccucuccugccaccugugccguaaguguuggacuugugacaaguucauggugcaaugacaagagcaggugccguucuccaccccauccccaugccuucuuugccaacccguuuugucguguuucacacguguugagcuccugacagcccugcuuguuguaaaguuggccugagacuuguguuccuuucauacagugagcauuuaaggaacguaccgugcacagaggugacaguccgacacagggguuugggcaguuggagagcagggcugucccagugccuagucugucugagucucaagucagaaccugcagggccuuagcugggaacacacugagagagaaacacaucagaugucaggggugcuuagugaaggcuuuaguauugugguaacugcagugaccacaggcagcuuggggagcacagggcuaauucaccuuaaaauguacagucccucaugaagucaggccaggaaccuggagaugggagcuguagcagagaccauaggggauuccacuugcuggcugguucuuccuggcuggcuuaguuugcuuucucacauaccagggccaccuguccaggggugauggccccucccacaguggucugggccuuuccacaucaaucauuaaucaggagaaaaaaugcuucaaaaaggcuugccuguaggucagugugacggggcgugcucuccauugagugagguucuuccagcuuaucaaguccaaccaggacaaagggaaaugacacgcagaguaaggacuugagaccucauucuuaaaggcucuggggaaauuggcaauagagaccgcuauugauuaaaggaccugggcagcguagccaucauauggggcaaguggacuuuggauccuaauucagauaaagcagcucuggaaacuuuuaugguuuuuaagcaguuggaaaggcucagguauuacuugauauuaaagaauuguagauacuccuugaaaaacucacuggaacuuggacguacuuuuuuuucccccuugcucauucugguagcagugcugucuggaaaaugggccaucgguugcugccuagcaccacacacgagagcugcugugcucauggccugggaaagcuccaaguucaguagcuccauuucuacugcuaguauugcuaauuucagugucagggugcagacaagcccuguuuggcuggcauauugaaguacucgggggugagggguggcaggugucaagauagcuucugucugucugucugucugucugucuguuuauucuuucuuugagauaagauccugcuguauauaguucuaguauuuugcuguguauauggcuugagcuagccucaaacuuguggcaguccuccugccucugucucuugggugcugugauuacaagucacuauacuuaacaaagucuauaugaaagugaucacagugauuaccuuugugugccauauguaugguuauauuaauguccaugucuguguguuugaccauuuuuauaauaaacauucucuaccacugauaagagcauuugccuagggugagccccuagguucaguucccagcacugcaaaugccaucaaacaaagcaauaaugcuuugaguugugggcacagugguaaugcagucccuuuauacacccuugaaacuaccucccucgugaaaaucaagggggcagggcuaagggaaagcugccugucuaguguccuaagacccugauuauagugcugcuguuugagaccacuaggucugagcagcaguguguaguaccaggugcugcccaggggugaaguuccuccugcucauguacuccuguuacugcugcuggaaaccugacacaggccugcugccugccacagagguggccagucuggaucgcuacuguagcaauuuuguauuuguauguaguguuugcuacauaaaaucuguccacuuguuuccuguguuaaaauuaugccacuggcuuguguuucuuaguucagaauaguggucuuuuucagaaccugagauugaagcgcgcguguuuuccccucccuugugccugucugaaugugucucacgucuuuaacaugcuuuuguccuugcaggcagacaucuggucccuuggcaucaccgcaauagaacuggccaaaggagagccaccacauucugagcugcaccccaugaagguguuauuccucaucccaaagaacaacccucccacacuggaagggaacuacagcaaaccccucaaggaguucguggaggccugccugaacaaggagcccagcuuugugagugugcaccuuucuggagucucaucuuggucugcauuucuucuguuaggguugggccagacacuguuuccagcugucucccugaucucucucucucuagucuuggcaaaugaauucaauaucuaucuaucuaucuaucuaucuaucuaucuaucuaucuaucuaucuaucuaucuaucuucccucccucccucccucccucccuccuucccucccucccucccucccuuccuuccucuuauuuguuuugagacaggguuucucucugaagcucugccuuuccuagaacucucucuguagaccaggcuggccuugaacucacagagaucugccugccucugcuuccugaguucugggcaccaccacugccccguuucuuuacggacgcucgcucuuuguugccuuuugucauccucuugucuuuuagggauuucagauguaauuauuuuaucuuagauuuucuagcaucuccuuacuucauugagccugaagaauauucuacuuaguauaauagguaggauggucaauuuuuaauauuuauagagaaaagucaggcuguacaacuaggaagcuacuucaguaguagcagcggguagacucaaaauaaaggaagcaaauggucagcuuccaguuaguuguugugugcuagggaacagacacacgggguacacgugagucgcccaccuccacugccccgccuuuucucucuguguuuacuuagagguggcaaagcccaugcaugcccuuagcuacucugagcuuuccucuuuguucucugagaaucggggcuuuucuuggaauagaaagguagccuguguguugucacauguagcacuccaugccguagcuuugauuuggguuucuuugagcagauuuagcuucauugagccugaagaauacucauggagaggguccccguuagcucuugucugaaaauggugagaaaagaugaaugacacaggagcaucauaugguuaucaacaggagcccguucuggcaaagggauuaaaaggggcagaaaacacugucuuggcuccaccaggggcugcagguugagguuagcagguugcauuugguuauugggucaggugguggguguggucuugcaugcuaagucaauguuugauuguuacaccauggugccacacaaugugguggaagagagacccaaauaugugcacaucuuuuuuuauuuuuuuuauuuuuauuuuuuuauuuuauuuuauuuuuuuugguuuuucgagacaggguuucucuguauagcccuggcuguccuggaacucacuuuguagaccaggcuggccucgaacucagaaauccgccugccucugccucccaagugcugggauuaaaggcgugcgccaccacgcccggcuucacaucuuuuuuuaaagcaugugcaguaccguuuauucccaccaugcaccccucuaccuuggcuuaccccuggaccuucacaugugaaagcugcaaagcugagaacacuugggauguuuggagcgucacagccaaaagaugggggcgggaggacucucagagauuuccauuagaagaaaaugcuauucuugauucuuuggagcaaacaucacugugggugugccugccuggcaucucugugauuuugcuaucugucccuaguugggccacucuguuucuuggggaacuuuuugccaguagauggggaagccgcuuacacucuuuaaugccauuugguuggagcugugccgugcuggguggggauuaagcuguuggucccugucaccaucguggugauggcuucacggaccuacuuuucuaaguggggagugcuggugagugagggaaccgaggcaggagccaggagccagucaggucucuccuaacuccugucccaaccucuucugagaugagucgaaucugugaacucaguuuaggguauucgccuaacacuauaggagaucauaaagaauguguauuucccuuagccagcacucaugcugagaaaccaaagaaaaacaagaugagcucucucagacaguacucaccaaguucuuuguggaguucuuugcaggaguucuuuuucuuuggugagcuacucuggcaggaugcuucagucuuuguuggaaacucucucccauuuucccugugcccauauaugcuugggcauggguaugaaaugacuucuccagaaagccugaguuaggagcaggcucugaagcagaauccagggcugccccguggugcgauggucuggcuuuuuaacccagcagucuugucuguuugugugggauagaguggggugaagaggaaauguccucucguggugaugacuucgacaugugugcuuuccagaggcccacugcuaaggaauuauugaagcacaaauucauaauccgcaaugcaaagaaaacguccuacuugaccgagcuuaucgacagguacaagagguggaaggcggagcagagccacgaggacuccagcucggaggacucugacguguaaguugcccuguccaggcucuccaugccuguagcagagaguugggcccugcuucgugggggugggggugggggugagcuuuuuuuguguguguagcuguggccagggugggggugggagggcaaaagagaguacaaacuuagagucauggccagaaggaggaaccugcggagacacugaggccccaaagggacuaauagugaaguggcaggcggauccuuaggagagguguggccacugugugcuggaggcagcagcaggagugauggagcuggugguggucugggcagugcagccccuggccugguguuggugaacuugguaggauuucuguuccaagggagacagauggccaggcgucuggaggcagcgacucuggggacuggaucuucacuauccgggagaaagaucccaagaaucuggagaacggaacucuucagcucucggacuuggaaagaaauaagguaccgugugcccaccagccaguggcgcuggggaaucuguccacaguaagccugcugugggagcggcaucugccccuuaaggcauugacagguuaaagauugaguucugucugaccauuaggauugaggugcgggcuuacuuagggcugaauuguguaucuucaccuugugugcaacacuggguccuccugaucucgaccacaggugggcuuggaugugaaguuuccugugugagaauuccagaaguagcuguuggauuuacucaagauacccugauuuuuacuggggcaguuuuuauugcaggcccuuaaagaccaguauguuccuuuugguacugaauauagacuucauguggaugcgguggguuuccacuacgauuaguuugucauuguccaucuguguagccucaugggccugaggagcucaucgguucagagagugggaguugggccuuucacuguggccauacggaguaccuggcuucagcuuucuaggguuuccuaccugcagagcauuauguguccgugccuaaggaguucacuccuggugccaugcacugggcucauggguggagccccuuuguagagucuucccucagagaucaugaacagaaguuguuuccucaggggagagaauccagucauccuugguagaauuguugccuguuucuaacgacuccuuucucuuuuccuucccuaagaugaaagauaucccaaagaggccuuucucucaguguuuauccacaaucauuucuccucuguuugcggagguaagaucccuggcuguuauucuugggaggggaggaagggaggaagaggggaccagggcugacuuucuguggauggcugccagucaguacaaguuagaggcauuaaaacuugcagagucagucucaagucuacaugcauuauguccauggugacugcuggcccugggcccugccuuccguaagccaggcaggugacuaggggaaguuguauagguuauuacuggcuuaaauuguuuccugaaaucauuccucaguagccaccucaaauccacugggaaugagaugauacucuggaaguucuagaaccgaagggggaaaucuuuuuuuguuuugcuuucccagugugcccugugguuagggugagaacuagagucggguguucagcgcccuucguuuuagauaaucaucagcucagcggacaugaguuuagcgcagucguggagaagcauagggccccgguucuccugucuugucuuugcuucugcuucgagauaccugggugcaggucaggucagaggcaggugaguggcagauugcagaucuccaaauccugugcuuggaagugugcuuauguggcccucccugccuuagccagucccuccacgugucccucagagacaggacaaggaaacugcuacccuaagguuaacacccugugggaccaaagcugagcauuuucuaaaacguuuguuaacaaauggaagcaggagauuuugggauauuccacaccuaagguuacauucaggaaacagauuugaaguuggucuucaugcuggggaggugccuuaaaucacaguuaugacucaugagagcagaggagggugugguggagucccagagcucaggguugccauguguaugugagaacauuaggcagcacucuugaccccaaaggcuaugugccugaaguuugcacccagcccauaaccaucaggaacgaagcuuuggugacccacacuguagcugcccagugacgccacaguuguacauguaggcauugaugacacuuucaggggugagcagaaggcugcacaagggagagaaagugguggaguguucaucaaacucaugugugaaggugugcaguuaccugccuguguucuggucuggaagagucacuguguauguaacugcuuacagagacagaagaugaggacccagagugacucgugagccacagagcucauacugggcccuugucagccuggcauggcaguguuggcagggccuauuugucucuuccuggagugguugcugcccagcccugugcccguguaugacacugcucuugugugcauuuccagcugaaagagaagagccaggcaugcggagggaacuuggggucaauagaagagcugcggggagccaucuacuuggcggaagaggccugcccugggaucucagacacuaugguggcacagcuugugcagcggcugcagagguaaccggcccugggcugggcuggauugcaggaggggagccugguggugcuggcacggcuucuuagacuaggaacugucacagacugcaccuugguauaucucugggguuuuucauucuugcucuguugucccuugggccaugggcuucuccugagggaaaagucuuguucugaauucuacaaaugggagaccugagucuggaaaggaacauggagcuuuguauuuguagccguugccaaagaaaugcaagaugccuuaaaacaccuacaugcagcagucuaaagaggagagagagagagagagagagagagagagagagagagagagagagagagagagagagagagagagagagagagagacagccucagucacaccaagaucauguucagauaccagggucuuugguguaguagacucaaaagcccuccuuagaacauugcuuagaaaccugugcucuggugucuaggagcuaccuagcuccugucucuaccucguggcuuuagccacguagccuccauguugaauagacauuacuguuuggcauaaaaaauaaagaugguuugcuuguuggcccccagucuugaggccauugaggaggagacaauaucuuuuuaagauugcccugauuugaaucuuaaaggaaacaauguguuacaguguaaaggaaaagacaacuuugaauuuccuuguaguggcaucagauuuucauuuaaaaagagguuugucacgagcaaagcagaaccacacccagaaagggugucuguuuauuauccugcauucuguuuucugcuuggaauaguaaggugucacuugugcacucugugaugugugcacucugugaugugugcacucugugaugugugcauuucugugaugugugcacucaugugugcacacuguggucagagauccgaggacagcucucagcaguugguuuccuuccacccucuuugaauucaaggaucuaacucuuuugcagcaucaggcccgccuacagucagcaccucugaccuguccccccacccccaccccccaaagccugccauguuggcagccggccuuggccuccauguagcugggcucaggcccaccacacagcuuuuguuugucaccuucaggaguuuugcaugugguccaggguugccugauguuguaugaguggcugguaaguacgacuugauuucccuaguagcucaggcacagguaguaugauguauguaugcccaguugguccuuuucuuguugcuggaucuguccccugcugaggcaccuaaucugccagcucuaguagaaaugugauaguguaagacccccuuucggggacccccacucuagucucgggagugugagagcacccaaaaaaacacgaggacccaacucgcuguaauuacaugaggacguuuaauuacggagcuccggaccagcaugaaucccacacaggagauaacagaugccggccacgaggcucgaaagccaggggcuuuuaugggguaaggggcuuagggguguggaauucagcauagcgacgcacuauuggcuuauucaaacauuaacagaaagaacacagugcaucaggacuuuguuccugugggcugggggcuuaucuuuguucacuuaacaaccaguugauguauaugacuuuacucggcgccaagggguaacagaaaggagguuccggccagauggugugaacuuagauaauguagccccauuuguccuugaauaccuuuucaucuuuacggccaagauauucuuuggaaugccuuaucaacagccaugccuuggccugccugggggcuuguucugcuuuguucucagucccagauggggcagugggcucuuaaacaacucacaaguuacaauauuuuaucuuccuucaauaggagccagaggaagaauuucaauuacuuuaaaaauauuuuacugauuauuauugggaggguacagguguguggugcauggaguccugucucuccuucugccuuucuucugguucagggaucaggauuugcugcgaggcucacacaacaagcaccuuuaccugcuggccccaaaugugaagauuuuggauauuuguuucuuaacauugaaagugcccugucugucugucugucuguuucucugucugucugucucucucucugaauuuuugugguacuggggauuuaauucuuggucuggagcaugcuaggcaaguauucuaccacugagccgagucacccagccuucucacacacagaauuuuaaauauucuagaaacuauaucaagaacauaaagaggagcaagcaaaauuaauuuuaguaauacuuugauaauuuccuguaucagcuuauaauaacaguuaucuaguaggauauuuuacauuguuuuccuugguauuaaaccuuugaagucgguauggugcauuagccauccuugucaauucaaaccuagauuucaaguagacacucacagccuuuuguucugaguggacccuccuacaacaucagaugauuaaguggcaggguccugguugucucugcaaacauggcuauggcuuugcaccuccccuggguuccagcagccagggacaaggcucagccagugccugucugcucccaggugagcuguauuggacggucucuucagaagucacuucugucugaaguguuuucagggcgucucugucuuagucugaauuggcuuugagauccuuuagugagcacagcucauucacucacagcagcaacucagugcauaaugagccgauuguaguucuugacauuugaguccuggaugcuguggcucgaguaagcugcuaagaggaucauacagaccuguuggaguauguucaguguaucauaaaagcaccucugcaugcaguguuggaggugauguuccuuaaauauguccuuggccucaaugcucauguagcauucagaagcaagacaguguaugccgcagacccucugggccccuuugucugcguggaacgggucucuagucgcaggugggcaaagcguuggauggaaugacagacagaugcaagagagacaagagagguuguguagaaucugaauguaauuugucaaaucgagcaucaaacuuuuuauacagaagaaaauaaggaaguugggugacacacccgcaagguacaaagagguuacuggauucuuucacaaaacagagaaauacaaacacagaaggucuaacaggaaccaccugugauagaauucauuguuaacaacugggaucaaaaagagcuccaccuaagauccacuuaaucuuagaaaccagggucaagggcuucgugcccuugccauaguuccuauuuuagucuauuguauaguccaccuucccccuaggccauuguaaauguauguaacucagcuaucuauaguucuaaguaucuacucugguuccuccuuaggucucaaacuuccuucuuccuagaugaugguaaauuccuguguagggcagugacuuagauuuuguucaaagugauaguguaauaccagaggcaauuuugaaugucacugaacaggcaacauuuuuacugaauuccaagcccauggucugcucaaggacuuucuaggauguuggaacacuggugaaggcuuagcuaugucagaauucaaucuuaaaaggcacuuauaauaagauaauacuaaaagagagcauguggauccauacaccagacuaacucgggaauagaauaugaguauauggguuaaagagaacgccagacuccaggaggugaguuuccauaaaacucucugccuugugaguggcuuccaggccucucggccugucaagcugacuccacuggaguguguggcaaguguagacuuuuuuuuuuuuuuuuugagagcaagaaauuacacaguccagugguuaugccauugcuucugacuuuauaugcaagguguucaugcagacacauaggcccuccuuugggcuguguuuuuuuuuuuuuuuuuuuuuugauaccgcuuccaggaagcccaucuaggcugcagccauauagugcugccccaaagaauugcugagcuuggacucaaccuaguguggauaugucccugagcucuugcuguguccuuggucaacaccaguuuucagaaauagauccagggauggagagggcucagagggucaagugcuuuguguauaagcaggauaaggucccaacacucagacagaggcugugugguggcacaugugugucaucccgguacaggguaggggugguaauccuguggagaccuggguagauagguccuggaggguuacuggccagccagaacggcaagcugcacgcaguacgagacacugccaggaaggugagguggaaccugauaaagacccccuagagucagccucugcccagaguucacaugguugugcacaccuguacauacaugugcacauuccacguacagcacacauacaccacagucacaaagcgaggugguccuaggugugacuugcgucgccaugacucccucauccaggguuaaccugcucauucuuguucuccuggccuauuuucuaagacuuugaagcuucuguaaacucuguaauguuuucguucuccgagauggcgaugcuuaccgaucucugcuuuuuccuagauauucucugaguggcggaggagccucagcgcacugaaggcccauggcgcccggguugguuuuuccuuucuucuucaucuuccuucuuuuuaaaagucaacgagagccuuugccgacucugcgaagaggugucacggaggggcccacccgcccucccauagcgccggcaccuguccagggacggccucgucgugccacagccagauggagucuuucccgauagggugggggagggucuucuccuucaagcaauuauuuuauuuuuuuaucguuuuuaauuuuaaucauagugcacauauucaaagaaaguaucuuuaaacacaaaaaacccugaaauguauauuuggaucguuuuaaggcaauugaagacacgcaaccucagguaucccgcuuuauaucgauagcuccucccccgggagacagagagucgcucugguggaucaguguacagauuguauauagcgucauuuuuacggaaacccuuuuggcgugcauaaggaucacuguguacacauuggccaagugcuucuguagauaaugucuguggaguaaauauuugacaggccagaacuugagucuuuugccuugccuuuauuacauguaaauuuugaaucucgugaccagugauuuggauuuuauuuuguauuuacagggucugucauuaauaauaauuaaccccccuccccucauggaacacucccguuuguaccucaacagaugcaaauuccccucucguucacccuacgcccuuuuugguacacuuagaaguuuuccuuuuccaucaaugguacuguuucuuaguguuuucaauuggaacauaucuugucucacagagcuuuaaauuauucuccuaaguuucuuguggaugaagcgcucucaucuaaccuauguuggguugugccaccacgucuguaccagaugucccauccggcaucuuuccauugaaucuuguagugcaacuugcguaucaucuucuccaccuccaagugucugaaugcuuacacaaauaaauuuuauaacucacu

SEQ ID NO: 7650 - RNA, 2684 nt, Mus musculus
cagacacuccuggagagugcagcggcauccagaagcaaagcuugcauucucuugccaagugacuuccuaacuucacugaaaagcgcucacuuuuucagcucgcaaaaacucuucaaggacaacggguaagauguacguggaaguuaauauugagggggcagauucuggagcggaggaugaaauucacacguuccaggaaucaggugggucccaaagaagccuguaugaaugaagggggagagggaaccgagcaggguuccagcgucgcccccacgggaacaucuuccagccccgcacucgagucgccaagugcgugcgugggcccgggccacgagaugagcggggcacccggcuggacccuaacugcccagcccaccugcagcagggcaggagcugcugcgcaccuugugggagacgccgggagcggaauggacguggcacccccucggcccucggggcuauggugggugcggcgcccgcugcccccuaagagcaagaacugacaaggcucgggcgcgggaggcaaggggcccccagccuccugcaaccccgagucccccgcugccccgagccggguccgggaagagcucggaauggagcgaagggcggcccaaggaugagggaaccgguacucacaaagcccacuggagccggugcuggugaacauggucccgccgggcccggagcccccgcggggcgucagggggaggggaggcagagguggagagcccccagcgaccgcgcaggcgcacugucaaccagcgagcgaagucggcccggcgaggcgcuccggagccgccaggaagaaggcgcaugcgcagcccguggggcgugcacacucggccagagcccgccccuuccuucccagagaggaagugcguaggugcgggcgagccggaugguagcugcuuccgguaguucggggcggguuuggcgcaugccagaauucccaguacagaaccuuacggcgugaagcgccgugagcgagccgguucuuccgccacagaacaccaggccuuucucgagaccucugaccuuucacugggcgagacggccgcgagucccacgcaugcucaguacuuccgugugggccuuggcgcucagugaacagucugcuuccggugacccaccaagcaccugggguugcuggggugaggguggacaagacggcuaguagaagaaaaaguuuuaaaaauacacuuagcuuucuguuccgggcagugguggcgcacgccuuuaaucccagcacuugggagguugaguucgaggccagccaggucuuagagagugaguuccaggacagccagggcuuggggggggggggggggacuguauguucauccaguugaguuauuucgcaggaaaauuauuuccuuaugaucuucgcagaagcugauucccacaaaaucuguagcccacuuaagacugguucucaaacuauggggucccugggagcacugaaggguguucagaagacccggccgauuuuuguaguaaugcuaaaacguguauuuuuccuuucccguucuuuuucauccaugaguaguaagguuuuccaauuaaccagcgccugauaaaccaacuggaacugcaggacgaccaagugcguguuaaggcagauccccaguugcaaguaaucuagaagccaccauuuaaacuuugacauuuuauggagggaaaaaugccauuuaaucuaagugcuugcuuuucuaauuccagaccuacucugggugagcuuuucuucauauacuucauccaaaacaucacaacaaacuaaaaagagagaagugcgcagggaauccccacaggguauugagccaggcauuaaaagcauucuuccuuaaaaugguuugccuaggaaaguacccggugucaaaacugaaugguugaauuuggacauuuuugccugauucaucuaagaaauggcccuauagugguuaaauacauagaaacgagggggauaguguagauuuaaggaaagcuucaaagucacauuaugucucuuaaauuacuguuuugaaauuuaauccugucuacuuaaguccuauauauuauagauaguaaccacuuaugguaaacuaauauaaacuauaaaagguuauuaucuaaucaggguuagagaggaagaaaugaaguaaauuccucauuccguugaacauuaguauguuuggaagaucugaaaucugaaaagauagaaagcugugagaugaacaguagucagaaguuuuguagcaguugcacauacugacugauaucaacaugaaaacucaaucgucacaaauucagggcucauaggaaaugaaaacacuugaguggaaauauaccaaaaaugaaguggucaaaacuugaaacucuugaaaauuauuccacaggaaacacuuuuuuuuuuccucuuccaguaucgugaacaucagugcagcaguucuggucaccuggauuuauaaacaccaagaaguagcaacagccagugugcaagucacugacaacccaagucaccaaaaaucuuacugagaacccauuagcuccuugaauuaaagauuauuuugugaaaagaggcuugaucgucuuguucugcaccugaaauaaagcauuucccauucuguuguuuuaaaauauuuacucuguaacaaguguacauaauuuuguuuuuauaauaaaaaaguagugauaccaaaauaugggac

SEQ ID NO: 7651 - RNA, 1628 nt, Mus musculus
cgccgcggcggccgccagcccaaggcgcaucuggccguuuagcggguggccaccgggagccccgggagagucgugcagcgcgggaaagagcgcggagccgccgccgucccggcccgcguaggugccgcuggccgagaugaacaucccggccggguggggagguggggucgggugcuggggggagcugcugccggaccgcugcuccccuccgagcggggccccgugcauggccgccgcgggggccguggcggaaaggucccuccggaggacgaagucccugcuguggccuuugccgcugcugcugccgccgccacuguugguggcaguguagcccgagagggcaggaggaggaggaggcgggggagggggagaggaggacugggagggaggaagaggaggggcuggaggcgggggcgccgaggccugcgcgccacugcugcccccgccgucggggugggugcgggcgccugggugagucccugaggccacggagcgggcggcuggugcgggaaccugggacagcccggggagccccugggaaggaggacaggggcccugcccgcuggccugugccaugugcucggguccgagcgcagugcuggcuacgccggggucagugccuaggucccgcggguggaggugcauggcgaccgcgcggcguugggagugggcgggcgggccgaccagcaccgggaagccugucauauucugaagcuguugggccugagccguugccaaauccgcuaaucucagcgcuggcggguuccucuugcucaaagggggcuccaucauaacuauacaaucaggcccauggacccucacuggggggacuuuuucccccucugcccgccuucaaaaacauguauauauuaggggcucuuuaacuucuuguguccgggccuccuagcugcuuauucuuguccccacucuauccuccagcgauuggcagagugaacaccacauuugagcugcacagugggaccgaguuuuuggaaauggcacgggugggauuggagggagccgugugauuggcagcugccucggcugcgcgauuggcucugguucaggcucugggcccagcgggaaaccgcccccguguaccacaccgccugugcuuucacuucgugcccccucuuccccuggagcucugcaucccggcuuccccugagaugccuaaguuucccuugcagaaaguuugcacuuggccgccgggcucaguccccuucgaaugccagucuccgggucgaccugccuggcgcagagcgucugcuagcuccgugccaaaguggacgggaaugagagaggucaugggaccuccccaccagggguaaagcgagggggcagggguugggggggggggugguggaagaagaugaagaacucacuugaacucuuucuacuucuucucuuggauaaucucuggaugcaucugcacugaaugaccaucgcauuuguagcggugccaaaaacuuaucaaauggacucugucugucccugggcccacguggagugcagacuguagguguaauaaggacaauuauuaaacuauauuggucacaaaacaauuugauggagcgcggcaaacuaccaaagucaaaauaauauauaauaaaucuuuccccaaagga

SEQ ID NO: 7652 - RNA, 4918 nt, Mus musculus
agugacacauugaugcuuuuacuuguguaagcaauaugguugacauauggcauuauuauuuaugaaugacagcauaaauuguauuacaaagucuacugcaauaauacugcacuuuauuggaaagcugcuuguuuguagacaguauucaaucccuagguuugcccacaagcccaaagguaacaaucuuugaaauaauuaaaugcauuccuguucccauaaacuagagccuccuggauuuuggauuuuuguguugauucuuuuuauuguuguuuuggcuggguuuuucuuuucaacauggaaaacauuccuaucaaaaaagaggagaugaagcaaggaaaauuaguuuucuuuuuccaaaaucacaauuucugucacccaguaugggagggugggggugggcuggguucuucuagcuucuucuccccuuuucugacaaguacaaaaguauuuucaucucugucaauaaacuacuggugggcacauauuuuauauugagguuuuuuuuuuuaauccgcucgaacuacagaguuuaauuauaaagagaaaagauacaaagccauggaagagcuuuaucuuaugagaucuucucauagccuccuuccuaauguuauuuaacaguuacagcuuuggcuaggauuuucacaacuuccucuccucuuacauuauaccuuucuaaagucaugucaaaaggcuuuuguucuauguggguuuuauagagggggcuucccagagcacacauguggucuuucauguaucagggggucacccaacucaguaauagcugagaaagcagaaucaaaaguaaccuucaacuuaauauccuguugauuaucuuguuggauuuuugccucuaauauagauggagguggugcuagauggagguggugcuagaacucuuguagaaaaggaaauuauuauuauguuaguuauuauuuuggccuaagcuacaauguauuacauacucuucuucacagcuucucucccccauuuuuacaccuuucuuuaagggaaaaaaauuggaguguuacuggggccaagagucacaauaauauauucaguggauagccaaguuguuuguauuuggugucuccuuucccacaauguauaccuuugugugugagaacacagugggugaagugcaaugcauuuauucuucuguauguaugugcacaucacgcuauaagagaucacaguagacaccauucaaaaggaguugcucaugauugcugggauguuuguggaauuugcuucaccucaucccuuauuuuucuucuuguaaacacaccacgaauuuuugaucaagccuugguucucuucacucgccgggaaauguacccuugccaggagcccuguggcggauauccuucucagccacaagcugagguuuugcccagugcagguuuugcccuguuugaaaagaacaauuuggggaaacuuaacaaagaaagaacuggcuuccaagcguugacaguuaccgguuugggaaguuugacagagcagccuuucuagaaaccuguuggaaaaaaaaugauuugcucagugucugccugccuucacuccuuccuucuguccuuccuuucuuccuuccuuccuuccuuccuuccgcuaaggaaccugagucuacuuuugaggcaauaguccugaaagccuuugcgcguucucgcaagcgcgcgcgcgcgcacacacacacacacgcgcgcgcgcgcgcacacacacacacacacgcgcgcgcgcgcgcacacacacacacacaggcacacacaggcacacacacacacacacacacacacacacacacacacacacacacacacuuguucuugcccucgcuuuuuccucuccuuccuuaaaaaaaaaaaaacugucaagaaggaaaagguuuuuuuuuuuuuuuuuuuccuucuucuucuucugguuugcagagaaauaaaacacuucugaaagaggggaccgagacaugacuuugaacuugguucagcuccucuguuuccugcagugagaggagaacuggagcugggaaagaauagccaggagggcccagccggcgagcucuccggcgggaauuaaggcaucugcccuaacgcucggcccucgaauccagcgcccagccgcgccauccugaauugcgggcucagcaaagaagaaaucaaagcgaaaggagagaauaggucaaaaaagagaggaaaggaagaguggggaggggggugaggaagugguagaagaggaaaaccuacaagugugagggcuugaaagaaggaaauaaggucuuuggguagcaaggcuguuauucucacaaccaaucuuagguuaaaaaaaaaaauugggagugguaguauuuuuagagcaaaccaauacaugcacuuuucaguauaaauugcuaaauaaggcaagcaaaugugaaagacugaauuaggcaggcuuuuaaaauaaauggauugaagccuuucugcuuagauauuuuccaucucuccccccuccccucccccugcggucuagcaggccaguguagcuucugcccuuugagguaggggaaugggaggaaagaggaccauuuccucucuccagcuucuaggaaagcucaugauuucggucaagaugccuuuuucuuguggucguuucucccgucccccuuaccaaggaauggggaacacggaggaaacagagggagccuugguagaaagguuggcuccaacaguugagccagacccaccuaagguuugagagguuguuugaucaggcaggagcucauauucauugcagcaaaucucaacaagagucuucuuccagcguuuuuggugauuucauuucaauauaaauuucgaaguauguuguuauucucuugcgcgaauuuuaucucaguuuccagagauuuauuaauaaaagcaguucucaggccugcgaaaggugaaggaagacgauggucacgggcugaaccuuuacacuuccccaaacucuuggcccgcaauucccuuucccauuaccucuuaccaaucugagggcggugggacagccauguucuuagugggaagccagccuggguucgagggcggcgcuugggaagcuuugcgguggcuucaccaaagagugacacuuaccguaagccccacaguuuauuuuuucugaggcccugauucugauacggcaacagccaaauuaaggccuaaaccuugcuugauucugggcauuccacuuccagaaccaauguggcuguggaccgggucaggagguauccacccggagggagacacugucuuuaaaugacgucuaaacugccccucagggucugcugccuaguuuacuccuguaaucugagcugaacaugagcggccagggcgggggguggggagguggggauggggugggggcaggggugagcuaagugcgcccaggggcagguggggaccaccgccugggaugggggcgguguauagacgaauguccagggaguggaaagaagggauaaguuugacuaucuguguccaccauccuucauccacgcuuuaacgccucaaagcaaauuggucaaggugagaauggagaaaguagagugccuguccagacugggaaagaccuguccuugucaggaaaagucucuucgcucccucagggucucgggcuuggugacucuauagcuaagggugcuuuggacuagaguucccggauuuuucgguguacuuugguaguggaugcaaucucuggggaguugguggccucugacaaaguauacgggagcaggaucgggcggaaggggacaagacccauagaccuggcaccgcguuaggcucgcagcugaacucuugaauuagccggcuggugacgggagccacagagccagacgcgcgaacgaaacccugcaugcuggcaggcccagucuaugggugcguugggccgcugcugcagcugcacaacccaagcggggcucagggaagguggggcgggcugggcgaaggauugacgaggccgugauggccaauagcgguuucuggagggcgggaugggcgggaguccccguuaaaggggcggugugaccaggaggccgagccuuggauaaggagggagggauacccgggcgggagacccggcggguacgcgggggaggggagaggaaaaggaggggacaaaaaauaaaaaaauaaaaggcugcugcugcggccucagcgcccaccgaaauaaacagaggcgguggcgaaggcugcccacugcagccgcgagagaggaagaacucguguuggccuccuagcauuugcuugugccgaggacuucgcucuguccucgcugaugcgagcacucauucccggacuagcgcccagaacagaucggcuggaggaagggggagaaccagagaacacuuuuuuauuguuguuauuguuuuucagacuagccucacccugcuccccucccccuccucgccuucuccccucccacagucccccccuccccugcuccucccccucccuccuccuccagcccaacuuaaagaaagaggggacgacgcgcccguuuccuucaucuaggggaauucgugaccgcugcaaguuuacuacuccgggcgucgccaaugccaagcucggagggccaagagggcuaaacccccgcagcaaccgcgaagccgaacaauaccggcagcgcucugggcggcgugagcaaggccucgggggagggagcggccacccgagagcgccguggacucgacgccuagccuccuccucccggcugcccagcgccccugcggagaucagguggagcggcgggugcgccaggcucuggggcuggcggagcuuguugcuguccgcucccugccagcuugugugcgcacagccacugcccuagggcacuguggccccgcagccgcguugacuucauucggcggaugccgcugaucucagccaggcuccugguccgccggcaguacaaggca

SEQ ID NO: 7653 - RNA, 4918 nt, Mus musculus
ugccuuguacugccggcggaccaggagccuggcugagaucagcggcauccgccgaaugaagucaacgcggcugcggggccacagugcccuagggcaguggcugugcgcacacaagcuggcagggagcggacagcaacaagcuccgccagccccagagccuggcgcacccgccgcuccaccugaucuccgcaggggcgcugggcagccgggaggaggaggcuaggcgucgaguccacggcgcucucggguggccgcucccucccccgaggccuugcucacgccgcccagagcgcugccgguauuguucggcuucgcgguugcugcggggguuuagcccucuuggcccuccgagcuuggcauuggcgacgcccggaguaguaaacuugcagcggucacgaauuccccuagaugaaggaaacgggcgcgucguccccucuuucuuuaaguugggcuggaggaggagggagggggaggagcaggggagggggggacugugggaggggagaaggcgaggagggggaggggagcagggugaggcuagucugaaaaacaauaacaacaauaaaaaaguguucucugguucucccccuuccuccagccgaucuguucugggcgcuaguccgggaaugagugcucgcaucagcgaggacagagcgaaguccucggcacaagcaaaugcuaggaggccaacacgaguucuuccucucucgcggcugcagugggcagccuucgccaccgccucuguuuauuucggugggcgcugaggccgcagcagcagccuuuuauuuuuuuauuuuuuguccccuccuuuuccucuccccucccccgcguacccgccgggucucccgcccggguaucccucccuccuuauccaaggcucggccuccuggucacaccgccccuuuaacggggacucccgcccaucccgcccuccagaaaccgcuauuggccaucacggccucgucaauccuucgcccagcccgccccaccuucccugagccccgcuuggguugugcagcugcagcagcggcccaacgcacccauagacugggccugccagcaugcaggguuucguucgcgcgucuggcucuguggcucccgucaccagccggcuaauucaagaguucagcugcgagccuaacgcggugccaggucuaugggucuuguccccuuccgcccgauccugcucccguauacuuugucagaggccaccaacuccccagagauugcauccacuaccaaaguacaccgaaaaauccgggaacucuaguccaaagcacccuuagcuauagagucaccaagcccgagacccugagggagcgaagagacuuuuccugacaaggacaggucuuucccagucuggacaggcacucuacuuucuccauucucaccuugaccaauuugcuuugaggcguuaaagcguggaugaaggaugguggacacagauagucaaacuuaucccuucuuuccacucccuggacauucgucuauacaccgcccccaucccaggcggugguccccaccugccccugggcgcacuuagcucaccccugcccccaccccauccccaccuccccaccccccgcccuggccgcucauguucagcucagauuacaggaguaaacuaggcagcagacccugaggggcaguuuagacgucauuuaaagacagugucucccuccggguggauaccuccugacccgguccacagccacauugguucuggaaguggaaugcccagaaucaagcaagguuuaggccuuaauuuggcuguugccguaucagaaucagggccucagaaaaaauaaacuguggggcuuacgguaagugucacucuuuggugaagccaccgcaaagcuucccaagcgccgcccucgaacccaggcuggcuucccacuaagaacauggcugucccaccgcccucagauugguaagagguaaugggaaagggaauugcgggccaagaguuuggggaaguguaaagguucagcccgugaccaucgucuuccuucaccuuucgcaggccugagaacugcuuuuauuaauaaaucucuggaaacugagauaaaauucgcgcaagagaauaacaacauacuucgaaauuuauauugaaaugaaaucaccaaaaacgcuggaagaagacucuuguugagauuugcugcaaugaauaugagcuccugccugaucaaacaaccucucaaaccuuaggugggucuggcucaacuguuggagccaaccuuucuaccaaggcucccucuguuuccuccguguuccccauuccuugguaagggggacgggagaaacgaccacaagaaaaaggcaucuugaccgaaaucaugagcuuuccuagaagcuggagagaggaaaugguccucuuuccucccauuccccuaccucaaagggcagaagcuacacuggccugcuagaccgcagggggaggggaggggggagagauggaaaauaucuaagcagaaaggcuucaauccauuuauuuuaaaagccugccuaauucagucuuucacauuugcuugccuuauuuagcaauuuauacugaaaagugcauguauugguuugcucuaaaaauacuaccacucccaauuuuuuuuuuuaaccuaagauugguugugagaauaacagccuugcuacccaaagaccuuauuuccuucuuucaagcccucacacuuguagguuuuccucuucuaccacuuccucaccccccuccccacucuuccuuuccucucuuuuuugaccuauucucuccuuucgcuuugauuucuucuuugcugagcccgcaauucaggauggcgcggcugggcgcuggauucgagggccgagcguuagggcagaugccuuaauucccgccggagagcucgccggcugggcccuccuggcuauucuuucccagcuccaguucuccucucacugcaggaaacagaggagcugaaccaaguucaaagucaugucucgguccccucuuucagaaguguuuuauuucucugcaaaccagaagaagaagaaggaaaaaaaaaaaaaaaaaaaccuuuuccuucuugacaguuuuuuuuuuuuuaaggaaggagaggaaaaagcgagggcaagaacaagugugugugugugugugugugugugugugugugugugugugugugugugccugugugugccugugugugugugugugcgcgcgcgcgcgcgugugugugugugugugcgcgcgcgcgcgcgugugugugugugugcgcgcgcgcgcgcuugcgagaacgcgcaaaggcuuucaggacuauugccucaaaaguagacucagguuccuuagcggaaggaaggaaggaaggaaggaagaaaggaaggacagaaggaaggagugaaggcaggcagacacugagcaaaucauuuuuuuuccaacagguuucuagaaaggcugcucugucaaacuucccaaaccgguaacugucaacgcuuggaagccaguucuuucuuuguuaaguuuccccaaauuguucuuuucaaacagggcaaaaccugcacugggcaaaaccucagcuuguggcugagaaggauauccgccacagggcuccuggcaaggguacauuucccggcgagugaagagaaccaaggcuugaucaaaaauucgugguguguuuacaagaagaaaaauaagggaugaggugaagcaaauuccacaaacaucccagcaaucaugagcaacuccuuuugaauggugucuacugugaucucuuauagcgugaugugcacauacauacagaagaauaaaugcauugcacuucacccacuguguucucacacacaaagguauacauugugggaaaggagacaccaaauacaaacaacuuggcuauccacugaauauauuauugugacucuuggccccaguaacacuccaauuuuuuucccuuaaagaaagguguaaaaaugggggagagaagcugugaagaagaguauguaauacauuguagcuuaggccaaaauaauaacuaacauaauaauaauuuccuuuucuacaagaguucuagcaccaccuccaucuagcaccaccuccaucuauauuagaggcaaaaauccaacaagauaaucaacaggauauuaaguugaagguuacuuuugauucugcuuucucagcuauuacugaguugggugacccccugauacaugaaagaccacaugugugcucugggaagcccccucuauaaaacccacauagaacaaaagccuuuugacaugacuuuagaaagguauaauguaagaggagaggaaguugugaaaauccuagccaaagcuguaacuguuaaauaacauuaggaaggaggcuaugagaagaucucauaagauaaagcucuuccauggcuuuguaucuuuucucuuuauaauuaaacucuguaguucgagcggauuaaaaaaaaaaaccucaauauaaaauaugugcccaccaguaguuuauugacagagaugaaaauacuuuuguacuugucagaaaaggggagaagaagcuagaagaacccagcccacccccacccucccauacugggugacagaaauugugauuuuggaaaaagaaaacuaauuuuccuugcuucaucuccucuuuuuugauaggaauguuuuccauguugaaaagaaaaacccagccaaaacaacaauaaaaagaaucaacacaaaaauccaaaauccaggaggcucuaguuuaugggaacaggaaugcauuuaauuauuucaaagauuguuaccuuugggcuugugggcaaaccuagggauugaauacugucuacaaacaagcagcuuuccaauaaagugcaguauuauugcaguagacuuuguaauacaauuuaugcugucauucauaaauaauaaugccauaugucaaccauauugcuuacacaaguaaaagcaucaaugugucacu

SEQ ID NO: 7654 - RNA, 1672 nt, Mus musculus
ugcuagauggagguggugcuagaacucuuguagaaaaggaaauuauuauuauguuaguuauuauuuuggccuaagcuacaauguauuacauacucuucuucacagcuucucucccccauuuuuacaccuuucuuuaagggaaaaaaauuggaguguuacuggggccaagagucacaauaauauauucaguggauagccaaguuguuuguauuuggugucuccuuucccacaauguauaccuuugugugugagaacacagugggugaagugcaaugcauuuauucuucuguauguaugugcacaucacgcuauaagagaucacaguagacaccauucaaaaggaguugcucaugauugcugggauguuuguggaauuugcuucaccucaucccuuauuuuucuucuuguaaacacaccacgaauuuuugaucaagccuugguucucuucacucgccgggaaauguacccuugccaggagcccuguggcggauauccuucucagccacaagcugagguuuugcccagugcagguuuugcccuguuugaaaagaacaauuuggggaaacuuaacaaagaaagaacuggcuuccaagcguugacaguuaccgguuugggaaguuugacagagcagccuuucuagaaaccuguuggaaaaaaaaugauuugcucagugucugccugccuucacuccuuccuucuguccuuccuuucuuccuuccuuccuuccuuccuuccgcuaaggaaccugagucuacuuuugaggcaauaguccugaaagccuuugcgcguucucgcaagcgcgcgcgcgcgcacacacacacacacgcgcgcgcgcgcgcacacacacacacacacgcgcgcgcgcgcgcacacacacacacacaggcacacacaggcacacacacacacacacacacacacacacacacacacacacacacacacuuguucuugcccucgcuuuuuccucuccuuccuuaaaaaaaaaaaaacugucaagaaggaaaagguuuuuuuuuuuuuuuuuuuccuucuucuucuucugguuugcagagaaauaaaacacuucugaaagaggggaccgagacaugacuuugaacuugguucagcuccucuguuuccugcagugagaggagaacuggagcugggaaagaauagccaggagggcccagccggcgagcucuccggcgggaauuaaggcaucugcccuaacgcucggcccucgaauccagcgcccagccgcgccauccugaauugcgggcucagcaaagaagaaaucaaagcgaaaggagagaauaggucaaaaaagagaggaaaggaagaguggggaggggggugaggaagugguagaagaggaaaaccuacaagugugagggcuugaaagaaggaaauaaggucuuuggguagcaaggcuguuauucucacaaccaaucuuagguuaaaaaaaaaaauugggagugguaguauuuuuagagcaaaccaauacaugcacuuuucaguauaaauugcuaaauaaggcaagcaaaugugaaagacugaauuaggcaggcuuuuaaaauaaauggauugaagccuuucugcuuagauauuuuccaucucuccccccuccccucccccugcggucuagcaggccaguguagcuucugcccuuugagguaggggaaugggagga

SEQ ID NO: 7655 - RNA, 1672 nt, Mus musculus
uccucccauuccccuaccucaaagggcagaagcuacacuggccugcuagaccgcagggggaggggaggggggagagauggaaaauaucuaagcagaaaggcuucaauccauuuauuuuaaaagccugccuaauucagucuuucacauuugcuugccuuauuuagcaauuuauacugaaaagugcauguauugguuugcucuaaaaauacuaccacucccaauuuuuuuuuuuaaccuaagauugguugugagaauaacagccuugcuacccaaagaccuuauuuccuucuuucaagcccucacacuuguagguuuuccucuucuaccacuuccucaccccccuccccacucuuccuuuccucucuuuuuugaccuauucucuccuuucgcuuugauuucuucuuugcugagcccgcaauucaggauggcgcggcugggcgcuggauucgagggccgagcguuagggcagaugccuuaauucccgccggagagcucgccggcugggcccuccuggcuauucuuucccagcuccaguucuccucucacugcaggaaacagaggagcugaaccaaguucaaagucaugucucgguccccucuuucagaaguguuuuauuucucugcaaaccagaagaagaagaaggaaaaaaaaaaaaaaaaaaaccuuuuccuucuugacaguuuuuuuuuuuuuaaggaaggagaggaaaaagcgagggcaagaacaagugugugugugugugugugugugugugugugugugugugugugugugugccugugugugccugugugugugugugugcgcgcgcgcgcgcgugugugugugugugugcgcgcgcgcgcgcgugugugugugugugcgcgcgcgcgcgcuugcgagaacgcgcaaaggcuuucaggacuauugccucaaaaguagacucagguuccuuagcggaaggaaggaaggaaggaaggaagaaaggaaggacagaaggaaggagugaaggcaggcagacacugagcaaaucauuuuuuuuccaacagguuucuagaaaggcugcucugucaaacuucccaaaccgguaacugucaacgcuuggaagccaguucuuucuuuguuaaguuuccccaaauuguucuuuucaaacagggcaaaaccugcacugggcaaaaccucagcuuguggcugagaaggauauccgccacagggcuccuggcaaggguacauuucccggcgagugaagagaaccaaggcuugaucaaaaauucgugguguguuuacaagaagaaaaauaagggaugaggugaagcaaauuccacaaacaucccagcaaucaugagcaacuccuuuugaauggugucuacugugaucucuuauagcgugaugugcacauacauacagaagaauaaaugcauugcacuucacccacuguguucucacacacaaagguauacauugugggaaaggagacaccaaauacaaacaacuuggcuauccacugaauauauuauugugacucuuggccccaguaacacuccaauuuuuuucccuuaaagaaagguguaaaaaugggggagagaagcugugaagaagaguauguaauacauuguagcuuaggccaaaauaauaacuaacauaauaauaauuuccuuuucuacaagaguucuagcaccaccuccaucuagca

SEQ ID NO: 7656 - RNA, 1595 nt, Mus musculus
cuuuuuuuuuuuuuuuuuuuuuuuuuuuuuuuuuuuuuuuuuuuuuuuuuuuuuuuuugcuuuucuggaaagaaaaugaauacagaaauguaagugguuugguaauccagauccaaaaugaaagcccacacuuuaucuuuccuacugucuuuuugccagaagaagcaagcauucauccuaacauccugaaaaggaggagcgaaggucagagcagugucacaggcaacaaguguuugaagggaaaaaaaggacauaaaggaaaaaguugaaagaagaaacacaauuccaaauuacugaguauggacccuauauuaauauauacugugcggacacuugaucuuccuuuaugggcuggauaaaggcuccucugaggcauuucuaauuagggaugacuacaaggagccaacggaaagcaaagcgcucuauaagguaccagcaucucagagaagucucuucccugggagcccacaguuaaaaacagcugcacaguuaaaugaaggaguggugaauacuucagguaucaguuaaauuuucucuuucuucuccuacucuucuuccuccuccucuuuaugaauucguauuauuuuuaaaagacgacacauguuugaacacuccuccgucucaggaaacagugcaugucuagcugagggguggggaagcauguaaugaggaagagcucauuuuuuuuaagagcugauauuuuuuuuacaacguucuuuaaaacugaaaaaccucuuuaaacaccaggaggagcuuaaauaacucauucugggccugaggguuccauguggacagucccuaucucuggucugcuucuggcaguguucuccuggauucuaaccaugacgguaggcccaacaagcccucacaaagacuccaaagcuccaggcuucacccaugccugugcucucuggucuucagggugcaccucagaggguuguauguggcuugucccacauggagcuuggucccagaaacgcagacaagguagccucgcuaguugccaggagcaaugaaaaugcaagccuuuaggcucgaagugagucugaccaucccuccacaagccuccacuuccaggccccgauugcagaaagcaaaccaagucugcccagccuggggccuuguguagggcgccccagccuuggccauuguuuaguccugaggaguugaugagaguugcuugcuccccugucccugggguccggcagcugcgaagcgcgguagggcgaggaaggagcgcggagcccuccuggcggggcgggaaggcugggcugcaccccgcgggccgcagggagccgcgcaccugccccgcccaccuccagccgagcaccgaccuccuccagcccccgcccucgcugcgcugcgcggcucaggugcgcggacccagaaccuuucgguucucgaaugcccccugucaaaggacaguuuagaugcccucgagcgagccgggcucuccgcgguagcaucuaaggcucccagaaggaagugugauggaggauuccgucuugccucacuuccagaguugaaagcuggaaagccgucgguucugcacagaggagcagucgggagcgagcuaccagccgcugaugaaaaua

SEQ ID NO: 7657 - RNA, 24442 nt, Mus musculus
aaagauugagguaucaggguagguaguccuuggccugcauugauauuacccacagugucuugaaggugauaagugcccaauauuaguuauugaauugguccaaauggaaacuguguucauaaagccuacugugugagagauuccaaguacugaauuuauugggacuuacuuuaguuuuuaagauuuagacauauguuguauuuaaugucaaccccaugauacagugcuaaguuaacaaagaaaggaucauguagcacuugaagguauucccuuaaagaugaacaugaaucuuuauguguuuauacguuuuagcuuuagcaaucuucaaccucagcagaauauuugggacuuuuaaugguauuagaagugccucucauugugggcacuucugcuuguuuccuacguuugucacuugguggcaguggcuguuuuaaucuggcuucauugucuuagcauaugauaugcaaaggcuggaggaaaaguuggguaacugggcucuuucugucuuacauggaacaaaaaucccccauuuucuaacugcuacuaaaaguagccuguuggucagguuuguuuucugaauuauucagcccaaaucuaggcagcgguuuucuuuucacagaauucucuguccaaucuagagagagagagagaaugucuucuuaauuuuggaaugccuucuaagcccgaaucauauuucuaacuaauuccauuuaaauaacugcugccuggcagcuuuucacagugaccuguccucuacccugggauucuggccuggcauccugagugucuggcagaacccuggccaugcugcagagggcagcugaacucuuuaguuuacaaagagagcaaaauuacccccaaacaaagaaaaacagcaggagccuaugggcuaaagagacuggaguccauacugauaucuagguagaaguuguauuugugcucuggggacccagagaacauccuucuccauagcacccucuagcuuuucauucuuuuguuguauggaauaggaugaucuucacaaaugccaugggcugcucuggcaguaguguuuaccaagccacuuccaagcuguggaagaaugaaaauaccuauaaauggauagguauucugguccaggaagaguuucuagguuucuguaucacuguccaugcguguguguguguguguguguguguguguguguguguguguguguguguguuauaugguguuucuaaguuucugucaaaccaugugugcaugcaugcaugugugagugugugugcaugugugguguguguguguuucuaagcuucuauucugucacacucucaaugacuuaucuucucacugugucauuguuuagucauuccugucuacagucuucauuucuguccgauucuagucagauugauccccuuugugaccucacuuccuuauugccacuuuaaaggcccagucuucacagucacacuaaaaggccaugggcuucgcucuaugaauagucuguccaugaugcauaacagaagucagugguucaaagacagcuuugaguagaaaagcaggcaguauggugaggcaucucuagauggccuagagaagucaagcccaucuucaccagcucccgggaagcagguguacuguggugagaaggaaugggcuuagaaaaccugggguucagacucagauucucaguuuccgauaagaugucgaauaccaaagcaauguaucagcucagagccacggugaugagaagaucuugggaagaaccauaucgagucaugguggcccucagcauuugccuugagucuuccucuccaaacaaagaucugugguaucccuuuccgggauuacuacuggccuuaggguuuaugccuccugauucugggaagagcuuuugaucaucaauagagaccucugauggccuuccucagggccaugucguucugcuuuucugaucuuaguccagguuccugcugcugcugccuccucuuucuuccuucuuccucuuccuucuuucucuuucuucuuccucuuccuuccuccuuuuucuuccuccuucucuuucuccucccacuucucuuguuccuccucuuucucccccuucuucuauuuuaaugguguugagauaaggucucaaguagcccugacugguuuugaacuuucuauguagccaaagauggccuuaaucugauucuucugucucuacuugccaagucuaggacugcaggcauguacacugggguucagacucagauucuagucucaccugauauuucucuguaauauauucugugcccauguguaacugagaggcucugccccagccucccaggcauccucacucuaagaugguuaaaaauuucucauugauuugcaaccaugaguccuguuucuuucauugucuuugcaaaugguuuaucuacucauauauucucuuuuguucuuaauaaauguaaaacccccaucauguaaguuaaccauuuuaagaccaauaagaugaaucaguauguaaaggcacuucuugccaggacucaacugagguuugaugaagacaugagaauuuagcuuuauaaggagggagaauugaccuggcacauucuuguaguaaaccaucagugaccuucucuaaaggauaugccaggacaaacaauacaccccaggacaugccaggacauacaacauaccccaccaucuugucaguugaugccuuacucuguauucugaguuuucagcagggacagccuccucuaaccccugaccccagacuucacaaccucuuuccuaaacugugaguaaaauauauuucuauacuaaaauauuaacagucugauggaggcuggagagauggcucagcaacuaagagcacugacuacuauuccagaggaucuggguucaauuuccagcacccacccacaugguagcucacagcugucuauaacuccaguuccaggagaucuaacacccucauauagacauauaugcaagcaaaacaccaaaauacauauuuuuaaaaaagcagccugugguauucugucauacgaaaagaaaacagaguaagauggcuuacaucagguuagagaagagacauggagacaaggaaguuaguugggugaugugugaagacaucaguaagaguugucuggucaccaaaauacaccuagaagacauaccaggcuggaagagucuaccucaagcuaggccuuuagaacugagacaggcagugcuguaugaaugaagcccagguuugaagggccuugucaugauagcccaagggcacaaguauggaauaauuugaccuuguugcuuucaagcugugccugcuguugccuggcuaaucauaguggccaaccugaguuccugcccucagcauccuaggaccuugagucucuuacccaacaccagcuuccuccuaucccugaacucugccugggcugccuccucuucccaggguaaaccucucuuaguagcuacuucagaucccagccagaaaaucaaucccacaaaacuuuuucuuaggcucugaaaccagagcauaaccuuuccugcacagcccuugaaaccuaugcagcgacacagguuuagccauuagccgaggcgcugugagguacaacucugggcuuuugcugcccugccguauguccccagcgcuggcccagugccuuaucuaguccucaucaguugcugccuggaggaugaggagucguagauguuagccucuaguuuaggcugccuugagagaacaguguggacugggguuuaaacagcaaauauuugcuucucaacauucuagaggugaggaaauccacagugaaggcaccugugcauagcggugcucaggaaggacccucuuccaguucagggacagggacagccaucuuucagagaaaccucugcauaacaaaugaaguaaggggccuaucuuuaugaccuauucaccuucuaaaguccuuaccuuuaacuccguagguuaggaguugggaugccauugcaugaucuucaauuagaagaugcaauagaugcccagcuuugaacaaagaagucuaugugcugauggccaaauugucaccuguguuuucagguucacuacaacauuggcaaaaaccuggcugaucaaggcaaccaaacagcggccaucaaauauuaccgggaagcagucagguacacaguuguacgcauagaccuucccuuucugaaaugccugucggucuugacugauuucuaaguguuagcugaaaacaaccgaacagugacagacugugugacuuuucucuccauuuccagacuaaaucccaaguacguucaugccaugaauaaccucgggaauaucuuaaaagaaaggaaugagcuacaggaagcugaagagcugcugucguuggcuguccaaauacaguaagcauuuuuuuuuucuuuucuuuucuuaacauucugccaggaacaaagagugaaaucucuggguuugggcagucaucuaauccccucguuuucuuguuuaucuuuuguuaaaaaaaaaaaauguuuuucuaggccagacuuugcagccgcauggaugaauuugggcauaguucagaacagccugaaacgguuugaggaagcagagcagagcuaccggacagcgauuaaacacaggaggaaauacccagacugcuacuacaaccucgggcggcugguaagggcaggcggccccaguuucccgucaccuaaaacagaaugaccuucuuaaacccauccagcacuguccacauuauaaaaguccuauauauguguuuaucucauuugaaaauaguauuugauuuccuuguauacacugccgaaguucuaauuaaugagccauacaaacugaaugagcccaauuuaugaaaaucacaaaggcaauagaugaaaugaaauucuguauaucccuucugccuuggaaaacaugcuucaagaaucuguuucuugauaaacauugauuuuguuguuauugauguuuuuaaaacaugaauucaauagaaacuaauauuuaaaaacaaaccuguaacuuauuuucugagcuuccuuguucucuuuccccaagggaacagaucucuugcuuugcaaggggacauccuccugaaaaggacagugucaggaauuaguguuuaucuaaaagggccuugcaguuacuuaaugggcauagaaacuaaagugcuugaauugcucuguauuucugguucuugacaaaauauuuaagguaaucugauugcucuuaauuuucauggcaaagaaaauaauguggcucaaacagcauaauucuuuaaacaggacucauuacauugacuaggugaaauugguaagggaaauacuuuggaucugucugagccaaaacggauuguacauacagagauggaacaucuaggaggaguguauagcuucacaaguagguagcauguacagguuaaaaaaaaaaucuugcuuauccucauuugaaauacccaaagcaucuuuuguguaaacaaaacuaguuccucacaucaguuauucauccaaauaaucaucucauguccuauuugauaauucagaugucccauaaaaaacaacaaaugucccccagcauggcccugccucugguaaucaucccugucuagacuuugacgacccagucaaggcagaagggaaaccaagaaaacauuggguauuuggauacuuuaauagaaagaauaggcuuccauuuuuaccacgacaugaauaacuuuggccuuuaccauguuuguuucuggaaugaugagccaagauuuuguugacugcacaaguagaaugaacagaggaaaaaaaaaaaauggccaggcgcaugguugcaaagagaaagacugacuuucuaaugcuggacaagucacuuuaaguggacagacgaugcuuguauuauaaauuuuagaaugaaguaguuuuuauuuaaaaaaacacaaaccuuguuuuaguugugauauauguaugauaaguaugauaggacgacaccaucucuaggaaucuacuccagugucaaaaagaggugucaccuccugcagggcacaguagagcagagacaucaacaccacugaccccaggcagcagagauuuggacgaaggacagaagccugagauucccuugucucaaucagcugucuccagguuuacauucaaaaauggauacuuuagcuggccagugguggugcacgccuuuaaucccagcacuugggaggcagaggcaggcggauuucugaguuugaggccagccuggucuacagagugaguuccaggacagccagggcuauacagagaaacccugucucggaaaacccaaaaaaaaaaaaaaagaaggaaagaaagaaaaaaaaaguauauuuuaugauguuucguacuucugugcugaagcagguuucuccuagaaaacagaagaagcucuucuaaggguaagcugggguuggggggcauuugaaaaccccaugacagugugcguagggaccaaaacuucagucacauacaaagcagggcgaguccucaaaauuaacaaagggaggaugugcuggcuggagggaguagauguguuaaccugaaucuaugcauggagguggagugacugucucuguuugaugagccaguuaaacuagcaguuaaaugacauuaggcuggucccugugaagucuuugguguuuccccuuuucuagagguagcuccuuucaggucacugccugccaagcaagugugcccaccugcagcuucaauuaaagcucaauucuacagucaucacucccucacuacucacugccucucacugcuguugcuugggauuuggaaaacagaaucuaugcuaaaugaaccccguaggaguagcuuccaaagcaaagaacgcagaacauaaaauauaagcauggauggugagcuccagucuugggcugcaugaugcuuucuuugacugugauggagaaaugauggaggcagugguguuguuuacccguugugcuacccagacguagcguuaccacagggccuguuggguacuguuguugcucucuguuguaguuuaauuacccagguuuugcccuugauaacuuaaaagcaucaaggcuuaaucucugcaccucaacuggcccacuuuuauacccauaaguaaaaggaacuuaauagcuucaagguaucuguuuuagaaguugcauuuuuauauugggagauuaaaauuugcuuugauuuauggacucugguaagaagaggauauaauguucuucuuauuccucuauauuauaauuccucuauaaugacagaggaaaugggaagaguuggauuauuagggauguggugcuggcccuugaggguggcaguaucagugaccuggaggagugcuggggacuguuggcuguggugacagugaccuggaggagugcuggggacuguuggcugugaagaagcuggucauuauucagucaugaugggcuuuagaaaagaaaaagcuggcuaaguauuuuaaauagggaaggcuuagcacaaggaauuggucagacaguuguggaaauagcaaaaauguaaauauagguuugggggaagcauguggauggauagagaacuaacaacagacuaggcuaccuuuuagaggaagaugacugcuucuagccucaggacaguagaaaaugggcuggagccauuuugagacgccaguaggagaaugagaggugcgggagaagcaugguccucugcccuguccuucugaggcugggagaaagagucagaggguaaaggacccaugauggacugguagguuaauaacaccucuacucccugcugaguauuaaauuaccaucacugugguucucugcuuccuuaaaguguguguaaaggaagaguagccauggagacaaaaugaaaacuuaucugguucaccuucaacaaaacaacagucagaguaauagugggaacaaguaggaaacaucuggaggacuuguguuguauaaugaauauacagugucaucacugacuccauccaagugacugugaccuggaauacacgcuggagugaacugacuuagacauccaaugcagggaccaaguuuaauguuugguauauuuaaacagcuguauuuauuugaauuuuuacaccauuuccuaaugcuuuccuaaaggguaaaacauugcaaccugacagucuuaagccucgugagaaauuugagaaauucucuuuaacaaaaaagauguuuguaaauguuuucauaauucaucugaccucaugucaccuacuuguugugugggacauagaacaagucaaaauguuucuguuguccaguggaaaaugugcuuaauaagcaguaggaaauuauaagcuaaagcugccauagauuccugucauggggacuccaugcagaguuaagggauggaguauauucagaugaaauguaccuuugaccugaguuuaagagggucggaucaccugcuaaagaauccaucagaaggcagaaaaauuaaagcaauuucuguacaagcaugaggaccugaguucagaugcccagaacuccauguggauaccagguggacaugaugaccauugaguugggguucccagagaaagcuagcuagugggaguagccauuuuagugaguucugggguugauugagagaccacgccucagugaagaaagugaaaaggccauggaagaugauuccuagcauccuuggaccaccacaugcaggugcucacaugugcacauauacccauauacaugcaaaaaaacauacacacaagcacacgaacauaccacacacacacacacacauaaauggaaaaagaaaagaauccaucacuuugucccucugacuucugaugacugugcagauuagagcuaucucuaucuguuuuauauuguuacggauguuaaaugaaaucuguccagagaaagcaaagaugauguucuucuuucacacaagccaagcugauccagacugcugagggaucuuaugugacuauaugggucuccaaaaaaguuugcaaaaauauaucugaauggcucauauuuguauuuugaguuuagauauucauaagagguuucuaaaacauucuucgcaagcaaauaggcauauggaaugcaugugugcucuggcuucccucccaccccaaucacuucuguguggguagcugagccuaugugugugcauauggaggccaaagaucaaccuuagguaccuuccucuguggcuguccuuauguuuugaggcagggucucaccauuucagaccuugccauuucaacuaggcucacuggccagugagccuccuggggugcaccugucucuguguucuccccacccccaguucugggcuugcauguguaugccaacaggcuuggcuuuaugcaggugcuggggaugugcaacagcuacccgcugagccauuucccaagccuacuacaccuuucugauuauaucagauacucauuuacugguccaaauaacacuuaaucaaagauaaacuauagggccuuucuggaacagaaucaucaguguuucucaguagcuugaagugugacgucauauuuguggucaauacauaaaagguaauaauguuccuuaacucaagacccaggucaccuaacacuaccucuagauguuuagcagagcaagucacucauuucccucuugucuugguuccuucuguaaagcucggauugugauggcaucuacucauugagguugugcuuuuaaguacacagguugauaggaaguaagguaguaguuauuguuuguucugagggauuuugugugucuuugugauaaugucauagaaagggaacaaggaauaagaguuggaauauugacucuagggggggcgggucuuuauuuucaguaugcagaucuaaaucgccacguggaugcauugaacgcuuggagaaaugccaccguacugaagccggagcacagccuggcguggaacaacaugaucauacuucuggauaacacagguacagaggagaaggagaugaugagaagguguuccaccauccaucauucugugggcuaaccaaggcaugcagaccagugacauucccacaggcuagucagggcgugcugcugaccaguguuaguccuagaguuuaaaagauaaauaagcuggguguggugguaugcagcuuuggucccagcauuuggcagggagaggcaggcaaaucucugugucugaggcccuuaggaugacacagagagacuccaggaaaagaaagaagggaguggggaaggaagggagggaggaagaaugaaaauaaaucuggguuaauugauguuaacaaaaauaaccuuuucuagagaguggggagauggcucaaucgguaaaaugcucacagugcaggcaugaggccacaagucacacccuccucacccacauaaaagcccaggcacggugguagauaccauacaaccccaacacugggaaauagagacaggauccccucacuagccagcuggauuaaccuaauuaaugagcuccaaggucagugagaacccugucccugacuuaaaaaaauaaauuggauaacaauuuaagaagacaucugauacugacuucuagccgcaagagcacauccaguaccccagcacacauaaugaugcuaaugucuuucuagaaaacgaaauuuccucuaacauaccugaacauaaugugaugaaaaccauaauguaaugaaaauuaguguugaggagugggugugaucaggucucauuuauucugaggccuaucauugagccacacuaccuacccuucagcaugcuggaaacagcuagguacacauaggaucugcuuucaggucuuuucugagaggaauggauucuuaguuaaaauacaaugcugaugguuagaucugauuucucagcccauaguagaccagguucaacugguuuggggugggguggugggcucuguuacccuuguugugcuaucuuacgauacuggagaucagucccagggccuuggaugugguaggcgaguuuucuaccaaguagcccucugcugccuucuuuauaaaaacccaaccaucccuuuaaaaaccuuggugguacuuugauagaauugaaaacuaguaaaccaucuaaacuguguagacaggagguagauggcuuguuuuccaaaacauacagaacauguacuuggcuguaagaauauucagaaguuaguguugcuuugcugugcuuuaugucccacuuuggauauaacugguaucugggagaggauuuaaacauggucuaaaaugucuguuaguaguguacugaguugccaucccaugucucuuccacccacuagguugugggugugucucaugucuucucauguucuccuugggucuucucaaguaguauuuucaauacuguguaucaugcauucaaguuuugcucuagagagaagaagacacaagcacaguauugauuaguucauuucuucucccagguaacuuagcccaggcugaagcuguuggaagagaggcccugcaauuaauaccuaaugaucacucccuuauguucucauuggcaaacgugcuggggaaaucccagaaauacaagguggguaagcaacaggcuuugauguccugcagucagucgagcagcuacaggagccacgguguuuaugcccaguucaaugaaggguucggccagagcaggagcaccaggggagcucuuggucagauuccucuccugguuaccuaacagcuagacccagugucccucgucaugagaaaccagcuuguuccuugugcugaggagugagaagcccaggaaaaguaacuagaaugagcugccagugcuggguuccugugcuacauggcuggugucaagaugacuuagcacagugccacccucccagggcacgcuccuccuuugcaugcagagucugaccuugcacuuacaguagggcaggaguacuagguuugucuguggguucuaucuuuugcauuuuauaaaccucaguuucuccucugaaucacaugucaucaucaaggcccuagaggcuuuugaccagugaaaaucauaagaucuuaacucuggcacuaagauguagcucagugauagaaggcucgccuagaauguaugucacacauauacaugcaaacacacaugcacacuucuuccacugagguuuucagaaguaguaaguugucugggccucacucccuauagguucauggggccggucacccaacacucuauucucuauauucucauuaacgcagauuccuccccaggagaaucagcccggagcggggcaaaucagagguauuuauuuuuaaaugacauccugggcacuucacacagacauacuuugggaacacuuggagaagcagucccacagccuuuggaugaagaacuauuucaggauuguggucugauagaugaguuauuacuuaaaauauuauuuuuauuaauauuuuauaugaauauuuuauucugaauaacuuuauuucagaauuauaacagcuauguuuaauuuugaacacucugaggccauggaugcgauucaaggauaaacaguagcaauuaauuauuauucaccuuuaaagaacccuacuacuauauuaaucaauaccucucguaucauuucuuuauauucauuagacaucauuauugguuuaacuuucuauaaacuauuuuaugcauuucuaucauuucugaauauuggugaauuuagguuuuacuacacauuuuuaauucuagcuuuuguccuaaaaaaaaaaaaauggcuuuuugagauguuucauuuuauuuuuuuuuauaccucuacaugggggaaggguggguuagcaagaaugaaucaggagacucaguccuccauugacccggcuaccuacagcaagucuucaagaugcugauucugugaucauuguauugauuuuucuaucauccugcagucuauaaagugcaauuucuauuaugggaauugagcccaggguucauuuggcuuccuguucacauuguucccccaccaccaccccauaaguagaaaauacuccauguaacagaaugguacaauagguugcccaucuguacacauuuucauccuaaugggcaaggccagagugcugagccuaugauaaggaaacaagaugaaaucugaaauaaggagcucauuuugagcucuuaggcagcuagcagcagggggcaugaugggacuuuuccagccagggguucagccagccuaguccagccauggagccagcaucucauacuuuauuauuuuuuuaaguuaaggguuuagaauguaaacauuuguauagcuuuucugucacaauaggaggaggauaucuuuuguucuuuaaccugcagggugcccuguccagccuguugacugcauguugacagagcccugggcagaucaguggggagauggggaaaugguggaaauagagucucacaggauugguaggcuucucuucuaguccagggauugggaguggugugugggugugggugucugucugucugucugucugucugucugucuggggcgagaggcugauguaagguaucuuccucagucacuggcuaucuuacuuuuugagucugagcuggaucuggagcugagugauucagccaauuugacugucaggagaaauccagugaugcuccugccucugccucuccagcgcgacaccauuuuuugcgugggugcugggauacagauucagggccucaugcuugcagucgugaaaugaccaaaugaauuucucaucaauaucagcaugcaggcuucagcagccugcuaguagcuucaguguacagaaaaugugucuacuauauugagugucucuagugcucaguuaagagcccuagaaccuaaccgcagucacucaccgguccaucauucaguuuguccuuguauaaagugaagauagcagucugccuggcuccuggcaauaugauaggagaacaugcaugaggguggaauuugcaucuacugaaugguaaauacaugcauacaaaaugauguuagcuuaauuaucauuaaaugaaccucuguugaucacuuuuaaacccauuaaaauuaauauugcuuuccaguucagggcuaaugugggagagccaaggugauguucccagccgucccuuucugcauugcucauucacugcguugggguuuaagggcauguccuagugagagaguaguuucccaaacucuggucaugugugccacacuguuaagaacuccuuuguuucucauauagguucugcccgauuuauuugcuuugcuuugcuuguuuguuuauuuguuuauucauuuauauguuauuuaagagacugaguuuugcuauauuuuauuauauaacacagguuggcacucuuccauccucuugccucagccucccaagucccugggagcauaguacauccaguugaugcuucucuuuacguaaauguucauuaaauuucuuuuuauuuuaugacugugcaccacaugugugcauugccaagggaggccagaaaaagacaucauaucccuugaggcuggaguaacacaugguuguuugaagccaugugaauguugggaaaccaaucuggguucuuuggaaaagcaacuaguauguucgaaugcugaucuccagcccuuugaguauauuuugaacacaaauaaauguguuuuaaaaggucauuaucagaaaaauaggguagcuaagaagugaaaguuuuacugagucucagcuacuuaacuaucccaggcauaggaucugagccuuuaaagggagauuggcccaugguagaggguaugagccgcaaaccaccaguugcacagacuuugaccugagugaaucgaaaggaagguaucuucuugugcuugguuucaacugcacauuagacugucucccuucccuuccccgagucauggcccuuaggacaucccaucugagggcacaggcuuagucuuaaugaccggcugcugcugugacauuuugucuuucagguccucucaacccagaucuccacuuguucuaaagacuugcaggaccauuuccggcucuaaaccuuuguuaauugccauuauuguucuucagaagagaguguauuacuuuuccuuuguguugauaaacaaaaucuccaaacuuugguuuagguugguuguucugaaucuuaucuaaaauguuggacaaaccugaggaucucuaaaggcugcuggagcugggauguaaaacuggcucaucaaugacauccuguauaucagauugauggcuuuauucaaacccuuuuaaauaauacuucugcacgaccagguuuucucugagcuauguggguucagaguuauccaccuagacacccagccuauuucccaggacacccaugggcuaucccauggcaaagaaacugcuguucuugcacuuuagaaaaugcagagguagagcggcagaaagcccacucagagaagccaaaauuauccccagucuagcaucauggguuguuuaagcucagcauuuggugccaguugcagugagcuuggcucuacgugugggagacaugcauuguggccuaggcuuauguuaguaaagagguuggacaucuaucugugggcaucaugguagaaagugacaucuaggcucagucugguagaaaaccacaucacccugcuucauggugaccucacugcaacuaaggacaacuuagaggaaaugcaaaucuguacaaaaaucaucccauacuccccaagggucacaagggucucacagucaugcacaguauuggacagcuuccauccuaaguggccauuucuuccucauucucuuugcuaauugcuguuguaugugggauccagccucaucugggaugcaaggguguucuggauuucugaggagacugaacggcucauaccccuaccugagagucugcaguaaggccuucacuucagguugggcaugcugcccucguugguguccuugacagcuuggugcuuuccuugucugugcccuucccucagugcacacugaaucaagucaucugauuuagguugugaaaucccagcuacuugugagguagagcuuacaggcuuugccauccccucucucuggccaccacuguguucugccacccccugccaccuuccauguuagcuucuuuagccucuucugagcagggcuguuucuggaaaggauuuggugauacaaaacaaugaugcuagaaaguaagaugauugguuuugcuucgugcauaauaccuucuucugcauguauuuuguuucauaggagucugaagcuuuauuccucaaggcaauuaaagcaaauccaaauguugcaaguuaccaugguaauuuggguaagaaaauuuuccauuugaauuguauugaaauuuugauauuauauacacaagcacaaacagacacacacacacauauauauguauauauuacauauauauacauauacauacaucauucauauacaugaauauaauauauugguauauauuauaugaauauauauauauauuauauaaucuuuugcagaaguaacguuuaaaagguaaccuauacugacccugucucaaaugauuuuuuuuuuaaaugggcuggugauacagcucaguguagagugcuuacccagcauacgcauucauguuccuguaccucaugaaaaacauucccuauauacaaaucaggcuuaggaugcugaaggcuugcuuuauuguaacuaucaucuuacagccucauuuuuagguuagagccccuaguucugccuagaaacacagcuguuauuucaccaaaagauuuauggacaucuucauuuaaaauaaaugguugugguuauagaaacagcucagcaguuaaaaacacuggauguucuugcagaggacccagauuugguuccuagcaucuacauggaggcacacaaccaucuguaacuuuaguuccagaggaucugacaucuccuagucuccaugcacaccaggcacugcaugcaggugguauacauauguacaggaaggcaaaauagucauaaaauaaaaauaaauaaaucuuuaaaaaaaauaaguugugggccuuucuaaaaaaggggauaaaauaauaaaggaccggacuuuggcauagcccaagcucaguacacugcugacuggcuagaaguuucacagcagcacugaacagucuugugcccuuucuuguaauaacauuucuggaagcacgugaaucccaucuaacaauaagaagaaacucaugaguaauaggcagggcccgggguacauuccccagggugugcaauuacaauaaauaaagcuuucaguacaaacaauauuuuuuuaaacagugauuucuguaaaggcucugcaaugguucuuugugcguguguuugggaauccugcaaguuagucagaagcacuuccaacuaaauucaucuccugcuauuucagcugugcuuuaucaucgcuggggacaucuugacucugccaagaaacacuaugagaucuccuugcagcuugacccuguggcaguaggcaccaaggagaauuacagucuucugagaagaaagcuagaacaaacgcagaagaaagaugucugaucuucccccuaauguuuugaguuugugagugugugcaugaagccucuguucagauuguguguuuagucauuuaaaagucucagacauuuauuuuauucuauuguuauuuuuuuccuaugaaaacaaacacaugcaaaaagauuauagcaccagcaauacacucuugaaugcuugauaggauuuuugcauugaaauuguauuuuuucacacaacucaaauguaauucuaaaaucucaaaaaaaaagaaaccuuuuuuuaaaaacuaaacagaaaaaaauauuauuuugagugaauuuugauuguguuaaacugcauuugggaugugauggagugacuuagacaugccuccuacaauuuacauagccaucuaccguuaucuguauauuagcuuguuuauuuaaugacaagaaagaguaaaucagguuuggguuuuuuuuuaagucucuuugcaacaguguaacuugaaguuuguaagaaaauuauuuauucacauuuuuguguugaacaggauaaauaauugaagaagggaaaauuuuaaugucuauauauuuaucuauauauuuuuuucauaggaaguuauggacucccaugcuuuuuugauauguauauguauucuccaaugugugugauguuaguaugcaggauaauauuccacuguuaauagaguaccccugacguacuuuaggcaaccuaacauccuggucucuguucuguccacuguucagagggcuaccuguguguauaugcuguguuuucauguuuuaguuguaaaguggguuuccaucucacaugauaaaaucacagacauuacucuauccagaaaaugcaaaaagguucucuuucaaaagaagucauagcucuggauugugugcuguucuuauaaacuggguuuguuuuuccuuuucacauuagaucucaacaauuuguuuacuuaguuuguucuuuauauacuguugaccuaauaauuuaugccaucgcugucauuucuuaugcaguaaaauuaucacacaaacugucaugaaaacugucuugguuucuuuuuaguuggauguuuuugucccccucucgccccuagagucuguucuuuucuaguauacgaguaaaacugguuugcaguuucagggcccacuguccauuccuuucccacugcugagacaagacacccgaguaacaggauaaagguggaggggcuuauuuuagcguggauucaggguacaggcuguugcagcagggaaggcaugguggcaggagucugagcagccacuguauggacuguguccauagucaggacacagagcaaugcuugccgcugcccugcauccauucuccuuccauucucugcagguccccugcauguggguugcugccacucacaucuaugccggcucuuaccaccucucucauaccucugaaaauacccuucaugaugcauaggugggccuaaagucagucaaguuuaaaacaaaaaucaucauaggccuauuuuauaggauucuauuaugaaguuaauugauguucaaauaaugagaucaaugacagauccguauugauagauuugauucuguguacuaaauuuuugaguaaaacuuucacuuuuaauuaaaagcaaguggaagaagugugcagacaggaaccaggccuggugguguauauauaagcccaucuacuugggaggaucaccaauucaaggccugcuuagguuauagaaugaauucaagaccacauugggcagcuaagugagaccuugucucaaaaguuagucaggguuuucuagagaaaaagaacaggaggggguuggagaaggaggaggaggagaaggaagaagaggaagugggaggaggaggcagggagagagagaauaaaaagguuauuggauugauuuacacugcacuuucuagguuguccaacaaggacuaucuuuacaauagcugguucucaguaaucccaaucuaacucugaaggccaggagaauucccccagauagccacuggucuaaagcucacaucauaaagcuaaagaaacugaaaggaaagcagcaucaguggcagccacaugguagauggacucaacagccaggugcaaaggcaagcaaguaggaaaaaaaaaauguuaacuuuugcaguuccuugcaccugggcuguggcaggaccaugaggcccauguuuaagaugggucuucucucagcuguguugcucuaaguuuucuacuuggucacucagauuuguuugcgcuuucaugcaugcuuaaguucuuuuagguuucaucccauuaggcccagccacacaucccugcauagggcuuucugguuuugagucucauauuaccuaguguguucauugcauaugguuucaaauuacugacuugaagguauauauagaagauuaagcacagcaucaaaacuuuggacaucugugccuauauucuugaucaaccugcuuggacccagauagacacaucuugauacuccugcuguaacauccuagguaauuuguuuacauuauucuccccauuuuucaaguuuaaagugggucauaagacuuuuuuuuauaagaugagaaccucaguggauacugaaauaaauuaccaauguuagaguggguuuuuuaaaaaguagcugugacaaaggagagcuaacauuaguaaauaugucuguucccucguucauucaguaaaaaguaagugccugcuguauuagucacgucuguauugcugugauaagaacacgauggccauggcaacuuacagaagaaagcuuauuuggauuuauggucccagguggagucuauuuuggcaacgcagacauuugguggcauagcagaagcugagggcccacaucuccaauggcaagcacaaagcagagaaagccacugggcauggugaaagccuugaaaccuuagccuucaggcaguaauauaccuccuugaucaaguuaaaacuucuuaaauuuacccaauauucaaacauuugugccuauggauaacauugaaacugccauaccuacuauguguuagaguaacuaauuucccauuuuguggcuuccagauugagaguuguaucuguguagacuguggcuauaccucagugguagaguggguaaccuaacaugcacuugguccuaggauugagccccaacaccauaagaacuaacauuuaaaaaaaaauuguagcuguguucacuguacauuucuuuugggcaguaugccucuagaguauaguaagacacaaauauaugugccagucuagagauuuuaguuauuuauugcaucuaauuaucgcauucagguuaauuuuuaacgucauuggagacccacaaaggcuguagucucucugcuuucacggaggcuuucugggguggacaacucagacaccugucagaaaauuggacucagcaugccucucaagaucacaggauuagcaaguggccagagcaagcggaugagucuucuugauggauuaaucagagcuacucauaauaaauguugaaagaauguugauuagaaaaucauccuuuguuuggguuuuugucccaaaugaauuaauugauucaggcaaagagcagcagugaauaaaaccauuagcugggaggcaaguccagaaagcugagcucacugcugacugggaucaauaugugacucccacugugagaccaugugaguuacauaaacaccuagaagaauucuaaaauaaauaguuccaccugaaucuaagcaaaaauugcacgaguccugaguuuaaauuaaauacuacagaugauguugaauuuguuaugauauaauguaaggacuuuagauuuuuaaggaagauauacaaugcuggauguggagauacacagcaggagaauggugagcuugaggucauacuggacuacauagcaaguuccaagucaaccuaagcuacuuagugauauuuaguaaagggagugaggaaggggaauaggucucaugguggcaggcauggggauaucccaacaucucuaagccugguccaauucaaggccgaccuagauuuccuugggagcuuagccaggucugugggucuacccagccugguucuugccuuccuguuccaucaccccuaccugguggggaugagaaaacaaaguuugucaauggagagaaauguuugucagggcuaccuuuggaaauguaauuugccauacacaucugcaauaguguuuauccacuucuggacuacccuuuggucagaaucauaacaaaggcuaugcuaaauacccugccuagcaagugucaugccauuggagcauucccucacuguuacacuugcaccaacugacugacaucaggaaacaugccauuccuuuccccaacuuggucccauacacagcacuaaacuucaaaugauaucacagacuuccacuuuuauauauucugguuaccuccaacuuuaaaauucuaaauuuccaacccguuugugguaacuugugauugcagcucuacaaagguaacucaguagcaaacucucaguaacaccacugugagauuagccaaucauaucagagugugagacuucucucucaacaaugggaugagacucagucaucaccuacgccugaaauaaugaaugggagccaucuuggcccuagugugcuuaguagcuuaguuugguucuuggugcacccauuuuacaaaaagaauugccucguugagauacuuggacuuuguuaaggugagggguuuuguuuguuuguuuugcuuguuuuuaugagaugcuaagaugauucuuugcgucuaccaagcuuucauuaguaaaaugggaaauaaaacuuuucacagaaguaugaggaaguuuaaguaauacauagacauaagagcaaaacacauuuuaaaaaauucuaaaaacauucugauaaaguauguauggagggcuggagaaauggcucagcaguuaaaagcuuccacugcucuuccagagguucugaguucaauucccagugaccacaugguggcucacaaccaucuauaaugggaucugauacccucucgugaugcaucuuuagauagugacaguauacucauauacacuaguuagauagauagauagauagauagauagauagauagauagauagauagauagauaaaaguaguugcaugguagaauuuacuuuucagcaaacaaggugauaagguuggaagaacuuuggaacaagaccaugaaucucagggucagcuuucuugcuuguguggugguuugaaugaaaaugacccccauagacacagaguggcauuauuggagguggcccuuguuggaggaugugugucacaggggcugggcuuucaguaucucucucucuuccugcugucugauuaucuggauguacaacucucggcuaccuaacaucaugucugcuuucaugcugccaugcuucucaccauaacaauaauggacuaaacucuaaaauauaagccagcuccaguuagaugguucccuuuauaagaguugcuguggucauggugucucuucacagcgauagaaacccuaacuaagauaucauaagucauuuuuaaagguucagugacuaucaaagacagaugaaucugauuuuaccauauuuaccuggaaccugggauuaguugcuuauuuacuuugugccccaguugcuuccaguaaauacaaugggaccacuacugguuuuauugauuucuccacuguaaaaugagauugugguaaaggaguaacuucaagcauacuuagacccuuaaccuucuucuucaacgauuuaguuuuguaaauuagcuugccgcauuaugaguggcucugagacuuucguaguacugcuuuguucuucucuccaugccuccuucccucaucccugcccaucuuugaugucauguguaauccuauuacucccuguuucuccccuucccaggcccuccuuuaagaccccauuuuccuucucaugguccucuuucuauaaaauuggugguuuauaaaugugaugauuguucaggguucuuguagacuuggacaucuauuuaaaauacaaccacuucagcaucauuugaugcuacgugaaaaccaagaauauaacacgauuucaaguacuccacauacacaaagucaaagggaugggaaaugaugaaaggaaaagcaguagucauauaguuaauuugggucucgaugaggagacaaugggucucuagucucaccaucucugugacguugcuuucacaucccgauagggacauauagaacucuccagcaucacgccugccugcauucugccauaggaacauccuuccaugauaaagaucucuagagaaaaaauugcccucagcuuuugguucucauacaucuuauguccuaaggguaggauguaggggaaagcuaguucuuccauuagcuccuaaacaaguuuuauuuuaaaaagaguugguaaguaggcagaauugcuacaguuaccuguaucccguagggauauguacgagcagaugcgaugccuuaauuguccuguggagccuuccucagaucugaguuuagcaucaccucagugucuaugugaaggggugagucucucugaaguagugaaucuuaggcguguuugggucuaacguggagucaaagcaugugugauguagagcugaaccuggugggagcagucgagcccgugucugguggugggaguggugguggggagcuugcuugcuugcauuucggaggaauguggcuucggguucuuaccugcgcgguuccggcacauggggaguggcgugcgcgcugccaggugcgcuccguggcgcugccggggcgggcggagcggcgagagaccagcaggagcgccgcccggggcgguuugguugcgacacccgcccagcugggcauuuccgcuccgugguccgggcgcgcuccucgugauucccccgaccgcugcaggugaggcgccgaggcgggcugggacugggagccugggggcggcuuagggacucugucaccagccagcgaaug

SEQ ID NO: 7658 - RNA, 2794 nt, Mus musculus
uccugaaaauauuccaaccaguaagaaggacacaugcuccacuauguucauagcagccuuauuuauaauagccagaaguugaaaaguacccagaugccccucuacagaggaauggauacaaaaaaugugauauauuuacacaauggaguacuacucagcuauuaaaagaaugaauuuaugaaauuccuaggcaaauggauggaccuggagggcaucauccugagugagguaacccaaucacaaaggaacucacaugauauguacucacuguuaagugaauauuagcccagaaacuuagaauacccaagauauaggauauaauuugcaaaacauaugaaacucaagaagaacgaagaccaaaguguggacacuuugucccuucuuagaauugggaacaaaacacccauagaaggaguuacagagacaaaguuuggagccuagacaaaggauggacugucauacccagggaucuaucccauaaucagccuccaaacgcugacaccauugcauacacuagcaagauuuugcugaaaggacccugauauagcugucucuugugaggcuauucuugguccuagcaaacacagaaguggaugcucacgaucagcuauuggaugguucacaggguccccaauggaggagcuagcgaaaguacccaaggagcuaaaggggucuucaacccuacagguggaacaacaauaugaacuaaccaguacccccgcccccagagcuugggucucuagcugcauauguaucagagguguccuaguuggccaucaguggaaagagaggcccauuggucuugcaaacuuuauaugccucaguacaggagaaugccagggccaagaagugggaaugguuggguagaggagucgggggggggguaugggggacuuuugggauagcauuggaaauguaagugaagaaaauaccuaauuaaauaaaauuaaauuaaaaaaaagaauaucacccacuuuuaucaagcuggucauauccuaaacauacauguuuaguucaacauaccuaaggaaaaaaaaaagaagaagaagaaccacgucuuugauuuccuagugagggagaaagcaacauucagaacaugaguauaaaggcuguccuuagacaaguauugagaucuagaggacaaaguuguugacaaggacaaggagccaaagaauucauggccaagcuauucauucacugcuguacaggcugcaguacuugggaaguccgaaguagcucucaucaccauagcucuuguucccuaagaacaaugugagcugagagcagguaaguuugcaaggucauaguggaugaaucauaaagagagagaagacaggcauggaaaugcacugaucuagaacauagaagagugcucuagugggguuccuggcaaggaaaccucuugcagaggcacaugaccccaaaagaacagcagugcccauugcguauggccuccagagaaauaggacugagugcuugacugcagcucccugcagagaacugccauguucaggauacauaccaacaucagcauggagaagccuuugccugugauacauucugaagcaugacauauagguuaggguuaggguuaggguuaggguuaggguuaggguuaggguuaggguuaggguuagggucagcucuuccuccugcaacugugagaggcaaacaaggacuagagcugcuucagaaagcaggucuucucuuccuguagcuccucacuggcucaucuugaguuaauuccauguuucucucuguaacacugaagaugauacuaucaaauauccauuuuuuccucuaaucugauucagaacccuauugcaagccacuguguuggcuauuguucuaggugcagggaaggggaaaugaguuagaaccaaagucagaucuguccuuaagaauuacuuuauuuuaauuucaugccuuugucucauauuuccucucauuucuccuuauugauuauaucuucuaccccaaggcuuuuugaauaagacauuuuuugaguacagaaauuccagcuguugaagaauaaugccaccagcacaucugaaugagcaccuuguaacagaugcauuaauauuccuguagcaauucuugacaaauaacaaguaaaaucaauaaguaugucucaugugggaucagacauugccccuaaaugaguuaaaaaaauuucauuggggauauucaccaguuuuugaauguaggaagcuugaguagggcuguaggucuaugugauagucacugcauuuaggaaccugcccuuauggccauaugcuccaauuuuaccuccugguauauaauauuuuuaacugugugguguugggcaaauuauucucuaagcucuuuucauaaccaaaauguaagcaaaagugcuacuuuuugcaucauaaauauugaaaaauauagacaccacacacaugggcuaaaaugguuguaagagguucuaauacaccuugcaugauguguuagauugaugccauugugaccugcacuaaaggcugggcugcuuucuaaacacuucucugacucaucccuucagccuaccuccauuuuucagucauaaguggguggcuucucagauagccagugaauccuccauuccucucuaccuggucacuucacuaucccaaggaaaucagaucacuccuuuugccccuucucagucacugagcuaauggcaaugcugacacucugaacuguaacacccaaaggaggaugggguauaucccagcacaugagcaugauucgaagauaaaucccugaaagcaucauuaaaauuuacaggaaacac

SEQ ID NO: 7659 - RNA, 563 nt, Mus musculus
agauuuuaucagauucauaauaaacaaaagaauuuuaaaaagcagucaugauauaaaauagcagcuccuguaauuucugcaaguaucaccuucuucagaaguugcuucaauucaguuugccucauucuuagaagccucaucaaaauucuccaccagaucuggaacuucaucaucaucauccucuccaguagcaaguggugcuucuccauccacagauugggcagagcuucagccagucuccuuaaacuagucagacugucugcacgcagcugguuucuguuagcggcuuugucucagcguggcauguaauggugaagguguuugcugccagagauaccugaacuuuaggguuguuaaaauagaucacuguuccuugguuuguaaacauguucaccccuucaauaccagagauauuguuuaccccuaacuucuuuaaggagaacugcaguuuuuuaucggcugcuguggcuuuucugugaaccaccuucuucuuucuacgagcaguuccuuuuccaccaaugcgcacuugugccugcaguuuggagaguuucuccugguucaug

SEQ ID NO: 7660 - RNA, 1294 nt, Mus musculus
gauccauuccuauuuccuuuuuuuuuuuuugugggugcagcgaacuuuauugaugguauucaagagaguagggagggcuccuuaggccccuccuguuauuaugggguucugggauggaaauugugagggagaugcucaguguugggggccgaguugggauagggccucucucuugcucaguguccuugcuggggugggugguccaggguuucuuacuccuuggaggccauguaggccaugagguccaccacccuguugcuguagccguauucauugucauaccaggaaaugagcuugacaaaguugucauugagagcaaugacagccccggcaucgaagguggaagagugggaguugcuguugaagucgcaggagacaaccugguccucaguguagcccaagaugcccuucagugggcccucagaugccugcuucaccaccuucuugaugucaucauacuuggcagguuucuccaggcggcacgucagauccacgacggacacauuggggguaggaacacggaaggccaugccagugagcuucccguucagcucugggaugaccuugcccacagccuuggcagcaccaguggaugcagggaugauguucugggcagccccacgaccaucacgccacagcuuuccagaggggccacccacagucuucuggguggcagugauggcauggaccguggucaugagcccuuccacaaugccaaaguugucauggaugaccuuggacaggggggcuaagcaguugguggugcaggaugcauuguugacaaucuugagugaguugucauauuucucgugguucacacccaucacaaacaugggggcaucggcagaaggggcggagaugaugacccuuuuggcuccacccuucaagugggccccggccuucuccaugauggugaagacaccaguagacuccacgacauacucagcaccggccucaccccauuugauguuaguggggucucgcuccuggaagauggugaugggcuucccguugaugacaagcuucccauucucggccuugacugugccguugaacuugccguggguggagucauacuggaacauguagaccauguaguugaggucaaugaaggggucguugauggcaacaaucuccacuuugccacugcagauggcagcccuagugaccaggugcccaauacggccaaauccguuuacaccgaccuucaccauuuugucuacgggacgaggcuggcacugcacaagaagaugcggcugucucuggaacagggaggagcagagagccuccuauu

SEQ ID NO: 7661 - RNA, 26366 nt, Mus musculus
guuuuguuuuugugguuuuuuuuuuuuuuuuuuuuuuuuuuuuggagacgaaaaaugucauuuuucuuugggaugaaaauuaccaacacuccuaguuuucccauauucuggcuuaugacaucaaagcaauguaacaucaaacgcuuuuguuccaagaaaaaguauucagggggaagaaagcugcuuuaagguuugagcaauaguucucaaccuucuuaaugcuaugacccuuaauacaguuccccauguuguggugacccgucucccaucauaaagguauuuucaaugcuauuucauagcuuuuuuuuuuuuuugcuacuuuuaugaaucgcaauguaaauaucauuguuuccugaugaucuaaggggguugaucccguagugggucgugacccacggguugagaaacaccugcuucuccgccaagaacaauaacugggagcaaucuucguuaaucaacucucuauuuuacaaggauuacuauaaggcagaaauagcucuggauucucucaaggagggggaaacccuuucaauucucccaccccuugaucuggcauuuuaaguuacuucacauuugcccaggaagguucuacuguuucuuuuaaucuacaagaaaucaguggucucaggcuguagcucguuugguugagugcuggccuggcgugcuggguuagauccucaguagccuauaaaagugagaaugaugacucaugccugccaucccagcacucuggggauuaucgcuagggagaucacauguucaaggccauccucuccaccuagggacacuaaggcugauuugaacuaccugagauucucaaaacuaacaugaacuaaagugggauaaaugacucgacaguuacaggcacacacugucaagccugaagaccugaauuugaaccccaggacccccauggccgaaggugaaagugaacucccagaaguuauacucugaucuccacaggccuaccuacaguacacacaugcauacauuaaguaaaggcuuuaaaaggggaaaagcaaauaaucacaaaacagucccguuacgucaacaggauguugccaaggagcgaaaggaagcugaguuuugugaaaccacucgccaguuuuuccugaaacugugaagccuugagauccuacuacagcaucaagcacggagauacacuuguuuaaaucuugcuugcacuccuggacagaggcagauguaucccuaugagguuugggacuacauggagagcucaggcuagcaggacugaaacugucccagaggaaaagcaaucuucaaaaucuaaagaucauacacagaacuggggaguuugaguuuagguuuugguuuuugguuugguuugguuugguuugguuugguuugguugauugcgaaauguuauugucagauacaauuauacuuaacacacagagugcaaagucucaaaaauccuaggaccaaaauaaaauacucugagaaaguaugaaaacaaauguuuaucacacaucauucacucuccuucgaaacauauuuuaguuuuucuuuucuucuucuucuuuuuuuuuuuuuuuuuguuuguuuguuuguuuguuugagacaggguuucucuguauagcccuggcuguucuggaacucacuuuguggaccaggcuggccucaaacucagaaaucuaccugccgcugccucccgagugcugggaucaaaggcgugcgccaccacgcccagcucgaaacauauuuuaaaucaauuuaacacauugauuugccuuuccauagucucaguuagaaagugaauauaauaaaucauacauuuuaaaauuuguaauucaauaacguuuuguuguuaaacguguuuaaguaaaagauacuuaauuuaaaauaaauuaauaaauguauccugguauuauuuucacuuugggacuauugcuuuuauugcugaaacacagucuuuuuucuuuucacuuuuuuuauuuuacucuaauuuuauguacauucuuaguuugguuuuuuuuuuuaauauuuauuuauuuauuauguguagcugucuucagacacuccagaagagggcaucagauuucguuacggaugguugugggccaccaugugguugcugggauuugaacucaggaccuuuggaagagcaguuggcgcucuuaaccucugagccaucucaccagccccuuaguuugggguuuuaagauuuauuuuaugugcauuuuuauuuugugugcauuaguguuuugccuguauguaugucaaugagaggguaccagguccucuggaacuggaguuacagacaguugugagcugccauguaguuguuggagagugaacauaggcucucuggaaaagcagccaguccucuuaaccccugagccaucucuccagccccuacuucuacauuuucuaagugugcagaaagucugaaauaguaagucaaacuguuggcaggaacuuagagauugucuuaucuauugaccacagcucaggcuuaagcaguuguacaugcucaggguuugggguuuggaagguuuuguuuggaggcacuuuguuguuguuagggguguguguguuguuguuguuguuuuauuuuuauuuugaguuaaagcuugcauccaacuaagugugugaaauaguaaagaauagccuucuauaacuccuugcuuuuucucuuuccuuucuguuuaagaaacguuacuaacaccuucaucuaccuuuuucucauucacucucucacggauccaucuccaaaccuucgcuuucuuuaaaugcuuuguaaauccagucacuacgaaaacugacauuuuucaaugauaugaaaaaucguggucccuacaguugaagaagguggacaguaugauaucuacugagagaguccuuugucuuccccugccuucaaccgugauggagugugcugcacagcucaacaggcuuccagcuuggaggcaaagauaaguuagucuguggcuaacacugagcuacugaccuaucauagggacuccagcccauuuccacaaagcauauuggaguauaagcaggcaggaauuacauagaaguggcucgaagaauccacucuagcuuaauagaaggugcuauaaauuguaagccuacuuuaguacuauggcguuuauuaacucaaaugagacgggcccugaugaaaacacacagggaugacccaacccuggugagcauaguggaggaccacagaggccgacaguguacuccucucuuacucucuaacucauuggugcuucuaaaacauccugucucuuccuggucuuuucuuaagcacucuauaguuaauaaacguauugcuaauaacuuaauaaauauuaggagucuauaguauggugcuucucuuaucaccucagagucuguuaguaauugugguagcugggacaggauaguaagauaggaaaagggaccauggagauggcucgguggauaagggcauuagggacccaagccugauaacccaaauuugacaaaaagcaggaugugucugggagaugguucccuguuaaaaguacuuacuuucugucagaauagagagccagcugaccaccagcaucuaucccacucugcuaauuguggacacaauguaaccagccacuuggugucccugcuacuuugccuucaaggccuaauaagcuguacuuccaacacaggaaccuuucuuuguugucagauaagccccaggauguuucccuguauuuagaugcuacugacuaaacguguguaugcccaaauuuuaucuguugaaauucuaccuuuacugugauuauacuuugaggggcaauuagguaaauaccacaguaacaagauccaugaccauaacgaucacagaggacucucauuccaucauguaggauggccacgcagccuaacagucuacuuuuuaacagcgauuccuucccagaacuuggaucucagaccucuacccuccugggcagugaaagauaaauuucuguuguuuauaagcaaccugaccuagugguauuugcuuauaaaagaugaauuucguaaaaaaaaaaaaaaaaaaaaaaaaaaaaaccaaaaaaaaaaaaacaaacaaaaaaaaaaccuuguuuugcucccugaaacaaacauuuuuuuuaccagauucuccagcauacuccaacuauuuaauucaauuuuucacaauuucuuuuuuaaaauggugucagaucccacaaguuaaaagcuuggucuuaucugaccaccucccuuaucaguugccaaccaugcgccuuaggcuacgacucggguucuaaacauuaggaucaugaccuuucucuacuuguuaguuuucuaaagcaguucacagaaccuuagagaacaguguacuuaccagcuaguuauaaaugauaucacaaaagacccauucggaugcaaaagacagaucaggcaaaggauucaggaagagguacccaagccugcgccuggcacacugccaacagggaaaccaugaauguucagcaauccaaaccauguguuuuguuuuuaaauuuucuguggagucuuuauuacauaggauucaacugccaucucuuuguccuccgcagaggcuggaaguagaguggauagugccaauuuucuaauaauaggguugguuccuuugguaagcaugcaccaucuuuagguuauuccaaaaucccguuguuaggaccaaaaagugucccgaucauauacaugggugauugcagcagcccaaaccacggagcuggcugugccccccuagucuccacucucugugaugcugccucagacauuuccugguuuuggcauccuucccaguguugugcuacucugguaugcuuuagaacagcccacuaagaugcaucccaugcuuuucucauagcuacacuccuggagggaagagcagguuuugcuucaucacacauguuaaagucacucccuaccagcagcauuuaucccuguugaccuugaccuugguuaccuggccuugucacauuccuucuuacaaaauuacuagguuuccucuuuccaauaucuggaaggaaaucauucauuaaaguccauacauaagaacuggaaacauagggcuggagacaugguucagcgaauaauuggauaaaaaaacauacuggucuuucauaggaucaauucccaacacccauagcaggguggcaugcucagugauuuagagcauuugcugcucuuccaggcgaugggaauccaggacccagcuccuucaucagguugcucagaucuguuucaagcaucugauguccucuuuuggacucugagagaacccgcacacacauggcacauacauagcacacacacacacacauacacaaaguaucaaaaaacuggaaauuuguaaucuuucuggcuuagcuuggauuaggagauguggccuuguuggaguagguaugucacugagagugggcuucaagauuucaaaagcccacauaauuccuggucagugccucuucauacagaccuugugggguauggaucaauuguaagcucucaguuacugcuguagcaccaugcuugccugcuuccgugcuccccaacacaauggucaugaacccuaaccugcuggagccaugggcccuaaauuaaaugcugucuuguauaaguugcuauagucaugguguucugucacagcaauagagaaguaacuaagacaaccaagcuggccuugauguggcaugauccuccugccucugcuuccuagucccaguaugacacucguacaucaccaugccagucuacuuauuuauugacagcaaugugagcugauggcuauuuuaaauccaacauuuuuuuucuuuucuuuucuuuuuuguuuuuuuuucgagacaggguuucucuguguagcccuggcuguccuggaacucacucuguagaccaggcuagccucgaacucagaaauccaccugcuucugccucccaagugcugagauuaaaggcgugcaccaccacugcccagcuccaacauuauuuuuuuguuguuguugcucaaauuuuuucagcuuucauuggagacuucuguaucuuuuugaucuucaccaauguaguuuaauaguuucacccuuuuucacuuucugcuguuccaggaugcuucagacucaucugguguaguucuugcuauuggcuuagagucauuuauuucuuggagagucuaagucacuucuuuuguagauugguauuugguacugagcaugcucauuaccaguagacccucucagcuaaaagaucagcgaaauaggcauauaauggguauauuaacuaauaaaucuauucauaucucaaaauagucuauguagggaaccauugucaucagacaugaagccagcuugcuguuaccaaaacauuauaaacuaggugacuuacuguggggagcggguguggcggcagucccaaaggcgccagggacuguagcuaagucauaugacuugcaccugacuuccucauauaagacacaaacaucuugagugcugcgcagguguaccaggauacaggugaauccaauuugguggagauuugccccugcugcccugauuagcugaggcugcgugccuggagaggcggcguggccugcugugcguggaugagaguauaaaagagugagaggcccaggcuagagggaggauuauuauucgagagaggauuacuauuaguggggagauauaaaaacaagggagauauaaaaacaagggagauauaaaaacaagggagauauaaaaacaagggagauauaaaaacaagggagauauaaaaacaggggagauauaaaaacaagggggagauauaaacaagaagaaacaggacugaauaaaugugugcagaaggauccuguagcagcgucguucuuccuggccuguugagcgcgcgcaacaacuuacaagcaucaaaaguucauuguucauggucuagagaaugugaagucaaugaucaaaacaccagcacaaucacuguguggcaagagcccauuuccugauuccuaguugaugacuuacugcuguuguuucacaugguggaaauggcaagagcucucugaaacuuccauaggggcagggguuccauucuuaagggcuucauucucgggaaccagccauucccuucaaguguccaggucacuggagcacugguaauuaugacuuccacauguaaguuuagagagacccaaaucuucagcuuauacuacaugguugcaucgguuacuuuucuguuguuguaauaaaauaccccaagaagaaguaacuuagggaagacaagggucuuuuuggcuuacgguuccagggaaucgagcauucuauggcagagaagacagcaauaagcaaggaaaucauggcaaugggaacagcaggaucuguuucaucaucugcacauaagaagcaaauagaaaaguggggccaggcuaaagagaaaccucaagaucugccucaaaucauauacuuacucccccuagcuaggcuccagcuccuaauggcucccuagccuucucaaacagugguacuguugggaagcaaguuuucagaccuaggaaccuaggaaggacauuucucacucaaagaccauaauccuuaucuguaggguuuggucuguugcuacauauucaaaugcuaaauucuguaucccaagaucuuguuacgucaagcugagcaauucucacuacaccugccuuuguuguguaaauguugcccccuccccugaguuaucccugauuggcuaguaaaaguugcugacagccuguagcugagcagauaagugguaaguggugcaaaaguucccaggcguagggucucgguuagggaccacgagggagagagagagagggagaggaagagggagaaggaggaggaagucagucaccaugagguaaugugaccaugagggcuggccugaugaagcagggccugugcaaaugaaauauauggggccgggugugguggcacacgccuuuaaucccagcacucaggaggcagaggcaggcggauuucugaguucaaggccggccugaucuacagagugaguucuaggacagccagggauacaaagagaaccucugucuaaaaccaaaccaacaaaaagaauauauauauggcaagugauacauugugauuagaggguugauaucugccucgccucaccucagcaacuccguccuuccaccagcaccucaggaacgauucguauguauuuccaugucuggccaccauuuugacccauagccuugacucacuuggacuacaguuucugucugcugacacugaggaaauacuucacagaagauuuuaccucaaugaugcagaucccuuacuaacacgaggugaguuuucagccccagcugugcagcauccauuguccaagcaaaguccauccauccgacacuggucuuuuguuaaccguagcugcugcguuagcacccuuugagcaaauagucuacggaggcaaguuauuguaccccguggaaagauuauccuuguuuuauucaaauaaugauuucucugcccccguaucugguugcaauccuuagccugaggaucucccugucucuauguaguguaaauauugcuccccaauuauucucugauuggucaauaaagcugaugagccagugacugggcaguggagagaauagggcuggaguuccucccagccaggggagggagggagggaggagaguaaacuagauggggauuccccauggggaaggaguccaggagucaccaggaucaguccuaaaaugcaaguaucacuaggagguagcaagauuagcuuagagguuaaaaugggguaauacugcucagccauugugcccuuaaagcuugcuaaauaaauauaauagcccagucucaauuauuugggagccacuagcaaguccagaaagaguucucauuuuccucuaaaacuucagaagccugguguacauugucuguauuguccucagcauucucaucuuccaagcucccgcacaaacagcccauuacucucugagcauucaauggcguuuccagcucaagacucaaaauguuuuuacaccaccaccaccaccagaagaaaggcuuugauuuggauuauaguaccauccugauggggauggcacugcaauggagaagaaugguggcagaagcaguaagcaggcugaccacaauucaucuacacaagaaggaggagaaggaggaggaggaggaggaggaggaggaggaggaggaggaggaggaggaggaggagagaggugagacuaugcaucuuuaaauccuccaccaggaauggauuuucuccagcaauauuccaucuccugaagguuccauagccuucccguagaggagugccagguauuaaaauguaugaaagauguuugaaacauacacacauauagucauaguuagguuuuuuuuuuuuuuuuuuuuuccugcagcaaaagcacccugaucacaaagcaagcuggggaagguuuauuugguuuacacuucccagaucauaguccaacacuggaggcagucagaacaggaacucaagcagggcagaaaccuggaggcaggagcugaugcagaggccacggagggugcugcuuacuggcuugcuuccuaugguucgcucagccugcucccuuagagaacccaggacuaccagugcagggauggcauacaauggacugagcucuccccauugaucacuaauuaacaaacugcucuccagcugggucucauggaggcauuuccucaauugaggcuucuuccucucugaugacucuagcuugugucaaguugacacacacaaaagcagccaguucauauaguuuuuauuucaucaguaacucacacgguacaaaacaaaacaaacccuaaauacauaaagacuugguugcuuuuauauuuucaucaggaacuuucuuuuuuuuuuucuuuuucuuuuuuuuuuuuucucuuucucgagucagaguuucucuguguagcccuggcuuuccuggaacucucacuguagaccaggcuggccucaaacucagaaauccgacugccucugccucccgagugcugggauuaaaggcguucgccaccaccgcccgacuaucaggaacuuuucuucuccuccucuuccucuuccucuuccuccuccuccuccuccuccuccuccuccuccuccuccucuucuucuucuucuucuucuucuucgauuuauuuauuauuguaucuaaguacacuguagcugucuucagauacaccagaagauggcaucagaucucauuauggaugguugugagccaccaugugguugcugggauuugaacucaggaccuucggaagagcaguuggugcucuuaaccacugagccaucucuccagcccaaucaggaacuuucuuuucauucaguauucacauguggaaaccuaacucccaaugacaccccugugaggcuacaaggccccaaacagcuacuuuuccuuuuguaacgugaggccaggcagaggccguuucugaggugguaagcucuuauugucaucgugcuuccuggaucuuggcuuuuccagccucugcaauggcagugaugcauuucuccucucugugaaacgcagguguauuacgcagcauucuugagaggaacagaacccauagaaugugcaugcacauauugugaaagguuauauauugugaaagguuauauauauauauauauauauauauauauauauauauauauaauacuaggaugguugauaggauggggcuaggcagucagaucguggcuaucuaccuuccagaguguaagagaacugggaagcuucauagucuaugaggcaauucucauaugucccugaaggccuagacauccuggaguguugguacugaugccacguuggaaagccaaagcaccugaagucuguucucagcaagagaugcuggcggcgguacuguuaggugcacucgugcacucgcuuaggaaaaagagaaagcagcaggggcucucugcuuuuacccuuuauaacuaugcuuccgggaccuguaagccagucccaguuaaaugucguccuuuauaagaguugccuuggucauggugucuccucauagcaauggaaccccaaagacaaugcauguauaugugugugagugagcgaguguguguguauuacacaugucugcucagucuguauaauguuacuuguauguauguuugcagggcuauuugauauuggauaaucaauuggugugcucuuuccuagugaagacuauuuucccacucugagcauuccuuaacugccuuuguguaaggcuggggccuucugggcuuuuccuccucuaaauuagagugucuauuguuuuugucuggguccagcucaugcuuaagcagucauguuacugagacuuuaccuguauaacuucugaauuacuaggagacacaaucucacagcaaacuccccacuccucugguucuugcagucuuccuaccugucacguccgcucucgaccagcaagaacgacacgaccaccaguccuuccuucuaacagcaguuuauucagcaaacuuccgucuuuaucucucucgcuucaacuuuuucucucucaacuuuaucucccucaacuuuaucucucucucuaacccaggccucucacucuuauauacucucaguccucauccacucacagcaggccacgucaccucaccaggcacgcagcuucagcuaaucagggcagcaggggcaugucuccaccaaaauggauucgccaguauccugguguaccuacacagcucucacgaugguuguggcuuauuuucagguguaugaggaagucaggugcaaguuauaagacuuagcugcagucccgggcaccuucuugggacugcugccacauccgcuccucacaccuaccccucuucugcaaugaucccugagcaagccuuagguucaggaguuauguuguagauacaucaguggauacugggcuccacaauucugcagucugauugguugugaguuuuuauaauggucuccaucuguugcaaaggaaacuucccuugacguggcaucacuuaucuggacaaaacuuaucuggguaaagaacaauauuuaggauguucuuagagguugcucagugaguuuauuauguacaguaccaguggaggaguuagguuaauauccauaagacuucccucuagggaagcaaucucagguuuguagauauuugggaggaagcaaauuuagcaguuucuaagauuauccgugugcuccaccagacugguuacucucugcuugcuuuuuuuuuuuuuuuuucuugacaaguuuauugaaguaaaauugacugacgugcaguaaaauucaccuguauuaguuguagaauucaaugaguuuagaaaagucuauaugguugucuaaccagaaccacgaugaaucuagaauacuuucaucacucauagaaauucucuuuuuaaaaagauuucuaagccgggcggugguggcgcacgccuuuaaucccagcacuugggaggcagaggcagguggauuucugaguucgaggccagccuggucuacagagugaguuccaggacagccagggcuauacagagaaacccugucucgaaaacaaaacaaagcaaaacaacaaaaacaaccacaacaaaaucucugggcuggaaagauggcucagugguuaagagcauugacugcucuuccagacauccugaguucaauucucagcaaccacauggugguucacaaccaucuguaaugggaucugaugcccucuucuggugugucugaagacagcuacccuguacucauauaaaauaaauaaauaaaacaacaacaacaaauuauguuguuccagacuugucucuuucaggaggccuuuucuuuuaggauaaccuuagagcauguuguguaacaguuuccucugaaauugaaacauucuauccuauagcuaugcuccuuaaacagaaagguaagcaauucaggauucucagaggagaagggaagggggcgacuaggggaaggucuguaugaggggggacuaagagggugggugaugauacagauuaaaaugaauaaauuaauuaauuaauggaaaaggaaaacagaaaaaaaauagcuucaggaagucccugaaacuagccagauuuacuaggccccuccaugcccgaguaagcaauaaaugcugagaaucccucaaccaagccacaaagaguucucuuaaacaagccaagcuacugagaagucucugagaccauaucagcugcccgggagaagcggaaaguaauugaguugcuuggaaaaguguuagagcagagucgcuuggaagcaacaacucuccaacccguugagcuucuuuauguccugugcaguaugcuccaaacuccuagcuuuugugagcugucucccaugcugcaguggcccuuggugaugcaacugugucugagucauuucugcuccugugagguaccccucacccauacuccugugaguaaccccaauaaaacucauugguucgccaaguugaacuucggucuguaugggguaucuggggagagcagucauggguguaacaucuccccaggacaaguuuugcuauacgggacaggcacaggacagaaccaaauaggagugggggagaagagagugcacaggccuggcuaucagaggcaaggcaugcaacugaggcugagagguccuagcggggagccuccauauggagggcauucugacacaaucaucuuuuccugugugcuaacgugccucugugcuauggcagcuguugcaugguucuugcuaugaguacugacaugcaacuaagacugagacaucaaaacgaggaguguugggggcuagagagaugacucaguggauaagagcaccgacugcucuuccgaagguccugaguucaaaucccagcaaccacaugguggcucacaaccauccguaaugaaaucugacgcccuuuucuggugcaucugaagacagcuacaguguacuuagguauaauaaauaaaucuuuaaaaaaacaaaacaaaacaaaaaaaccgaggagugucugugggaggaauugugggauagucuuugucuaugugguguaagcuagcaugccugcuugauaagugaggucuaccagguaaauauggaguuacccugaacauagugaaagguuugcagaaaacauuuaguguuugagauuagcaaaggaacagccuggccacgguugugcagcauuagauaugaaucugaagcugagacgcuggccaagcaggaacuuguuuguguaaaggagcaauuacauuaagaaaggcagaugugccuggcauguuccauguuagccucggaguuggaaaguaaauuagauacaugagaggaugggagagagggagagggaggggcagggaaagggggagggggagggauagaaaagcaguaggccucucaaguccaaucuuuuguagaaaaagaagaaaaagucugugauccacuguacagaagggggcugguggugguuugugaagggacuccagccagcccaagcaggacaagcauggcucuggcaggccuugcccuccugcauccccucuuccucacuagaaaccauuagaauacauuccugaaacuagacuccaaagucuagccccuuguuuggccacuuccucuuucagaggcugauuaucaaggucuagcuaucaaaguguugaagcccagcaaucaaaagcccacuugugggcuggagagauggcucagcgguuaagagcacuugccugcucuuccagagguccugaguucaauuugcagcaaccacaugguggcucacagccauccaugagaucugacgcccucuucugcugugucugaagacagcuacaguguacucacaauauauaaaauaaauaaaucuuaaaaaaaaaaucccccuuguggcacuuuauuuaacaugcccaaucaaaauuaaucaccacauucuaacucaggggugccccuuuuuaucuuuauaaauugucauuugccuaugggccacaucugacuccucucuaugcagaagcagucccuugauccucugcgggacaaauaccccaucccugucuuugaugucucuuccuccuucucccucauccucuaucucuagucuuugucacuuaacccuugcucuuuguccuugugaggcaaauaaaucuccuuuuugcugacaauuuggcuuuggggugucuugggccaauaaagguucuuucaguuugaauaagaauguccucaauaggcccaucuuuuuaaauauuuagucaucagagaguagcacgauuugagaagguuuagguguggccuuggaguagugugggcuuguuggaggaagugugucaugguguguuguaggauauuucaucacauugugaacccugagauuguguuguuuacugggaacuauuucuaguuguggcguggcucuguucuuaguacacuuuaauuccucuggcuggaauacagacaugcccuuaguacacaccuuuacaacuccccuaacaaugaagguaaaguagaaggaagcacccauguuugaaagugccaucuagaugaauggcagacaaagugaugaaucagagaaagauuugacagaaugggaucugcccaacuuucaucaggagaggaaagggaagcuacuuaauagagcaaugcagaaagagagagaaagaaaggcaguuuuacugggacagauguacagagaagauaagcuagacacaggugaagacagaacaaaccagagaaagaggagccagaugauuagaacauauugccacaguuaccaugcggccaagccgagcaauucaggagaaacugagagaagccagauugaaucagucaucuugaagaggagauucagccagaacagcugaguugagcagccagccagaguucacaaaaaaaaaaaaaaaaagaaaagaaaggggagcuuauucagcaguaagucucaaaggcugaaaacauucuagcccuagacaagauuguaaggaggccagaagcuuccaggacuaguccuagguuagcagauggaggcaguaaaccucggagaugaaaauuacuucagucgaauaaaagauauuuuuacaagugggggugggguuuaaaaagucccacaaggcccagugucucuuuuagccuauaaaugagguuguagaucuuagcuacuucuccagcaccacaccugcuugccaccauacucccucuuuugaggauaauggacuaagagacucugagauuguaauuaaguccuccauuaaaugcuuuccuuuguaagaguugcuguggucaucguguuuuucacagcauuagaacaaugacuaagacuggacauuuacaauaguccaguacaagaaaccacagcgauugggaaauaguuagugcuucaacugcugaaacuaggagagacuuuuaaacaagcaaugagagagccugucgucacagcagaccugauacaucuggcauuguaagccaggauagaaaccuguggcuggggaugucagaggacccacuggggaaggaacuuguauuguuuuccuagagggaugugcugugcuuaucagaccgcuucuuuuuuuuuuuuuuuuuaauuuucuuuuuuuuuuuuuuucgagacagggugucucuguguagcccuggcuguccuggaacucacuuuguagaccaggcuggccucgaacucagaaauccgccugccccugccucaagagugcugggauuaaaggcgugcgccaccacgcccggcucuuuuaaaaauauuuuuauuagguauuuuccucauuuacauuuccaaugcuaucccaaaaaucccucauacccuccccccccccccagcuccccuacccacccacugcaacuuuuuggcccuggcguuccccuguacuggggcauauaaaguucauaauguuguuccaccuauaggauugcaguucccuuuagcuccuuggguaauuucucuagcuccuccauugggagcccugugauucauccaauagcugacugugagcauccacuucuguguuugcuaggccccagcauagucucacaagagacagcuauaucuggguccuuucagcaaaaucuugcuaguguaugcaauggugucagcauuuggaggcugauuaugggauggaucccucgauauggcagucucuagaugguccauccuuucgaucagacugcuucuuaagcacauguguuugcacucauagaucacugcugcuaucaaccucaacaauucuuuuuuuuuuuuuuuuuuuuuuuuuugagacaggguuucuuuguauagcccuggcugucccggaacucacuuuguagaccagauaucugccugccucugccuccagaaugcugggauuaaaggcaugcacccccccaaccccccccccccccggcaguagccuaauucuuagucaaagguggacauauuuaguuuccccuccaaggcucagggaucauuguggaagagggcacaaauagaacgcaagagccagaggaaguggugggauguccugugacaguuuccucccagaaugaaauauuccacccuucaggaaagcucuuuuaagcacagaaguaaacaacucaaaagcuccaggaagucccugaaucuaacuagauucacuagguuccugucugaguacacagagaccacgugggcugucuagaagagguuuggacuagagucaccuggaaaggacaucuuccaaccucuuaaccucccugcaagcuggacaguguucuccaaaucccuugcuuuugugagcugucacgcaugcuggagugggccuuggugauauagcugcuuuugagucauuucuacuccuguaaguaacuaacucucaccacuaucccuguaacuaacaccaauaaaauccauggguucaccaagcugaaucuugcugauggcuguacuuucgucuguugugguuuuccuagcuugggugaguagacacguguguugugccucccucagaaaaguuuugucauacaacagagcagaagcaaaaucguccugcaguccacuuccacauacaggcuguuuuacuauuacuauuuuuugaguagauaguuuaggaacugccgggucuguuuagcuguauaaaaagcagucuuuuucagggugccuacagccguuuauguuuccaccugcacugaaugaaugaguguuccaguugucccucguuagcacuuacagugaggaugaccccauucuccagaguacuaguucauggugguuuaacuuacauuuccccagugucauguggcaguuugaaagacccccauaggcucauauauuugcauacuugguccucgguugguacaacuguuugggaaggacuaagaguuguggucuuauuagacgaaguaugucacugggggccggccaacuuugaguuuucaaaggccuaggccauccuagguagcucucucuuugccuccugcuuguggcucaggauguaagcucucagcugcugcucagcaccauaccugccugccugcuuccaugcucccacuuaugauggacaaggaaggacucaugcucugaaacugucagcuuccaacaacucuuuucuaaguugccaugaucaugaugucucuucacagcaacagaagaacagagaaguaaccaagccaggacaguggcacacaccuuuaaugucagcagucaggaggcagaagcaggugaaucugugaaucugaggccacgcuggucuacagagugaauucuagaacagucagggcuucauagauucugucucaaaaaaacccaacauauauacauauauauguacaugugucucagaaaaacaauguuacauauuauauuugauauauauugcauuuuguauauaacacacauaaccacaauaugcauauuacuaauaccauauauuauguaauauauaucauguacauauauuucauaucuauagaagauauacagauaauaguguuauuuguuguuguuuucugggauuuuguuuuuauaaggguuuuauguaucucaggcuggccucaaacuuacuagguagcuaagguuggccuuaauauucuuccugguucuccuaccuucucucccauuuguaggauuaaugguauaugcuauaauaucuagcaauuauuucuuuuaauuuauacauuuuaguuuuaaccaguuuuuuuuuuuagauuuauuuauuauuauauguaaguacacuguagcugucuucagacacaccagaagagggaguuagaucucguuacggaugguugugagccaccaugugguugcugggaauugaacucuggaccuuuggaagagcagugcucuuacccauugagccaucucaccagcccaguuuuaaccaguuuuguugacuguaauuuuguuuuacacaugacuugggcuuacccauaaccacuucucucacuuuaucucuugguucacuaacauauccccaaccuaacaucaggguccaauauguacauaacauucaauauauauauauaucuaugauagaaucguauucauugaauguacauuuacuugagggacuuccuuaacauaaacucuggagcgccaagcugcucuuacuguucugauccaaacaaccuuguaaguccacaggaccauggucuguugugcagcuauguucagccucugacccccggaccacaugugucccgguauaguuaugaaaggggaacaauacuuuuauugauguugucaugugacaaugucaacagacuggauacucauggauaauagcaaauagccuagacugaccucaucaaguuaaaugauaccuuucuauacagugaguuccaggguagccaaggcuaugcagagacccuaucuugacaaacuaaaacaaucaaaaaugacaucuuucaccagucagugguggugcacgccuuuaaucccagcacuugggaggcagaggcagguggauuucugaguucgaggccagccuggucuagaguuccagagaaaccaucuugaaaagaaacaaaacaaaacaaacaaacaaaaaagaaaaucuuucaacguucucucuccuugcuaucauccacacaauacucauuuuccagaaugauacuacaugauugcuaauauauacaaauuguuacaguaagccagucaguaugccguauucucacagugacacuuugaaauaaagguacauaugagguauggcaaaaguuaucccucuacaaaauaaaacgcacaaagauccccgagcugacaugauuucauacagaagcuaguaauuuuuguauuuuaauuuuauauccuuaugugcuuaguaguguugcuugcuuuuccaaacaggucuuuccaguccuuccuaugugcugggauucaugugugccagcacgucugcuacagcauuauuucuguugaagaaaguguuaucuaauggccagacucaaagcucuaaacuuaacgcugagguucacauuccuuguuuggguagcaagcagccacacgagcacugaagucuaacuagucgaaagggagauggugucaaguacauuaugguuugcucaucuaacagggggaaacaaaucaaucuaagaugugucaauuuuuaugccaacuguguggugacacguuggcuacauuaauaaaguauuaguuuuacauuuuaaauguugucuacaaaauuuaaacuacauacuugauuugcaucucauuacauuucauucuuaauauuugccuuucuguagaccaugcuggccuggaacucagaaauccgccugccucugccucccaagugcugggauuaaaggcgugcaccaccacacccgguugccuucucccuuucuuccacacuauauacuuaagcccugcuaggccuaaagccuccuggcaauucuaccuuagcuuucagucucccuagcaacaaacgcagggugacagacgugugccacugaccuuggcuuuucacugacuuggguugcuaguuaaggacucugcugagcagggugucuccucuuuucuacuuugcugcaccaucucuuuggcccucccauuguacugcuaguagacaaugcuggucuacaauacuuucaggacaguuuagucaagccaacuaaguuuuacucagagcccuguuguacucuaauggcaaucugcuucucacauuuccagucuaagaucaaaguccugguaggcuaugccaggagagagcugucucuucuuuuaaagcaccagaccuugacacugcaucuccaugaaggcuguauugagaaauuaagguugcuuuucauucuuaugcaaggugaccgagaaaggguaagucugcggagaccacgacugaguaguucagauggacucuccugccuaacucacaaguccuugcacuguaagcauguaccaccauggcccacuuugcucauuuauaaagugccagcacaacucgaaaguuaccauauguggugucguucaucuguuucgugguauauuugcaacaugccaucucaggacuccugugauuauaaaccacugugccgugcuguucucugaagagcugucucuaauagaauaguucuuaugcagcuucucguuuucucuccucccuuagggauugucuguccuccgagggcugcugcucuccauaugccuucccuaucccagaaguccaauuauaagcugcuuuccacuaagaacuguuccgcuaccaggccaguucucagguaacugcugacuucagaaaugcagaccuuucuccuggacccugcacugagugcugguggucagugggcuuuuuccucaucauagcugguccagaucaacuuuugaucaagacagaggaagcaaaagggagaauuagaguacaagauagaaaauguggucccguuucuugcuugcuggagagagcacuccgccgggggucggugaaguaucccaagauggcugggcguaaacuugcucuaaaaaccauugauuggguaucuuuuguggaggucaugccccaaaaucagaaggcaauuggaaaugcccugaaguccuggaaugagaccuuccacgccagguuggcuagucugucugagaaaccaccugcgauugacugggcuuacuacagggccaauguggccaagccuggcuugguggaugauuuugaaaagaaguauaaugcccugaagauuccugugccugaggauaaauacacagcccugguggaccaggaggagaaggaggaugugaagagcugugcugaauuugugucuggaucccagcucaggauccaggaguaugagaagcagcuggagaaaaugaggaacauaauucccuuugaccagaugaccauugaugacuugaaugagaucuucccagaaaccaagcuggacaagaaguacccguacuggccccaccagcccaucgagaaccugugaagcagccugggacggagccccggccgacaugaaauaaaacauuuaaauaguaaaaaaaaaaaaaaagauagaaaaugugucaccaagccuuuguacuuccuuggaacucacaacuugucaugaccuuuguguccacacacauauacacaggaauggaaaaagagagcccccuggggcaugagacauuucagaggugacaauuccagcaaagcuggcaacuugccuugguuacuuagcaugcacuacaguuugacauacuacuccagacuuaaaauagcuguuuuuagagacauggcuucacuuccuaguucuucuaucaccccaaaucccugucacagcccucauuuacaaacugaaaaacacgaacuuuugaguauuauccaaaauaguaauaaagcgugauuucugcuucuauaaaguucaugcccaugagcgcuuugcuugagugccuauguguaccacgugugugccuggcccagggaagaggguguuggacucccuagaacuagccauggcugugaaauaccaugugcacacuaggaauuaaaucuggguccccugaaacaagcguccuuaacuucugagccuucucucaacucaagcauccaagcacagccauguguucaugccuauaaucccagucccagaaagguaagccaaucaauccuuugaguuccaggagagcuuccagugagaccuugucuuagaaaaagcaaaagucauggacuggagagauggcucacaaccaucuguaaugggaucugaugcccucuucugguguaugaagacaucuacaguguagucauacaaauaaaauauauaaauucaucuuaaaccccagcacuugagccaguagcagggccaaggguucaaguuagcucuacccacuccucugcucaaaauuuauugccaggcauguucaaccugagacuaguggacuccacguacuccaugugcuauggaggauacccaauguuuguuggugucacaauucuagacacacugaguaucgaauaauagaucugcacccuacccucaauuuagcagucuauugccuagcuuuguggcuguaauuuuucucaacuccauuacauacuagaacugacaucacaaacacccaaauucucccacaggcauuagcuuaagaaaggauuuugaagacaggauuuuucuguaggucugcaacuaacucuguaaaccaggcuggccucaaacuuaagauuuugaguuugccucugcaccccaugugcuggaauuaaaggcccgagcugcuccagccaccaccaagcuugaggucaccuugcaaauccuaacacaagcuuuuuuucaagccccacuuaucuugcagaguuguauuaaucuuucccaucucuagaguuugucaagucgggacacccagagcuuaauucccacuugccucagugucugauuuaagccuugauagaaauuacacauucagccauaguaaggaaaccacacaccaaucuuaagucuacacggacuaugaguucuaguaagaugaauuaagaguuuuaauguguagcucugauccccaacucauagauccaccugucaccaagugcugggaauaaaggcuuaucuugcuuggcuuuauucaaguaaauguuaaaaaucagaaacuacaggauaaguaagagcucaaaucauuuaagucccuuacagacuguaagcgucuuaagacacuguaggcaugguagugauauaaccacaccaguaacuguccucaucucuagcaagccugcucguucagcucaucacucacccacuuccaugcccagggccaagcaaacacgauggggaccgagacaggcucagaguaucuuucccgagaguccacccagccccucccagcuucggacccacaggaacuaugaaggaagaagcguaggaucccagagcaaucauauaaccgaacucugaaccgauguuaaaguaccuuagaucaccacagaauuuuugaaagcagaacauuuauuuuaugacugauugaaauccuuaagaagaacuggaugcugcgacagcugcccucuuggguuucggcguuguucccucacggaauccaugucugugccauguuaaagauaagaaaaaaaguuaaagcagcaauaucaaacauugccuccaaauugaucaagcagaccguaaugagcuuaucucaguuaaaugcugaaaucauuauagcagucauauguucagacauuuauuuuuuaggacaucauugauaagcuauuaguuuacccuaaucaagacacccacauuacauuaaaguuaacugucucaacaauuuugggcucauuuucccuauuuccacaagaacuaaaguauuuaugaagcuauuccuuaagcuauaaaggacagguccuggcaccuuuccuuuaguaacaggaaacacugaccaagcuuaacaggaucuugaagcugcucaacucagaagucuaaauguuaaguagcacucauuucuacucaauacuacauaggaagaugagugauucuaagcacauaaagguuaaucaggcucaaaacaugccacuagccuaucaaacacuagcaagccacuacacaucaaguucacaaaacuggacugaguuuaaaacagagacaaacacaaaagcaccugucaaagcacagaccccacaggaaagucuaagaggggggcuggggauucuguacuuuuaaggaacaucaaggccuagccuccaguaaaaagauacccaucuauguuaugacuggcacccagaacagcuuagcagacuugagcaaagucuggaggcagauccaaguaagcugccccccagaucccacucauagucuugacaaaugugggcgucucaggcccacaccaaaccccaguaucauuccuacccuucaguaagagugcaaaguuucauccuacccuggaggaccaaugacauuuagccaaaacuguaccugaaucugcgguagacaaucuuuaggugccucauccgaccagucccgguaguguuucgucucuuagccuuggcacuccaguuaucuaauaaaaaaaauaggauuccaaaugguuuucccaagcacccagugucagcccauuuucucaguagugucauuacuauguuuuaaccacucagccaacaaaccaaccuccaaaguuguugcgugccaaauguguuuucuauuacaucgcuaccucaggucaagguaaaagcccgccugcggauuacaguacuuacacuuccucuugcgcuuggcaggguagccacacuugccacaagucgacuucugaaggugguaggccuuggagccacagcggcggcacagcgugugcgucuuguugcgacgcuuaccaaaggaugacguucccuucgucugcacauuaaaagaaaaagcaggaaaaaaaaccccacauauaagcaacucugaaaucugacuucucaauguacucuggcauuuucuuagcaaugaguauggaugagacguaaacaagauccacacgggacaaaacgguguaaagauuuaaaucuuagcacacagguaggguagguaggaagcacuaccggcuauccacacgaccauuauaaugccuuacucugcgcggaccuaagccuccuuggcuuuaggcguuaaggacaacauucugcccgucucucagucgcgguacugcccaccaagcagccgguuucucggcggcuggggacagauguccccaagccuguccugaucacccacccggggcugcagugcguacgucuccuccaaagcccagagagacccacagcggcgcuaggaccgugggccgggcucugcacacagcagccauccuuccaguuccugcggaccacagcacgccgucuccucgcccaucagcuccccucacucgcaaccuugucaccgacgcgccgggcaacaggcaggacagcccgaggaagaaggauggagagagauuuacagagcccagaaaccacacucaccaucuugcuucuaccggcgaggccaaagagaccggaagagaaagcacccccgccacuuccuguggauaagc

SEQ ID NO: 7662 - RNA, 855 nt, Mus musculus
uaggaagugaagccaugucucuaaaaacagcuauuuuaagucuggaguaguaugucaaacuguagugcaugcuaaguaaccaaggcaaguugccagcuuugcuggaauugucaccucugaaaugucucaugccccagggggcucucuuuuuccauuccuguguauauguguguggacacaaaggucaugacaaguugugaguuccaaggaaguacaaaggcuuggugacacauuuucuaucuuuuuuuuuuuuuuuacuauuuaaauguuuuauuucaugucggccggggcuccgucccaggcugcuucacagguucucgaugggcugguggggccaguacggguacuucuuguccagcuugguuucugggaagaucucauucaagucaucaauggucaucuggucaaagggaauuauguuccucauuuucuccagcugcuucucauacuccuggauccugagcugggauccagacacaaauucagcacagcucuucacauccuccuucuccuccugguccaccagggcuguguauuuauccucaggcacaggaaucuucagggcauuauacuucuuuucaaaaucauccaccaagccaggcuuggccacauuggcccuguaguaagcccagucaaucgcaggugguuucucagacagacuagccaaccuggcguggaaggucucauuccaggacuucagggcauuuccaauugccuucugauuuuggggcaugaccuccacaaaagauacccaaucaaugguuuuuagagcaaguuuacgcccagccaucuugggauacuucaccgacccccggcggagugcucucuccagcaagcaagaaacgggaccacauu

SEQ ID NO: 7663 - RNA, 855 nt, Mus musculus
aauguggucccguuucuugcuugcuggagagagcacuccgccgggggucggugaaguaucccaagauggcugggcguaaacuugcucuaaaaaccauugauuggguaucuuuuguggaggucaugccccaaaaucagaaggcaauuggaaaugcccugaaguccuggaaugagaccuuccacgccagguuggcuagucugucugagaaaccaccugcgauugacugggcuuacuacagggccaauguggccaagccuggcuugguggaugauuuugaaaagaaguauaaugcccugaagauuccugugccugaggauaaauacacagcccugguggaccaggaggagaaggaggaugugaagagcugugcugaauuugugucuggaucccagcucaggauccaggaguaugagaagcagcuggagaaaaugaggaacauaauucccuuugaccagaugaccauugaugacuugaaugagaucuucccagaaaccaagcuggacaagaaguacccguacuggccccaccagcccaucgagaaccugugaagcagccugggacggagccccggccgacaugaaauaaaacauuuaaauaguaaaaaaaaaaaaaaagauagaaaaugugucaccaagccuuuguacuuccuuggaacucacaacuugucaugaccuuuguguccacacacauauacacaggaauggaaaaagagagcccccuggggcaugagacauuucagaggugacaauuccagcaaagcuggcaacuugccuugguuacuuagcaugcacuacaguuugacauacuacuccagacuuaaaauagcuguuuuuagagacauggcuucacuuccua

SEQ ID NO: 7664 - RNA, 38041 nt, Mus musculus
cgcggcgccaugcgcagacucaguuccuggagaaagauggcgacggccgagaagcagaagcacgacgggcgggugaagaucggccacuacauccugggggacacgcuuggugucggcaccuucgggaaagugaagggugaggacgcccgggccagcgcggacccggcgaacggcgagcgacugcgccuuucgcacuccgcauccucccccgcgcccgccuuccgggugucugggcuccguauccccgguccgggcggcgcugggagcggagcccgaggcugccgcgggcugcagagcugugggguccgccgcgguggggugggggcggucgccauggcgacggcgcggcgccggaggggcggggauggcucugggugcaacuuucccaggcgagggaguugggcacugagcgcgcgggggcgcccggcgcggacgagggggucucuuguggucuucugauccccugugugcccuuggcgcagagccagcccaucgcgcccuggcgguccucggaguugucgcugccucgcuuuuaggagguuguggacuaaagugcuucuucgguuuccugaaucgaaauguguucuuccaaaagcaagguagcuguggagauaccuuucagaaauaguaaugcccuuguuaggacuauugaucuccgucaggacuuuugaugcauaugccugugaacuggcgcgguguuuccuaugcgugguuuacaguuggaugcagaugcugcuuuuaagugauuccguuuucggaaguuuugcgguuuccgagagcuauaccugguagguagggcauauguuaacuccagaugguauuuauuagcuuauagguauaguuuccguuuauucucacaguauauuuauauuuuaguaauucagugcacaucauuuggacuuuuuguucguuuugguagaauccccuguuaccgccuuagcaaaagcacaagcauucugucuucaacuaacuacucuagcccaccaccugugacaaggaaaauucugauuacaaccuuugugagguggacuuuuuuccccuuuaaaauauuuaagccugcuauuaaguauuuagaggaaggaaguuuggagcugauaagaaauaauucauacauugguuuuggagaaauaauagacuauggccugcauauauaguaagcuccuuaguagauauuugauugaagugaaaaaguuugucaaauuacacagcaagcuaacugagcuccguucucccaggagggcagaaagagcccuuccuucucuugcccuuucccaguccuaaacggaaaguugcuguguuacccucaggggagcaaaugccuaaaccuaccuaggaaaaucagcaagccagacagugugaaggaggaguagguguggucuagggccuagcacugaucaugguucagccaguguucgugaacacucucaggguuuugcuuugucucuuuuuaugcaugcaugcauuuauuuauuucgagagaguguuacaaugcuguccaggcuggcuuugaacuuguuauucuucgugcuucagcuuccuaaguaguuggcauuaacaggcagcuagcucuuccaguguuuuguuuaccuuuagcuaggcauccuuguuugccauuagaggugguaagaagugcuaauuaaggcucugauggaagugauaaggcagacuugaacucagaaggcuccuuccgaaggcccugcuuggaaugaauguggcauccaguccgccauuccuuugacacagaccagagcggaucaagcagacaagaaaggaagaagggauuguuuucccggccugggauuugaccugggaaguagcagugccucgaaccucccucccagugacucugcuuuuccuuaaccuucacuucuccacccacccacacagccuucucuugaaauccuauaccaucagucauaagccuccuccaauacagagggccagugugagucagaggauccuaggcuucucgguuauaauuaaacuuguccuugaacuuguuaguugaugugggucuaaauauucagccaguucauuuuaaaacuguuaaaugguugggaugcuuuuuuuuuuuugacauuaguaauaaugucaaauuaguaaccacaggauuugcuaugauccucuccuuacuaaggaauggcuggacugccauaucccauuugguuuaugcaucagaguggggauagcaugacugucuuaguuaggguuuuacugcugugaacaaacaccaugaccaaggcaacucuuauaaggacaacauuuaacuggguuagcuuacagguccauugucaucaaggugggagcauggcagcauccagacaggcauggugcaggaggagcugagaguucaacaucuucaucugaaggcugcuaacagaaaacucacuuccaggcagcuaggaugaaugucugaagcccauucccacagugacacaccuacuccaacaggaccacacuuucuaauagugccacucccuggaccaagcauauauaaaccaucauaaugaccauaggaggaaugugacccagguuuggauaugugugggaggggggggugucuuuuuuuuuguuuuuuuuuuaaccuggcuacagugcauauuuaugugugugcuugccuuugcugcagggauacuauaaagaaugaguauuguuagguaggugagaaagugggaggcaggaaugcacagagagugggccaaaauaaccacugugucuggucauauuggaaauuaaccccaggcuuaguuugacaagaacucuuuuuuuuuuuuuuaauuacuuuauuuuuaugugcauugguauuugccugcgugugugccuguguaaagauguuggauuccccugggaccagagucacagacaggugugagcugccauuugggugcugggaauuguaccuggguccucuggaaaaacagccagugcucuuaaccucugagccaccucuccagccuccaucucuaagaauucuuagagauaauagcaucauccauaaauucuuuguuucuauauaucuguguauguauguacauaccgaucuauauuucuauguaugugucuaucuauaucuaucuaucuaucuaucuaucuaucuaucuaucuauccgucgguuuuugagagagauuucucuggggagcccuucuauccuggaacucacucuguagaucagacuggacuuguacucaaagauccaccuuccucugucugggucuaaagggguacgccaccaccacccuagccuuaaauucuaauucaaaaaauguagaguacauuuuucaaguauuaugcguguuggaaaauuuaacauaagagauucuaacagaaacugugauggugauagauggauaaaucauccgugugcuauuuaguccuuucagggaauuuaaguguguuuugguuuucuuuuuucuauuuuuuuuuuuuuuuuuuguuguuguuggcuuguguuguuguuugccccccccccccuuuuuuuuuuuuuuuuuugagauagggucucaguuagacaggcuggcuguucucaaacucacucugugaaugaggacagcuuuggacuuugauccuuggguuucugccucccuagugcugggauuagaggccugugcaccaccaugccugguuauaucgaguguugaggacugaacccagggcuucaugcuaaaugcucuaccaagugagccacuucccuaguccuagaaauugaauuuuggggcuaaauugguaguggcugucauguuaugaaguuaauaguaaugaaaauaauuggguuacuuaaugauagcauuuggagggaaaguuugggcagaaaacaaggguuugggguugugcuugaauuauuauuuucaagguauucuuuuuuuccguccugucuuuuuuuuuuuuugaggcagggaguuugagacagguuucucuguguagcccuggcuguccuggcacucacuguagacucuggccucaaacucagaaauccgccugccucagccucccaagugcugggacuaaaggugugugccaccacugccuggccucucuccuguuuguuaaggugucagucucuacuccuuugcuugcugucuucuaccucccauaaaacaguuauacacgcacagacgaauagucaugcacagucaaauggcuguucuugacaguuuuuauggguugugucuucacgaagcaaguaagucgcuucuacauauaaccuguuaaguuggugaguauuuccacauuaagccauuacuucagguaaauagauacccuucucuuugaaugaauaaggaaaauuuccuuaaggaaaaaaagaaaagauguacauaugggcuggagagauggcuuaacaguuaagauaaccgacugcuuuuccagagguccugaguucaauuccuacaaaccacaugguggcucacaagugucuauaaugggauauuaucccccuuucugcuguuugugaagauagagcaugcacacacacacauaauaaacaaauaucaaaaacccuacauguaauauguacauauacauaugucauauauguggcaugagugacucuuuagaaaauaaaguuaggcaucuagugcuccuaaccacugagcaucucuccagccugccacagucauuuuuaaguaccgacauuuuaugaaaaggacgagguguugcuaugauuuaauggauuuauauguaauaaaauagguuagugugugggagagggacacugaauucagaguuacuggucaccucuggggagagaugaggagaggcgcugggacuucacaugugucuguaauguguugcuuaagcugcugguauuugaaauuuuguaugauuuaaaaauaaaaacguucucuuuuuauuuagugugcguguggugggggaggggugguguuggaggugguucuuucauugcguucaccauguggguccuggggugugacuuagagucugcugccuaacagagcagucccguguucucucacuggcccuuguauguucccauguuccuaaaagaaauccuuuaagcuccccucucaauaggauuaaacuauuuccuuacaguuuuauuaguggaauuuucuucuaauuuuagaaaggaaacggaaaugguuagguggcuagaaugcuuucaggggaucuuucuaucuccguggcaucucuagccuguuaaaauccuuucuuuuaaaaauaggaucuuguuacaccucagcauuuuguauaugacuaugaaacaucgucauuuguugacgauguuuuguaguuaacagacuccaagguugagagaacaaugaguuugugguuagcucaucauuaguugauuaagcuguugcucuugggaggugaaccuuguagauggcuaaugccgguguugcaguuugcuuaaaagcaacaguuuuagcacuguugaaaacaaaguaacagucugaaauauaccacuuaagcuucaauaaagggcaggcagggccggccccucagggaauauauacucuuggcaaaguccuuuuauuacauucacugauugaugggagcagcaauucuggggagcagcaauuacuuugacuccgccuuaguuuacucaauagagacucuuuagcccaguuuugagaaaaacaguucugauucucacaugaugccauucccuccccgcuucucacugcaugugguugguaggacagaguggauggguugaaagacuaaagagucagaagaacuguagaacuugaucagaauagcugucuuuacccuggcaaacuauggacccugagcguccucaguuucuucauccuuaaaauaacaggcuuugaagacauaucauuaggccugagauacuauguuuaaaaguguuacacugccgaaauguuaauguugccaaucauuuguucaaagcaaagguuucugugucccuauaggucaacauuggcaacauuguaacaccauagcuuuaaaugacggacuuaacugggaagaaggaaggugggaaggacggauaaaaggaaggagaaaauaccuagauguguuuguuuguuuguuuguuuguuuagacaggauuucuuugugguguagggcuggcuguccaggaauucucugcagacaaugcuagccuugaacucugcaguauauacaucugccucugagugcugugauuaaaggcaugcaucaccaugcccagcugagauaaggccuauggugacagagaaaauauuuuaugaucaucagggucuagacauuguuugaaaacuuuggaaagcgaaguuuguauuacuuugauuuauuuauuuauuuauuuauuuauuuauuuauuuaugaaucuguguguuagugccccuuuucuccccagggucugucaccuuaagucagagcucacaccuuuggcuaguguagcuaaccagccugcucuaggggaucaaagccaguugaaacaaguguagcaggaccuacuccacacuuagcuaaccaaugugcgaguugagcucuagcauauggcagaauaaucugcagcggucccguuagucuccuuuaguucucacggaugaaccaugaagguuuaaaaugaaaacaaauuggagggaaaauguugccauucuccuuuccagggccacgaugcucccagaucaagugccuuaguggcagggauggggaaguaggagcggcuuaguuacuguccagucgcucugcagagacaccaagaccaaggcagcuaauaaaagaaagaauuuugccaggcagugguggcacaugccuuuaagcccagcacuugggaggcagaagcagguggaucucugaguuugaggccagccuggucuacagagugaguuccaggacagccagggcuacacagagaaacccugucucgaguccccccccccccccaauuuuuuuaaauugaguuuuagaggaugaguccacguccccuccuuaugguggggagcauggcagcagacaggcaggcauggcacuggagcaauaauaacugagagcuuacagcugauucagaagcaggaggugaggaacggggccagagacacagacagacagacagacagacaaacacacagugaaccugguaugggcuuuugaaaccuuaaaguccaccccagugacucaccuucacuaacaaagccauaucuacuaauccuucccacaucguccaccaagaaccaaacauucaagccaucaccaagaaauaccauauuuaaguacaguauacuuuauguuugaacaauguaccuuaagaaacucaguuccaguacuuuuagcugugugacuuuuccagcuaauaagaaguacuuagagcauggagaaggggccgugaaagcugacucgugauaggcugcgcaggaugcaacuuaacuucgauagcaaaaucccauaggagcauccgcuagucaugggaaguccucugagcugaacaacucccagggaagaaucauacaaaggcauguuguguguguuuacuuaagaugaacauuugugucccuguccucgugaauacuguauuuuuuuuuuuuuugcauuuuuuaaaaaauuuuuauuagguauuuagcucauuuacauuuccaaugcuauaccaaaagucccccauacccacccacacccacucccaaaauuccuaacuccaucagaauaaauguuauuuguuuuuuaauuuauuuuuauuuuuauuauauguaaguacacuguagcugucuucaaacacuccagaagagggagucagaucucauuacagaugguugugagccaccaugugguugcugggauuugaacuucggaccuuuggaagagcagucggaugcucuuaccuacugagccaucucaccaggccccgaauacuguauuuuugaaaccuuggaaguauauaauccaguauagaaagccuuuuuuauucaacuccuguuuuuaaagcuuauuuuuaaaauuauguuuguguguguuuauauauaugcuuuugauugaaggcggguguggaggucaaagguguuggagccagcugaagcugggguaacagaggguuguaugccuccuguugguggugguccuguggaggagaaguuuguguucugaacugcugagccaucuaucuaucacccuugaguccuauagcuuggucuggccugaucucccaauucuccugccuacuccuccagagugcuggccaguguuuauuuuuuauuuauuucuauuuucuuaaagauuuauuuauuuauuauaugugaguacacuguugcugucuucagacacacuagaagagggcgccagaucucauugcagauggcugugagccaccaugugguugcugggaauugaacucagucagugcucuuaacugcugagcugucucuccagcccacugggcacuucuuacaucaauaagcauaucaccuugcuagggcugcaauagcaguacuaaagguugggggcuuaaaacuagagaaaauuauucucggacagucgaaggucagaggagggaaaaugggagucucaagggcugugcuccuucugaaggucaguggcgaaugugugccuuaccucuuagccucuguuauuccugguuucuccgggccuagcauaacuccacccucugcugcugcccccaccguauggcuacucuccuguuucugcgcuccucauaagagagcaaguccuuagauaacugugcucauucuagcaucauaccauuuugagagccuuuucuaaauucuauuuuuaaaauuauuuauuuaauguauaugaguacacuguagcugucuucagacacaccagaagagggcauuggauuccauuacagaugguugugagccaccaugugguugccgggaauugaaacucaggaccucuggaagagcagucaguguucuuaaccacagaaccaucuuuucagccccuacuaauuuuaaagauuuuaaagaacugcuuguaaguaagacaacauucugagguuccagguugacgugguuuucagcucgccagacucccucuacucuuucauguuuuguuauuuauuuguggacacagauccuggugucagguguuuaccuguguugcucucuguuuuucaaggucccccacugaaccugaagcuuacucaccuuuucagcuaggcugcuuggcauucugggaucugccugccucugcccucuagaugcugagguuacaggcaugggaacugaaacguugaacucagggucucucacuuucuuuuuaggaaggucucucaagguuaaaguuguaugccuuuucaaaagauucuuuaaaggacuuaguaaauugauuguguugacuuuuuuuuuuuuuuuuuuuuuuuugagcaagguuuuucuacgcagaucuggauguccuggaacuuauucuauugagaucagauugaccuuaaacucagagaucgguuaccuuuaauccugaauucugaaauuaaaauugugugacaucaugccccuuuucuugauuuuaggguaacuuuuuuuuuuaacauuuauuaucauuaucauuauuuaaugauaauuuuaaauauuuauucuucucucauauacccuucccucuucccagccugccccucuccuccuuagcacuccucuccccagauguucucuucccccagggguuaacuuguaacuugauuugagagaaugcuuuaaucaaaugccaaugucucuauaauaucucuugagauuuuuaaauuucaaaaacuagaauaaaaagauuuugaaauugauagguagguuuucagcaggcaaggcuuauggucuaauacaggaaaaagaucaaaugaaagagugaaauuuuagagugauuuuuuuuuuuuaaguauggaaaauucaaucuauuuucaaauuuucauuauaagguaucagaagauguuucugauaugugcaacuuuuauauguuuuauuagaaggaugcauauauaugcauuauauauacugugcaacuucuguuuugauuuaucuuuuccuguuuuuuuuuuuuuuuuuuuuuuuuuuuuuuuuuugguuuuucgagacaggguuucucuguguagcucuggcuguccuggaacucacuuuguagaccaggcuggccuugaacucagaaaucugccugccucugccucccgaguacugggauuaaaggcgugcaccaccacgcccggcgauuuaucuuuucuuaaaggcuaauuuuauuaucauuggcauaauuuuagguaggguuucauucuuuagaccgugaggccuugaacucggagauucacuugccccugcuuucuucgugguagauauuacaugucuggcuauuucauuauuuuaaaucacguacaugucuguggguuuguacuugugagugcuggugccuacagaggccagaagucuugggucucucuggacugggguuacugguagugacgcagcccaguguagguguugggaaccgagcagauccguugcagaaucauuacgagcuccuaacuccugaguuaccgcuccagcuccuagaguucuucuaaaacuauauuauuauggucuggccuugacucuguggguaccaacccgccuggaaggacgguacugucuccugaagcuuagccucugcccucucugcaagugcacuguggcacgaggcuucgccacacucauacguggauaccaugcauucaguaauaauacuuaaaauaaagaauuuaaaaaugucuaaagagugcugucauguuuccucuccuggagggagcuuccaguguugaacccaaucugaguuagagcuuugggcugugccacgcaccagccguguacuuaggacacauugugucugugggugccucagugccccguagaaugguauucauaaugccagccuuccaaaguugaugacuguucccgucuguggccauagaaauguucuugaaaaauuuuagauagacagcgaccucguuguagaggacuggugcuguguguaugagcgaccuguugaauauuaacuguugaggaaaugggcugaacuuuggaauccaaaaaucucggcucggugcuuggaguggugggauuuaagcugccgagagaggguggccccugaggcucuugauaagggcaggcuguugaauacaacugaacagaaggcacuauuggaagagcugagauccaaagcaccuauucccacauccaaauggauaguucagggaugauuaaauaggaacgggggacugguuugggaaugguggaaacuuaucccucaguacuaauagcuacaguugucuguucacuuaggaugugcugguaggggggaagguccuuuacaaacacgguuucaugugucauguggccacccuuguagagcaggagaucacauuuaccaaggguuuuauauguguaagucagaagucuguuaaguaccuucaaagaggaacagaccugaggcuacagagugcacgcacacugccuucuggguuggaaggacaccuggguauucagucuguuccuguaaagggcuggaucugccaaugccuagcguugaugcccuccccuugggugggcgagcuuucuuucuuuccuuuucuuuuucuuuuuaacugaaaaaaauaaaaauaaaacaauacaauuugaaagacgguggcuacagcauaccuuucuucuuauuucuucuguagcuggcaacuguggcagccuguguaacuuuauucaccauggugauuagaaggaacauuucucauagucuccuacaagagucugcuguauugaaacaauacaguggauuagcuguuuucugaaauuagucauuaggagaucugcaggcuuuuguucuuacacaauaagcuguaauaaaccgagacauauuuaugcauguuuucagcuucguaguucaauuuggagacguauguuuuuucuuuuuaaauacagugccaccuuuaauucucaagaauuuuuuuuuuuuuuuaaauuugguucccuaaaguguucccuugguuccugcagccauccccgucaaaaacaacagcaaaaggaaucacuaugguaacuuucuguuaagcagacggaaagccagugcucucacuuucucuguuccguccauucuggucccuucuguguaccaggaggucggcugaccacuugcuuuaugauggcugacguggcuccuucgccucccaguuaacuuucucaguuuuuguuugaacacaguuuuacuuaaugugauuuuuuauuuuuuugcacuucagucaguagacccauccccguuuucauuuauauguguguguguguguguguauguguguguguguguauguguaugugugugugugugugugugugugugugugugugugugugcauacugcagaagucuuuccuccccgucagcgagugagagaauagggguugaacgaagguccccgugcuuggaggccagcaguuuacccacugaaggcucucuggaguuguuuugaaagugaggacuuauaucuaagugcuccuaauuacuuuuguaguuuggugaaacacucaaguaugagaacaagaugcaguaugcuuggauggauauuggcauccuuccuucauuuugcuuuuuaaacagggggacgucguguuugcaggugaaauacugagauaccccuugcugaaacuauauacuugauuauauacuugaaaugauauacuugauuccuaucccuuggagaccuuuauccuuguuaaauucucucaguucuuaguauccgaccauagaaugugccacauuauugcugagucauacuaacuacuaaguggcacgaacuguucuauuguagaauuuucauugugcccuuuguaucucuguacucuuaaaaaaauaguguauguuuguguauauguguguauaugugugugcauguguguguguauauguauggaugugugcauguguauguguguauaugugugugcaaguguguguguauguauggauuugugcauguguauguguguauaugggugugcacauguguguguauguauggauguguuauguauauauguguguauaugggggugcacauuguauguguauggacauguguaugugucuauaugggugugcacaugugugugaauguauggaugugugcauguguguguguguguguguguguguguguaugaguguguguaggcuuuauauccaugucaauuaaaugggaucagggaucacuuuugagguccuuucccucucauuagccuaugaugcuacacaaauucaugcuaaggggacauauuacuaaacagaccucugaaaauugcuugcugacacuguaaugcaauaagggggacagagaguuaccaaacuguguacaggaugaaaugagaacugcuuacccuuccauguuguguuaguggaggucagaggagaacucugaggaguugcuuuuuccuuccacuuuguuggucccaggaacugaacuuaugucaucaggcugagucaagcuaaaaucucucucucucucucucucucucucucucugagaaagggucuuacaugcuaacuucuauuggccuuaaacucauggcaauccuccugucucagacuucuaaguguugaaaucauaggcaugagccaccauacccagcuuuucuuuaaaaugucagucuuaugugucccaggcugaccuugaacuggcuguauauuggaggaugacccagaacuugugauccuccugccucccuccugugggcuggcaccaucacacccaguucaaacccagugccuguugucugugcugugcaaguacuuuaccaacugagcuacaucugcaacccugcuuuguuauuuugagacgggcuugcucuguagccagaguagucucacauucuuggcagucuuuuugccucagcuuccucugcuaggaggacaggugucugccaacacucagauugcuuuuuucuucuccccacuaaauaauuuauuuauccacuuuacaucucuaucacagcauccucucuucucgcagccccuccucacacugccuuuccucucagcuccccgacccuucaucucugagaaggcggaaguccuuccuggggaaccaacccaccuuggcaccucaaguuuaugcaaaacuaguuacauuuucgcccacugaggccagacaaggcagccuaguuaggggaaccagauccacugguuaagccccucccccaguuuugggggggaccugcuugaagaccaagcugcacaucugcuacacaguccagggucucuagguccagcccuugcuugcuccuugguuggugguugauucucuggaagccccugugaguccagguuaguugacucuguuggucuucuuguggagucuguuuguccuccgaguaccucaguccuuccccuaacucuuccaccagacuucccaaacuugguguaaugcuugggugugggucuuugugagccucucggaggacaguuaugccaggcuccuuccugucugugaauccaggcugacagauacaaacagccugggacuccaaagagguagaagggaggacaguaguccagaaaugugucuguagccugggcuagccuagaacucacuauguagaccaggcuggcccgccucucucucuaaguugcugggauuaaagauguccacuuagguuuuugagacaggguuucucacuggccuggaacucauggacuaggcuagauuggaugguuuacaauaaaugcuaaguauauaaucccaaaugagucaaagagaauguucagagcuuccuacccuaguuucuuacuugaugaaagaaauuauaucuacaguuuuggauaaaccucaaguguuuuugagaaacacuuauuaauguguguguguguauguguguauguacaugguaggggcgugugugccacagugugcuugugagaggauggccuuaggaaguuauuucucuccuucuauuauguggaccccauacuuucaaaggcauaggauuaucucuguugccucaaaauaaggacgcuggcuccucugcggguugccuugccuggguuugcugcugugcagaccagcacagcugucgccguuuggagguuucucaauuugccuccugcauuggauuccugcucuuuuggggacagagucuaagucaccaaggcuggucuucagcuaucuuuggagccaaagugaccuuaaacucccugucucuucucacaugcuggcaauucaagcauguacuaccacagcuggcuuuguuugcuuuuccaggcagcggcccuaccccgugcugcagccaacccuugcuggccugaagcuaccaucgcuagcagcaaugcucccaugaccaggacaucaagccugagcuggcacucucuucacuagaugugcugacuucuugcugacguuuuuguuucucuucugauuuugauaguaucuauguuuuuccauaaguuccugagaaaggguacacagacgccagacuuuuggggacuuugccucagcagcaguaucugaauucuuaugugcacauagacugucugggugagucugggcaagauggaaucucuuuaaacaugauuuaucuacuuuuauuugcauagauguuuugucuacauauauacccuugcaccaugucuguacuuagugcccaagaaggcuagaagagguucucguauccccuggaacuggaguuauagaugguugcaggucgcacgugagugccgagagucugaccuggacucucgagaagcgcagcucgugccacugagccaucucuuuagccuaaaauccauguauuuuuaaauuuucuauuugaaaauggaaacuacaugccauugagccaaaacugaaaacagaacaaaaacaacagcagcagcaguagccaaucacgggggcuguuaaugauaggggaucaugugcaguagccaaucaccagggcuguuaacgauaggggaucaugucagugucccaggggaguucguguauguaguuuugggcauaugugugcuguauguguaugucaggccagaggacauggcuugcuuuaucauuuucugcuuuuguuuccuugagacaagaucucuuauugaaacuagagcuagguaguuagccaguaucaccaggaaucccccugucucugccaaccugugcucuuucucccaguguugggcugauaggcagggaucaugcuagguucuucucuuuuucuuuuuaaaaguguguugugggaauuugaauuuagagccuccugcguauacagcucuuuguuggugagccaucaucucuccggcccugcagggcaguuuucugaggggaagauacaccuauucuauguuauggcuuuuguuugauuuucuuguuuugagauccaguguuaccacauagccugggccuucccuuaguucucagucccccgacugugcaucugacgauugcaggcauaggcuaccaugucuggauccuugccacaugauuauuuuaauggugguagaccaguuccucuguucuucaguucuacagaagguuuuccaauaaaagauaguuucauuuucuauguacaguaguugagaaaugaauagugagcuaaagggauuugaguaccugaaggcauacaggaagaauuuuuccucuuucucucuuaugacugguccaaauucccuuuuccuaaaauccgcucuuggugagcaguuccuugugugugucaaacuaaggaggagggcggcaaagaugcuccaguaucuucugaguguuuagcuuucuaguauaauacaccaaaguauauuauccaucagaaccggugcgaacacacuaaaaaugauuccuucugcagugggcaagcacgaguugaccggacauaaaguggcugugaagauacucaaccggcagaagauucggagccuugacguggugggaaaaauccgccgggagauucagaaccugaagcuguucaggcacccucacaucaucaaacuguaaguccaccucuuaucccucugcucucccucacaucaucaaacuguaaguccagcucuuaucccgcugcucucccucaaaucaucaaacuguaaguccaccucuuaucccgcugcucucccucacaucaucaaacuguaagcccagcucuuaucccgcugcucucccucacaucaucaaacuguaaguccagcucuuaucccgcugcucacccucacaugaucaaacuguaagcccagcucuuagccugguccucacccucacaucaucaaacuguaagcccagcucuuagccuguccucucccucacaucaucaaacuguaaguccaccucucaucccgcugcucucccucacaucaucaaacuguaaguccaccucucaucccgcugcucucccucacaucaucaaacuguaaguccaccucucaucccgcugcucucccucacaucaucaaacuguaaguccaccucucaucccgcugcucucccucacaucaucaaacugcaaguccagcucuuagccugguccucucccucacaucaucaaacuguaaguccaccucucaucccgcugcucucccucacaucaucaaacuguaaguccaccucucaucccgcugcucucccucacaucaucaaacuguaaguccaccucucaucccgcugcucucccucacaucaucaaacuguaagcccagcucuuagccugguccucacccucacaucaucaaacuguaaguccagcucuuaucccacugcucucccucacaucaucaaacuguaagcccaacucuuagccuguccucucccucacaucaucaaacuguaagcccagcucuuagccuguccucucaucccgcugcucacccucacaucaucaaacuguaaguccaccucuuaucccccugcuuccccucacaucaucaaacuguaaguccagcucuuauccugcugcucucccucacaucauaaaacuguaagcccagcucuuauccugcugcucucccucacaucaucaaacuguaagcccagcucuuagccugguccucacccucacaucaucaaacuguaagcccagcucuuaucccgcugcucacccucacaucaucaaacuguaaguccaccucuuaucccgcugcucucccucacaucaucaaacuguaaguccagcucuuagccuguccucacccucacaucaucaaacuguaagcccagcucuuagccuguccucucaucccgcugcucacccucacaucaucaaacuaaguccagcucuuaucccacugcucucccucacaucaucaaacuguaagcccagcucuuagccuguccucucaucccgcugcucacccucacaucaucaaacuguaaguccagcucuuaucccgcugcucucccucacaucaucaaacuguaagcccagcucuuagccuguccucucaucccgcugcucacccucacaucaucaaacuguaagcccagcucuuauccuguccucacccucacaucaucaaacuguaagcccagcucuuagccuguccucucccucacaucaucaaacuguaagcccagcucuuagccuguccucucccucacaucaucaaacuguaagcccagcucuuagccuguccucuaccucacaucaucaaacuguaagcccagcucuuagccuguccucacccucacaucaucaaacuguaagcccagcucuuagccuguccucucccucacaucaucaaacuguaagcccagcucuuagccuguccucucccucacaucaucaaacuguaagcccagcucuuagccugguccucacccucacaucaucaaacuguaagcccagcucuuagccuguccucucaucccgcugcucacccucacaucaucaaacuguaagcccagcucuuagccuguccucucccucacaucaucaaacuguaagcccagcucuuagccuguccucucaucccgcugcucacccucacaucaucaaacuguaagcccagcucuuagccuguccucucaucccgcugcucacccucacaucaucaaacuguaaguccagcucguuagccugguccucauucucacaucaucaaacuguaagcccagcucuuagccuguccucacccucacaucaucaaacuguaagcccagcucuuagccuguccucucaucccgcugcucucccucacaucaucaaacuguaagcccagcucguuagccugguccucacccucacaucaucaaacuguaagcccagcucuuagccugguccucacccucacaucaucaaacuguaagcccagcucauuagccucguccucucaucccgcugcucaccccuguacuuaacccaccugaccuggcaaaccagagcgaggcuggaggugucuuccugcucuugucucugaccccgguucacugccagucacagggcccgcccucggguuuuagcauggcucacauccacuguauuccuguucuuccuguugucuggaaagaggccccuuugacaguacucugggcuacuguuuuuacagguuggguugcuacuagaaguuucuguagcaggugccaggcccuguuuggucuccuguaccaccugaaaggaaaaaaaaaaaaaaaaaaaaaaaagaggcgagaaguucuugaguuuaaauuucaaguuuuuugcaugcugggaaucaggcucaggagagacuguguacuagaaaucuuuuuucuguacccugcuuguacuugaccauacagaccgggcuuugaggaauccagaauuucagaaggacaguaauccuaaugguaguuuugagaaagccucacuaaggcuuacagguaacguacuucuuaccuucgguguuaccuuguaggcuauacuuuaacgcugccaggacuucuccguuaaacuggaaucguggagcuggcuccacaguuguuuugcuuuuagcucucauucauuaaaguguuuggcucuaucauguguccugauggcccccaacuguacaguccuugcuuugagacucauucucugaacuccagacccugugccugcuccucacucauugggguguccgagaggucuuucaaagaaccuguuccaggucucaucuccccaucaucuccucagcucuucuuccuacacuguucucaccaucaucgcaguuaauugucacuuaaccccggggguggggugggggguggggaggacaaugacgaagacggauguaggagcaucuuuaacaauccuguuuaucccucuucccaccaucacuccaucucuuccuccagaauguaucucugaccuuuuccuccguccuuuaacgccaucacacuggccugugcuaccucaccgcucaagggcaucuucugagcguucucuccggucuucauaccgccacugcuuacucuuuugacgugacugccagcauaaaaacaucccauagcuuuccacauuccuuuaaauaaaggccgaagauuucuucccucccggcuuguggagcucugcaucuuuggucuccaacgacuagcuucauguccuguuuucucuccuggcuuguuuugcucuuaccuuaccauaagugugccaagcaggcucccaacugggcccuggcccuggcuguuccuucccccugcccacuucaccuuccuccuggccaagguagucugcuccucccuuccuuggggcucugcucugguguacucugugaccuuccuggcaugcucugccucuuacuuaauuacugucuguguccuggccccugcaucaagaacauaacaaacuugcuuacugucugucuccuggcaccugcaucaggaccauaacaaaaacaggagauuggcuuugcucccccacagacuucuagcagcuagcacaguaccugguaucuuauaggugcuuaguaaaucuuuacugaauggaugaauacacguguuuuaauauuaguagauaauguuuucucucaccagguaccaggucaucaguacaccaucugauauuuucauggugauggaauaugucucuggaggagagcuauuugauuauaucuguaaaaauggaaggguaagcaguucucauuuaauucuguacacaguuugguaacucucugucccccuuauugcauuauagugucagcaagcaauuuucagaggucuguuuaguaauaaguccccuuagcaugaauuuguguagcaucauaggcuaaugagaaggaaaggaccucaaaagugaucccugaucccauuuaauugacauggauauaaagacuacuuguugaguauuuguucaaggucacgugauuuacuagugauuuacagaguucacguaagucccuaaaauuuauuauccucagauuuaagguuuuuagcaaaacaaacuuuuauuuauuuuuuuggagacagggucacacuaugccacugugacugccauguagaucaggcuggccuccagugcauagccaugccccugucucugucucccaagugcugggauugaaggugugccuggucugugcucacccuuaaugugcuuccuaaacuuuccuaacacgcuuuccuaugugggccucccaaaauacgucaguaaguacuuaaacgauguaggccuuguucuucaacccuggccacauuucaguugugcucguguguugguuucugaugugccugcaguagaaaggaauagggauuuugaaggagcuaggaaguagacuuacagggcuuaguguuugaaggaaccuugaagacguuuaguucuaagcacaaauucugagcaccguccccugcccauacgcacucucacguuaucugacuggcacagcgcccugcugaaaggccccacaccuaggagagaagagagccuggcuccccuucagucggaagcuauuugcauucuucauucuuucauguuacgcacugucucucuuuaaucaggaucagacucauuaagcacgcuagucuguuuuuucucaaugugguuaauuucuaccuaaaguuuucccuuucucauccuucaaggcccuauuccuguccacuggaggaauucuuccaaauugaucaaugccugcauuucucaucucucucuuuuuuuccucccauuugucauuucuagucauuuugcuauacauuguggggacgucuuuaguguuaccuuuugaaugccaaccuuccagcugucacauguuuguauuucagauuucugccuuauuuucugaaauucccuuuggauagcugccuguuuggccuuaccuguuugagaaugacauuuugguuuuaaaugucuuuuggccacugcaccgcuccguuuuccgugcuuuccgcucgccuccucuuuuuuuuccccccuucuguucauuuugucucccccccccccaacccucccauacucuuagucagauaucuggccauucuuagcuguccacuuaaauuucagaacaaagucacaccacaugccaagccaguggaugugugcuguuuaugguuuucccucagguugcauuguuggagacauuaauuuugguaggguaaauucuuugcucacaagcacaaguguuuuucuucguuugauuugguaucugcuuuuuccuauuuucuugaagguauugguuuagcuguuggaacugagucgggagauggggucaggucuuuccuguuaguaugcacauaaucuacaucuuccuuaacggccuggccaacccgaggagcuacaggucuuacucccccuuggugguaccuacagcuuucugcacaggccugcugucuuguuuccguccgccccucauugcuucagaaagucauggugcacccacugcucagcguucccaggguuccgcugugcacuugcguucauuuucuccucuaggauuugguuuugcuuuucucucuuuugcugaguuuucaucugcuguccauacauuccucuugauggccgcugucucuccaucuuuuuguuuuaugggccuuguguguugcugacagcacccuggggcgacacaacagggagugacacaaaagacucagugugggauguuuaucagcuuggaguguucuuuuacauggcucaucuuccuuuagucgcugccauucuuuguacuguauuuuuauaaauaaaauucuuuucaccuuugcagccuuucuguuacuuaucauuuguuaaguuuucucuuccucuugcauaauuuuuuuuuaaauaaacaucuacuugaacaaaggugugagauugcaaaaguauuaaugucuuuuucuuaagggagaggaccuuacauuucaggguaaggguaugcuacacuucaguagcauuuuuaauuuuguauucaaagcaauggcugguuucucuuugucccacguuauccaugcggugaaggugugggguucuggauuuagaaugcucacuccugaccugccaaggaccucaugugagcauccuugccugggccaguagcucacuuaucgaauccccuguccuggaacccgggcaaagcagugcugcuuccccugcugagcaaacgccagaaaaugcagagacuggaagaugauuuuuaaaagauuguacuuaaaaauuguaauuguaguguaaguguuuuccuucaggaaagaugcaaaggguaaaugugcuaaggauuuucuuuuggugaagugaaaacaucuuagaccugaagagauggcacccaugucagguggcucucgauuguaacuccggguccagaggacccaacauucuuagcauucuugucucuguaggcaccugcaggcagaugcacacacacacacacacacacacacacacacacacacacacacacauauacacacacacacacauauacacacacacacacacacacacauacacacacacacauacacacacauacacacacauacacacacacacacacauacacacacacacacacacacacacacacacacacacacacacuuaaaaauagcuuaaauuucagaguacaggcuaucuuugcguuguggcucaauuccaauacuuaccugucacuucuuuguggucuguaaucgucccccaugcaagcaucacuugguauauucucuuuuucuuucccuuuucuccgauuagauuugcucuuugacaguugcguccauguguucugcgcccucuguguacgcucccacccugacccccuucucuuccuuccccuccucccugcaggucccugguuuacacucaugacuuuguucuguucugggaaccacugaguuugacuagaagcaucuguuucccccuggguuuggaucugcucauuggaacgcuuucuguaucacucugugacccuuuuuucccacuguuacgcucauguuugguuugguuuuggccuuauuuugucuacuagaguagggccuuccucucacucaucucugugcuauggauaucuaaccaguacagcauauugaauaucuaauacuauggauaucuaaccaguacagcauauugaaugugcucaguaaauauuuguugaaggagggaaggauuaaacaccacuaauuggaaaacauucccaguuucagguagaaguugaaaguacuagaaauagcccaugagcuccagaagaagauguguuuuuaaguguaguuuauauaugugauagggucaaagaguugaguugcugauuugguccccguaagcccuugcuuggcauuucaguguagggcugcaggccuuacuugcccauuucaaaguaccucaugggugaaguucgccuggaagcuuucaggcguugacaguccacaggcuggagaauuauaagaauguuuucauugagagacacagcuuaaaaugccuuucuucuuuuccuaguuggacgaaaaggaaagccgccgucuguuccagcagauccuuuccgguguggauuauugucacaggcauauggugguccacagagauuugaaaccugagaacguccugcuugaugcacacaugaaugcaaagauagccgacuuugguaaggaugguugugauguuuaaugagcauaaguaucaucuucugguaguguuuauggggugcacuagaaccccacucugcaagugaacauucagaagggaaaacaguaagguacgcgcgcgcgcgcgcgcgcacacacacacacacacacacacacacacacacacacacacacacacgccacaggauagcuuugggggauguuucuauucuuccagcacgugggucuuagaggguggauuuagguugucaggcauggugguaagcacuuuuaccugcugagccuaccugccagcccugaaauucaguuuugugaucuuaaauauuucaacuucuuaacauuagagagaucauuugaaaagaaaagacuauuauuugucaagaagguagcaacuugauuucuaauauuucuuuuugguggaguauggagaaaauggaaagugggauggaauuauugacauaacauuggaaucuagaaagaugaauuauaugaggaaacuuuuuuuauaaaauuaauauuuaaaugcuguaaaguugguuuucagauguagugguaggugccuucagucuaagaauuccagagauggaggccgguagagaucuuucuguucagcugggucuauuuugccuagcaguauccauauuaaaagguagacauuucaaggaucuucuaguauucaaaaccaccacuagcuuagcacauacacauuaaacucuagauguugaaauucauuguacauuuuguguauaaggucagaauauuuaagaaauaaagacuauaaucaaguuaaaaguuuuuguuuuuuuguuuuuuuuuucuguuuuuauuuuauuuuauuuuauuacauauuuuccucaauuacauuuccaaugcuauccuaaaagucccccauacccuccccccccacuucccuacccacucauucccauuuuuuuuggcccuggcguuccccuguacuggggcauauaaaguuuguguguccaaugggccucucuuuccagugauggccgacuagaccaucguuugauacauaugcagcuagagucaagagcuccaggauacugguuaguucauaauguuguuccaccuauaggguugcagaccccuuuagcuccuuggguacuuucucuagcuccuccauugggaguuuuuuuuucuguuuuacuugcuuuuuguccuuaagaacucuugacuggucacuuuuugucauuucaggucuuucaaacaugaugucagauggugaauuuuuaagaacaagcuguggcucacccaauuaugccgcaccagaagucauuucaggaagguauugcugccauuaggcuacuuuugaugugccuguuguugcuuauuucucuuaaguuuguuagucuguacugucgccuugaggaugugaugucacuaacgaggacauaaaaguaacacauuggccugugguaacugucaucuccgaggcucgcugccucagucugcuaacguaggucuaggccuggaagcuucuagcuuguguacaaucuaaucuaggccuagaaagacuucagcugcugaggcuugcugcuggguaagcgcgccccuuccuuguucuuucugaucuauggcugauucaacucagauguuuuggcucucaaacuccucuccacgauaacugauucaaucuggcuucucugggcuucuccugaauuugcccugcuugaccuccaacucugucaucguucuaaucuggcuccuucucagucucugcuuguucugucuucaccugugucuggcuuguccuuccucugcaagcugucucuguacaucuguccugguacaguggccuccucucccugcacugacccucaaguacuuccucucucuucccgugagagguugggcauauccuauucugucaggucuuuuucugauuugucauuugucugccacucaauuagaaguuacuuucaaacaugggugcuuucuucuaugaacuaacuuugccacagggauuaaaagugugugcugaggccgaggcacaucacaacuagaagcagcuuuuucaguaaauaacacaaucuugagguuuuacaauaugauaagauauccugcaacagaaagaagggaauauauuucuguacuugcagauuuucuauuuuaugaauaaucacaaggagcuggagagauggcuuauugguuaagaggacuugcugcucuucuagaggacuggaauuugggaccuggcaaccacaaucuggguggcucacaguugucuauaacuuugccuccaggagacccaacacacucuugguuuuugcaagcaguuacauacauggaugcaccucaacacacacacacacacacacacacacacacacacacuaauaauaauaauaauaauaauaauaauaauaauaauagaaauaaauaaaaaaaacaaguggaaaaacaaguccaucuuuggaggagaguguugguuugcaagucacaguaaaguaguuagaaugaagugcuuucauuuuugucucuggugggcgaauugaaagccaaccagcuguaaagguggauaagccgcugagaaccugccuacugcaguacucacucccgaggaaugcuuuacuuaggcgaacauuaaaaaauguaacaugaugggcaauccuugcugguaauucuacaccuucucaugacaccaucucaagaaaaccaaaccaaacuagaccgcacagagagcagaacagaguuacaaguguaacgucacguguaguuguauaaguauucaaauagcuggcauucauguaguagcuucauguuuuaugaggaaggaaacuaaagaagugguccuuuaaaaaaacagaccagcugaauguauugcaugccuauagccugaguaucgcacauggaugccaagacagggcuauauaggccugguaucaaggaaaaucgaggugaggugaggggcaagaggguuauaaaaagggagaaggaaggagagagacucauuuauguucagucuugaucuagaucugcuagagauugaaguguaagacugcugaacucugaacuacuaucuagcacuaaaggacggauguauuuucauuaguuacuuuuuaaauagcgugaaaacaaaauuuaauuuguguuuuauuuccuuguuuuguucaagguucaaguuccuccuccuccuccucuccuuccucucccuccuccucuccuuccucucccuccuccucuccuuccucucccuccuccuccucuuccuccucugugauagagacaguucauuaacaaagagaaggcacgccuaaauuuggaagugggguaguggucugggaaaagauauuugcuuaaaguuguaaaauuuaauuuaaaagacagacuuuauuuuaaaccauauauguauguguguuugugugaggguauguguacauuaguguaggugcugacagaggucagagccccccaaccccacccccccaauccucacccuucagcuauugcuacgggcaguuguaagcugccuuguguguguguguguguggggggggugagaacuaaaccagggaccucuauaaaaacagcgcagguucucaauggcugagacaucccuccagcucagagaauuuauuauuuuuuuccauuuuuuaaaauuagguauuuacuucauuuacauuucaaaugauaucccgaaagucuccaauacccucccccaaccugcuccccuacccacccacucccccuuuuuggcccugguguuccccuguacuggggcauauaaaguuugcaagaccaaugggccucucuucccaaugauggccgacuaggccaucuucugauacauaugcagcuagaaacacgagcuccgggguacugguuaguucauaauguuguuccaccuauaggguugcacaccccuucagcuccuuggguacuuucacuggcuccucuauugggggcccugugauccaucccauagcugacugugagcauccacuucuguguuugcuaggcacccgcauagccucacaagagacagcuauaucaggguccuuucagcaaaaucuugcuggcguagagaauuuauuuuuaagaucaacgcuuuggcuaggcuugguggugcaccuuacccaggagguuagacagcaguuugucuccagcucaggcuccuuagugagacagggccagcuugggaauaaauaaaaugcucuugcaaaaacaagcaagcaaagaaagaaauaaaaaacaaguaaaagucaaagcaaacaaaaacacauugcuuccucauugcugcugaaacacuaaugagguaggggaggccuguugcucgccagugcccacaaucccguccaccucaaccauuuccuuguuuaaaugcuucaaauggugauggaccuaauuuaaaaaaaaaucccugugcuuucuauguucaugugcuuauuuuuuuuugacugcucaaagaaaagguaaugaagugaauuaaaaagauucauuuguguuuucuaucuuaauuccuuugauuugagaaaaauucaaaaucuagaugcuacagggaauauaacuaaagaaaaaaggcaugcgucauguucaagcaugcauaaaaugggcucuuggggaaauguacaguuuggaugucuuuccuugaggucugugugaauaggagcacucauuuugagaacaguguuuacugcugucuauaggaaggaagcacucucgucacucugaggguucguuuucccccugaaggcagccucggaugauucagcugguuugcagcuaguuagaauccgugucuccagugcuuccuucacguagacgcacucacgcacgaagagggcgaguguucugugagcuccacugcccuuggcuugcuucugcagcuccagcuuccugaacugugaugugaggguuuuaggagaaauggguucagagucugucacuacagacuugaaucaugggcccagcgaguuggcucagcugguaaaacauuugcugccaagugccuagagucugaccccugaauccuggguaaagguaggagagaacugauuccacagagcugucaucucagcuccacacccacuguggcaugugcacaccauacacacgcacaugcaugugcacacacacacacacacacacacacacacacacacuaaaaguuacuuaaaggugagggugggggaacaaaaaagguacuuaaaaaaaacuaucccuguggcucaaaucaacauugaucaugauggcucaaggguugaccuuauugguaggaaguuugagggucauaguaagguaguacaauuugacccauggaucacaaguuacaaaauagcuuauuuuuaaacagguaauacugauaagacuaguaucuuuaugugugaugugcaacaaccacuauagauaccauauucugaccacugauuucuuuaaaaauuauuuucuuauauuuuucauaaaguauuuguauuugaagaguguugaccgaugcuuuuugauauugugauuaauacaguuagcauucucuaugcagauuguacgcaggccccgagguggacaucuggagcagcggggucauucucuaugcuuugcuguguggaacccucccuuuugaugaugaccaugugccaacucuuuuuaagaagauaugugaugggaucuuuuauaccccucaguacuuaaacccuucaguaaucagccuuuugaaacauaugcugcagguggaucccaugaagagggccgcaauaaaagauaucagguaacucacuuuaucugccuacuugaccaaccagccaacaaaccaucugucugucugucugucugucugucuggacuguguagucuuggcuauccuggaacucacucuaaagacaaggcuggcccugccucccucugccacccgagugcagugcuaggauuaaaggcgcgugguauuaccauugcacagcaauauuaggugauuuuuaaaccaauguauuuuucuaccuuuucgagucucuagauaccagagaaauuucauuuuauuuuuuauuuuuauuuuuauuuuuuuuuuuugguuuuuucgagacaggguuucucuauauagcccuggcuguccuggagcucacuuuguagaccaggcuggccucgaacucagaaacccgccugccucugccucccgagugcugggauuaaaggcaugcaccaccacgcccagcugaaauuucauuuuauuaaugacacacuuuucuuguggcaauauacuuugagucauaggaaauugauuauugugcucaauugaguauugagaaauggcugcauuguguaucaugguuuaaccugauaguuuaaauaaggcaugacugauaguggcagcugugcuucccggguugcgguaagucacgucucaugaacacucaguacucccuggccaccguacucugucaucaguguuucuuuauuuuuguuuuccuuaguucuuugaucuucugaugucuagaguacacguuuuucugauacucaaaguagaaggaacuaaagacgaauaauaaguagaaaacauuagggcacaugggacuuugagcuggauuccuugccacugacuccuuaugcuagaaguccuguugaagcuggguguggugguccacgccuuuaaucccagcacuuggaagguggagccagggagauccuguuaguucauagccaaucuggucuacauaaugguuucaggacagucagcucuguagagagacccugauucaaaaacaauaacaaacaaaaagaccugcugaaaagaagucuccaugucgcggcauggcagauggggaggcaaacucaguuaauuaaauggauauuauaaaauauguaagugggauguauauucgcacauguuuuagauauuuuucauaacugaaaugugauagcaaaugcuggaucugguggcgcacacccaugaucccaggacuugacaagcugaaagaguaugaccgugaguguguuuccagccugggcuauggagugaagauuccaccucaaaaaccagucagauacccuuaaaaaccauuauucuuuucaguguuugcuuuguuuguuuguuuuuaaguuuuaguauaguucuuguuaugguuccauguccuuucauauauagaauuaaugaauacaauaugaaauuguucagagguuggucuuuugagucauagaacuggguugaaaggacgaggguagauuuuaaauggaugaauuguuuaucgugaaacucagcauggaguaagaaugcauaggaugauauugcacacuguuuuuguuaguaagcucuuuuccuauaacaugaaauaguguaaaaagugaagccacacaacauaguuucuuucugggcuggaaaaagacuguccucagucauuguccuuuggguagacauaccaaauuuggcugccuugauccucaaaaauuaguggcaggggacuagagagauggcucggcuguuaagagcacuggcugcuuuuccagagguccugaguucaauucccagcaaccacaugguggcucacacccaucuacgguagguuccaaugccuucuucuggugugcaaauuguacauacagacaaaauacccauacacauaaaaguauauaaauaaaaaauagguuguagacuaauguuuuucucagcauauucaaugaaguaugagcuagaaggggaaaccaguuuaaagagaacaacuguaauaauguagcaugaguaugaacucauucauauccuaaacucuggaaacuauuacuuuuauucuugguuuaacugaaaacccuucuuccaccauugcugucucucuuagggaacacgagugguuuaaacaggaccuuccgaaguaucucuuuccugaggacccaucuuauaguucaaccaugaucgaugacgaagccuugaaagaagugugugagaaguucgaguguucggaggaggagguccucagcugccuguacaacagaaaccaccaggacccacuagccgucgccuaccaccucaucauagacaacaggagaauaaugaaugaagccaaagauuucuaccuagcaaccagcccaccugacucuuuccuggacgaccaccauuuaacucggccucacccugaaagaguaccguucuugguugccgaaacaccacgggcccggcacacccuggaugaauuaaacccacagaaauccaaacaccaagguguacggaaggcaaaauggcauuugggaauucgaagucaaagccgacccaaugauaucauggcagaaguuuguagagcaaucaagcaguuggauuaugaauggaagguaagaaggcaagugcucucucuguuuggugagccuguagccaaagcccuuuguaggagaacugaugugaugaugugccuuuguuuuuguccauauccaaugcuagguuguaaaccccuauuauuugcguguacgaaggaagaauccugugacaagcacauuuuccaaaaugagucuacagcuauaccaaguggauaguaggacuuacuuguuggauuuccguaguauugaugguauguacacgcagaacccuggaggucauguaguuauauagccugcuuaccucauuugcuuuauagucuuuguuuucuuucuuucuuuuuugaauaaaaacuaagcaugcaaaguaguaagcuucauauggcgccuuccucccuucucucucucuagcuuuucuauccucccucccucccucccucccucccucccucccucccucccucccucccucccucccucccucccucccucugcaugugucucagaacacaugggacaggcugcagaagucaaugucagguaccguccuccuucaccuuccaucuugcuuuggagacaaggucucuuugcacacgggugguugcccuucaggguacacucacgggccagcaagcuccagggaucauuuaauuuccgacuuccagcuuuggcguaaugggcgugcccucgcuggccuggcuuugacaugggucuggggaucagcggcagggccuccuuaucuacugagccuucuccccagccccccagugcacgcugccauacauguccugcguccuuggcauccuccucacugcccuccaccucagcuaugucuuaggaagcuuccuggccuuuuccugcuaauucauaggaaacaugacuuccuauguucugcaagacugacguuugugaaaccuguuauucuugcuccauguagcauauugauuuauagauuauuggggcuagggauuuaggucaguauugaaguucuugcuucacuggcuucaaucaccaucaccugacuauuguucuguaaaaucuuuaaaaauauacaggguuuuuguuuguuuguuuugcuuaugcucuaagugauguuugagaagcugcaggguaagagcgcugaucugagguggggagggucgagcucuugagaggugggaacugucccuuuggugccuuggacaagucccucaacuucuggcuuuuuauaucuguaaaaugguuccuaggugagacaaguuccaagauaccuuucauacugcaagugaucgauucuguauuuuuuguuuuguuuuguuuuugagacaggguuucuguguagcucuggcuguccuggaacucauucuguagaccaggcuggccucaaacucccagaguugucuuugccuccuaauugaugggacuaaaggugugcuugccacuacccagugagucugugguuuuaauaaauaucuccuagcagugauauuaauuuacagguuauuaguuuacuguuucuuaguuggugugaaagucaagagugcuauacuauguaucccauguugacuggccauuguauguauuuuuugugcuguguguagaagugguaaggugcuuuacaaaggcacgcuugcucuauuugagaauguaaauaaaaccagugugcuuuggagaacugguuaguagucucacuuaggugcugcuuaaacacuugagggagaaauagauaauaaaacauugaaauucuuuccacccagaugagauuacagaagccaaaucagggacugcuacuccacagagaucgggauccaucagcaacuaucgaucuugccaaaggagugacucugaugccgaagcucaaggaaagcccucagacgucucccuuaccucaucugucaccucccucgacuccuccccugucgacguagcuccaagaccaggaagucauacaauagaauuuuuugaaaugugugcaaaucuaauuaaaauucuugcacaguaaaccuaaaauuuugcuuauuucuuugaugcaauaagcaugcauaauaaauaauagccaaauacuuccacuuaccaaguuauauauauguguguauauaacugaggauuggccuuuuggaaugcaguuugcacagggacuggaaaacgauugaucguuaaaagccugaugugcagaauugaaugaggaucacucuguuaucccguauucaguagguacacacagcguaacacacacacaauggacuguaggucucaagcuuacuugacuuuuggccauuugaauuugcuguaacaggucucagucgaccauaaauuuaccauaaagccuucacauauuaguacauguugauguauuuuauauuagcuucaugaauuuauugaguugccuggaauccucauagaccuuauuagauaaugcuguuuucugggcuccuuaacuuccaaaauagcuacuaguuuccauuuuugguuacauugugaacuauuuccauauuccucuuaacaugcuauuuuuguguaguaagucauuucagagagcagucuggauuuaacauuuuucuuuggcuugugagcccccaaagccccagaauuuauauguucagacccuccaagcccugaauuuacuuuuucagguuugcccuuuuauauaugaagugcugcuuuggauccaagagccgaguugcucacacuguagugaaucguguugcuucugucagugcacagagacgcuaucaugucagccaguguugaaugucuuugguauuuucuaagccaauccagugcauagaaaggacaguguuuauacgcucugaaugcuaggauugggguuuuagccccugauuuuauucuggacaauuuuuaaagaaagaaaaguugcaagaauuuagugacugcauguguauuuacuacuuagcuccuacaacuacuguuuggccauauuugcucucuagauccacacauguauaauauacagauaugcacauauauucgaguauauguuugcuuuuauucugaaccacugagauguuaagguauauauauauauauauauauaccagcccugaauacuucagcacuuccuaaaaauaauaauaauguccuuuagaaaccuucugaaaccauuauaaaaucaauaauuuccagauagugccugguuuuccagauuagcuguaacugcccagaauuccauuuaaguuacagccugauuuuauuugcaguucuuuaaucagguuaauaacacuauuuugaaaagauguagaagaaauccuuucuucaaacuggccaaguuuauuucagguuuuaauucaaaauaaugaguggcuaaagaagugugauuuuucuucaaucucugauuuauaugccucucuccuuuuagugguagcauagcauaauggguguaagugaagauuuaagucacgcuagacaaagccgguauugugugagcuaauaauuaaugucauauuggccauauuugguuuccuuuaaguuuaggaaauuggucagaggcucuagcccaguggugaggcugggucaucuccagcaacgugaaacaaaaugcauuuucuuuaaacauuaaccauccccccuuuguaagagagacuuuuccccccacugcauucauuuaaaaauauuuugccccauccccaaaccuguccagcacuuauguaagaacgcauuuggaggacaugauagcuugcauaaaagaugacgcuauaguuuaugcacugauuuccggacaaaaaugaugcuucuuuuuguucggggcuuguuuuauucaacuccgaauugaaugcuguauaaaguaauggagacuccauuuaccugaguuccugacuguauuuauaccuguguguuugugcccucuguguggggcucccugaugucacguaugcugucugaaugcagcgcuguauucccgcuguguagaacagaaggcugcauuuguaaaguuauagauuuguaaauaaaacugaggaauaucucuauaaacuguuggggggacggggcacaaaaggaggagccaacuaaauaggaccuucuaaaauuuguuaauuuuguaaucuuugcuucuuuuauaaguuauucugugauuccuuuuaguuaccgaguuuuauuuugaagacauuaaaauauugcacuuguauaaauaguaugauaaaugcagacuauugcagucaaauuuuuuaaaagcuaggauaucugaaaugacaacuuucaguuaaguaugucaagcccaggacaggauuuucacaaauguauuguaguuugcaaauucuuacacugaaaauguaaagggagucaaugcaaaugauuuuuaaucuuuuuuuuauuaucuuuucagcaauuuauauuuucuugugauuuuaugcaaccauauuuuuacuuugucuugacaacugaaagcugugugauguuuuugacagaaaaguacuguauacauaguuuuaaauauaacagauuuugcugauauguaaaaauuuugccauuaaaguugauuucucaugaaaggaacuuuucuaccaagucgggagacgcaagagcuuaauauaucuaauuuaaaauaauuucacugaaauaaacaccauugcuuuuacuuugauucuauuuuuuucuuaagaugcuuuuauaguguuugggaguuuuagauaauuuuauaugaauucucucccuaccuugccccauccuuuggaucuuugauaccauucacaaauaaacucauguggcuggguguguaaagauauguaccccaaggggcaucuugggaaagaaaaccauaaauucuucuccuuaacuccucccucugccuguucauugugggcucugacaugaugaauggaaugccacacacagccugacuguaagccguuguugggaggaguccaccauuguggcuuauguauguuugcccagaguaaccugauuuagaaagauggcauaauaaagaaaaaaguucguuuuucauuuguuac

SEQ ID NO: 7665 - RNA, 10641 nt, Mus musculus
ccaccguacucugucaucaguguuucuuuauuuuuguuuuccuuaguucuuugaucuucugaugucuagaguacacguuuuucugauacucaaaguagaaggaacuaaagacgaauaauaaguagaaaacauuagggcacaugggacuuugagcuggauuccuugccacugacuccuuaugcuagaaguccuguugaagcuggguguggugguccacgccuuuaaucccagcacuuggaagguggagccagggagauccuguuaguucauagccaaucuggucuacauaaugguuucaggacagucagcucuguagagagacccugauucaaaaacaauaacaaacaaaaagaccugcugaaaagaagucuccaugucgcggcauggcagauggggaggcaaacucaguuaauuaaauggauauuauaaaauauguaagugggauguauauucgcacauguuuuagauauuuuucauaacugaaaugugauagcaaaugcuggaucugguggcgcacacccaugaucccaggacuugacaagcugaaagaguaugaccgugaguguguuuccagccugggcuauggagugaagauuccaccucaaaaaccagucagauacccuuaaaaaccauuauucuuuucaguguuugcuuuguuuguuuguuuuuaaguuuuaguauaguucuuguuaugguuccauguccuuucauauauagaauuaaugaauacaauaugaaauuguucagagguuggucuuuugagucauagaacuggguugaaaggacgaggguagauuuuaaauggaugaauuguuuaucgugaaacucagcauggaguaagaaugcauaggaugauauugcacacuguuuuuguuaguaagcucuuuuccuauaacaugaaauaguguaaaaagugaagccacacaacauaguuucuuucugggcuggaaaaagacuguccucagucauuguccuuuggguagacauaccaaauuuggcugccuugauccucaaaaauuaguggcaggggacuagagagauggcucggcuguuaagagcacuggcugcuuuuccagagguccugaguucaauucccagcaaccacaugguggcucacacccaucuacgguagguuccaaugccuucuucuggugugcaaauuguacauacagacaaaauacccauacacauaaaaguauauaaauaaaaaauagguuguagacuaauguuuuucucagcauauucaaugaaguaugagcuagaaggggaaaccaguuuaaagagaacaacuguaauaauguagcaugaguaugaacucauucauauccuaaacucuggaaacuauuacuuuuauucuugguuuaacugaaaacccuucuuccaccauugcugucucucuuagggaacacgagugguuuaaacaggaccuuccgaaguaucucuuuccugaggacccaucuuauaguucaaccaugaucgaugacgaagccuugaaagaagugugugagaaguucgaguguucggaggaggagguccucagcugccuguacaacagaaaccaccaggacccacuagccgucgccuaccaccucaucauagacaacaggagaauaaugaaugaagccaaagauuucuaccuagcaaccagcccaccugacucuuuccuggacgaccaccauuuaacucggccucacccugaaagaguaccguucuugguugccgaaacaccacgggcccggcacacccuggaugaauuaaacccacagaaauccaaacaccaagguguacggaaggcaaaauggcauuugggaauucgaagucaaagccgacccaaugauaucauggcagaaguuuguagagcaaucaagcaguuggauuaugaauggaagguaagaaggcaagugcucucucuguuuggugagccuguagccaaagcccuuuguaggagaacugaugugaugaugugccuuuguuuuuguccauauccaaugcuagguuguaaaccccuauuauuugcguguacgaaggaagaauccugugacaagcacauuuuccaaaaugagucuacagcuauaccaaguggauaguaggacuuacuuguuggauuuccguaguauugaugguauguacacgcagaacccuggaggucauguaguuauauagccugcuuaccucauuugcuuuauagucuuuguuuucuuucuuucuuuuuugaauaaaaacuaagcaugcaaaguaguaagcuucauauggcgccuuccucccuucucucucucuagcuuuucuauccucccucccucccucccucccucccucccucccucccucccucccucccucccucccucccucccucccucugcaugugucucagaacacaugggacaggcugcagaagucaaugucagguaccguccuccuucaccuuccaucuugcuuuggagacaaggucucuuugcacacgggugguugcccuucaggguacacucacgggccagcaagcuccagggaucauuuaauuuccgacuuccagcuuuggcguaaugggcgugcccucgcuggccuggcuuugacaugggucuggggaucagcggcagggccuccuuaucuacugagccuucuccccagccccccagugcacgcugccauacauguccugcguccuuggcauccuccucacugcccuccaccucagcuaugucuuaggaagcuuccuggccuuuuccugcuaauucauaggaaacaugacuuccuauguucugcaagacugacguuugugaaaccuguuauucuugcuccauguagcauauugauuuauagauuauuggggcuagggauuuaggucaguauugaaguucuugcuucacuggcuucaaucaccaucaccugacuauuguucuguaaaaucuuuaaaaauauacaggguuuuuguuuguuuguuuugcuuaugcucuaagugauguuugagaagcugcaggguaagagcgcugaucugagguggggagggucgagcucuugagaggugggaacugucccuuuggugccuuggacaagucccucaacuucuggcuuuuuauaucuguaaaaugguuccuaggugagacaaguuccaagauaccuuucauacugcaagugaucgauucuguauuuuuuguuuuguuuuguuuuugagacaggguuucuguguagcucuggcuguccuggaacucauucuguagaccaggcuggccucaaacucccagaguugucuuugccuccuaauugaugggacuaaaggugugcuugccacuacccagugagucugugguuuuaauaaauaucuccuagcagugauauuaauuuacagguuauuaguuuacuguuucuuaguuggugugaaagucaagagugcuauacuauguaucccauguugacuggccauuguauguauuuuuugugcuguguguagaagugguaaggugcuuuacaaaggcacgcuugcucuauuugagaauguaaauaaaaccagugugcuuuggagaacugguuaguagucucacuuaggugcugcuuaaacacuugagggagaaauagauaauaaaacauugaaauucuuuccacccagaugagauuacagaagccaaaucagggacugcuacuccacagagaucgggauccaucagcaacuaucgaucuugccaaaggagugacucugaugccgaagcucaaggaaagcccucagacgucucccuuaccucaucugucaccucccucgacuccuccccugucgacguagcuccaagaccaggaagucauacaauagaauuuuuugaaaugugugcaaaucuaauuaaaauucuugcacaguaaaccuaaaauuuugcuuauuucuuugaugcaauaagcaugcauaauaaauaauagccaaauacuuccacuuaccaaguuauauauauguguguauauaacugaggauuggccuuuuggaaugcaguuugcacagggacuggaaaacgauugaucguuaaaagccugaugugcagaauugaaugaggaucacucuguuaucccguauucaguagguacacacagcguaacacacacacaauggacuguaggucucaagcuuacuugacuuuuggccauuugaauuugcuguaacaggucucagucgaccauaaauuuaccauaaagccuucacauauuaguacauguugauguauuuuauauuagcuucaugaauuuauugaguugccuggaauccucauagaccuuauuagauaaugcuguuuucugggcuccuuaacuuccaaaauagcuacuaguuuccauuuuugguuacauugugaacuauuuccauauuccucuuaacaugcuauuuuuguguaguaagucauuucagagagcagucuggauuuaacauuuuucuuuggcuugugagcccccaaagccccagaauuuauauguucagacccuccaagcccugaauuuacuuuuucagguuugcccuuuuauauaugaagugcugcuuuggauccaagagccgaguugcucacacuguagugaaucguguugcuucugucagugcacagagacgcuaucaugucagccaguguugaaugucuuugguauuuucuaagccaauccagugcauagaaaggacaguguuuauacgcucugaaugcuaggauugggguuuuagccccugauuuuauucuggacaauuuuuaaagaaagaaaaguugcaagaauuuagugacugcauguguauuuacuacuuagcuccuacaacuacuguuuggccauauuugcucucuagauccacacauguauaauauacagauaugcacauauauucgaguauauguuugcuuuuauucugaaccacugagauguuaagguauauauauauauauauauauaccagcccugaauacuucagcacuuccuaaaaauaauaauaauguccuuuagaaaccuucugaaaccauuauaaaaucaauaauuuccagauagugccugguuuuccagauuagcuguaacugcccagaauuccauuuaaguuacagccugauuuuauuugcaguucuuuaaucagguuaauaacacuauuuugaaaagauguagaagaaauccuuucuucaaacuggccaaguuuauuucagguuuuaauucaaaauaaugaguggcuaaagaagugugauuuuucuucaaucucugauuuauaugccucucuccuuuuagugguagcauagcauaauggguguaagugaagauuuaagucacgcuagacaaagccgguauugugugagcuaauaauuaaugucauauuggccauauuugguuuccuuuaaguuuaggaaauuggucagaggcucuagcccaguggugaggcugggucaucuccagcaacgugaaacaaaaugcauuuucuuuaaacauuaaccauccccccuuuguaagagagacuuuuccccccacugcauucauuuaaaaauauuuugccccauccccaaaccuguccagcacuuauguaagaacgcauuuggaggacaugauagcuugcauaaaagaugacgcuauaguuuaugcacugauuuccggacaaaaaugaugcuucuuuuuguucggggcuuguuuuauucaacuccgaauugaaugcuguauaaaguaauggagacuccauuuaccugaguuccugacuguauuuauaccuguguguuugugcccucuguguggggcucccugaugucacguaugcugucugaaugcagcgcuguauucccgcuguguagaacagaaggcugcauuuguaaaguuauagauuuguaaauaaaacugaggaauaucucuauaaacuguuggggggacggggcacaaaaggaggagccaacuaaauaggaccuucuaaaauuuguuaauuuuguaaucuuugcuucuuuuauaaguuauucugugauuccuuuuaguuaccgaguuuuauuuugaagacauuaaaauauugcacuuguauaaauaguaugauaaaugcagacuauugcagucaaauuuuuuaaaagcuaggauaucugaaaugacaacuuucaguuaaguaugucaagcccaggacaggauuuucacaaauguauuguaguuugcaaauucuuacacugaaaauguaaagggagucaaugcaaaugauuuuuaaucuuuuuuuuauuaucuuuucagcaauuuauauuuucuugugauuuuaugcaaccauauuuuuacuuugucuugacaacugaaagcugugugauguuuuugacagaaaaguacuguauacauaguuuuaaauauaacagauuuugcugauauguaaaaauuuugccauuaaaguugauuucucaugaaaggaacuuuucuaccaagucgggagacgcaagagcuuaauauaucuaauuuaaaauaauuucacugaaauaaacaccauugcuuuuacuuugauucuauuuuuuucuuaagaugcuuuuauaguguuugggaguuuuagauaauuuuauaugaauucucucccuaccuugccccauccuuuggaucuuugauaccauucacaaauaaacucauguggcuggguguguaaagauauguaccccaaggggcaucuugggaaagaaaaccauaaauucuucuccuuaacuccucccucugccuguucauugugggcucugacaugaugaauggaaugccacacacagccugacuguaagccguuguugggaggaguccaccauuguggcuuauguauguuugcccagaguaaccugauuuagaaagauggcauaauaaagaaaaaaguucguuuuucauuuguuacacaguauuucuuauuucaucaagguuugggguggggugcacuuguucaucguugaguaucggggcucguucagguacugaaauauuacgaugcagacaguaaaugcugaagcagcugucacagaccaaucacaaacacaggccuugaauuccauccuugcuagaauucaguuacuauucaaucuagaaacucagcguucuugaggcuuuugcaggauugcuagcuuucuaaaucagaaaagcuucauuuuagauguuaugaacagcaugugaaguucuuuuggagagcuaauuuuucuagaucuucauuacaaguuuacacaagaaacuggcauguggaaacuugcauccauuaaacuguccuguucugaaugaguaagcuucggguuguuguaaaugccaaucaauggugccaaauauuuagaggcuguucacugacuuggaagacauggccaagucuuuacuagaguugagggcaucaugguuaagcuacccugagagacugggaagaggaacagagccucaagcacuguguauucauccauauggccacugugaaccauucaugacagaugucaccaggacagcaagauacagguccugcgccaaccaucuuauuagggauggauggagauagauauagacacuaaaguacaaacauguaaggauggacugaguuguugggaaugugaccacgugaaccuccauccagacugaggaacagugcauccaccagacugucuauuacgauuaauaugagcgugaggugccacaggccaacucugacauggaaagaccuucacagagcugugagcaccaagagcaggaaacacugaaguucuuuuauaggcugacuaccacaguaauacauugguuauagugaauauaccaacuuacuugacaacauuaaugaauauaaucaaauuauaaauaaaaauuguaucugaaguuaccauugaucucaaagucuagacacacugggaagcugucaagauuauuauauaaggaguacaguuuugucauuggaacagacauugucaacuuuuuaagugagaaaauuuguguguguauguguguuugcaugucauagcacauguacggagcccagaugacaacugucuuuccaacgaguacgcucugcagacauaacucaugucacaaggcugagcagcaagcauccuuacuugcugagccauuucacaagccccuugcuuuauucauuucaagaaaaggucaaagaccuaaauaugaauauaaucaguuugucagcgguuaaaaaaaaaaaacaaaaaacaguuguguuccacaagauaguggaacuuuauaauagccuuaaagaacuggguuuauugggucuggagagauggcacugacugcucuuccggaggcccugaguucaauucccagcaaccacuugguagcauacagccauuuguaaagggaucugaugcucuuuucuggugugucugaagacagcuacaguguacucacagagagagagagagagagagagagagagaaaauaauugauuugauucuuauguaugugcagccacuugcagaggccagaacgugggguuggaaacucccagagcuguaauuacacagaggcugugagcugccagaugcugguguugggaacugaacuuugguccucuggaagagcaggagccagugcacuuaacuucuggacucucuguccagcccucaugguggaaucuucacucgcuuuugagaggcaucacacuuccguagcaguaaaagcacuugguaucauagaaauaugaaugccaucguuuagaaaugcccuugacgaagcagugauacuuggcuuauuaaagugagucuggaaauugggacucuugcuaggugacauagcuaggucucaucucaggagaaacuuguguuccagaguuucacuguaacggcgugacagaggacucuaucacuaccauuagaguuugcaucauuaccucaaauccacguagcugcucuaucacuguggcguuuuaacagccagcaccaauguuuacuuuugugaaaaauggcaauauguacgaguucuggguacggaagggccuuugacacuugguaucugugggugucagaagagggcagcaguuccccuguaacuggagucacagauguuuugagucucucuguugaguguuggaccugaacccagguccucuacaagagcaguaagccaucgcuggggccagcaucagugauuuuaaugccagcguuggguaagagugucccuucagggacuauuugacauuuuggagagaaagaaguuaguaguccuuuugguaauguaugugugugugggggggguggggauggggaugggggugggagguggggaggggaguauuacuaaugguaucucagaauccuaccauguuucuguuugguuucagacccaggaacaaacaacuuagguguauauuuuacauaccaaagcagaccuggccuccugguucucccagcaucccucagucccuaguauaacuggcccccaauccugaauuuucagcacagggccuggacucccuucccccagaggaucuuugcuauauaauccauuuuguuuucucccuccccaucuccccugcccccuugucuuagccugagggcucucuuucucuuccucuucucucccuuuucuggccuccuuccuuggggccagugaacucaccugcccgagagcagcuucuuaauaaaccugcaguuguauauauuuuaaucuggcuugaauuggcucauuuuaccaguggagaaauaacuuaucaguuuaccucaacaaauaacuagccaguaagacaugcgguggcgcguugaaaaagcguggucuccauaaaucgaucuuggcuuuguguagcacagcuauguggauaaacuuaaggaguuuucaauucccucagugugccccauuguuaacaucagccugcuaauuuacuuguaagaagugacaggugcuacuuucaggcucugcuguggauucucacaggaagcuugcaguucagcccaauccucccugaucggcucuuacuuaagguuucuguugcugggauaaaacaccaugaccaaagucaucucggggcggaaagggguuauaucagcgucuaguuucacauuauagaaggaaaucaagguagaaacucaagcagggcaguaauugguccuuuuuaaggcuuguucaguuagcuuccccuugggccagaccaccugccaaggguguggcacugccuguaauggguuggguccucccacaucaaucauucaucaagacaaugcccgcauagauuucccuacaggcauuuucucaguuaagauucccuguuuuauagcuaaguauauguuugugucaaguugacacaaacaagccagcacccuuugcacuuauuucagcucagucuccgcccccccccccccccccccccuucugcaucucacagacccuucagcggcuaggccggucagacuaggcgguaagccauuuauuuaccugaggacuguguguauugcaaagcacaaccucaaacacgggaguccauucccggcugcaguuagagggcgcuucgucuggugucuuuauuacaaaucccauagucccuagggcgccgcagugacuucugggauuagugguccugcagaagggcgcuggcggguaagaaagucuucuuuucuucuguccgccuugcuggacuuuagaacgucccaggaugauuucaugcuuuuuuuuuaaaauaaagaaucgggaagcacaggcaggcaaggcagauuagaaucccggcagaauaguuuccguuuccggugcca

SEQ ID NO: 7666 - RNA, 1842 nt, Mus musculus
gacuuuugguauagcauuggaaauguaaaugagcuaaauaccuaauaaaaaauggaaagaaaaaaaaaauaaaguggcuguuagaucuggaggcuugugcagauucauuuccuuggugggagcaggugucagggaggaggguggcagccuggaggacuucuacuagaaguuaaauaucauaccagcacgcaccgauugcccuuuucugguguacuuuccugguugcagagauggaacaccucacaaagaaaccugaaggcagggcuugcuuuggcuucugguuugaagaugcaguccaccaaguaguggaaugcaaggugacaggagcuuaaggucacacugcaucugcugucgggaagcagaaagagcuggaugcuggcacucagcucucucuccuuuuuauucagcccaggaccccagccuaggggacagugccaccuacauucagagugggugcugcuucucaaaacaccucuuagacauucccagagguccguguccuuggugauuacagauagcaaguugaugagaguaaccaucugaucuagguuguuauuucacuagaagucauaauaacacuaauaauucuguuugucuuuuguuccccccaaaaauugaggagaaacuuucuaaaacaacuguauuuucuuucucuggggaauaauuuauguagugaagccauuaggaguaaagaccugcugcugcugcugcuguuuuucuuuucuuucuuuuuuuuuuuuugccucauuuucaaugugaaaacacacaaaaugauggguauaauuaugacacuguuauauggauguacuuuguucuuguucuucaucccuccucacgggccuccuugcuuccccugucccucugcccagguagucccccuuucuguuuucuugucauauacaauccauuaucuguugugccucucauggccuccuucaggucuccuccuuccuucucaugguccgcuagucuuauauuucacccuucugcacacagauacccccaacacagcuagggugugcucucucucugucugucucugucuugucucucucucugucugucucugucucucucucugucucucugucucucucucuaucucucugucucugucucugucucucucucucucucuuugcuugcuuucuugauucuacauauuaaaggaaauaagaacaggauuugucuuucugagucuggcuuccucacuuaaugcagugaucuuugguccuguccauguucccacaaagaagucuugcugugauuuaacauuugacaaauaguauguugcuucccuagcauucuccggugaagaccaacgaacuguuuaguuuuguuguauuuuauaaugcccugcauuaagacauauuuugguauauuuccauucccaaaauuaccaugcaaguuaguuuucaaggugguuacauuaauuuugcacuucuaccaacaguguagaaaauuuucuggaguguacaugcuguucucaaacuuuuugugguuuuacugucuuuccaccaccucuucugaguuaagacauuauuaauuggccuuguacaucuagcuugugguauguuuauuuacuacugucuccauggaguucauuaugauuugcuugucuguauucacuauuauuuagugauuauguguauaauugcugcauauaguugacugagguauagcauacuuauacuuuuguuccagaacuucuuguuuuuccuggaguuaaguaagcacuuuuugauuucuauguauauauuacaaaaccgccccaacuuuaaugaauuuagaauucuccuuuuuguaaugcaaacaauuuauuuuaaaaacagaaauuuugga

SEQ ID NO: 7667 - RNA, 370 nt, Mus musculus
cauggcacugcagaaagacaagaagccuuagaagucaaccuggagguuucauuuggaccuuacucauccaguagaaaauggaauuuuugacucuggaaauuuugaacaguuucuacaggagaagguuaaagucaauggaaaaacuggaaaucuuggaaauguuguucacauugaacaccugaagaauaaaaucacaguuguuucugagaaacaguucuccaagaaguauuugaaauaucuuaccaagaaauaccuuaagaagaauaaucuccaugauuggcuucaugugguugcaucugacaaggaaacuuacgacuuuguuauuuccagauuagucaagaugaaaaugguucagagucugaggacuaau

SEQ ID NO: 7668 - RNA, 1566 nt, Mus musculus
caccaugugauauaguuuauuaauucuauagauggcauacagccuuaggagaugaaguuacuauauugaagaaaaaucagcacucucaugaguacugcagcaguauaaacaauagcuaaaguaaagaauuaacuuaagaaugaaagguguguuucuauugcugaaaacaacuagcacuuuagaaacaggguccuaagaugguauugacacaaaugguacccuccccgaggacuagauuucaagguacuugccauguaagcuuccaaaggaggauggagucaucagaccgacccagcuauguuaccuaugaacaacaucagugacaagaagaguaugauaaaccuaaagcuuagcaauggcacacacaucuuugcaauacccaaacacuuacuaauugaaauugagagcugcucaacaagaggguacuaugccucguacuuuaaacauagcuaccuaaucagugauagcgacaucauugcuauugaagaagaaucugcaaccacuaauauaccaaaccagcauauucccuaauaacacucuauaaauauuugcucuuauacccacggauaaguguagucuucauccuucauuauggaaauuuuccuuugucaaaauuagagaccacaaccagucaauaugcagaguugaggaguugccaguccaaugauauaucuacaaagcacccccacaccaaggaucagggaacauugcaggaggcaggggccauguaaagauuauaaaagccagaucagugaguuuauugugagauugugucuucuaguaauaucagaagcuauaccuacacaguuuuguuaacaugacugcccaaauaugagugaaauaagaaagaauaccaauaagcaugccaaacugaacagagaaaaguccacgaggccuuaguucuacacaaagaacuacaggcaagugaguaaagcuuagagcugcagaggugacucuccuagggaagaguauacuaauuaguuguguagugcuaaauguuuagcucugaaaacauauauauauauauauauauauauauauaacauuauauggacucaacagauuauauuuaggaauauauauguauauacaaauguguauauaauaacaaugaaaaagaggcuauaaauuugaaggagaguggaugggguauaugggaggauuugaaagaaggaaaaggaagggauaaauguugcaauuaaaaugcaguaucaaaaccaaccaaccaaccaaccaaccuaacuaaccuaaguauuuguaaguacaugcauucauaaaacacauauggugucuuaguauugacagucucaaaugacauugaaaaagaaaaugagcugaauaauaagcuuuaucagguuggucugugaggaugucuaugagggauuguccugauuaacaaucacauaaaagggcccagaccacugugguugguacaauucccugggaagaauaaagaagauaccagaacaugagugagccagagagaagagccagcaagcaauauuccuccaagguuucugcaucagguuccugcccuaacuuugaucaaugauggauugugaacug

SEQ ID NO: 7669 - RNA, 92023 nt, Mus musculus
uguugugacugaaacccgucaauauggcggcgaucggccgcggccgcucucugaagaaccuccgaauacgagguaagcccgcucgccgcccucgcucgccucacccggugcgggucacgggucgcggcgcucggcuuugcuccgggccuggggaugggguggggugagguuggacggggaagacgagcggggcgucgggcgccgccggccugcgauggauucuaacugggguugugugucuugucucgcacagggcggaaugacagcggcgaggagaacgucccgcucgaucugacccgagguaacgcgggccgccgcggccgccggggaggcgcgggcagccgggcgggcgggcuggcaggcgagccgcgcggggcagcgaggggccgagcccgcgcccaucccccugccccgcgcccggguggcccggguugcccggggggcugagcccgcuccggggccucgggcggcugcggagcuccccggccggcucggucgcguguguguccccccuccguccgcucccggguccccccaccuccggaucccgggggcggccuuggacggggugggugggggagcaagguagagguuguuauuuagguugcuggaggauguuugugggaagagcgaccacauccugcccuccccguuccccccaagagcagaugcuggacccugccggcuucuugcucacugcgggacugcucuucccugcccgugggauccucuuggguggggugggggggguccccgcagcuuuuugagaacccggagagcccgugaugacugcuaagugucugguucacgccgcagcucccugcugcucgcuucccgucucccgggcccgcuggggcuguaguuggcuggagaccgcccgcccccucacucggccgccgcuucauuguguaccuuguggcugcaguggaggagagcuggguuuguuuacaccuuucccagcagggcgagccccgcguguguuuuguuuuuaagaaccgcacccggcgaacgaucgguauuuucuugcuucggucaccggcccccgggcugguguuucaucucccaguaucucgccgaagcaucaguccguucucugccuccuuaaacaggaguugggucuacagauuccggacgguccgacuccacagcgcuggaguggaguguaacuuaacuaguucugcuguuacggaaucacuuuuugagauccgugaaacaccuuaggacguuaaaacaagacaagaacagucguaaacauuguauauacgacaugaauuugguucccccacccacccuguauguagugaccgucguauaaaguuauuugguggaugugggauuugggggacccaucucuguauugacugcguaauucaguucuguuucgguuuuuguauuguaagaauccuucuguguagacugaaagacuaguuuugauuuaguuucaugaacacguguuuguuguuuagcauuugguucugauaguuuaggaagcuguuuugaguaaaggagcccuuucaaaggggaaccucuuuaaagauccagugcaguggugugucaguccuagagauggcgacuacaucagugaucuggaacacucuuaccauuaaccagcuuucagaaacacuauagaaaaaaggucaagcuuuaguuguuuuuuuuuuucaaauuuguaaacuuaauauauaccugaaaaauguauacaaaguagguuuuccagacagcgguucugaguaucauaauucagaccugagauuuugcaucgugcuuuucuaaccauguaguucgccacugauuuaauugguaacggagaaacugugugaagauaccucuugguuaacuagagccuaguaccuacaguauaaaccuguucagaugugggauuuuguuaaucuucuuuauauauuuuuguggaggcugucagaauuugggaugguagaaaagcuuauauacaagcuuauaugaaacuugccucacuucaauaggaacucgggaagacaaaucaguggguacgauugaaaaucaucaguucucuaagacuugacuuaaacggcuaugugaugagcagcuguuucuaggguuacguaaaaugcuuagacaauguuauguuugcuugccgggauaaaacguacuaguguugcaaauaaguauucacagccaguugaccugauugcaaaagcaaugcacaacagagagagguuacaggagaacuguaggccucaaucauaaggaagcuuagaaggaaaaaguuaggaguuagauucauauauagggagacaguugauuagagaaaguguuacuugaacaaacauuucauuguuugaaggcauguggaucacacaugaagaaaguccacgaggaauugaacuuuaguaaugauuugagacccacggcgcagauggguugcagcugcuuguagauuagauuccaguacggaaaaauguaaaguuugagccaccagauuuuuguuucacaucaugcuaaggcagugugcagauuguuuugugaagucugcuguguagguggacaaccguggucauagugauuuguaaaagggacauccaugcauaucacagcacugacugucaagucagauaguucugcauuguacucucagggacagcaguauugggggacuugggacaaguuauuugaccuugcuuaccuucugguuucuccaacuuggaaaaaaaaacaaacaaacaaaccaaccaaacaacuuuaaaguguuagugaaagguaaaggaagguaguucuuaauuacucaguaugaauuaugucuuaucacuuguaagcaauauuuaguguuagcugcuugccuacauugggaauuuggaaucuuuaaauccuaauuuaugaaggaugucaggugguugugugugcacguccguguacaggugcagaggcacaugugugcauguguguauagaagccagagggccaccuagguaucaguaacuccucaguggccuggaccuugucaguuaggcuagacggcugacccgugaauaggaucugcuuguugccuuuggcuccucggugcugggaacaaaauauaugccccacaccuagcucuuuuacuugggcucuggguuuugaacucagggccucucgcuuuuggcaagcaguucucugacugguuuccccaagccccaaaucauugacuguuacacauauguauucaacgaauuagaguuuguuuuggagaugaucuacuuuauuuaucagguauaucugaaauggaguauuuagugauaacauguuuuugcuaguaucagcacuuaggagguugacacagaacugggaauuggaggccagccugggcucuggaagaccugucucaaagauuaccagcuaaguuuaacccaaaguauaguuuguuguauguacuuaggguaagaugugagauuacaguuugugagcccuagaauuguuuucuuuaacaccagaaagcuuuuaguuuggugauugacuuguguucugauucuccugggcgagggcuuggggccuuugguuuugguacugguguuguuacuguggcucauacagaaugccuguauuagaaauuguugacggauuaauuuugaucuaggagucuauuuaguaaaucuuagaguuaauuuguuaguaauucuugcuuucaguuuuguucagaagccuacucuacuuaauuugugaaaguccccaguuugcuucugacaccauuaaauacucccuguauuucauaccaaaauguguuuuuuuuaaaagaaaguccaaauacccaaauacuucuuuagcuacuuccauagcaagcauggaccuuuuucuuuuuccuuuuuuuuuuuucuuaaauagugcauccccuucugguccuguuuacucagacuugaaagacacaguaaucucucaggguaagucccuguuaguauaguuuuugaagugucuuccuagaaaacggacacuucugcauuagacauuuauuggaaugcagucuguuggauuagauuguugaugguucagcuugcuguucaguauuuagaaaggcaggaugguuaucugaaacagugugaauuugaacauuuuuuuuccuaauuucccuuaguugggugguuacucauuuuuuuaauugcucgcuucaguuaaaccaaacaaacccugacagaaaccucuuauguaucagaaacugaauuaaaugcuggagaagcagggacaggaaagaugucgcuccuccuaaagaguuuauuggugcugaguaaagaagagauuuggugugaaauaauaagcaaucagauuguuugagggacagaaguggugucgcagcagccagaggagagugugaucaguaguggcgcauuggugaucagagaagccuugaaagggcuagcuguccauaaaagcuguggcuacguggaaggaggugugggcugccugccgaauccagcacacuguggaaagggaaagucgguggauggaggagcuguguagaaggcaucuacuggcaucggagaaaugaugaaggauuagaccagggguuuagcuacagaauuggaaucaaagauauuuuagagugaggaaaucagcugauuugcuuucuccuauugaaaagcgacuuuuaaguuuugguaacuuaaaagucugucugucucccauuuugaaggcagucuuguguguuccuagcugguuugguucugacuauguggcccaggucggaguaauccucuugcuuaagcaugugcuagcacaccuagcuucuuucuuuucuuuauuaagaaggcaaaggcugagagaucugaauucuggauuccuaaugaagucagaccugacuucucuugcuagucaggcuguaaagcaguuccucuccaggagcgacucuacuccugauagauuuccuucaagucuuuguacaacucuuccuuuacuuuaguuucuuucucccuguuggccccguuuccacuugauuagcagauauuugcuguauccuucuggauggguuacuagaguggacauaggucagggcagaguagaaagagauaaagacuaggaacaauaauucucugaagacuucaggcagaguuuccuccacagcugccuucucuccaugggcucucuccauguagugaaaacgcugucuuaauugaugugaacagccucuccugaaacucacugccauuugaaguuuuacauccugcuuuugcuaugauuacuauaccgugcugugccaagcacucaauuaucucaguuuucauuaacuguucgcuauacuuacuccaaucaaagaagaaaagcuuugaaauucuaaagcauugagaccuagagagaugucguucagugucauagggccagugaaugccauguaucuaauaaucaucuuugagugugucagacuuggcacccgaaggcuuaucuacuuucugcuuucuagguacuaucaguaucuucuguuguucaaacuccagaccugcucuucauuugcuuaguucucuugaugaacuacugcauguggccucugaaauaucuaguugguagucuguucccaucauuguugguguuccuucaaguucucauuaucccuguggaguaauaaaaaagacuugaucuccguuuuuaccuuuuuuucauuccugcucuacugcuacuaggagcauuuucuuguaaauccagauuugaucuugccauguauucacuugaaacuaaacggcagcgaaacaaggcuugcuuuugcuuacaguauaaaguccaauuccuuagcuuggcauccaaggccuuuuauaagcuauuuaugcauuuucuuuugugcuacuacagcuguagcaaucaaaauguauuugccuguuggcauagcucuuguuuguagcgcacuccuucauacacagagcaccauuugcaggagauuagggucaguuuucuggucuaaagcacugacucuccccccguuccucuugagaguaauuguuugaaucagagaaauaugguuuuugaagcgugacugccauuuuaugcuuacuuacuguaguuguuuccuuuaccuaggaauguauucucaguagucuuuauuuuuuaaaaaacgguaauucuuuaaggcuaagggguagagcugaaggucuuugcucaugcuuaccaagaagucuguuacugaguuuguucccaaccccugaagcagugaaugaaaggauggagaaagaaaugaacaacagaguaguauauuauuaaagagacuggaaccaaagugauagagcuguaaaauagagaagacacuuaggacuucagugugugguuuugaauuucgugugauugauaacaccaaccauauggaaaaaguacuacaaaauagagugaauguuuaauaguuguuauucugaauuuaugauuugaguauuuuuuguauagguuguuacgagcgugcgagagauuuguguguguugggagugacuguaggaccuuacaugugcuaaacauguucacugcugaauuauguccucagcuccuccguggacagcuaaagaucugagcauuccaagaucagagagacugcacauuguggauaggauccuucaacagaugaaaguggugaagguucuaaucugagauuguucaguuggcggggcuggaagcuguaguggaagguggggccuguggaacuuaguucugcucuuagcgugagagugacucuggcugguguuuacccugugggcuucggcugccuuaccucuagggugcauaacgcuuacugcacacagcacuuugaccuuccgucucugugauucucagauaaucaccucuggcuguugaaagguuaaauaaagagaaagcauucggaaccuuguuaaguugauggugaggaguauugagaaguauuucuuaaauacuguguauguauaaacaguauguguuggcgugacaguguuucauagcacuuuaaauguaaguuacagucaagcgaucugucugcugagacuugcuaccuuggucuccugcuccagaaaauagggcucugaaaagcacagugggcuagcaaaagugcuuugccugccgguuccucugucacccucuaguuagucugcucugcccugcgcuuagaaagcugccagggagugugauaguguggaguccuguuacugacucuguguguugugauaguguggagucugugucgcuuggucagaucgucauguuguucuuuuucccuucaguagguuuuuuguuuguugauuuuuuuuuuuuuguauuuuuauuuucuaaguaaaugcuaucaguaguggagggaagggaacagguuaaaauauuuaguaaauaaucgauguaugagugaugagaggaaacugcuaaacuuuuuggaucauccauuguuuugauaccauuguacuuuuugucagugugaccacguuaaacaaaauugcucccuguacagugaauggcguauagaauuaugcagaugccaaaauaaaugggaaauaauuaugcauaccagcuaaaaauaauucauauguucaaguaauguagaugacaaagaauccaaacaugagugcauucuucauccaccaguuccaguguagacucaugcgcuauugcuguguaccuaguaaugaguuuuauauaaaauaacauugagaauauguuaaugccuuaaacaaagccagguaaauauaauagcaaauauguuaaaaagacuuucaaacccaaauaaacuuggauuuuaaagacuuagcauaaauaaguugcaguuuuuacuccuguauacuaaagaauuuggauguauagugcuuuuucuugauguuagcacaugccaccauagcagaccugagacaguuuuaaaaaucaaaaccuaaauuugagaccaaacaucuuacuaacaagucauuuaguguuuaagauaguauugggagaaaguugguggcaaguguuuucccucugaaauguugaagacuaauuauauuuuagguuuggguuuguuugaccuuugauaggcagugaugcuggacuggauuuugagauuugaaucauacugugaaauaauugcacacuuguguugaugaaucuguaauugcuugcauuuuaagcuuagucauaaaugauucuucuccuauuacuguguagggcaugugaccuuccucuucauuaauacauucuugacagaggguacugugcaaguucaagggcuucuuucucucaguuuagaaaacuuaauucugaauagaugcacccuggaaacacgagacuaaagugggguggcuguacuuuuauuuucuacagcgaagugacuauuuucugaucucagaacuuaagcauaugaccuacugaugagaucuuaaguaauuugaagugaacauccugaaggcuggugagagggcucagugacggacgggaccugacuugccgacaagacaagcccagcggcacagaaagccuggagaggacugaccccagcagucuguccuuugucuccggggacacgugugcuugcuguagcacacaugauauagcaugugcauguacacauauccccaacauacaacauaaguaaauguuguuuuuuuccuuuuucuuuuuucgagacaggguuucucuguauagcccuggcuguccuggaacucacucuauaguucaggcuggccucgaacucagaaauccgccugccuccgccucccgagugcuggaauuaaaggcgugcgccaccaagcccggcucaacauaaguaaaugaauacuagacacguaagaaacaucugucuugaaaacucaguguuucauuaaguccagaaccuguuuagcucuguggaauggugaaauggcugcuguagcaggguagcagaaccagacuuggauugucacuugcagagauguuaguaauguugcuuggaauucagugcaauuucauguguuucucauaaugaauaaagagugaagaggcacaggagcuguaaacagaggagguugccaagucacuuaguuacuuaaaaggagcaguuugccagagaaaaggauauuuaacugcuuuaaaugugggcauguauguauuuuuucagcaguuacauagaucuagaaagucacaucuugaaauaguagugcuaauuauuuccgcacuugguucaucccugguguauuaaaacuuuuaauugcccuguuuuuuuuuuuuucccacucauaauccucuaauguacucuuuaacauuguauaauccccaccugccuccugcuaguggggaggggggaggaaaaagaagugaauggagagaaacuuaaguugaggaaacauuuuggugaugugagcuccaacauuguacuguguuucuguguguggccaagggacaauggaauagugugguccuuaguauucuacauguggauuguaagaggugguaugauuuuguuuaaucacauuugucuccuguguuacugacuuaaucaguaauuacugucugaauauuagaauuguuugauacucuguuagaauggccugugguuuuuauuacuagacuggugguguuuuaaaaugacacaggcugguacaaaggaagucaggugcaugccuaaguuucaauuauuauauggaauuccuguguacaguuuuaguuacugcugacgaauuaaauuuaagcuuauguuagcuuugaaauggagguuacuguauauacuuccucccccuuuguccuuuuccuuuauuuaauaggagaauuuagaguuagcuguuaauuagguuccagccuuguucuuucccugacaaaaggagaaaaauuacuugaaaaaaggaaaagcuuuuggauuuuuagaagaaaacaaaaagauguuaagagccuggguuuaaaacaguugauucuguuauuguuucuuuuccuacuuucauuuuuuaauaauucuguuuucguauuagaaaaugccacacagaaaagguauaauugccuuuuauuauuuugagauaggagcuaaccacaaacuuagacuuccaaacccagcuuucuauuguaaacaauacauauauugccaugaaauguguauuugggguauuggcauaugccuggguugggggaagguauguuuuauguaugaacuuaauguuuauuuaguuuuuauaguauuggaacuugaauccagggccuuguucauaguuggcaaucaaccacugagguacaugcccaaucuguguuucuaaagcaugcauauguuaaugacaauagacacaugcucauacauacuaucuucacaguuuccuaacguauacauuucuuauauaaugccaucuaguuguaauauguagguuagaugcuagaaccguuaugaacugacgagaggaaacuuauaucagaaaagugagacagaaaaggaauugcagaacaaggaggacggagaggggguucagugguaaggagcgcuggcugaucuugugaaggaccccaggcucagucccccucuccccaacagcucacugcugucuauagcuggaguuccaggggaugugacauucuuuucuugccuguucaggcacccggcauauacacggugcauguacauacauguaagcaaaacauucauacauauaaaaaaagcaaaucuuuaaaacuuuaacccaugaauucaugaauaaauaugaaggucuuacuaaucuuucuagguaucuaccuaggugggcauuucaguuguggcuacacacacacacacacacacacacacacacacugcagacuuugugugaauaauugacagucaguguaugagagaaacauucacaaaaaagccauguaacuauaaagagcucugaugagauaaggucacugaguauaugaacaacacuagaaaaacggagguuguuuaaaaaaguugguagauuucccagagguucccccuucccacaagcagugaaagcugucaaauccuauagacucucaguugaaggaaaggacuugucgacaugauggagcugggagaucacuggggggaagaaagcuuagagagugcuaaacaggccgcacuauggcuggagaggagaacaauccagacuuguaaacagucauguccacgggcagagcugauuccuucucgacuuuugcugugucacagggcauaacuggcuaaaaggucauaugggcauugagagagaaaugauauucaagcacuuuuauuguuucuuaugacagaccaaaugaguuuaacucuuuacugucuuuccaaaauuaauacaggugcaguagaagauagaugcuaacacugacagagcauagauuuggagcacuuaggaguaaaguauaguuuagcuuucauccucauuuucuccuuaacuguuccaucauuaggaaucucacuucauaguaaagacaguucauuuccagcgcuaugaagcaccugcugcuccuuugauuuccugcauguugccucauuucuuuggucacucuacacuacuuauuaaguuuuuccaacuuucacuuuggugagcuuauagaacugggcuuucaauguuauuauaugcaaaguaagacaauaauuacaaagaauaaaggggccuggugcuguggugguuuguauaagauuggcccuuauuaggcucauacauugagcacuuagucaccaggaagugaugcuguuugaaaggauuagaaggauuaggagguguggcuuuguuggagaaagugugucauugggaauaggcgcugagguuucaaaagcccauguuggguacagucugucugcugucacccccaaaccuccagccugccuguggaggugauaauggacuaaaccucugaaacuguaagcaaguucucaauuaaauuaaagaguuaucuuggucauggugucucuucucagcauuaaaacagaaacuaagacagaugucgagaacacaugaacuguuguaaauacacuuguugaugguauuuauuuugaguaugucugccuguauuuguuugucuaucucucucugucucuuucacucucucuucuguuuuuccccaaaacaaaguuucucuguauagccaugacuuuucuggaacucucuguagaccaggcuggucuugaacuuagagaucugccugccucugccuccuguguucuagaauuaaaggcauacaacaucaugugaacugaagagucccaaauauuuaugcuuacacuucccugaugguuggaaacacuaacuuugaaagcuccuugcuguuugugagucuguaguacauugaacaaguguuaauguaguauacauuauuagcccccaaagggcaguugcuuuuagagaugaauuuugaaugauaguugcuguuaagaaugacacaaugguacuauuuguucugggguguagcugguacauucaccacagcugcugucagugacuucuuagagcuuguuguccaauguaaucagaacuggacaguaucacaccuuauccuaaguauauacaacaaaauacuuuugcuuaaacaguguucucucucucucucucucucucucucucucucuauauauauauauauauauauauauuuuuuuuuuuuuuuaaauuuuuggagacagaucucacguaguccagacuggccuccaauucccaguccugacacuaccuccuaagugcugguauuagcagcauggaccacugugcucagcuggugaucucuuuuuauauuguuggcccucuucuccuccccuucccuccuuuccuuucuuucugucuucagauuucuucuaucuuuuucccucuauuuuuuuuccuuucauuucuuuuugucuugcugagauugaaccuaagaugucacuuaagguagggcaguguucuaccacuggacuauaauacaucuuuuucauagcccuugccauuggugauguuauaguauauauuuaucguuugucuuccugcagugaaaauguugugagcaugcguauuuuguuuugcucauuauuguauugaugacuggaacagcucuggcaugcuguauaugccuaauaaauauuuauuaagugacgaucagguuuauguuuuagucugacagcuucagagcaauuuuguauugcuuacaauaucuuaaccauguaggcaaguacacuaaacuuaaugguuuaaaauuacaaauucucuuauucuaaaaaugcuuuccuauuucucaccuguguuaagagaagugcuuuaauugggccaaaucagauacccuagagccauccuaaccuuguuucuugucccuguuccacaaauccaauuuugagugggaugaugguacaguuucuauuucugaaauacacagaaggucugguguugccugccugcuguuguagcuuuacucaggccuugcucuucuuggcugauuggaaugcuauauguccacuccuucagaaggucucuuucccucgucuguucucucuucuguauuguagccagcgcauugucugagaaguuagcaguaacuucccaaauaggguugaauucuugcuuugggauuucaugguauauguuaccuuauagcuaauuauagucaaucaaaauuagcaaguauuuauugacauuuuacuauauacuggauacugaccuucugcugugcugaauucggugaugauagaaugagucccugcucuagagggacauagacugucaguaugggaacauggaauuuuaggcaguguuaaauggaauuugguaugugaaagaauguugacucauggcuggaggaagggggauucagagaaaugcucucuaggguguaguauuuaggaaacacuguaaaugguaggaugggaaucuuccaaauagcagaaaugacuaguccauguucccagagauggggaagaaccgacauggcuggugcacggucacugagaggagaucagaggagaggcagccagguaugagcuuggauaaaaggauacgcugaggcagucaugugaucugacuuaaaaagaucauuguuuggagagaugcuuguccuuggaacagacucuggauagcacauaucacggagccaguaccaagugagugaauuaauucuuuccuuuuagucacaagacaggcaagauuuuucaguuuuuaucacuugaggcuuacauauugucucucacagaaacaaaccaaaauggacuuggcagaugaugguugcauuaguaaccuauggauuuguaaacccucauuuuuuaauauuuuuaguuaucaaggaauaccugagacaccauuaacuucagugaauuuucuguuguagguaggagugcuacauucauucauucauucacucauucauuuauacagggagcuacugugaguagguaugggcacgcugccagcuucugguugagauuauaacauagugcugaccguacucuuaaggaggauucaguuaguuguauaucauuuuuuauaaaagugauuuugaaaggcuagaguuagguuagacugacaaagcaggggguguggcgagcauuggccggcucuuucucuuccccucagcucugcacacacaugugaucccugcgcugggcugggcugggcuguguugugcugcugggugcuuucauuuagaugucaguagccuugggaauauggcaaagcaggccauguagaagucagggagauuaguauuuuuauucucagaacuuuuuuuauuuugaauaaaaccccaggguaauuuuucuugcuucuggaagucgcacagaccccgcccccucgggccuguccugcgcccacugugacugcuguucuugggauacagcucuuuagcucuuuucgggagcccuagggggaaugccuccuaacauagaauuugagggaaauccuugccuuuuguuuuauagcuuuuauuuauguaccuuugugguaaaguucgagauuuauaguggguaauauuaauuauauaggcuuauggucacuuuacaaccuuggaaaccccagauuucuggaaauuauuauuuuuuccucuaccaauaaccugauaaaaugcuaccuggcuuaaacucauucuuuuugagccugacuggaauuuuauuauuaauguugaucuccuguagcguaucuaguaacauguuuuaccuaaaacagaaaauuauaauuuauaauuaagcaaggcugucccuaauacuauuuuggaauacucuaauaauucacauuuuaaaaugauaaaugggggcuggugagauggcucagacuuuaagaacacuggcuguucuuccagaggccuugaguucaauucccagcaaccacauggugguucacaaccauuuaagggaucugaugcccucuucuggcaugcaaguguauaugcagacagagcacuccuauauauuauauauauguguguguguauauauauguauguguauauauauauauauauacacauauacacauauauauauguacacacacacacacacacacuuuaaacuuucuccacuacaugggggauuauaaucaccagaaguauggaagcagauguggcaagagcauugucagaauguaucauguagacauguuaacaauguaucauguagacauguuaacagugcuucuagguacucuucuauugcugugauaaaauaccaagaccaaagcaacucagaaggaaggauuuguuuggaguuuauggucagaggggucagguuccaucaugggcaggaagcaugcauggcagcaaguaggccagcaugggugcuggaauagugcugggagcucacaacuucauucacagacaggaagcagagagagccaacugggaauucagguggcuuuugugacgucaaagccugcccacagcaaagaccugucuccugugacuguuccuauaaugccaccaacuaguauucaaaugcuuaagauugugggcgccaucuuauuuaaacuaccacacagaauauuguguucuaacacuuuuauucuuggaaaauauagguagaaauggaccauagugauuuuguuuacaauagcccaaagcuuuugguggucaaaaguuuggauuuuuuuaaugcuaugaaguuguuaggaauguccaagugaaauguaggaaagaaaaacagucauuuuaaaauaaguggaccaacuuccauuugcaccauauauauguauaauuuucuuuaaccugacuuaagacugucaugaaaaggcuuaacauuuuuccuuuuggggcuugagauuagccaauacauuuuuuugugugugaugauuuugugcaugccauguuuuugauguuauuaaugauuauaccuaaccaaaagauaucugcugaauacuaaauaggaaaauaucugcaagaccuuggucaaaacuuagaauaugaaggcaagacauaauuaugauaaaggcugacuuaacuauguuaaaacauauguaauaaggugugucagugauauuuacaaaccacaugcauagauauaguagacucuggagccuuaauuuccguuuuucauaucucauaaggaaaggaauuuugagaagcuguuuuucauuuuaagaugaauuauuuugaucauagaggucuuauuaaaguugacagguccugcaacuuaaauacuugacaucuguuucuguagucgaagauaaaaguuuagaguuaaaguuucaaggcauuguucucccuccguguuagaaaauugauggacaugguggagagagaacucugaaggcagaggguaggacugaggcuguguuagagacggagggaagacaggccugagaggaacacugggaaacacagagaacgaguaaggagagcuccaggaaagaugcgugccaucgagugaccaggacaggaaagccguggucuuaaaggcuaaaagggaaagcaggcaggcagccuuugagcuggguggauguuguacucuuuaguucuucagucgacagcagagaguagguggugaggguuaggagcagagaaggaaagaacccauucacuugugucuggggagugcagcaaagagcagugucucaaaaacagaaaaugaaaagguuuuaaagauuucagacagacgucagagacaagauaugugacaaaauaauuaggagaaguguaagaaugaacuuaggaauuagaacauauggagccgggcgugguggugcccgccuuuaaucccagcacucgggaggcagaggcaggcggauuucugaguucgaggccagccuggucuacagagagaauuccaggacagccagggcuacacagagaaacccugucucgaaaaacaaaaaaacaaacaaaaaaaaagaauauauggaaauagcagaauguagcaugguacuauuuccuagguuucaaaccacacucaucugaguauacugcagagcugagaugucuuugugccucugggcuguuacuaguuucugaguguggugugccucccuacauucauagaugacacguguuagacucgggcugagcugcagccucguuuauagagaaaaccaaacaggaaaguacgugugaauaugcaaggugugcacacagcuccugagcaguuguagaggauuuagaauuaaucucacuagguguagaguuaaucucauuauugggguauauaacacaguuaauuguuuuuugcauuuagacacagauguucuguucuuucaugggguucauuuaaauugugaguuauuuuaaaggcaaacaauuuuucucuuauaauaaagggcuccuaauuagaggacuguggaugccuaauuaccuugcaauuaucauuguaagauaugaagguugacauagaaaugauagcagcacaugcaguauuguagucauuaagcaaaauuguagguuuuuuucauauuuucucaagaaaaaauaccaugaaaauuauuguuaccaacauuucuuugaaugacagaaauuucuguagccugaaaauuggccuuuguaaauuuuuuaguacauacuugugcacaaaguaaaagugcuuuguguguuugauucaauccucuguguuuuguucuaaaacugggucuuauguagcccaagaugguuggaacuuccuguguccaagguugaguuuuuaacaccugccccuucaucucccaaguacugggauuacaggcaugugccaccauaccuggacaauuacguuuuuuuucugggcauuuauuugcuacacauguguacuauauuccccaauauuaugacaagaaagaggcaaaauuuaagaaaggacuugauuucuuuuucaucuauucaguagcucuuucuaccuaguucuuagguaacuuuuaacuugagaggcugagguaaagaagaauuugaugugggugugcaugcaugcacgcacgcacacgaacacacccacaucaagugugugacucacaagguaaacauuaggugccuucccuucuuaguuuuuugagacauggccuuuaaucucuucuccuaagcucgcaggucagugagcuccagggacuuacccaucuccuuccugcccucaagcucuggcauuacagacaugcugcugucacaccugacuuucaugucuguggauaccacacucacacugcagguacuaguucaccaucuucaggcccaggagucagguguucugauggcagauaauaggcaaaaaguuauagucguuuuuuuguucuuuucguauuccuaggaauugcugcuauuuuuaaaaauuacauuugacaaauuugagcaaagcccauuauguuuuaauuacauuaaauauguuuguucugauuuaaagauguggaacuuuuucaguucaauaaaguguaguuaaauauggggggaaauuuuauuuuauauauauuuuuuggcucuuuauuuagaaaguugaugaacuuugagcuagcauuacuuugauuuguuccuuuguacacacacacacacacacacacacacacuacagcugucauuauagcuaaucauaaaauuaauuugaaguucuauuguaaauucauauuuuaucauucacagugcugaccuggaguccuguccuguucuuuucuuguccuuucuuucucuuucuucuuuuauuguuauauaaaugccaaauuuuacaaagucagccuaaaguagcauauuccuguguucuguaaauggagacuaguagucucuaacaucugaaacucuaacaaagcauuuuuuauuuuuguuuuuaaacacuugcuuaucaucagcggugagaucugugagucuuuauacauugucccuccuaccucugacaccaguagcaaguccaggaaacagcuugauggacuuuacauuuuuaugaauuuauuuauaguaauacauacaguuauucauuaaaauguugaguggcuagugauuauuauauuuuuagguguuuguuuuuauuuccuuguuuguugcuuguuugcauuuugagaugaggugguguuuguuugcuuguuuuggccaagcucuuuguuuuuagacacuuucuuuguguguaacucaagcaggccuugaacccacuauguggcuuagacuggcuucugaauggcgggugaucaggcagaccucccaaauacugggaggcacugacacuuucuuaggucucuaacacugugcuacugucauccuuuguaaacugcuucccacaucccugcacuuugacuggcuagcuucucagggcuaccggagaaguaaaacaugcaguacuuaguaaaauuaaaccuccacugucacgaguacuuuuaucgcaacagccuaguuuuauuaagaaaauaauuucuuccuauuucuacugcccuuucuuucuuccuuccauguguccuuccuucagccauuccuucccugacucuuagcuuuccccucuuucagcaggggaccuguaagcccaggcauuuauuucucuuuccugugccagugcuaccuuagccuaaugaggagugccgugcagugaccacccaugcucagcucugcuguaauacagaaaauaauucuugaaaaucaguuuauggucgagacuguuggucccuguaguuguaaauaagauguuaauguucuugugagacuugaaagccuuuggguaaaugcucaccugauuuuuuacucucguuuuuauuguuuaaaaggaauaaaaaacaguauauacagauaaugcuccagugcacacaggaacucauccagaauauugaguuuagguaaaaagaagguugagaaauuaaagacaagcuaaacuguaggauagaagauuaaaaacggaaucuugaaaguauucucgaagcugcuaaaugcagucagcaauauauuaauaacagcaccaugcucccuuaucuuauuuguaccauuaaauucacauauauuaauaacagcaccaugcucccuuaucuuauuuguaccauuaaauucacauuaguuuauuauaauuuacuuuucuaacacauauauuucuuuaaggguucguuugaaauuuuauuauauaauaacuauuuuagguagauuuauuacuauaauuacuguauuaucccuugucuguuaaauaaugauuucaagccauucauacuaaauaggaaacaucauaauuuucuaguauucauauagcauugugauuuuacuauuucuguaugggcuguguaaucacuauacaguucugaaagauaauuguacuuuaaauaugauaaaaucuuagaucauggaagugaugcauuaaaguacucuauaauaaaaucuauuaauuuaaacaugcauauaugaaacauuugcuugagcuaaccacauaauuuucaugauugauucauaaaaaccuauugcuaagcaaauaacuuuuaauuauaguuaguauuuauugaguagucguugcuguuuucacuguagauagaaaaguggaucccugugaaguuaagugauuaacagacuacguaagcuggaguugaugacaguuaaguuuuaucccaaagcucacuuaaaauaagauuguuauuuauugacagauaagauauuagcauaguuaauugcuacaaguuauaauggcguguaaaacauguaaaauuaaagguuuacucaucaacaaacauuacaggugucugugacuacguggagaacugagcaaauaagugaauguguaaauaagaacugagugacuguuuuguuuaguuuucuccuaguaguuuugugcaucuuuucauagggagggaguguguguuucagaaccugauaacugaauuauuugguugguuuuguuuguuuguuuguuuuuuuaguuauccuuguuuuuguuguuuuguuaguuuaauucaguuauccuuccuuuugaaguauagauugauuuuccuaaucuagaaauucgaaauggaaauuacaucugaccucaugugacagguuccagucaaaacccagggagugguauaugauuaucucuauacuaugugauaaggugugugugacauaagggaaugucuuguuuacauuuagagcucaccucccaaagagauuucauuuuauuaugcaaauguucuagaaccugaagacaugaaacccaggccacuucaugucccagguacuucagaugaugauauucagucugggaucuaguuauguuauagaaagaacuucaugccacaauuaacacagagcagaauguaccuaacuuaguuggugugauaaaacaccaugaccaaacguaacuuggggaagaaaguguuuauuucaguuuauauauccuuauuacaguuggacaucaaagaagucugggccaggaaccuggagucagaugcugaugcagaggcuguagaggagugcugcuuacuggcuugcuccucauggcuugcucagccugcucucuuauaagcaaggaccaccugccuagggguagccccauccacagugagcugggcccuccugugucaaucaucaaccaagacaauacucccaacagggcauuuucucaauuaaaguucccuguucucagaugacuccagaugcugucaaacuagccagcacuuacauccuuaaauuugacagguuuaacaccacugcuuuagauaaacauuuuauccuccucaccuguuuucuguugguuacuucaucuuccagcaggcacuaauuccucccaccauugcauuacuuuaaucuguguuuuaacuacauguaaguggaacaccacagugugcacuuagccugcuggcuucuaguaagguucugagacuggucuguaguaucuauccuaggggucguauuuuguugaucaguauuucaguguuugacuagacuacaacuuaguagaccugggucguaguuacaguaguacuaguagcuuucuagcagggauauaauuuuuuaugcucucccagcagcguauaagggcccuaaugcccccuucuucucaagcauuugguggugccagacuuuuuuauuuuccccuucuuguaagugauuuuaguuuuguuuccuaagguuuuguuucgucucggugcuuggccaaauggauguggcuccugcccacaccgagaacagaucuuucuagugagucugcucaaccucacgugccagucgguggcuauggauuguauaugggugugaugcauaccuucacauuugaacagucaagcuuugcugcuccucuggguuuuuaauguagucaaauuggcaauuaaaaaugguuaccauggcaacuguuagaauguuuuuguauccuuuuauuauuccgauuuuucuuuuuuaacaaaaguuacuuuuguauucagauacucuaccaaacaaacaucaacauaaauaauauaauuuauggugacaaaaauaugugauacuguggcagaaguguuuucucuauccgugugugugugugugugugugugcugugauuacuauauaguacaguaaaauauauggcacauauuuauuauauuuaguuauuugaaacuacuguuuugcuuuuuaaaauuuaaugaaauugaagauacuucauaccaaaagcuaugggacacaauggaagcagugguaagaggaaaacucauagcugagugccuccaaagagaaaccggagagaacacacacuagcagcuugacagcacaccugagagcucuagaacagaaagaagcaaauacacccaagaggaguagauggcaggaaauagucaaacucagggcugaagucagccaaacagaaacaaaaagaacuacacaaagaaucaacaagaccaggagcugguucuuugagaaaaucaacaagauagauaaacucuuagccagacuaaccagagggcacagagacaguauucaaauuaauaaaaucagaaaugaaauaggagacauaacaacaaaauauaccuuaaaguaauuauucugucuguuggauauuaauaguugacaauauuaaauucauguucuacaaacaucauggaaauauuauugauaauuuucucacugugcuugaaauuagcauuuucuuaauguuuaacuucaaagagcuuuuugcuauuuugaaauuuuuaaaauauacuuacugauaaaauaauuucucuccuagaaacacugauaaucuuuuuaaaguaaacuuacaguuaaacaauguacacagauauauaaugcauuuuaaauacucauucucacuaugucaggugguaucauauaagggcuuuugaacauauauauauauauauauauauauauauguguguguguguguguguguguguguguguauugguuuuuacgagacaggguugaauauauuucuuaaugauucauuuuuaauauuuuaugcucuuuuacuaugcuaaauuaucaaagaauauuuuguauguuuugaaaaauuuaguauucaacauuauauauaggauccuuaguuauggauaguauuaaauguucauuaaugauauuuuuaggguaugaaaggauaugaauauagaaguugagcaaauuuuuauauaucacuuaauucucaaaauacucaauauuauuaauauguuuguauaaaugcacuuaaauaauaaaaauguaagaaacuauccuuucccuuuuuuacuuacaagaaaugauguggaagagcaggguacgguagggaaugcuuauagucccagugcuggaagcugagauuggaggauuguuuauuugaggccaguuuggggcuauauauacucuguuugaaaaacacaagcaagacagaagcaggaggauuaccucgaguucacgggcauccacgacugccuuguaagacuguuucaaaacacaaaacaggaaugggcaugugauuaauguuguucucuucacugccauggacugugcauucuuuuuaagucauuuauuuccucugacuuucucucccaguguguccuaggcaggcuuugaauucucaguucuuuugagacaccucugggauuacagguguagaccaucaagacagcaggcagaaaccaccacuuuaccccaagucauguugagauagaguccggugaaugaaauguuuguguccauccccaauuugucuuuugaaauccuagucccuggugugccgcuguuaggagacugaacucugggaagauacuuaccaugugaggauggccucucaugagcagauagugagagcaucuuuugucuugucccuuucuccaccaugugaggaaauaaugagaaauuaaagggaagaggacuucacuccuucacuugugcuucaccaaacuuacucuggccuuaaagaacuaugagaauaaauuucuguucaaaagauaccuaguuauuguuucuguuuaguagcagccuagacuaaaauacaaaacuguuucuauucauacaugcuuucuucaguuucuuaguauaacagcagucaaguguauacaagagacuuuuaugaucuacaaagucuaagauacuuuggcuuuuaucugagacuucuacagaaaaaauuugccaaaccccaguuuaacagggaaagaagaaauaagcaauuucucauuucauuacccaggggaaccuugacccaauguaaauugagaguucccugauugcaacauuguagcacgugaguauucguaucucagugucugaaaagggcuucuuaacuguuuugaguuguccugggaagugacaugcaguuuaaggagauguguuuucaacaauuacuugcaaagaaacaacugucaccuagugugaggcccuuguugaagggcugugcugacuuccguuuggugccugagacagggccugaggagaaugagcgcucagcucaggagaagauugcacccuuaaccgcagacuugcuuuuuaaauggcaacaguuucagccuagaaaguuugucagggcucucugaggcaauucugaugagccuuaacugggaggaugcagagaggaggaaugucacuugaggaauuuuuuugguuccugagguuuuuaauggacuuuucucuuugacucuugaaaaugcauagguucuaaauuacauuauccuaaaggguuguuuagaaauuuugugaacuucccauacauuacuaaaucauuaauguguuuuccuuccucguucuguauagauagaauacaacaacagaacaguauuacaaaggaccagcuaagaccuucaucaggccuuuauaauuuuuuuuuuagggauuugcucuuucuuauugcuaggcagaucuuuaagucauuaauguagaccuuuguuaacccacuuaaaacuaaagugaauuucauucauacugaauuuguaauuuacgaaagaugaagauagaaauggaggagaugaugugaaguagcaggugccagcuucacagcagagggaauuagcaggguuuggugcugugcuuccugggguaucagcacugucauggccaucacccuugugguggaauuagguagaagagaagcuaaaugcagaccaggacaguuucaucugguaaggaaaacaguaauuacaacuaauaguuguuccuuucuaaaguaucgaaguuucaaugucucuuaaacuauuaccagaguuauuauagaauguuaaagauucugcuuuuguuuuauuuaaaacaagauguugaaaauaauugcuugagaaauguuacauuguuuuugagggcuugauaaacugcugcagaggccuggcuggcucuuggccugcucuuucuuguaaagugagggaacugugauagguuuuucugaguuuuaucacuguguaugcacugggugugcaaugcagcacauggagacgagaagacagggucgugaaguucauguucucccacauuuacugugggucauaauacgugucuacucaccaggccuguaugaguuaccagcugacccaucuugcccgccucuuucagggaugcucagcaguuuaauuaggauaugccuuuguauagauaguugucuucauguucccuuugcuuggagucuugaauuuauugccuugcuguuguuauuacauugauaaugcucacuugauggaugucacauagugcuuuuaaccugccuggaaggaagggacuccuucccuauaauugcuuccauccguugcuccuuguccccucaacacugcugcagugacuguugcuccacugaaugcaccacaagcuccuuggccagaucuucagaguacuuuuccugagcagugcccgacuucucuaguaguccguggucucuuuuguacucugagcuuugugucuucaacucaauuugccuagauuuucccuccccccuuaacacaugaagaucagaagacaggucugugaaguucguuuucuccuggcagugucuuaggcaguuggccagcacaaguauagggcaugcaugcaugcuucucauuuccagcgaucauuguuccuuacugaauauguucaugguugugagaaguauacccgauaaauguuuuaucuaaguuuuugguuauauaaauuugaacaguauauucgguccugguugucaccuaauaacaaaaaugaaaguugugacguuaagacuuaugauuucauagcucaauaaucugaaugauccacagcguuggacgaugggcuucugugagugcaguggcgaugcgaaagggauugaacucugaaggcagccagcugugcacuuggggagaaggcuuacgcuguaaacugagaaccaacacuggggggggggggcgcuacagcacacuuuauguuugcuuaugguaauacucuaaagcuuauguuaaauuguuuuguauuuucuaccagaaccuucugauaacuugagggagauucuccaaaauguggccaaauugcaaggaguaucaaauaugagaaagcugggccaucugaauaacuucacuaaggcaaguagcuugaaacucuacugacgcguucuuuuauuugacuugauaaacauuuccuaauuauuaagaaguuuuuaaaguauuuacuuauuaguaaauuuucauugguuucaucauguuucugaguuucugaggaauguugcuauguugucuagacuggucucagaaccugagugcccaccauuucccugaggaguuggaaccagaguuguacaccaccaugccuagcugucaaaugaaugugauaggaauauguucauacuguagaaaauccagaagcaagccacuguaauccagugucuuauuggcuuauuuaucuuguuaacauaugacuauuaaucucuuaugcaucuuaaaaacaaacauaauucccagagaccuguuguauuucucuuccuuuauccugauuguuuauucccaucaucggcaucuaaauuagagcccaagugagguguauuuuaugguuuuauuuccuuuuauuaaauaucaauuuuaucuuguugaucuuuauguaacucaaauaagccacugccuaacuacuaucauaacugcuuuugcucaccucaguguguggcucuacuugucuugguguaguuugaaaacuaggguuggcuguaagauggcucugacugcuguugccaacaugguggcaccagccuaaguccuagagcguucuagaacagugcugucuaauagcaauccaugugagcucaggaagagaggcuuucacaaaacuauccuaaaauugcuauaugaagcauacggcauuaaguaucauuuaacuuuucauacgaguauuuuacacugauaaauggcucaguucaugcuaaagauguuucuagugucuauaagcagcuguggcuggcacuaccagguauuggaugguaccaagauagacuuuugggcugggguuggucuaagccuucauuccuagagcagcaguguuucuccugucucugucuugguuuuuuguuuuuucugucugugucuaggccuuggagcaaggggauccauuucuugauucuccucccucuuuuuccuuuccuggcuuuaucuaaauuucuuucauagcacuucacuuauuuuuccuguacuuggucugugcuucuuguuuuguauucugggacugucuccuuucucuugcucgcucuccuuccccucuugaaccgugcccccagcccaccucccacucccugcucuucccucugccccauugugcccuccuuucuuuccuaauucuucuuagcuucauguguccucuccuccuccuguauggagacugugguaacuucuguagugaagucuugagacuuuguguauuuuguacuuauaagccauauuguaaaaucaacuuuugccugugcugcugguccuggugcuggcuuuuugcucgcugucuucagguacguguggguugggaagccagauagucagacuugguagagaaugcuuacaguaagagggguuaauuccucaguuaugggcuagagagcugccccauaaauaaauccauuaacuguagacuugauaaaauuuacuuuggcuaugauauaggagaagccugaaguuucaguuaaauguaaccucaacuaauagaggccaaucuuggggaaauuucacaguacuguuaauaccauuggaugcagcgcggugcuggcuuguaagauagcucuauagcacacugcaugacaauuugaagcuuauuuuauuuugauuuaugcuuuuuaccuguuuacuagguuuucacuaacucuuaagaagguaagccugcuuaauuguugagcgauagaugguagaucagguuucuucaggguauagcacucuugacuuaacagaacagguuaugguuuugaaagaaggcugagccuuguuucugacucugcccaccauaugacaggaacauuuacuuaacacaccucaauugugaugagcagaaauuuccuuaagaauagucagauguuccuuaggagauaagaugucucuauuuaauaucugcugcagcuccaaauaaauguguguagauuuuguaauaaaauuuaccacauacaagcacauacugaacuggauuauaauaauaguaagccucugaaauccauauuguuagagccuggguauaagaaauacuuauugagguggcauacccauaaaaucugcauguacaugugccuacuuaguguaauguagacauucuuaaaaacccaauagguugauuggccuagaagaugaaaagguaauaauuauaaugcuagaagaaugagagcuaguugggaauucucuucuguuugcccuagaacacacacucuuucugaaguuuagcuagagaacacuagccgucuaaaccaagcuucucagaccaugaaauauuuuguggcuuuccacucuucugcuucucuuuaucccagaucuagcuuguuccagacuucugauuguaaugugagauugauaagaguuuucauuuuaaguaugggauuucauuguaacuagcauuugcuuuacuguaaaguguaaguguagcguugguguuaauugugguaauguauagggugaacuuuccuaaaaccuccuccugagccaugaagcaagcagaugagugcuaugaucuuuuaaucaguugccaaccugccacacagcaugcuuguccucugccaucauugcacuagacagagcagaguguacggcagacugaugaugaauauaauucugcuguucgauuuugacaacagacagcauguuugcagucuaacgaccugcuuucuaaagacggagacuuaggcccuuuucauuuuaaacauuuuaaagcuuugaaagcaucuuuauuugcuuuuuuuuuuuuuuuaauuuaaagggugucuaugugagguaguuacaugaaaauggcauagaugucacaguaaaaagugaacuucucucauuugcuacccuucccccuccaaaguacucacucuaccauaaugcagagcuuaugggcuagaagguacuuaguuuuguaguaacaaacauuggguaaauauguuuaugugagugucuuuuguuuguuuuguuuacauuauaagaauuaaaugaacuaaauaaaguguuuuauaaagugcucaguuuuauuuguaauuuauuauguauauacaaaguguuuuuagaugaguuuaagauaucaguguguauaaauacagguuugugugugucuauauccaucuauguauauguugauuugcaguuugcauuuuuucacauugcaguauagaacgcuuugcuuuucuaaauauaccauuccauguuuuuuaaaugcccaccucuguguucuguauguauguauaaauuaccuucuaagagugaggccuugugguauagucuguugucccagcuacuuucaaggcugagccaaaggaucucaaguucaaggacuugagcuagcgagagacuuggugguaaaagaguggcugccaagccugauggcccgaguuuaauaccaggaccccgugauggaagagacgacuucugcaagccguccucugacuuacacucuugcugguggugcacgugcgcgcgcacgcgcgcgcgcacacacacacacacacacacacacauaaauaagacauauacacguaguugaaauucaggggccugucugagcucuuuagucagaccuugucucacagaguuaaagaguaggaagcagugacaaagaauaacuguugccuagcaugaauaggcucuggguccagcccugcgaaacaguaaauaaguaaggccuguuagauaccccuauugcucugauaaaacaguguggccacagcaacuuacagaagaaagagcuuuggggcuuagaguuacagagggaugugacucuauccucuguaaagguagaguguaucucucuggcagggcaccagagcagcauggcagcaaacagcagacauguugacuggagcagcagcugagagcccacaggcauuugaaaccucaaaguccacccacagugacauaccuccucuaccaaggcuccuaauccuccccaaccaaccaccaauugggggccagguauucagaugccugagauuuaugggggacaucucauucaaaccaccacagauggcucaaugguuaagaacacuggcucguccggaggacucaaguuugacucccagcaccccauguaagcagacaaccuccuguaacuccauuucugguggaucauauacccucuucuggcugcuacaggcacuaggcauggacguggggcauacaucuauauguaggcaaaccccucucauacaguaagcaaacaaauaauuguccuuuaagaccaugcuguagaauucuccuaugugcgaaaauuuuuuaaaauuuggguuauucuguguucuuauaaauaggacaaauauuuauuuaacccuaguucuaauuuauuauuauauauuuuaaaauuggcuuuguuaauaagaaaauucagggcuggagaaaugccuuuguuaagaacaugugcugcucuuccagaggaccaggguuuaguucccaacacugaugcccauaacccccuguaacuccagcuccaagguagcuggagccucuggccucugaaggcacccuauguauucacaagcagacccguauaccuacacaugauuagaaguaauaaaaaugaaaauuuaaauaaauauuuuuuaaaggaaaaauauucuuuagagaugauuugcaaauucguucugacauuuuuagaaguagccuuuugugagugugauuaugugagugugauuuugugagugugauuaugugaggaagucacauuauccgacacggaugaguguggaguuuuauaagcaggugaaccagugacguagcaaccuuagccuauuugaagauuucugucuucaacauuuacuuugcuuauacaauugacauguuuaugacaggacuauagcuuucuaaugguauugauugguauuaacuuuauuuucaguaggcagcaaauuuaacaaaccuaagguaacuugacuaaaaugaaaagaaguuaguuucuuacauaguuaugaugaugaaauguuggguucuaauuucaggcaaacaauucacguugacagugcaucacugggucucucuuuuucucucuuuuuguuuuagauuuacuuauuuuaugugcaugaguguuugcacaaauauaugucaguacguccuguggguacuuuguccugcagauagccagaagugggcaucggaccccuggagcuggaguacagacaguuaggagcugccaugaugcugggaacugagcccagcuccucugcuacaccagccaguguucuaacugcgcagucaucccucuagcccuaaguuacugccccauccagccuucagggaugaccgaccauuugcuauugcagaaacaguuaugcuuuuccuggggaagaccgauuuuccacuuucguugcauuccuuaguugcacaguucuuugucuggggaugaggccuccugagcuucugucuuccuccaaggcauagugggugucuuccuuguucaggucaugucuagccagccauuuuugucagacuuccucgggguacuuucucuuguguuccuaggaggaaaaaucuuacagcaaacuaccuaccuguucuuuuagcucuuauaaucuuuccaccucugagccuugggugcaggaguuguguuguagaugcguccgcugggaacaggcauuuugauccauagugguuuucuguagugaucugcaucuguugcagagagaaguccuagaugaaagaagaacaguuauuuaguauuauaaacuaauaguguaaguguaaugcuuauaaaucuauaaaucuacaaagguagauuuuguuucugaugcuuuuuccaaauuuggugaaguauuucuagcuuauacuuccaacaguaaaucguauaugguacuucaauuuuaaguggaauuuuuagaucuauuuuuuagguuuuaggaaacacgguuuuauguuauauuuauuugucaauuuuauuuauuuccucaguaaauuucuuguauaaucuuugccuugaaaaauuuuguuuuuuacuauacaguuuuucuccauuuuauauuauaagcaucuguacuaacuuggcuggcugaauuagaguucucaauuuuguucuccccaaauguuugaaguucuagcccuuaggaacuuaaaaauagaaguguauuuggggauuaaggcuacuagaaaagcuaugggcggaucuaaugcaguaugacuacuguccuuaaaagagaugaggacacagauaugugcagaggagagaucauuugaagauacaaguauagccaucuacaagcuaaagggaaagcccuuuccaagacagauuucugcccacaucuggacuuuaggucugcaaaucaugaaaaaguacaucucuguuguguauguucugauacucuggcaaacuaaaaaggagucuuaguuuuucuaucauauaugcuauaguucaucgucuguuuuuuuuuuuuuguuuuuuuuuuuccuucuugaaaauagagucucauguagcccaagcuggccucuggcacuuacucuagccccuaucugccucccaaugacuggaauugcagaugugcuaccagcacgcacauauuugugacugauauguuacuuucaauuuuagguauaucauacacauacacacacaacacacacacuuacuucacuuuuuaacauacagaguguuugauaugaucuuaaaaccacguuaaagcuuacugcuguacguauauuuguauuuaugugcacauguguuaccaagaggauaguaaacuugugaguuugcucuuuagggucucuucuuuucacagugacaaauaccaaagucagcuaggguuuuucuuuggcucuacccagagaacuccauucccccccccccccaaaaaaaaaaaacaacccccaaacaaacccagaguuaaaaacaaguagagaguguuguuugaagacagcaaacuacuugaccauccagaaguacggaggccagagguguagagaaaggcuccugugaagugggcguccgucucucauucuccgggaauacucagcugacuugaagcacagaacgugcauggcuaugaguugucugaggagagagggcuggaguugaaggauaagaaaggcggggccagagauccccuucauggaucuguugaauccuggggcuagcucggaugggauccuuaacgccuaagcuaggcagagaauuugacauagaacuuaguaguauuuuuauaagacaaauacaauguauuauccuggagacuagggcuguuacuaacaagcuuucaguugaagccuuaguggugaggcggguccagaggguggcaguucuuucugucagugccagagagaaggcugagcucacgucggaaaaaugccagucugcuaagagcacaggagccagcaaagcacagggcugauggcauggucagagcaaaggaauacaacuacuaaaaagagccucaaagacgcuagcgucuauaucaguuugcaccaugaguaaccauguaaguagcaaagaaauagaacuguggagaaaaugggugaaaaaggaaggguuuucacuagaaucuuagaaaguuuuaauuuaagaaaaauacguuaucuaaaauuuaaaaaucccuagauguguuagugcagugguucucacaguuccucauguuccucauguuguugugugaccucagccuuaaaauuauuguuucuacuugauaauuguaauuuugcuguggcgaauccuaauguaaaugucugaucugcagguuaccugaucuauggccucugugaaccacugguauaggagagaagguucagacaguaggagaggacgucaguagaaaauaaggaacaguugaaaucagagaaaauagagaagaaaagaugauuuaaugaaaaugcauauaccuuuugccagcagaagagaagagauuuggacaaagugauuuugaagagauaauauauggaauguuuuaaaaaauugauaaaauguucaaaaccagagauucccaagguauuauuuauuuuacacaaaguggaugcaaaggaaaucacagcugaacaaaucaaaguagccaaugaugaggaagaaaauggcugaaagaaugugaggaaagacauguuuugaaagagcagacagcaagauuuaugcuagacucugagcaaccaagugcccugaaacuuuaggaagaaauuagcaguuaaacuaaaauucaguguguucaccaaaauugcuuuaaaaacgaaaauaaaaucacuuccaaacaaaaaacaacuguaaaccuaggcaaaaguaagaucacaacaugagcaaacaaugucaccagugugaccagugggggaacugugacauuagggaagaacgauaaggggaaaacggugugaauaucagcuauuauuaacuguguguggguugaaaaaauaaacaguuaacagcagugcuaucuuaagcauccugaauaacacugggaggacggagggagagugaagauaagaguaagcagggucagggauagacgggcugucuguagaccaucugcagugcuuguaaaagcagggaccgugggagugguggcuagacagcaacacuaagacgcaagacggugggacagaaacucagcagaagacaaaagacaggcaguucaaaaagucgagggaagaggucagucuaaaguugugguuaaguaaaacuuuagaugauagaaauaaugcaguguauuuuuauuacacgauuacagauuuuuuuuuuuuuagaaauucauuaaagaaaaagguuccauuuuucagcccaaaauugugcauagacaagcauauaaaucuaaacucauauguaagguauuucuguguuucuucuaacagcuucuuugcgauauuggccauagugaagaaaaacugggcuuuaauuaugaagacaucauaauuugguaaguguaguucaguuuuuucucccaucccuuauuuuaguaauuucuauuauaacaauuuaaguccgagcuagggugccugcagcacaugccugguucuguagacacaguguuuggcugaaaggagcagucaguaacuuggcugugugagcauuagcucagauuuuguacugcuggguacaaagaacuaaaccuaaauauccagaauuacacgaacuucuccaaaaauuguaauuaaauauuaaauuugcagacugaaugucucauucuuuccaggaaacguuagaacaacaacaacaacaacaaaaaaaaaacccuagauuuucccuaagaaagaauguaucuauuacaaacuuguuguaggcuaauagguaauugaucaagcaguuucagugccacuuuuggauguucuugggaguaaacauuaauauaguaguauguguuuacuaacuacuguuaacuaucuuguuauugaauuaaacuaauuauccuuugagacauguggaagcauacaugcaaauaaaggauacauuguagaaacaucuaaagauacaguuugaaaagacuauaggauuucuucuuccauuuacacaaucugccagaagaugaguaaaacucccaauuggcuggauuagugugacuauucagaggaagcacagaauaaagacaucaccaaauacaauucuuuacuuuguaguauuuuuuguuugguugacuuuucuuaaauagaauuaauuguauauaacaaaaaguuugggauaccuuagccaugaaagaacuugauaugggaguaaauccuaaaguaugaaaaaucugaaaugcuccaaaauccgagacuuuguuagagccaucucaagcauucacaagguuggggggucuagauuuucaaguaagagauacucaguuugaaauagucuugaaaguaguuucagucuaaaaauacaagaaaucagaacuacuucucgucccaagcauuucacaugggggcaaaguaaccucugcugaacuguggugucuuugaagccuguguaacagaacguuuuuguuuuccuacaguuugcgcuuagcuuuauuaaaugaggcaaaagaaguaagagcagccggguugcgagcgcugcgcuaucucauccaagauuccaguauucuccagaaggugcuaaaacugaaaguggacuauuuaauagcuagguaauguucugagacgugccugucuuucuuaugccuuuaaaguuuuguguuuagcauccagccaaaccuguacagauuuuugguguaaagcuuaauuuugcaaaggugcaugaucaaguaagaccaagacuaaugguguuuuuagcaaaggagggacucccuuuauacuuucaagcaauuguaaauaguuuucuccuuagagauuuguuuuccugucuuugcauuucacauuacauguuaauuaauguguauaaucgacauauguaaguauacauuuauuguuuucucaucaucuguaagguucuuccacauugaucauaucuguuuuuaaauuuuauuuuugcuaugaaguauuuggucuuaugcuuaggacaugcuugaaucuguucauucaggauaguuuucaguguugagcuauuuugaaugaaucugcccugcaaucuuguguaagucugugaggugcucacuucuuagaagcaggcauagagaaggagauguuggaaccugaugcaugugugcuuagcuaugugauuguggucggcaucccucucucuuuguaaaauguauuuuuauucuuuaaucccuuuuuacagucuggacuucaucccccauccacucccuaucccauaccuuccucaccccaguguccaaaaggauguccccacccccaucccacccccaccccaccaggccuccucucucccuggggccucaaggguuagaugcaucuucucucacugaggccugaccaggcaguccucugcugacuauguguuggggccgcagguuuuuucuuaagacacggcacugaucauuuagaugccgugacuguuuggugagcuuuagucacacuuacuggguuugggacuucuguuguuuguugcgguaaaucuccucccaaauaggcccggcaaugaaaacacaacacaguuacuaugauuacaugcugugugccuagauugggcagaucuaccgcuacacuaccaucuuccacagcuugugagacccccuuagaacuugcaguuucuucaggccaugugcuucuccuccggcucuucuucuuccuccucugcguccucucucucauuuucuccuuccucucucucccaccuuccacuccaccuucccuuuuaucugccuaaucaucagcucuccuuuauuuuacaaauuaaggugggaagcagguuuacaggaaauuaccugagugcugacucauuccuuguucacaaccccucacaagagaauggaauuaacaucaaauacaguuagccccagggcuauccacaacaguuguuuguuguggguuaauuuauuuauuccuguuguuguauuacuuuguuuugacaggguuucugcuacaaauuccaggcuggcuucaggcuuacugauucuccugucucacccucuuuagacauuguaguggaggcagugccauuauuuuuucuucugauuuuuagcuacuaauauauagauaauaggacguacugucuucuuuuacagcagccuugguaaaucccuauaguuuccccagucuauggaguccgugggccucccaugcuugugaacuccugaggacucaccuccaggacccuuagccuuagucuugcuucaguccucugcuucucgagaacugcacugcauccggacgucccucguucgcguggaaggugccaaguacuccacuggcuugacuuugcguagcuguuaguaaacuauggcccucacuuguauuuuugaagucaauucauucauucaugauggcuucucauuucuaaauagacugaacacauugguauuuaguuuuuaguucugcuaauacauacuucugcuuuggguacuauguaaagauacuauguaaaacuugugacuuguguuaguauuuccccuaggugguuacaacuagaccaugaaccuuacagggguggguuuuguuuguuuuaauuguggcuuacuuugcuugguugauacagcacuguugaguuuucuguguuggugugugucuguuugggacucacuaaggcuugacuuuggugucuuggagaggucugucugggugcugcuuccuucuguccuugucugguccuguagcauccgucagacacucuccugcugcacagcucccgucacauaaauaaauucaagcuucucaccuuacgacaugggcguuuuuugucucauuuguucuuugcauuuucuuuucuugugguuuuguuacagcuuguguuuucaagacaaggucucaaguagcucaggcuggaccugauuccuggacuccugcuguguuggaguccuccauuccugcuauggcagaggaguggacugugccuucugcacuguugugcuggguggguugugccgaccuaacccucaccugcuucuuaacuccacaaguguuacugagcccauucaguguuuacaggcgacauuugccugcccguguuugcaccucaugcuuccuuggagugcuauuuauuuggcagaucuuguacuguuuauuguagcacaggccuauaaaaggugaauuuuucaucuuuuacuuguucaugaacaucucuauuuuaaucugcugucuuaagguuaauuugauacuaguaauuuuucuuuuuuuaaaagagauauuuauuaacuauguauaugaguauuuugucugcauguauauauaugcaccguguaccugccuggugccugaauuggucagaaaaaaucagaucuucuggaacuagaguuacuaauggcugugaaccacugugugggugcuaggaauugaaccugggcccucuacaagauagcaacagcucuuaaccaugaggccaucuccagccccaucggcuagcuauugucagugaguguaugucuguccgugucuucuaccuguuccuuacucucagucagugcccucuacaggguuuuauaugcugcaucuuacccucccauggcgcucaggucacugugcugggucaucuuacagcacccauguaucugaacccacccuuacuggguuuuuaaccuuccuuuguuuguuuguucuguugucgucauaguucaaggcuuauuacuccuuaccuaacuuuauuccagacugcccugccaguaaguccuccucuuuaauguuugcuucaguuauugccuuaugaauuaucuuuuuaaaaauuuguuucugcuuuuauuuuuccaucucuauuuucacagacauaccaaaucaguuauuuuugaaguucugauauguaaaucaucuguauuuuuuucuguugucauuuuuuuuuuuuuuaauuuggaguucuugagacuuuuggguauuuguuuuaaaacauggcuuauaacaacuaaacuaggcaaacauucauguuuaagauuucuggcacuggauaauguuaucauuuuccuuugaggagaguuuuauuuaagagucuugccuuacugcacuaguuuagauguuuguuuguuuguuuuuuagauuuauuuauuuauauuaauauauacuauauaguauauaguauauaguacacuguugcugucuucagacacaccagaagagggcaucagaucucauuauagaugguugugagccaccaugugguugcugggaauugaacucaugacagagcagccagugcucuuaaccauugagccaucucuccagcucacuaguuuagguuuugcuaauguucaaaguagcagcgauucggagucuaaagcuagaacugcgaucauuuaacagagccuccuccuuggccagccccagcuggagaaucuuucuuaguuaauuauuuccugcaucucugcucuguucuugugcuucucagaguaggcuuuuacugggcccauuagagccuaauccugccuuugcacagcauagagccuguccagugcuuuggugagagcauugauacagaugucuaagcucauaauccuguccuucccuccuuuggccacuuaccugccuucaaguacaucucugucagcccugcagggcuccugcugccccacagcuagggcugaccauguucccaguggagauggcgugauggacaaugaggcuccucagcuuugucuuuucaggguugaguagaaguugucugcaggaagcuugucagccuuuagaguugguuuuggcggaggauuagguaugauccaagcuuucugguuguaaaauguaaaucuucauccacaugauuuugugugugugugugugagagagagagagagagagacagagacagagagacagagacagacucuguagagaguuaguugcuggacuugaaccucgagcgaacacucuagcucuucccuguuuauuuuuaaauuccauuuagauaaaccagaaaugcuuugaauaguaacuuaccuaauuauaaaauauugguuaaaauaggaacugccuaacauaguuaaguaauuuuguuaugacauaaaacaaaauuuauuauauuuuaucuuauuuuauuaaauguuaucuaagugauacuugaucaaauauuauugaagagaauucugaauuuaaguuauuuaguaaaauaguguuguuguuguuguuguuguuugagacagaaccucacuacuguguagcccuggcuguucuggaacacccuguaggccaggcuggucucaaacucagagcuccaccugucucuguuuccaagggcugggauuaaagguguguaccaugccugguuaaaauaggauauuacauugaauaagacagucaugauggauacaauuuaaucugugauuaaaaucacaagcuaagacaauggaaaugguuccuuuagaguauacauacacugcugugacucaccaggucagggaacucuucccacgaaucugaugcuuagcuucauuuguauguugugauucuuucuugauagguguagcaccuuuuucccccuugagauuuuaucucauauuucuggcaauauguaucacuagaguacauuaaacauuugcuguuacuguaaaagcauguauuacaguuuuaauacacuguacuggacuaugaagguaaauguggucuaauauccuguaagguguuguugcacaggauuucccaaugacugaugcauuauuuguuauuuaggugcauugacauucagcagagcaacgagguggagaggacacaagcccuucgcuuagucagaaagguacgcuccaugugugagggcagaagggcgaugaguacguugagugucaugcugcuaaagaaugacuuuucauuaaacacuuuaauuuuguuaagaaauuuuaugaaguacauagagcuguuacacaugugaagcgugacuauuuguguaauuaguauaugugauugggauagcuagaauauucucaggaaaugaucgugcugagggggauuucugucugcaguggacauguaaauguaguuacagcguaauuauuagacaauggauucuuugcccacaacuaucuucaucugucucuaauguguggccguuccuuagcuaacaguaugaaauggaugucacaaacaggagcucaucacuuucaagaugaguuuggccacaacccaugggcacuugugacaaacaauugggcugacauccuuacaguauaaaaugcuacaguuuaagcccaguaaaggauuugauuaaaggcaguucacaaugcuucugagaucccuccccugucuguuguaguugugauugccucaugaccaacuaggaaaggaaacagaaaguaaaguugguugggauacauccugaaacaaguaucauaucuuucccuuugaugcaguguauguuuguggaugugaaaaugucuaauauuauuauuacugauguuuuaaagcugggucugaguauguggcuuagcugggugagauagacuacaaagcccaggauggccucaaacgcuugacccucuugccucagccucccuaaugcuagaauugcaggcaugcaucacuaaccucagcuuucaacuauugauugauugaauuuauuugcugucucuuuuuucuuucuacugucuuugauugaauccacugcauguuucagacagugggcugcagaguuaguauacugacuuguuugcuuccuuuccaguuagccuuaaugguuuaguaaugguccacaaguucacuguaguaaagaauaaggaaaggaugaguuucuuuaaagaagguggaaguucuauucaagugauacugggaagaggcuuggagacuuuuguuuuaagaaaaugguuagcuuagaacuaugauuuggcuucucauauuuauaauuuaaaauaaccuauauuuuuguuuguucauaaauucuuccuaaugcuaugaguacucaugacaagaaacaaaaauuucuuccuguagaacaguuuggagcuuggagcuauauuuucagcauagauugcauuaaaaauaaauuauaugcuaaaaauaauaagccuaacaucuuuuuucuaaaguauauuuuccaagagagaaaauuagugaggagagugcucuuguuuuacauuuuuuguaacucucuuaaggguaagucuugauaaagauagcuagaguguuauguuugcuucucugucacucuguuuuacugucacauacagaggaaccucaagagagagcuugauuguauacugaauaaauaaaacaagcagaaaguauagguaucauaaaaacaauguauccuuuuguuacuaaugaaauaguuacagucuuguagaaccucuaaaaauauuuuagggacccuucauaauuguugaccuauauguugcuuucagaagaaaagauaguaucuaauagauucaaacaguugaccccaaguuuuggauuauuuaguaaauauucugucucccccaucugucugucucucuguuuggggagcauggguguguggggggggguaguggggguuguugagaaaggggcucacucucuaaccuaggcugggcuuaagcugcuggagauccucuagcuaccuucuacaugcuaggauuauaguugugagucaucaugccuaucuuguauacauuaaauuuuaauuuauaacauaguuucauuaaacuguacucuuaaaaauaauuuaauagcaacauaacacagagacaguuuaauuccauuguuucccgggguacaaaucauugguauguuauuacuuuaaaaagcaauagccauauaguauacauauauaaaauuuguuaucuauuuauuacuugguaguaacuauaagccaagauaaaacuuauaggcuaagagaaaacuauagacuaagauaaaacuauaggcuaagagaaaauaaauauauauaauguauuauacauguuuucuugauaguaacuauauaggcuaagaagaagagcuauaguguuuggauucucuuucauuuagcuaaaaguguuaaaacauuugaugaguaaacgcuguccuuuagcauuagagguacauguguccuuuuucagcauuaccuggacacugagaucaauaacgugcagguggaucuggaggccagagggcugugucugggguuugcuucgguuucacuucagcuuguguuuuaggaucuguccuugaaccuggagcuuaucuauccagcuagacuggcuugccaaggaacucuagaaagcugccauucucugaacccagaauuggauuuagagaugcucuauaugauaggugaggugauauaccagggcaccugaauaacaugguuguuggggauccaaacucaggaccucauaguugcagaguaggcuuuuuacugacugcacuaucucuucaguuuccuccaaaguuaaguguaaaaauauucuuuuuccucaugcacguguguguguguguguguguguguguguguguguguguguguguggugugcccugacacacaagucgaugucagaggacagcuugcaagagugaguuuucugcguugagugaguaugcgggucccaggguaugagcuuagguauucaggcuuagcuacagccgccuuuacccacugagccaucucaccacuucauuaauuccuuuuauucaaacauuuguuuuauuaauacuuugaugauucuuacgauaauaacucaggcuuuuuauauguauucaacauguuaaaaaccuagcuucuuuagucuaggagcaauuaaggaauacuuaagucacguucccuucuguuuuaccugucucguuuauuugaagggauucuuuuuggcacuuguuuuucagugucuuucaucucuucuuucuuuucucguuccuuccaguauucuuuucugguuuugucuuacacgaucucuacgguuugccacugggcaagugcuccuacgcguucuucuucuccuuucaauuccaccagggcuggucaauaaaguccaugcauuaggagcaaacuucaggacgaggcuggggauccuccucguggggagaggguaugggacacagacaggcagaccccugcagcucuugacuagccauuuuagcugugucacuaagcuccagguucagagaacgacccugucucaaacauaaaauggagaguaauugaggaaaacauccaacauuggucucggguuuccacacacugggacaugugcacacguaccucccccuucacacacacuauagaauacgucuuacuucuuaucaugcuaacuucauauaauauucauauggaauuuuuauucauaaaauaaauaaaagggcuguuuucuuuuccuuguacauauaagaauuccauuuuguagaaucacaugccuuugauauuccauaccacuaaauagugggaaaucuagagugagaacccaguguccagauuccuagagucacauuggcuaauggguauuaaauacaaccugccuaccuugguucugccaagcauuucuauccaagcugucaucugaugacauuguccauguaggcagaggaccaccgugaccucaguuaccgcuuacuucccauuuauuucccccucuuucuguccuucaguccccuuccagucacagcacagauuguagcugccugccucugagcacuguugucuaacugcuuugugccacuugugcagauuuauugccuaguuuauuauaugucuguuccugccagaaaagaagauuguaacaguggccacagagcaugaagcaugccauggcuuuuccuugauugaguguucauaggucaaagaggagagcauccuuugaucucagugacuuuuuaaaaaaaacaaacaaacaaaaaaaacaacuuucucugcaaugcacccaucucccuggaaaauagcaauuaugauuucauuuauaaaaguuuaauuuucugcauuuggaccauaguauaauucauugaauaaaaaaguauauguuuaguagacauaagauuguauaguagaauuucuacugcacuugaaauuguuggaaaucuugggaaaugaguuucgguucucugggagaguagcugcacucuaacugaucugucuuccagcccuugguggaaguuuucugugaucacaagaaccaugacucccaugcuaaugcacuuaguaaaaguuagcguggagaccaggagaggcuaggcugcuccuccccaggaagaccgcuuucuucuacccugcugcuucagccuccuuucuuugcuuaguggaaacaguugcaagacccaaccagcagcugaaagagucagauacagauauuugcacccaaccaauggacagaagcagcugaccccuguuguugaauuagggaaggcugaaagaaacugaggagggcgauccuguaggaggaccagcagucucaauuaauuuggaccccagagaucucucaaauacuggaucaccaaacagacagcauacaccagcugauacgaggccccccaacacauguacaguagagggcagucuggucuguguucauuuagagaugauggaccuaacccucaagagacugcaggccccagggaauuuagaggucaggguagauggggggggggggggguugaggguggagaauggaauauggaguguaaaaaauaaauuaauuuaaaaaaaacuaaaaagccuuucuuagggucuuugggaaugagauucauuuuaugauuaugaaguaguauucuuuaauuucacuugaacuguguauucuuucuuacuguugaagugacagaagccaccuguguuguagccaggcugacuagcacagaguguuccugugguccucauagaccuuagucaucuauauccugugucagaauacaaaguuuaaucuucagcagguucauaacuccagugauauccaggagagguuacuuuuccuccuaucaaaacaagaccaccuucucuuuuccugcucucggguguuauuuugaaaugguugucuaccagauagucuuaaacaguagucugccaccugcuuuauuuucuuucugcuuucugaaucauauguagaccuucuugaccuguuuucagaacugcaguuguauuauugucaauuugaccuuugacacgagguucacccggagucucaucacuugguuucuguauggucuacugcacuguuuuucacaucaggagauucuggguuagucagucuuccugauagcugaggacaaguggagguaacaugagggacauggagauggaccagcccuggugugugguccccgugcuugugucccugagcagcauuagggacacugaggagcucuguaagaugccauucccguucuggagggacuuaaaaucuuagagauagcaaagucuugucuaguuuuaaucauuagaaaaaaccugcuaguuauaauaauagcccuuuauacaaagcugaguguuaaaaucgaugccugagccaaacaagaauguugugcccuuaacucacucccuccaaguaaaaugaauuuuaaaauauacuaaacccgaauuauuuucugauccuucucuguuacagaugauuacugugaaugcuuccuuguuuccuaguucuguggccaacucauuaauugcgguuggaaaugaugggcuucaggaacgagacagaaugguccgggcuugcaucgccaucaucugugaacuaggucagaauugucuuccagucaugaagaaagguuauaaagcacacggaacguuccccaaugucuuuuaaaggaaaaugcucugucuauugcuacaaaaaaauaugaaaauguacauuugugauagaauauuagauauuauuuaucaaauaauuuagaaauuauguugucauuuuucagauuuauucauuaugaaacaugaugguguguaauccaauaauaacaauaauaucuacuaaaaucuagccuuccuugauugaugauacgguaucuugauauguuuaaaaguaauagucuagacugcgcagaguaaauccuaaaacccuguuuuauuagagaugaaaaguuagagugaaaacagaguaaagacugagugcaugcugugguggcacugagaggagacaagugaucaagucgugcucucaugacgagaguuuacuaucuggcacaaacaagugagugcugcagagcagacaagcagaacaauaagaggaaaguaauagagugaaagcaagcccuuccccagaugcccacauggcucaccacuacaguguaaacguuuagccuccuuuauuaucaaugcaauguaauuuuaaguagaaagaaaacgaugggguuuguuugugugguuguuugucuguguggguguuugguuguuuuugguauuaucaaaaaguggacauuguagagaucauauucaucuugggauaauaaauuaauaaaguuuaaguuaaaagagaagagccacucuacuacuaaagacuguccugcuguagggagcagaaaugugacuacgaaaauuacaaaaguuuuacaauaugccaauguaugagaugccuagaaaacuauauugauugauacguaucauaaacugaagcaaaauguaaaugggugacaaaccagaauaggaaagacaggaaaugccagauccuauggucagcaggguggagugagggugacauuaguuuauuguuaggaugaaagaccgauugcucgcccuucacuuacguagguagcagaagaaaacauugaaauacauaaacuccaaguugaguaauaccuuaauaagguauuaaaaucuaauaggaguucuuuuaacuagaagauuuuuuuaaaaaauacauauuuuggaauuuauuuauuuugaaauaaaugcugauaaccaguugcaggaaaguagaaauacaugcuaggucagaaggcacagaagugauugcagcugcugagggugguccuacacaccccuguccagaaacauagaucaguagaaacauguccacagcucuacauguauguauguaaaguaauggaaaaguuauaaagugccacggagacguggagggacuaaucuuaaacaguguaaccaggcacaacacaagaaaccaugaacacuugugcgaaaaaguaacagcagagaauuucuguggggucaccagugguaaccuuuuuguaugggugugcauggugugugcacacgcaugugaagaccagguguuggcacucugugucugccugggucacuuuguaccuuaggcuuuggaacagcagucuuaguaaacacuguuuacauuggugaggucaugaaguucaaggacuagaaagcagcuagaugucacugucaagaucuacagagaaaacaggacaagugugauggcucacaugaugacuacugugggauggugagaauucaaaucugauacauaucagcauuaauaaucagaauagaauacauaagugugaagauacaagugacccagcaugcagaaugggcucaguggccacagcggagggggagauggggaccaagagaugccuggccuguguuguugggauuugugugcugugcagcucugcugcauuucagaacacgagggaaaacccgauucugaagucauccaggagaauaaacaugauggaagaaacauuuuuggaaagaaaaauaaaaaacuaucuaucacucauuuuuuuaagagaaaaacuuuuuaacaaguugcauauucuauuuuaaaaacacauuggcaaaucauuaggaauaaaaagggaagaugggcuuaguaacaaacaccuagcugucaucucagccuugggagacagagccaggaagagagcaauugucaaaggcagcuugcaaauacagcaagcuugucucaacagacguaaaguauaaaaaucaauuugagaaaugugcugggguaauuaauaaaauaugagaaaaaauugagauuacuaucucaauaaugucauuuaucucaauaaaaacuucaugauggagugaaauaaauagaacuuaagucauuaaaacacacacaugccaggcguggugauagacagcugugauccuaguacucgggacagacagaguggugaaugagaagccugcuugagcucggugcugacuuccaggcccuauuuucauaacagaaaucccacagcaaaaagcauagacuauguucaggggcaguccuggucuucaaaggaagauaaaaagagguuuucaucuuaaaauugaauauucuuuguguguguguguguuuugcauguguguauuuuuaugcaaauaaaugauacacacuuuaaaucaaaauuaaaaacaagaaguucuauaaaguauuugaaaaaaagccuaugggacuaaugucuucauaguaaaaugaacucugaaacugaagaaaaauauucaguaaacuauuguucaaagacauuuuaaaagucaggcuuggggaaagauauuaaaugauuuuaaauuaaauaaagauauuaaaucaguaggaaccugauaucuuuuguaaauguagguaauuagaaaguuuuagguuuuccuaaaaggaaacuaagacguaaguaaaagaguaggguuuaaguacauagugcugugaauauaauuagucuuucuuucauuuuagcacuucagaacccagaggugguagcccuucgaggaggacuaaacaccauacugaaaaaugugauugauugccaauuaagucgaauaaaugaggcucucauuacuacaauuuugcaccuucuuaaucauccaaagacccggcaguaugugcgagcugauguagaauuagagguaggcaccuuuuaguaugcuucuaauauaaacaauaacuuaaaaauauuuauguuuacuuaauguguaugggugguuagccuuaauguaugucugcaccguguguguccagugcccaccgaggcuagaagagggcguuggcaccccaagaacuggcacgacagaugguuguaaguucucaugugggugcugggaaucgaacuuugauccucuggaagagcagccaaugcuuuuaauguuagagccaucucucuagcccuaaaguauaagcuuaaauacaaaacuuugcuuugaaauuuugaaauguagacucgggugcuauauuaacugucuaaccuaugccaguuugguuuauucccauucuuuauuaaaguuauuugauuaggaaugaguuaaaaguguuauucucaagaauauuucagaaacauauaaaaucguucauuuuguauuagcccuaagaaguuuccugagccaccuaaaggaugaguaagauugcacuaagacaugcgccuguguaggaaaugcucuguuaauauuguuuaccuucagcuaagugggcuccgcuuauucaugagcgauacugaaguuuucucaagaaccauuuugggggcugaggcgaugguucagaggguaaaggccuuacuguggaccugacaccuaguucaguucugugaucucagcauuccuggaaaagcauaagaguuggcugguaccucaggggcagaaacagaagaauucugccucagcuauaaggugggagagaacagaguccccaaaagguguccuucaguuuccacaugcacaccauggcaugucugcaccuguacaccaauaccacacauuuacauauauaguaaauuaauaaugaaaauuaacaaugaagaaacaauacacuuugguauuuggcgugcauuauuuaaaagguaugucacauaaaauuuuuacacuaauucagguagaguguuuuauagcuaaaguaguaagauaacuguccacuccuucuuauagguggugcuaacugaggaugauggcacaugauguaaucuuagcauucaugaggcagaggagggguaaugggagaggaaaccauccaggacuacuagugagacugcaucaggcagggcagguuguuuuggagaacgcacuacauuauugucuauugaaggcagcaucugaaauuaagucuaaaugaaggaauuaaguauuaaauuauaaauuaucuaggacuuauguuuauuauuuucuaguuauccgaaccauuuuagggaaggagccuuaacuguaguaguucugaucauauuaccauuucuuuuucuuuuucccccugugaugcggucuugcaauguucugggcuggucuccagaggguagacuccuaggucagccugccacauagguugaaugauaggcagaaccaacaaucuuggcauuaggacuauuuuuuagaacauugcagaugguaaagcuuucuucagacuguuauuacuaacaaauguaauaagcacaguagucucucagugauuuuuaaauguauucuuuagaguccuaugccaguauugauauuuuauagagugcuuuaauuuauuaaauagaauaauauuaaaguugaauauuuuuauauuauauuauaagugaagaagguaaguguauagacucuuccuguacauuauaaagcagacuagcaacccuuuauagaaaugaaaauaaccugcaaagacuaugguagauuucuaaacaaaccguuuuauuaugugcauacaaccauaaccaccguucucccucaggaguaugucacccagugggacagagccugagaugguagacuuuaggcuguauaaguuacguuuggugauaagcagguaacucaguggugagaacacagccugcuguacugugagggugugaguuuagcccauuacggccuugcuagcuuuauagcguucggcagcaggucuucucuggacuuagauuuuuaauagggaaaaugaaggucaugguuuucaaacuuaaaagaauuauuucaaaaguuaaauguuguaaauaacaaaucuuaagaauuguagcugcaguacuuggcaacuauagaagcuuauauuuaguuauaugcauuucccaguauuucuagucuaccuaaaauguguuguguaauucuucacacuuaauaaaucuggcuucccuggcuguuuaucacugucuucugucuucacccccaagucuucaucguggaaucaauuagagaaugcagucuuuauuacaucaaaucaauuuuguuuucauucuaaagcaauuuguuuuauuuucuauaagaacuauucauagugcccuuggcaucaccuuccuuuuguuaacagaaggugugcgacuaacuuaagguugugugucucgauguuuagcuuaccugcuacucauuaggagugaguuuauacaauuauguguaauugcuuaccguuugcaggaugacuugugguguguuggagaaaguacucaguaagcucuuccugugacauuagaaaaaucaagaacuuuugcugaauguagaguacuaaaauaacaaacuacguacuuuguaacuaaucucuuguucuuaauauuuaccaaauucuuaaaguugcuuaaauggguaaaaggucucaguuuaaacauauaaaauacauucuggaaaauucuuggcauggugcaugccuauaaucauagcacuggggaaucagaggcaggcagaucucucuugaguucaaaacugugcugaucuacauagugaaucccacgucaaccaaggcuacauagugagaacuugucuuuaauuaaaagaaaaaaaaaagaggaaucuaguugggaccgggacgaugcuucagugguuaagaccagucucugcuccuuuagagggccacaguuagagucccagcaccugcccauggcagaccucucacagucucccauaacucuaguuucggggagaccugccucuucuggucucuguguacaccugcacucaacgugcauguauuuccauacacauaucuaaaaguacuaaaaagaaaccuuuuuaaauaucucauucuggcuguuaaggaggaaaaaaaugaccuaaguuauagugaaaacacuaggagaacacacuaagacacagaacagacaggcauacucagcaugacuaaguuaggguauaacuucuauuuaacaacaucauugggauugaaugaguagcugcuuucauuuaucugcauagaaaagaaaauuaaccgccucugguggaagauaacaucaaguaauuuuuuuuuuaauaaaaugacuguuuuggacauucagucauaaauuucuagucauggccuggcuaguuggcucaguauguaaagugcuugguucgagcacaaggaccugaacuggcaucgcauagacaagccggguaugguggagcaugcagagacacggaaguagaugaacccuggugucuccguggccuucuggucuagccugaacagugcucuguaggcucauugagacugucuugggaaguaauguggacagugcuugcacagacaagucaacccccaacauagacaugugcaugcauacgauuucuauucauacacaaagauaugaucguguuacuggaaacucaaaagaaaaaauguuuuucuuagaucaggaaggguuaguguuaggguuaggguuggauguagucaaagacuuuuuauuaugugcucccccccuuuugguuuguuuauauaauguaucacauagacagauuuucauauguugaccuaucccagcauuucugggacaaagccuacuugaucacgauggaugauccuuuugauguguugcuuagggaauaaucuacauagaaaaaaaagacgacuucagguaaaccacaguuaaauuguucuggguggaaauaugaagaauuuuaucacaaccuauacaaaaugaaucaaaaaugugaaaaccaaauaucuagaauucagaauucuauaaaauuaaaaucucacuguggacaaggagauuucaauaggaaaucuaaagggucaauaaaaauaaccagaguaaaucacaauggggguaaggggcccacaggacacagcacauagaagacagcagcuucaguccuggaaaggaggcacaagcaagguuccaaaaaaacaacuacaauuuucuagcuuuaacuacauuuuauaaggacauaaaauaaguugucaggcacuccauuguaggauuacugaacccaggucacuuaaacucuuagaagcaacuugagaagaagaagcugacagaaagauaaacaccaacaguguaacagcugguuucucagcagaagaaauggagucaagguguccgguagggaccauaaugaacacugaaggagaugacugccagcccaauccagaagcgccuuuaugcccaugucuguuuuguuuuagauguacauuauaccuuaguuaaugaauuaaaaaaucacuuuguacuuaaaaucauguuacauuuuuaaaaaugaauuugaagaacaaaugucuuaagugguuaauccacuuaaaggugcggagaaaugggauuaauuuugugcuaaagaaagaaugcuuuuuauaauaaauuuuuuuguguguuucucuuuccuuuucuaauuagcgaauuuuagcacccuauacugauuuccacuacagacacaguccagauacggcugaaggacagcucaaguaagugcccugcaugucugccaggacguggggcgucuguucccaguaagcacugauuguuacagagccagagcacgggaggagauggccuuguucguggcucaguuguacauagcacaaaugaaaggauagcauugagaaacuuaaaaguuaauuagugauacaaagcaauuccuuucggguuccucucguuaggaaugcagguguugccccuuggcuccguggugucguugcugugugaugcuuacugaaccgacugugcucgggggcucauuugaagcccaucuaagaauacguuucagaaagagcgagguuuaugacuucauuguaacccgugcuguggauuugaguuuuagucacuuauuuauuuuuugccuuaccauguuaucccugaccagccagacaccugcuguguagucuagccugacccagaacccacagcaacgcucuugucucugucuccugagugcugacauuggaggugugcacuacuccacaccuuaaaacugaagaccaguuuauacuaaaagcugaguaauggcuuuagaguagaccuggucuuuuucagaacaucuuguuuugauuucaaauguaaauaauuaacuuuaaugauagacuuuucucugauacaugauuaucagcaaaaacucacuucagucuaaauuuugugucuuuaauaacugcccacccacaccuugcaacagagaagacagagaagcacgauuucuagccaguaagaugggaaucauugcgacauuccgcucgugggcagguauguuauguauauuccucagugacauaaaaaacuaaacuuaguuuuucaaauguuuaauuguugcagcaucuaauuuaaauaugacuaguuuuaaauguaugguagucaaggagauuuauacaaaauaaaagacagaaaauuuauaguaaguaggauacugcauccuguauucugaguuuuguauugauauauacucauuacauuuucagcucacugugcuaaaaugauuaccugaacauuuuaagaaaauccagcauuaucuaccucuuucccugaggcucccaaaguaaagggcaaaaauaaaaaauaaaaaaauuaaaaagugaggggguuguauguauuacuuaaauaugguauaguaaugucauaauuauuaaguuaagcaggguguuaggagacucaaacuucuuuauuauuuguuuuuacaguuuguuuguucugaacccagggcuuuaugcaugaugagcaagaccucuacucucgagccuugucuccaggucaccagauuucuuuaguauaaagauuauacaugcuucauuuuucuauggaguaaauacuuaguuucauaauaguacggcagagagcuuagaaaggaacguucacugcugggugcuugccuucccaccuuacagacaucuuguccauacaaaugcuuaucccagccgucaguaggcuucagcucguaugucuccagugugcuuccucugcucgcuuggugcccccgugagagcccugcccuaccuauuucaccuucguggacaacugagagguuguauguggaccuaagaguaaacauaacaucucucauacuuguccaaacaaaauaccaaagaguagacgauucauuucaaaaucaagauuuacgugguucccacuucuggaggcaugagcaucguauggcgagcaugaaagcugguccacuagugccaggcuucccucucuuaguuuuagcuuggggauuuguuagggugccucaccuaacagguccccucccagggaccaucaucuugucauaugaucucugagguccuccccccaaagcugaaaguguccagcagugcacuacuaaccccccauguucucuuuuaacaaggacaugacuucagucacuuuggccagcuuagccaucuuugcccuuacuccaagauaaugccaugucugucacuagguauccucugcugcuccucagcugcugcuauagcaucuuuauguuacccacacgcugcacugggcucuaaccaccaaggucaccuacugcucacucagcccuccuucuagacucugcuggccaucacugcgugccucguuguggucagccucuuuuaaaguccaucgcacacucuuucuccagugccuuccuuauguguugaucuaugacgaguuagaugcuuucuauccucuaucaaacuaagaaaaauaauaacaaccuugaaaauacucuucuaacagaaguaguuuuuuucuaaauaguguuucgauucuguggcccuauuuauaauuagauacaguuugcaguguugauucuacaacaaguuuuaagauuacaaauaacuucuggagggauaacuuuagcagcacaggcuuucuacaagcgucaacaccuuuuuuccucuguuagcacaggguaaguaagacuuagaucuguuaccguaaucucugauuucucacacggcugucagaugucaaaguuggggaccugcacuucaaggacuggagcacuuaauuuugcuuacugugcugaacuugaggaacuugaggaauuauagauacucaugcacucaggcacacaaauugauggcccuuaauaugaaacccagaaugcugucguagcugaggcuguuugagcagugacaugagcagaggguuguacgugugaccuggugggacuaguugcacucauaacauaagaacguugaguuuagucuccaggauauguauauaauguauauuugaaaccuaaaugaauuuguuaugcccacaugugaauuaucucuuagaauauaugcaggaauucugaaauuugaaaaaaaauuagaaucugaaacacaucugguucuaaggauguuugauaauggacacuucagccauuguagugagaaagagucagaguccuaugugacuuucaaaaacauuuucccuagauuuugcuauaaaacauuccagagcauuuaaaaaacuguguggugauuagcauguauucccacuguguagauucuguuaucugucuacugucugucugucaguguaucccucuaugucuucgucauuccaucuaaguuucucuagcgcaccaugaagcgcuugcagaugcagcauucuuucgucccgaaggaggggcacaugcgcacuguuugcuguuggcuuuuuauuccaguguguuggucucacuuaagcaguuguauuucacuguaguuaaugguccugaguauuuugugcuugcacauacauauuuuuugugacacagaauuuuagugucuuuaacuaucuguaacuuaaaacucuuugaucugugaauuuuauuuggagccuguugcuuauuccccuuuguacacuuaggagauguuagaacuaaauuugacaagcaucaugcagcucuucacuguaguuucaaggaguauuagacagggaaaauauuguucuuuuuuuccucucauguucuuacucccagagaaacauuuauuuauagccaacucuguguucaguuucuacacaugaaauagaaauuaauaagaaauuuagguggugagaauaaugucaauuuccaguuagggaaauucugagaauacuugguauuuauuauuuauaugaugucaaguauaauaaccaaauaguauaauuuaacuuggggaaaaaaucacagauuuuuauauuaugacacauuauuguagaaguucuuucuuaguuuaauuuuuaaacuuuuauccucuucagguauuauuaauuuauguaagccuggaaauucugggauacagucucuaauuggaguacuuugcauaccgaauauggaaauaaggguagguaacaguuacuguaacucuuagaugccuagaccuuuaaaagugacacuagaggcuggagagaggccccuuaguaagggcagcuccugcucuggcccaggacgcaggccaggcuccagcaugccucauagcaucuccucagcucuccuuaggcaucuacacacaugcacacagauucuuuacaaaucauguuagcugaaguuguucuuuaaguuggcaauuuuuaguuuagagcauuuuucaguauaugaauacuucagaguauuauauaaaucacuuaaaauacuguuaggaguggcaguuuuauuaaaaugaguuaaaauauaaaugaauuauaguuuauuaaaacaaugcaaguaaaguagaaagguauucuuauuuuaugagucaauuguagaaaaaauagguauuauauuuacauagucaugcuucguaauuuauauacuuuugauaccauguuaccaugcuuuuaucuugaagauggugauuuuucacuacaacucuuagguguugauuuauuagcaauauuucuaaauuauuauuauuauaauuaguaaguuuauauuaaauagcuaaaccagauugaauguggagaaaacauauauuagcuuuuaagcugucuuuucccuuaaauauuuuuaauuucauuucuccauuuugccuucuaguuuuuucuuuaaaugaacuguuccuguaugaggaaaaacuguuagaaagcauuggcugggugugcacggaagcgggaggguuugcugauaacucacagagcucuggucaagaaacaaaggagcaguucuguucaccuuuuauuuuugauguguugggaaucgagcccugcaauguccgaggcaggaguuuacuacugagccacccgucugaccaccagcuggccucugugccuauauggaaagaacugaaaucucuuuccagauuuguacaguggugauaaggaaagauuaaaaaauuaaaagacauauauguuaaauauuuaguaauuaucccuuagguauauguuucuguuacuuuguuauucuguaaacaugaucuuuuaaaagccauuaaggacuuuuucuguagaaauaaguggaguguacuuguuguuccagcgaggucugcucgaagugcucuaugacaucuuucgucucccucugcccguugugacggaugaguucauagaagcccugcucaguguagguagguucugaagggcaccggggucugccgcuuacauuuccaugggacuugaugcaaacacuuacuaaauagaaauaugaacaguugcuuuucuuucuggugauuagagaauucauaagaugccuaagucuccaaaugaaggaaguuacaaguguguaccuucccauaaacaguuggguguauugcaugugcguguacagguaugcacacuuccuaaugcugcugucacaggcacauaccucuugacaagcccggguuguuaccccugugccagucaugacacaauucccaucucuccccaaguguuauuuuaaaaccacuuugaaguuuuuguagccuggauagcugauagucccaugccuguguguuucaguauugccugaucuccuaaccucauuuuaauucuuuuagauccaggaagauuccaggacaguuggaggcuuuccgauggcuuuguggcagcugaggcaaaaacuauucuuccccaucgugcuagauccagguaccuuagguagaaaagggacggccacuuauuuccucacugcuuuuauguuccgugagacaucuaaacuguggcugugcuuuugcuuccaggccagaccucauggacaauuauuuggcucugauacucucugcauuuauucguaauggacuuuuagagguaacauuuacaaaccuuuaucuuacauuguuuuucaaaaacuuccuaggagugcaaaccaggucuggugcagaaauguguugaccugcacugcugggcaacacuggugcuuccuucuugccuccuagggcuuggucgaggugauaacgaacagugacgaccacaucucagugagggcgaccauccuuuuaggagagcuccugcauauggugaguacuaugacuucugccuugugguuggacuuguaggaucuucaaugauaaaucggguuaaaugaaugguguuacuuuugauagcucauaggauauauuaauaauauugccaaagccuuugguaccuauuccugguagauuuaaauuuuuaauauuaacugguuuuauaaauguaacaagugugaaaaauaccaaauacugaauguugaucuuuuuuuuuuuuuugaaaaaguucuaaauauaguuguuuuaccugagugucagugauuuccauaaauuaauaguuuagguucacagagugagacucugggacgaggccucggguaacuacaucauuuuaugaccuuucuaacaauuagaaacuauuggccuuugccauugaagugauuuuuuuuugggcacauuuuuuucauacccaucaguggcuuacuuguauugucaagaguuagcacugccccacccccaccuggcucaugagcguuucuggcugggcgcgauagcauucuucugaucuuaaucccaggaagcaaaggcgagggucucugaggucaaggccagcuuggccuuccuucauagugagugucagaacagcagcgcuacuuaccagauaccaucucagaaaccaacaccaaacaagugcguuuccucccuacauggcagcugagcugugucugugagguaaagaauuaaacaguauacaaugucugucuuuaaucagugacuuagccacuugcucugaucucauugagccuauugguaaaaacacaaaacaguacugcagacucaggucagaugagcuguaucuugguucucagagaccacuuccucuacaaacacuggaauucauuuucuuuauaugaaggaaucuuuuaauagaaauuuaaucuuuuucugugagccccagaauucugugauucuuaugaaagauaaaagcaggcuggauuaaaugauagcacuauucaaugcuuuuuauuauaccuucuccuucuauacauuuaauaaauguacuuuucaguagaaagcugguuggguaguuaaauuguuucugucaccgggaaauaaaguuucuauuuaaggauugcugcuacaagggaccaacauguucugagguagauacagcacagccucucuacuuuucucaaauacagugcuuugcuacauaauucuccagaucacgaaagaaaugagauuggcaacauuuuuguuuuuguuuuguuguuguuguuuuugguuuuucugagacaggguuucucugcauagcccuggcuguccuggaacucacuuuguagaccaggcuggccuugaacucagaaauccaccugccucuaccucccgaguacugggauuaaaggugugcaccaccaugcccgguuuaagauuggcaacuuuuagaagccauauuuaauaauaacagauaugauaguagcuuuauuaauuuuuauucuucuugucuguguauguuuguguguguguaaaauugugccauggugcauugagggucagaaugcaacuuugcaggaguugguucucucucucuuugccauguagauccugggauagaacucaguccucauauuuaguggcagauaucuguccugcagagcuaucucauucuuacugaaauuugaugggauuaagaauuagaaguaugccggacagugguggcgcacgccuuuaaucccagcacucgggaggcagaggcaggcggguuucugaguucgaggccagccuggucuacagagugaguaccaggacagccagggcuauacagagaaacccugucucgaaaaaccaaaacaaaacagaauuagaaguaucugugggcagaaaugauuuaaguuguuuucaugaaaagccuuggguuuuauugguccugcauacuguauuugucucugaagucucaugaagcaucauguucccuguaggcaaacaccauccugccucacucgcauagccaccaucuacacugcuugccaacccucaugaacauggcugcguccuucgauauucccaaggaaaagaggcugugaguaucggagccuccgcaaagcgugcucggucugcuuagcgucugccucgauggccuggccuuuaaguggggagagaaaacaaggaguugauagguuguguuuggcaguuucccuugggaaccccaagaaggggaaguuacaauucucaaaauaguaguaauuuguauuugaggcuguaaaguguuaguaagugguagauugacguuuuuccuuucauguuucuaaacaaggcuuuuacuguaugacugaaauagaaagguuuucuguugugguuuuaauuuguuugcuuuuaugaucugggaaaagucauauauauuucccccauaagcaaaaugcaguucaguaccuccugggagcugugaacauuuguuuaaaaugacacauucuucaagaguugaauuagcuuuaguaaugugugugcuuacagaugggccuaacuaucaguaaauagcgauucauuuucgcuuuuccaguaaguagccuagagacauuguucagcugaagcauuagcaggccaccguguucuaacgagaagcuuacaguacaauauacaagguuuaucuuguaguuccaugauugagguaaagccuuucucaaaaccugguggucguuuuaaacucaaucaaauuaaggucacaagacucaggggucauuaagauuaaaaauugugguuaaaagaacugagauaguaauagucuaaacauuuuuuucuuuagcucccuaaguugucuuuacugacagguuguauacucgccagucugacuguauccuaaggguuuuagacucuacuuaacacaagucuaaagcuuaguugcugccaaauucuugaaaacuauacuucgcauguaacaaauaaguaauuaaauaacuuuaaaauauuuuaguuaggaugaugaauuggugcagaagauagagagaaucccuuuaauacuaggaucauggauuauauugauggacaguaaaaugguuuuugcagcuucaugaaaacaaaaauugguuucaaguacaauaaugaguuacaugugagaaacaaagcuuuacagcuuuaguaaggaaaguggguucucgacuuaaauacuuguguauaccugugaguauguggaggggacagggagucgugcuggccaucuauguagcagucagagguugaagucagaugucuccuuguaugaauuuccaccucacccuucagccuaggcuggcugaguagccagugauccuugggacuuccccugaggcugcagguguagugccuacaucuugugaguacuagggcuccaaacccaguuaccccucgugcaagugauccuacugaccaucaugccaguaguccagaaggaauucuuacagagugggccuaccaccuuagaagaaagaguuaguauguggaaguaugaccccacauuaggcuuccuuauguaaauuagcagugucgacuugucauuaugcucccaugccccaccaaaauuugcuugguaaucucuguuguuuauguaagcuuaaguaacuuagcagccacugcuugaaaggaugcuagcccugccacaguauggauuuuucuuuccuugucaggcgagccagugcagcccugaacuguuugaaccgcuuccaugagaugaagaagcgaggaccuaagcccuacagccuucauuuagaucacaucauucagaaagcaaucgcaacucaccacaagcgggaucaguaucuucgaguucagaaagauauauuuguucuuaagguacugacaugagaaauggacacaauuuuaauuaguuuccuaguucuuagcaacuggauugucuggauuuucagguuuuuugcaagcagauuggucgucuaguuuuaccaugacuaggaauccuugaacugcguuuauguguaugugaggguagaaugcauugcaguguguguggauguguacagaugcguguggggucaagagagcagcauucugcuguuccucagagaccaugcaucuugaguuuuucauuuuuguuuguuuuugagacagggucucuuauuaaaaaaaccucgccccauaggcugggcccagcuccagcacucuccuuacaucucuuccacaaugcugggauaccaagugugucaccagucuccgcauguguagccuauggggcuugaacuuagguccgcaugcuuguaaggcaagcccuucaugaaacugagccaucucaggcccuucuuguugucuuaucaaccuuuugaaaauaggcauugaggaucuuugacgaccuaacuauaaauacuacaucuacauaccccccuccuuuuuuuucauuuuuaaaauuagaauuuaguuugcugauguagcauagacugccuaauuguccuucuuacugucugguguuuuaggauacagaggaagcucuuuuaauaaaccuuagagacagccaaguccuucagcauaaagagaaucuugacugggauuggaaucugauugggaccauccuuaagguagauagagcacuuccuggacauugccgaaucaauugccgucauuuuauuacuguuauuuguuagaguucuaugcuuaggaauugucagauauacauuauauaauguauuguguuuuucuaguggccaaauguaaaucuaagaaacuauaaagaugagcaguugcacagguauguaaaaucuauugaagaacuuaaauuuauacuaagcuuaaaaguaauuauugauauuuuuuaaaugauaauuuuauguacagucuuauaaucagugcaucagcuaaauuucucauuacuuacucugcuucuagcuuugaucuuucuaaguuacuuacuucaggguaguguuacucagguugugaugcuagcccugacacaaggauggcauuaauuaagaaagggcguguguuuuauuaagccgcuugugcucacacucagaucaucuuuggagaguggccuccucgucagcuccucaguuccagugucuguagagcaugcucugucucaacucacagagcacagggagccucugcucucugcugcgcccgugugcucuuguacuugugaguuacugagcaaccacugcggucagucucuuuggaucacaaggccuuacuaugucuuagagaaguuccuaucaguaacaguucuuacgcuguaaucauauguaaugauaggagcuauguuuauaucagguuugaaaaaauauauaaaaacccaacaagguacaguggcauuaagaagcaugguucucuagagaaccuuuaagaaaaaacgaaugauaucuuaauaauuccugcuaccuuucuggguuacacuguugugcaugaaaguaagcugaacucuauguauaugaagugagcacagcauugaaaguuacugaaauauguauguaaguucaguuacaucggcgucugcuugaggcuuccuugugccucccuagcuuuacagucuguauguucucucugcucuguggagucuuauguugcucuuuaggguuuuugaggguuuuuuguuuggcuuuguuuuuguuguuuguuuguuuuuuugaggucagaguuugcuuuguagcccaggcuaaccugaaacccauuauguggucuaaccuggcuuugagcuacugcucuuucugccuuuaucuccuaagugcugagggcuuaaagugucugucccaugccugcccaugccugaacacucccuaccaggucuuacucuuaacguucuuacucaaccaacagaguuuuaaaauccgugaacugugccaaaguguuuaaugaguuuccugaccuguucuuuaauaauuguuugguucccugcuuuguugcucauuucaucuucauuuuagguuugugcgcagacuucuuuacuuuuacaagcccagcagcaaacuguacgcuagucuggaucuggacuuggccaaguccaagcagcucacaguuguugguugucaguuuacagaauuucugcucgagucugaagagguaagccuugcggacuuucacagcagguguuuucuguugacuccgcccccuucauuuuccuccucuauuacucuuugauacucucuccuccuuuuuuguucuuuuucuuuauuuuuuucuuucuguuuuugguuuuuuuuuggggggguuggguguuuuguuuauaggaugggucauacuguguagaauuuacgauguaggccaugcuuaccuugaacacaacgaugugccugcuagagugcugagauuaaaauguaccccuaccauaccugcccuucuggcuuacuucuauuuccuagacuguauaugcuguuugaaauacaagcuuagccauauaugugaauccugauguagucccuaccuagguauaaaaccuuagggaauuaucugcccucuagauggacuaguuuacccucagguaagauggagagaugggaaauaaagacuaucuccagguaacaguguuuucauugaaagaguuaaaauucacucagugauccuaucuguuacuagugacuuaccaucacuaaguuuuuuauggcuacuaaaggugauuuucuaacuacaggaugggcaaggauacuuagaagaucucgugaaagauauuguucaguggcucaaugcuucaucuggagugaaaccugagagaagccuucagaauaauggcuuacugaccacccuuagucaacacuacuucuuauuuaucggaacacucucuugucauccucauggagucaaaaugcuggaaaagugcagugucuuucaguggugagccuucucagaucugcugcauugcaagcuaagcuuuagucccagggaguccagacacaguuugccuuuuagucuuacgcauguguguuugguuaaucauuuuuaucaagacucuuuacuuaugaaggauuuuuaaaauguauguggaauuguuuucacaugccuauaccuuaagauagcaauugucugugcuaauggauuuguuaaugaauuuaucaccugauagguuaaauuuauauccaauuagguauucuguuugaauauacauaauuuuuauuuugucagucauauuucaauaaagcuagugaaaaauuauuguuaaugaaucaucauaguaauuuauaauucuucucuuuuagucuccuuaaucuuuguuccuugaaaaaccaagaucaucugauaaaacucacuguuuccagccuagacuauagcagagauggauuagccagagucauucuuucaaaaauccucacggcagccacagaugugaguauaacacagacggaaaguguacucuucuagccagcucauugcaguacuguguaaacuagaggcugagucacaagaaccugaguaacuaagauaugggauggaacugaguuaaucuugagcuuuagucuuguacuuagcuggcaggggacauucugugaucuuaaagauguuauuuccaggguaccauguccuuuacauaugcugaccccuguggcuucaccaaauacaaaauauuugauauauaauuuauaauaguuuguaauuacauucacacauucuuaaauuaaaaaacaaacaaacaaacaaaaaucuagucucugagaaacuccauagagaacuuuuuuagguuaaaucaaugaggcugcagauaguaacuacaacucaguuccaggucuuuccagguagaagagguuuuuuguuguuuucaaaaugauagcaagguguauaugcugacuuuugaugucuuccuuuaucuaucuaggcuugcagacuguaugcaacaaaacauuuaaggguuuuauugagagcuaacguugaauucuucaacaauuggggaauugaguuacuaguaacucagcuacaugauaaaaacaaaacaauuucuucugaagcgcuggauauucuugaugaagcuugugaagacaagguaauguugaguuucguuugggcaaaauuuuauuaaacuauuccaccuuaauuggcaguguuagaaaagcuccgagugcauaagcguuuuggagcagaacguacgcuaccuuggcuuacuuacuaacucggugaucgucucuuuaggccaaucuucaugcucuuauucagaugaagccagccuuaucccaccuuggagacaagggcuugcuucuacugcugaggugaguaugaaguacauuuguggugcccucuuggucauguguauuaguguuagaugcaaaucugacuaggagauucucugaauuuacauugaacaucugaaccaugcuucauuuagaauugaacuauuccucauugugagcuugugcuuagcguugugcuccugcuugucaugacguuucccuuacuguuauugcagucagucuuuuugcaaauacugugaaaguuuaucugcaaauuggaaagucaaggacaacuuuauuagagcuuaaaaguucaaacuccagaguagacaaaguguaaaaccuuaacagcuauccugaggaaggcaguggaggagaggaguccagaaggccgugcccuaacauggcaugaagggcaggcaugcagcagacaagcagccacauggugggagggaagccugagagaaaggaagccuaaagugugguagaacagcccaacguuuuaaggaaggcauguuaagaagacagaaacaagaccggcaaaggugggcuuuucugaaucagguagacauauaagguacaugguugcaugcuaugguacuaagauccaguaacguagcugggugauggcugaucuggcuucuggcagcuaaauggcugagucaggugugguggucagagugcccuuccaguacgcguaucuauuacaacagugcacccaugguuuuaucugugugacugucagauggagagagaaauggaaguccacauguuugaaauauuaauacuuuacagauuguuuuauacuggacauaguccaaggucucuuuguuucugaagcauaugcuuugugcuaauuuagauauuuuuuuggacgaaauguucaguuaugguuguucuaauuuacagauuucuuuccauuccgaaaggauuuucuuaccugaaugaaagggguuauguugcaaaacaguuggaaaaguggcacaagguaacuucuuaugaaauaauaagauauacuuuuuuccuuuggaaauucagaccagccuucacuacaugaaacccuaucuauaaaaacaaaaaacaaauuaauuauucauucauuaaugcuaaauuauauuaaucuuacauuaacauauauauuuguauacuucuuuuuuaauguuagauuuauuuauuuaucuuguguguguuguaugaacaucggaggacagcuuauggaaaugagcccucuccuucugucauggaaucauaggaucaggcgcagaucacugggcuugguagccagcacgcuuugagcccuuuguucuuccccauuuauuuuaaccacaugugccuggugccuguggaggcaccugaagugggcagcagauccccucgaccugacguccuaaaggcagugagccaccauguagauacugacaaucaagccaggguccagacaguagccaucgcuuugaccuagugagccaucuccagcccuuuucucuauuuuuggauuauaaauuucacacaacuccagguuugaaacaggaggaaggaacauucuuucucucuugguaaacucacauggguuugcuggcucuaagugagcugauuuauguugagucuuuuguuggaggcuacauucaugggccucucguuuacagcucuugacaaggcagugucucccaucaucuggcugaaucucguaguggcuacagguccacaguugacaugaaggaguguaucuccuugcccuuccaucuugcccuuccucugccuuuuguaucaccuccuaguaguagacagccacacuugggauggagggccaugucucccaggucaauauuuuuggaccagaucuucaaaauagcccuuauuagaaauuuaauccauuucauaacuuucagcaaugguaaagauaugguuuuaguugucacugguaagauaucauugaguauauauaucuccguggauaauaacuaauccugcagaaagcuaaaaugcuugucuuaaucaaguuuuuuguacugacauuuuuauuagaggcaaguacagugacaguauuaauuaagcccuuguuucaguaaauguacaggaaauauaaaacccagugaccaggaagagcuuucaguggccugagcaggaugcuaaguuaaagugcuugacuggcauagucucugguuuaaaaugcaaacuggcuucucuguccggcccugucuucucugaauauccuucacaauuucuuuuuuuauguacuugacuauguacacagcuauaagucuacauauauacauuuuuauauacauauauauauauauuuuuauguccuuuaaaauguaaagggauuaguucaguuugcaaauaaauacaacugaaaaaaauaaauacaacugaaaaaaaaaauaaauacaacugaauuuuuauuuauuagaacuuuccagaauagugugcauuuagaucuacuucauucauuuuuuaaacacccucacugugcgugcgugcgugcgugcgugcgugugugugugugugugcgcgcgcacauguauucagccauguguggaagucagagaacaauuugcaggaaucauuuagucauuuaucuuccuuuauggaaucucuggggauugaaaugguugucaggcauggcagcaagugucucucuaccuguugaacuaucucacuggccacuacuuuuuuuuuuuuuuuaaagacugcauaauuuuaccaauccugguacuaaaauauauuuagauugugccugaaacaccuaauuuuuuuaaauaaaugguauuugcuuauauuacauguauaaggauagcuauuucauaguucuaaaaguauauaaauuaaauuguuaaaaaauaaaauacaaauaaauuugaauuuaauuuucaguaaauacugcuaaguugccuuccaaguugguuuuacuuauuuuugcugacaguuugaaaugaaaaucucuuguaauagcaauagcagaaugguacacucacccuaaaacauugaguuacaauuuuuuuuucagugguauguaugugaaauuaauuuugguuuugaucugacuuaaauuaauaaagaauuuuaucuaaaaacacuaaaauuauauaauucaguuaauuuucuuuuuacaauuucuccugaaugucuucagaauauaaugcuaagaagacaacuuguuaaugaaaaugagagcucuaacaggacagaggccauuacuugcucauuuacauggaaggagaggcgauacagagcucuuuuagaugggguagagcgugugccuucauaacuuaugcuuuuccuuuccuaaaaacuugugaacauacucuaagguuugcuauaauguggugaagauaauuaugaaaacagaagauuuaaaacaauauuaucuucuaggaauauaauucaaaguauguugacuugauugaggaacaacuuaaugaagcccucacuacauacaggaagccuauugauggugauaacuacguucgucgcaguaaucaaagguaugauccagucggugugucccuguauaacugucucucaaaugccaaauuaaaagcagcucuuaauaaguuauuuaaaaacguuuccgaggacuccuguucagugauagaggagagcucuugcuugcccagggcuccacguugcuaauggaauguagugcaugcugagcgugcuccaugccacccuaccuagccacgcuccauggccucagcccagucugcugcacuagcuccagcuugcucaccauuaaacuuugagaccuuuccagagacauccucaugguuucaccccucuguaguuuugucaggaauugugccaagcuuauuaguacuuguuuacucacuuagcauacuuaagcauguuaauaacuuucucggucauauuucgucacaccagacuacagcgaccucaugucuaccugcccguacaccuuuauggacaacugguacaccacaaaacaggcugccauuuacuggaaguacagguaaaaauauaauuugcauuuuaauuguagaaaaaguaaaaggaaaauauuaauaggacuaaaaucauuaucuuugccaagauuucucaaaagcaguuuuauaacugacuuagccaguauucaaguugcugggugucauaaucauauacugugauaaaauuuagacauuaguuuuaagaagaugcuauuuucuaacuaaaagaaacaaacauacagaagagauggcucauggguacccagacaccuguugucuagcuugauaaucuugaguuugcuccuaaggagcuguguagaaggaaagauccaacuugugugaguuuuccucuaguaucagugugcuguggcauacacacacacacaguuuuuuaaaagcauuaauauuuaugauuuguaauacuagguaccguguacuucaguaaguacuucauauguaauaguaacucacaagaccucguaagauggguucuauaaucacuuacagguuaagaauucaaggcacagggaugcucgguaacuugaauaacuaauuucugguguuagccucagcuaaggucuguggucuucaugauucacugaagaaauuauaaucacauacacaaaaaaauuaaguuucuucccugcuucggaagcugagcugaacuuagugcagauuagugagaaguguagacuaugaacucagagccugagccuccuaaaaaaugcugagugcuaaguuacuccugcaguucuaagugagcagaaaugacgggagagcaccuuugcugucuugugccaggguccagucuaagauaagccuaagaugcucacaugguacuuccuucucucuccagaguaucaucacagagcucugucacaauguucgcacuccagacuuggacaaaugggaagacauuaagaagcugaaagccucucuuugggccuuggucuguaguaaacaguucuggucuuuccagugcuuauggguuuuguuuuuuagguuucuuccacuaauacuaaauaaguuaaaauuacuuuaccuugaacuuuuucuuagauuaauauuuuaaagaccaggauuguuccuaccaauuuaaagauuaucuguaugcauaagaaauagauguuagauuaaacuauuagugccuuuguuuuucuucuaaaauauaauugcuuacuccuagcacaucuuauuuauuaaguuuuggguugguucuuuuuuuuuuaaauggacuccccccccccccccguuagauuuaaauauauuucuugguagauuuuaagguuucuucaaaauauuagucuuauaaauauuugauauuucuuuuagggaaauauuggcucaucgaauugggggcuuaauuugcuacaggaagaaaaugugaucccagauauacuaaaacuugcaaaacagugugagguccuuuccauccgaggguaugucacauucuugaaguuuuucuagugaacauauucguacuuagaaauaaauguaaggcagaguuuuaugguucuuaauugucgauuucaaugugcuagucuauggccuuguuaccugaccuuuuuguuuuaaucacaaacugaacaauuuuuaaaugucuuuuuaaggaaaauauaaauacccauacaguacccuuuuauggcuauuuaagaaaucuuaccuuggaauuauaaacuguuuuuaccacauauuuuuacaugcaggaccuguguauauguucuugggcucauagcuaaaaccaagcaaggcugugauauuuugaaaugucacagcugggauucuguaaggcacagucgcaagcaucuauggccagugguuccagaugauguggagcagcucugcaaugagcucucaucugucccaagcacccucagcuugaacucugagucgaccagcucuagacauaacagugagagugagucugcaccaucaagugaguaccgugauggcucacgucaagucaaccccagaaucuggguuggaguuuuuauuugugaucucacagcuucaauguauucauuaccaucuugaguuuacauuucucuuuucuaacuagacuuugggcuguuggggggcaagagucuuguaugaccuggaacgugcugaacagccaaggaugguguuggcuuccugauauucaugccuccaucucuugagugcuaggauacagacgacauguagucauacccagauccaacacuaccauuuucaaaaguaguaucuugaugguuagacccuguuagaagcugcacuucuuuucauagcaguaacuaccagcuagccuguucucucccuugcuuuugagauagcuuuaggaauuuuguaaucagagaugaucauaaaucauagauguuaaacaaguguggggagccacagguauugcugaguaguagaacacuugacuauuuucugaaaagcucuggguuuaauucucaaaacuagagagaagaaaggaaauugguagauucuuaaaaagauagcaugucagaaauaaaugauuugugaagcagacuauggauucagagucuguguugaugcuaugaguuguacaaaaguauaggcauauuucuuugcucuaagaucauaacacaagugagcaagguggcacacacuuuaauccuagcacuuggggggcgggauggggaaagaggcaggugaaucuccauguuuuacaugccagccugguuuacaaagcaaguuccaggacagcuagggcuguuacacagagaaacccugucuuaaaacaacaccaguagcaacaaauuagauaacacaaacuaguccuguucgcacaugccucaggaugcucaugcuggaagaucacgaggccuuucuaagcuacaggauaaguccaagaccaacuuggacagcuagaugagguuuguguuugguacaacacaaguaaggaaaggaaggagagagguuggaucugcaaguacaccuuuuuagccccagcacuuaaaccugaagcucaaagauugucaacacuaguuggagcucauagugaacuugaggccagauggacugcaguauaaaaucauaucucaaaacauaaagauaaucauacauuuuuugaaccguauuucaccccaagucuuugauaacuugaauuauaagauguacuaauguucguauuccaacaagaaaaagaaauacaucuugcccauuacacuucuccauacucuuuguuacaugauuuauuccugagaaauuccauauaaaaagauguaucuuagaguugcaaaauuuggaaaaacaguguaaugugugagcuuauuuaggauuuuacuuucuuucuuuuuuuuccccaaaguauauuuaaaguccuuaauaauuacucaacaggacaguuacaaauaaaauaaaucuuacagguaccauuaauguaggacagacaccuacauuaacugaucucuuacggguagacacuaagaauagcauauaaggcaaaauggacagugaacauaguugguuuaagugugacgcuugcaagugugccuuuauucucuguaaguuuaguuauccuugaauaucugugagagaucccaggcccccaccucaguaccagaacugauucugauacaaaucuccuacauacuuucuaucgucuuuacauccucuauaaugcccgaucugagugcucaauguuaaguucuggucuuaauugcuuaagaaauaauaacaagaaaggcacaugaacauguuuaauauaagcaccuuucuaugaauauuuuuggucucugguuaguugaagccgucugugacuaacucggauguggagggaugaaguauauuucaggguuagggaacucauuucuucuaaggugagugucuccugccacuguaauguaaagaagccaugccgcuucugucuaacagaaagagcguccgugcucaagggcucuuuuucucuaucuugacuauuuggaacaaucccuaggaauaggaaccucauauacucugcacugggaugagcacugcagauuucuucguagauccucaccaugauacgaucuuuuuucauucacauccuaacucugagcuucagggaagcaguuuuauuaacuaauccccguccccgugccugguuagacagugugguagcccucagcacuguggugacugacagcccauuguugacuugcaggcauguucaugcuggaggacgaccgcuucggcagcaccuccaccagcacauuuuuccuugacaucaaugaagaugcugagccagcauuuuaugaccgaccuggacccauaaaagauaaaaauucauuucccuuuuuuggcuccagcaaacuuguaaagaaucguaucuuaaauucacuuacuuugccuacuaaaaaacaccgcaguagcagugauccaaaaggaggaaaacugucaucugaaaauaagacaagcaaccggcgaaucagaacacuuacggagcccaguguugacuugaaucacagcgaagacuucacaagcuccucagcacagaaaucauuacagcuagagccuuccuucguugggaauaagcaccuugaagacgcgggcagcacuccaaguauuggagagaaugaccucaaauuccccaagaguuuugguaccgagacucacagagaaaacacaagccgagaaagguugguuguggaaggcucagcaagcucccacaucaagauccgcagccagagcuuuaacacggacacuacgacgaguggcaucagcuccaugagcucgagccccucccgagagacagucgcugucgaccccacagcuauggacacggacuguggaagucugaguaccgugguaaguacuaaaacuguuaagacgagccacuauuugacaccacagucuaaccaucugucucucuccaaaucgaacucagugucccuggugccaccagguucuucucacacccuuccuagaagagcccagucccuuaaagcgcccuccauugcaacaauaaaaagucuagcagauugcaacuucagcuacacaagcucuagagaugccuuuggcuaugcuacauugaaaagguuacagcagcaaagaaugcacccguccuugucucacucggaagcuuuggcgucgccggcaaaagaugugcuuuuuaccgacaccaucaccaugaaggccaacagcuuugaauccagacugacgccaagcaggugagcaguaugcacugagagaugagucagcguguucuaacagauugaaauguaagacacuagucagcuugagcaccacagaaaccaagucucagaacugacccacuuaccucaguaggcugagagcuccucguuaccugauagcauuugaaauggauucuugcagcugcgaggggggaaaauaagguccauuaggcccugaaaauaaacaugguuugcaagguuacacagucacaagcuuuucuuauuuauuucucgcuucugcaaggaucgauuuuaaaaagaagcaugucgggggagucaggagcuuaagaccuacaguaacaaacagccuuuucagguaggucgagguaaagcuccaaacggugaccucuuacuaguuguuaaaauagcugaaaacuucaggucaauuauuuugcauuaaguacacauaauuaaaaaggaaccuaauaaacacuaaaugaauuccuggguccucaagacuaagcaagaguuucuaauuauauauuaaauauuccauauuuaggguauaucaagcuauuaacaguauaguuuaaguuuguuuuuuaccaugauacacuuugaaacuugacaguuauaaaaaguuccacaccuguuuguuguugggaauucucguaguugaauuauguccguuuaaaugguuuauauuucucuaagcagacugcuaggugucagguaguaaaaugagagagugagcccucauuuacaggguaugcucacugucagaauugggaguuacugcuguaaaagaucagucucauuucugacuuuuagguagcauuuuuaauaaagaagguccuggcagcagauagugaauuguguccccucuuaauaaaaaugugcaguaaugguuguuguaacugggagucucugccucugccauccucgggaguguggaacacggccacgaggcacgcauggagggcuagagcugcugcguuaggcuggcugcggcucugagcuggccuacuggacacucggcuagauccguggguuaaacuuuuacaauguuaacuuucuaagcaggacauuuuuuuucuuccugaaggauagcuauacaaauccaauaaacaaugcaguucaaaauggagcuacagcugcuugaaauagaauuggaaagugaagagacucauguuaccucuuucacaaaauucauaaacaucagaagcgaguacuuuuuuggagauuaggaauuacuuugcuucuauaaucuuaauggcuacuauuucaaacacauauuucuuuguguguuuugugugaaauaauccuuugauuuacauuuguacauuuuuuaagacuugguuuuccaguuauuaaugugagacuucgaauaguguuucauauauuuaacaagguauacacagagugaacugugucuguugcaugaauaguaaugagugugacagaguuuaacuuagggagguguccacaugccgugguuauagagucuucugugccuguaagggcggaccagugggcugugagaugucccuuguacuauuuacaaaugagagagaggaaggauuguaccacgguguguguaccuuguguguuacagacuccuuacaugaugaugaaagcguuaauuagcacacaggaucgauaagcaacuagucuuacuuuccaacaaugcauuacuuaguguuaguagauacaucuuuagcuacacaguauagcaaguccagcaucucucugcguguaaaggcagucuuugacuguacuugucuguaaguuaguuuuguuuucuucuaaauauggacauuauucucuuugccucccuucucaucuuuuccuggggccauaacaguuguucuuuuggcagcacugagcauuacugcuggccccaugguugauacguagcagcugauguuagugcugaugugcucacaguagauacaggugguccgcuccuggcagacugccugccuugaugauagugucaauugggguuuuguuguugucguuuuuuaauacacuuaccaguguaagugaagacgcuaauacaagguuucuuuugugauguuacagguuuaugaaagcuuuaaguuaugcgucauuagauaaagaagauuuacuaaguccuauuaaucacaauacccuccagcgcuccuccucaguuaggucuaugguguccagugcuacauauggagguuccgaugacuacauuggacuugcucuuccaguagacaucaaugacaucuuccagguauccaaagugcuccuguuuucuaugagcuggcuucuuguuuuguuuuguuuuguuuuuuaauguucuguagcuucuuauuagaaguuguaauuuauaguggauuacacuaauagguuuuggaggugauuuuucaucuaaaacuguuaaguccacacucugagcugcucuguauucuagucaggcugcagucucuagagcagcacgcugucugacucauguguuguagucucugaucccuuuucuccagcagccaguuauugugcccacggacaguagcccugcucccaugagauaggacaguuucuaguugcauguaauaguaccggagaauacauuguuucuuagguggcuguuuuauuauuucuucggucuauuuuucuuuguguguacaguagaaguauguguacuguggugcauauaugcguguaguuccacaugcuugcaguagacagagaaacuuguuggucauccugcuuaguacuuugcccuacucacuugacacaggauugcuccuagaaucuggagcuaggcgggcagccagcaagcccucccagucauucugucuccauccuucuugcccguguuugacgagcacauagaugugaacacaccuagcauuuaugugcauguggauauugaaacucauacuuuacagcaagcacccuuaacucacuggaaccgugcccagccucuaggugcuuuagauaaacaauaaaguauuugaauacccacuuaauucaccaggaccaugguuaagagaccgguguuugguuauauuuugguaauuuuaaucaucguuaguaaacuuugcuuucuagauuuauaugcuacaguaauucuguuucuguugcauuuccuuuaauuuucuuaauauucauaaugaauuucuuugugugaugaaacugaucaugauuuguaugcguuuuagauaaaggauguuccuuauuuucaaucaaagcacgugccuccaccagaugaccgaggugcaagaauguuuucccaugauggagcagguaauggugcugcucguuuuacugagacuucuuaccuuaaaagugaaaugcucuuuucaguuagauaacacuaaaaauuagcugcacuaaacucugcgguuuaaauuuaaacacuaagccaaaauaauucagucaacuaaaaaguaaagcauauuuuaaaauuuuuuauuuuacuuuuuacuuccucacuuuacauccuguucacuguuccucucccagucacccccuccuacaaccguuccucccacccccucccguucucugagucugggggccucccugacuauccacucccccaacccccgcccuggcacuucaagucucuguaaggcgagguguuuccucucucacugaggccagacaaugcagcccagcuagaagaacauaucucauguacagacaacgguaaagcacauuguuuuguuuuguuuuuuuuuaagaaaauauuuuugcagugaggaucccagccucuuaaguugauaaaauccaaaauaguucuuucauuuuucuuaaagugcaagagaaauguuaaaacuaguuuuauaggucagagacacagcuguuccgaaugaaacaagaugagggcuaacuucuuaguccacauuuuauucugugcugggaguuguguguguaugugaagcauaggcucaacagcuuccuaacuuauaccucuuagaauuacugauuuuguuuaagcaauuaugagaguuaauugaaauccuacaauaaucugguuuuuuuuuucaguuguauuuuuaaaaccuuauauugaaauaguaaaggaauaugugcuguuuuaauuuucauaacuuagaacacagaauucucuuuccuuccuaaucagaauuagauguugggucauagagauuucuaaauauuucucuuuauaaacaguacuauuuuaagacaugagaaagauaccgacagugucguuaucgaguuguguuuuuauuuacuuaaacaugcaggucuuucaucuggagccgguggucucguaaagaacucuuuucacuugcugcggcagcagaugagucucacagaaauaaugaacucuguccauucggacgccucccuguucuuagagagcacagaagacacugggcugcaggagcacacggaugacaauugccuuuacugcgucugcauugaacuccugggcuuccagcccaguaaccagcuaaguuccaucugcagucacuccggugaguggugcccuuggacuucacucuauuuacaagcccgccagccgcacuacugcugugccggccuucuuacuccaucuccaacugcagacguggaugcuccucagugucugccuagugugcuauuaguauuccagccuucauucccccacuuggucuuuuaguaaugcugcuuaagaucgacagauaguuagacucuguguucuguggguucgccauucucauugcuuaucauugguagaccaugccuaaguuuucaacagcugcugcaaaugaagcugacuuucccagcugcacacacacacacacacuuucauuuaguguuuaaaguguuccugcagauaccuuuucuugauaaauaucacuuagcuacccucagaacucuagugcugccagaguucucugguugacucugcagaaauugucccuaguauuucauuacuucccagcuugugacugcgucagcugaugguacuagggagacgcccguuagcaauguacuugcuguaauuugccacaaauaguuugagagagugcuuagaaacauccaucccuucagugguuccaagucccuggagaagccugaauuggagagauuccuaaacuaggcuucucacacucuggacccucggagccucuguagacucugacggauuugugcuuuuacaaacguguuuacuuaugauugucuuuugagcauuuguaaaguguuagauguacuacacagcauaggaaagagggcauguaacugggcugugguugggugguggucgcacaugccuuugaugucagcgcucaggaggcagaagcacguagauuucugagguuaaagagugagguccagcucaaauagagauauacauugaaacucugucuugaaagacaaacaaaugaaaaaaaaaaggaaggaagaaaacaaauaacagaaaggaaggcaucuucugucauuugccaacguuugcaugguuuagggacuccacauucuuuuccuuuagacgcucaguguuugaagcacuugggguggagcucuguaguuaugaaaaucccaggaaggccagccaccaaacgguuccagugagcacaaccagaauuauacaccugacuacaaacuccuuccgaagcucuuuagucagcgcgucaugagaccagcauuaaacacaggcauaacgaugacagaguagagaagcuggagguaaagcuauacaucuucagcugacagacauccagcagaggggcuaaggacaccugcuggagugaggacaguggcuugauaaaagaaaaacugggucuccuccuggaaguaaauaacacuagaggucgcuaacucugaauaaauguauggauuaaagccauagugagagccugaaacugaaagcugaagaauugcuucguguuuacaguggggugaggacuuuucagaauuuuguuuuguuuucauugauuuuaguuccuaggaacuauuuuuaaauuuuauuacauuuuuaaaugugaucuugagugugcuuaugccccacacuugcacgugugccagugugcaggugccacagggcccacucgaagaucaggacaagugcgggagucaguucucuacuuucacucugugggcccuggagguggacuccgggaagaaggcaaagcaaccaggcaccuuuuaccuuugaaccuuccagccgcuccaugcccuugacauuuuuuaacuaaaaaaguacuuuagcuuaaauguuugguugacuugaaaaugccacugugagggccuuagcagugaugggagagaagaacaaaaaagaaaaauuacgcuaggaagagaucugaaaucaccuucuaacuguaaauauauuuacugccagauaaggcuuucagauacagguagaaaggaugggucgagagagaacaauaccaguacacuguguucccauuuuauauguaacugcuugaguuucagucacguacagaguccuacaguguuuuguuacuaggaaaaccaacucucuagcagguucccauguuugaaugcucaucccugggcaauucagguuucuuugacagucuucuggaagagaaaucacugagaauggagaaggagauaguuuaguguaugcagugcuauuacaagaguggaucuuuaagucaaaugcuuuuuucuucagaucuucaagauauuccguacuccgauuggugcgagcagacgauccacaaccccuuagaagugguucccucuaaguucucggggauuucuggcugcagcgauggcgcaucucaggaagaaggcucagccagcagcaccaaaagcacugagcuguuacugggugagucuugagguucaguuuccuacuccuuaauaaaacaaucuucaguugauuuugcucauuagcagugcgcuguaguuaggguugucucgggcucugcaggucgguauuagugaaagcauuuagcagacucuuaaguaguccccugugucauccguccucagguucccugucagggaucugccuccuccuagauuaugugcagcugauugcaguuuuagcugcuuguguaguuagaaaauaauuaucaugaauuguaaucauucucuguuguaggcgauaggggaccucacacugaugucuucauuccagguguuaaaaccauuccagaugacacacccaugugccggauccugcuucguaaggaagugcuaagauuaguugucaauuugaguaguucaguuuccaccaagugucacgagaccgggcuucugacgugaguaacugcaugaugguugucagcuuguuuugcuuguaaauuguaggaaagauacgagugcucccuagcugcugucacaggcuggguucccaccugugggugggccuuacaggugauuggcuguggcaccucagucugcagagcagagugacuacaagagggagugaggauucagccagacuugaaacacaauaucuaaaagcggggccacucuugcacccccucuuuguuuugguaaaauuuggggguuuaauuaaauaacuuacuuuuuaaccuauaaaauguuuuuaaauuuucuaaauaccaguuucugaaauaauuguugguggcuauaacucaacauacaaaaaaaaaaaaaaaaaaaaagcuuuuuagauuucucaaugacuuuucuuuuuuuugagacaggguuucucuguauagcccuggcuguccuggaacucacuguagaccaggcuggccucgaacucagaaauccuucugccucugccucccaagugcugggaucaaagguugugcgccaccacugcccggcucucaaccacgucucaagaaaguugaggagaccuaaagagcacaagcuugaaaggcagccgaggcugcugcgaguuccugcuuaaccuggguuucucagucagagccugaugaaugacaauugugagaaaaucaucuuuauuugcacagcucaggguugugcaagcagugguugucuaaagacguauaugugugcucuguauguguguuggccgugugguccagagcugcaagagugaggcugucagcccagccucccacccacauggcugcuccugacgugcuguccucauggaaagauagucagccagagauaacuaauaacuuaaaugccuuacagugugagcauguuauguagucgugcuagucuaauaaauacaauucauaauuuccugguguuacuggaaaauaacuuuacaauaagcacucagaucuugauacucuuucaaaaucagacacuugaacugucuaaaguguaaacuagaaaugcuucccaguaagccagcuaugguggcauccacaugucauccuggcacuggaagauggaggcaggagggccuggagugcgugaggcaugggggcauuggucaaggcuggaggaaaagacagacagacagacugacuggcuggcugacugacugacugccuuauacuaguaaggcacuguugcuaacacuccaucuagucaguauccggggugagggaaacuuagcagcagugucauuugcugggguggagugaauauaucgugugcuauuuuaucacggcguguucucucuuuuaauuuuagcauuaaagagaaguauccucaaacauuugaugacauaugccuuuauucugaaguuucucaucuguugucacacugcacauuuagacuucagugucggcgguucauacaagaguuauuucaggauguacaguuuuuacaaguaaggaagacuguaguucugaaauuugucucccagaauuauucuguauuugaaguugaaaguuuaugucuauauuacauaccaauuuuauuuuuuaaaaaauuaacaguuuauuacuucuuccuagaugcaugaagaagcagaggcuguguuggcaauuccaccaauucagccuauaguugaugagucugcugaauccugaccucaugcuuaugacguuuauagcuggauacucuauauguauuccuacuguggacuuccugaaagccccacaggauacugacuggcugacagugaggcaggagagccuucugacacuggccagcaguuauugguacagaacagcugggacugcuggcauuccuagccaagccaacuucucucccgcguugggcccuucucgggguucgugguucauuaccaugguuuuaauucaguuaccaucauaugcaagagccaagcacugaauaucuacauagguuuucuauuuuuuuauuuucaaagcgcaauggcaguggaacaaaacaggacaugaagacgcauccuucacaccguuguuuucugaaugcuuuuuaaucaaggguaaauacaaaagaugccuuguuuguuaacuaauuuguggaaagcaggagucacugacuccgagacugcauccuguuaccccgugggcuguaacugcugguaucagaggaacacacucgccuuuccacacuucuuaaugucuguaacacuacuucagagguuuauaacuucacagcagaaggaacaccucagcacucggaacuuggaaguuaguuuacgaugcuagaugcauaaggaugcuuacuuguccucugucgcuucagguuguugcaauacguuguuaaaggcuauuucuacuaauuaagguuuuucacuaugguugugauguaguaaggaguaaauacuucucguguucagagcacauuguacccaaccuccuccacuccucucaccacuuacaagggacugagccagaugagcagucuggacaaagcaaaggaagcaugaagugaggcugcagucucucaaggaaaagacagcuuugccugcaguuuacacauuccaugggaaaaaggaagagccauauguccuauuaaaacgucauugagacucguuauuaagauucagaauuguggugaaaagccuuaauuacuaaauuuuaaagcagcgauaauuuaauuuuuguuaguguuccuguuuugcauaaauugcaguuauaggugaguuaaaaguauagucauugccuuuaucacauuugugaaguugaugaaggcgagacuuugucugucuaauuuguuuauguauaaagagacuuggaaaucuucacaggaauuaaacauauaugcaaauuuguacauaaaguagcaugaacaucauuacuagacugcuuacgcgugaaaggguuaucuuggaacaaaccauccagcugacuaggacugacuaggaccuuugcaauuccuuuguguaacccauuuuacaauugcacaucagcuuuaacaugucauagacauugguccauauuuucccaugucguacacccuucucauaauggucuuguuugcaagacugcuguaaaguacccugugaacuagaaaacauaacucacagaaauuugucuuugaacuugcuggcacugaaaguuggcacugagacgaagcauuuccugucccuccugacuccucuuugacugcacuugagcgaguuguucuucugugcacuguauagcaacuuccaugauaacaaagcagacaagggcucuaagcugcugcucacauuacagcacaguucgcauuuucccagaaaauucagugaggguaaaacuuucuuuucaacuucaucacugaacccguguucauuaaaugucagcagugcuugaaagagcaugccuaucaccuuggucuuuggucuuggacaauaaaacugccuuuccagagaaccaaaugucagagauacuagaccaaauaaugguuacaauuccaaaggaaguaauguagucuuauucauaaaugggauuaacauuuuagacauucauuuuaaacacuaccucaguuaacagaguagaaaaucugugguuucgucccuugagaguuaaugauaacuauucuuguuuguuuuucuucacacaaaacuaugcccauucucgcgcccaagucagccaucaugaaccugaggcugugcccuaguguccuaagccaaggauuguguuuucacuuugacuguuacuuugaaaggugugugugugugugugugugugugugugugugugaucauaucugccuauagcacuuacuuugggaagauaucagagcuuugugaugaucaguauacugggggaaauugucuaugcuuaaauuuauagugcuauuugguuuaaccaugguuucaccaacagguguaauacauuucuuuuuaaguacauguauaaaaguagacuuuuaugacgaaaacgacaugcagugccaagugauuagcauagguguuuaagacuauuaaauuauagcagaaaagguuaugaaugaugucaaugguaauagcaaucauugaaaaauugucuauaaauauuagauauuaccaaaaugucaauaccguaguuuuucaagaguuuagaauuaaucuuagucauauaaauuuguacuauugauaauuauuuaauaauuuggaggaguuugaacaguuaagcugguuguaaacugugaauuucuaauuguaaauugucauuucuaauugaaauuuuuucaagaacagauuucagcuucacauacuaaguacugacaaauaaaaaagugagaaauuuaguauuuauaagaaaauaggcucuaaaaugucuuaugcuuuucuguuucugcuuagaguauaauggaggaagacaguguccccugaccuaaguguuucuaauaaagaguaaguguagagacaucccacaagacagcagcagugcaaggcucuuaggaagugugugcacuguugcuguggugauguauccaagucaccaggagccguguccucaggagcuuucggcucuuguccagagcuugagacaguugaagcuggguuccaucacugagaccagaugugcguaggggcugcuaguguguguguaaacugcccacugcuguuuccaugcacucucagccccuucagcugaugccccuggugccccacucaaagcacagaccauuaagcaauaaacaaaauugucauucaaauuauaauugugguuauucuccugugauaagaggugcuaauuuugugugagaagaacaugugaccucuuuggaaauauaguuuggaaguaaaguuuuucccccucuucuuguacuuccauuuugucccaaauucacaguucaugaaagaaaaguaaaauuguuuaggagacuucuaagaagagcugcuugcaauaaacauuucagauuuucccgagugugaguugggaaggucuccauuuccuccauacugacaaagccuguuguuccaacgucucuuagcuuggagagugucucuacacugagucucaccucagccugccagugacccugaggucacugcugaggaagacacaggagucugcacuagucuuuacaagagccguugucauuucagguccccggggguucauuacaguacauuuauacaacucacaagagugugggauuccgccccuuugaguauuuuuauaguuagguggauaacugccgcagaugcauggauugcacauuuugacucuauaauacuuaguaugaaaaauuaauuuaugccaaaaaaaaaggaaacauaucuuacaauuuccccaacuagguugaucuagcacaagaugcaaagucuuggggcagagcgggagugguaaaaucuuuuaauguaugauuguugaaaaauguuccauuacuagccugucaaaaacccuaaugaugcauuguaaaacaaaugauguaaauuaaauuagcuuugaaaagugguaagggauuauaaagaggaucucagauuuaaugcucucugaccacaugaccuuuuuuuuuuuuuuuuuaguaauacgcugcuacauuuuuggagguucugguguuuguaggucacugaacagacauugaaaucugauuuauauuguauaacuguaacauagaaagaaaaaguauuuauauauuuuccuuaagaauauuucauugaguuguguauaauuuaaauaagauuugucccaaaaugguuuugcucacuuugauuuuuuuguuguuguuauugugguuguauuguuuuuguacaauguguacaguuuauguuaagggcauuaaagccuccugaagcauaaucuuaucaaagggauucauuguuaauaaaauguacuuaaaauucuuaaac

SEQ ID NO: 7670 - RNA, 61395 nt, Mus musculus
gcuguggacauuuuaccaugcagccauaaagagaggucaaaaaugucuuucaagugcccgguuaguaaagaucugauggcguucuaaggagagaaaggaacuuggaucuucguggacaaagaauucaggucuguagcugaaggaggcguggccacacagggcguuuccagguccuguagaggaagcacaguucauagaucucuguucuaacacgucugucuugcucugaacgccgaaagucaacucgaucacaaguuugauccaacaguuugacauuucagguaauuuucagacggagcgcugggguuggaucucccaagcaacacaauuggcucugugcaggacaccuggcacggggcacugggucgcagcucguccccucucccuccaggaacaacgaugcucaaggaccagcuuuuccucccaggccucucccacuucccuucucaccggugcugcccgcccggucccgggaaccgcgcccgucgcagggucccgaucguuccccccuacauccccuugggaccaggagcaaauuccugugggucccaggagugccaaaagugcucagcgagacgggaaauugcaacaguacuuggccccucggcccucccccggcgcuuucccguaacucccgccccuggacacuugccccguaguugauucauagcuggggcgcggggccgccuccacacgccuggacagacguccgcgcccguuccccugugaggccgaggaccggcaaggcuccggagcaggucgccaggcgggugaguacgggacccgugugcccgcgcugccgccuccauccacuuuccgacgggcgagccgagagcuuugcugccccgcgccucugcccuguccugcguuaguuuuugccucccgagacugcacucucaggagccgcaagagguugugccagaaaagugccaccuaauuggugggcaacucuaaaagacuagauacucucagcgugcacgucgcugggacaccaguccaggccugcuuugagguucaccguccccuggccucucacucaagcagcuggggaaacacuugcugaguuagaacucccauuugggccaauuugguuucucucacaauaccccgugggagugggaguugaugguuucccccagccucuugcuuuccaguccuuaacucccacccgucccugucauuucuccgggacuaggugcuucccucuccacucagagaagagcaccccacagccuugggggcagagcuucuaugcggguggggagagcagguaccaccucucgagcugcuugaacggaagugucaccacuaacaggcaaggaugcgcauaggggucagugucucugagaguaggcaccagugagaugcugaaacgggagcgugaauacagguucccuguaacaguucuugacgggccgcuuguucacacacucuucaucuucccugccugccuugugagugaccaagggcacagauauagggauuacuuucagacggacagaugcuaccugccugcaggacauggugaaagcgcuuugcgaucaagcuguuuuucagcucaggacucguggacgugaggauggauguaagcaaagcagacagaauugaaaguggaagcuaggugcagaccaaaggcauucugcuuuugagagguggugguggugguggaugucgggggagaccgugugugugugugugugugugugugugugugucugugugucugugugucugugugucugugugucugugugucugugugucugugugugugugucugugucucucugugugugugucucugugugugugucucugugugugugucucugugugugugugugugugugugucugugucucucugugugugugugugugugucugugugugugugucucugugugugugugugugugugucugugucucucugugugugugugugugugucugugugugugugucucugugugugugugugugugugugucugucugugugugugugucugugugucugucuguguuugugugugugugucugucugugugugugugugucugucugucugugugugugucucugugugugugugugugugucugugucugugucucucucugugugucugugugugugugugucugugugugugugucugugugugugucugugucugugugugugugugugugugugugucugugucugucugugugucugucugugugucucugugugugugucugucugucugugugugugucugucugucuguuugugugucugugugugugugugugugugugugugugugugugugugugagggggcaggucuggaggggcagcgauauccccaauagguccuaacccugauguaaacagacuuggaacggguucagguuaccuuuuacaucuuaguuucaguuuucuuguuuacacaacaauacaguuuccuauaacuuuugaccaggaacugugugcuucauuuuaagcgacuuuauggcaaauaguuagaugacagacuggagacuucacuuccuugucucauagccucucugcuauucuuccaauacuagguuuuuuuccggaguggggcugaggucucuguacugcucuguuuugccugggaugagucacaggaguuccccaguugaccuguguuugagaaucauccuuggucuuuuucaaccacaccuacaucugacaccuccugggaauaucucagcacagugagagauguucccaggcuaggaaggucgacuacuuucacugcuggguacagcuaggucaaugccaccacuggccucuuuggggcucuugagucccguucugucucuugucuguuuuucaucaaaggcagagagaaugugagagaaugggccuggugcuaaguguccagaggaacuuaagccacaagagcacucacuguggauggcuuucccugucuccucuucaucugcacagcccagagucuaccuguuccuaucccccaccccacccuccaccccauccucuccugccuggggaccccaucuccagugcacaggaaguccguggguguugauguuuuuguuuuccuucgucccgggaaaagaaccgagucuggcacacugguacaguucuggaagaguggcuguccaccauugugccggugucaagguugguguuuuccccgugggaacugggcugaauguuuacagacgcugaaaggaaaucagagugugcacucucgggcucguuuaugggaacaguagguuuggcccucuucucuggacaggaaaccuuuccuagagaggggagaauaaaaaacaaaacaaacagcacacagugagauggagccaaagcacacagcauuuccucaucuuucuugagaagaccccucccuaaaacaaacuuucuugucccucccuaccuguagcugacccuggcuucacagucuuccuuccuccacacuuuauucucuggcuucccaggucuugcuuaccuuagauuaucuuugaacuggguugcuuugaaguaacccaaacaacaacucuccuuacucuaacaguggagaaguggcugcagcaagagccuuuccucacggcuguuaccagucugaaguggacaggcaguaguagaguguauuauuucucucuguugugacaaaugauggagaaaaagcaacaaaagagaagaaacguugcuuuuggcucaugguuugggagauuauaguccaccaugagacagcuggucacgguguguuggcaauuagggaggagaggaggugaauguuguugcccagacagccucucuccccaucccgcuccccauuuccaucccguaggagaugcagcccuauguagggauagugcugugacacccugaaagacucauccagagaugugucuccugagugauucugaacucagucaagcuggcaaugcagauuaacuaucaugacuugaccacucaccaacuugacacccuaacaucacuucuaagucauaacgugauaaauaucacucuaagauacuuuuauuuauaaugauuugaaggacauaucuacaaguuuuucaaguaugucuacauauguaaauuuccuaacuguaguguggcgcuuccugcuuuacagcccagguuggagagcuuuucccacaccugugcaugauauuuugccaaggguuuccugcuaaccuuaagcaagauaaaauuuauuuacccucucccuuagugauggcuguuuugcuuugaaaacauauuuaagauuaacaacaaugccucagggaagauacugcauucaucuuugcucucaacuaugaauauugcuguggagucgaaccccaggagagcuguuuugagggcaagcaucuuacagcacaccucugcuucauagaucagugcacaugucaacaugugaaguuuggauacuccuuaccaggacaaacacaaauagauguguuuucaaacuugggaauggaugagacaaggcagcauuuuauuuuacauuuuguuacuuaguauuccaauuuacuauuucuacauauuuaugaaccaucuguguccuaugacgacuaggucacaccuuuacucagucuuauauugagcuguuuccucucagucuuuaaaaaauugguuaccuuuauuuauugauuuauggguggggagguuguuuaugcuacaguggacagguagaggcgaaaggaaagcuuuggggaauuggugcucuccuuccuccaugugggaccuagguagauaccuguagucacggagcuaucuguccggcucgggguuuuucuaauuuuaugcacuguagaaacucggcccugucucagaucauaauacuccgugugcagcagacaaugcaacgacuucuaccacaaagcugccucuucucauuuuucuuuaaucgugggacgagacacauaucacagcaguuaccaucuuaaccaccguacguauaaagcucgcugccaucuaggguguccacagcucuccagcaccccguucccgagccgaaccggaaauggaaccacaaguuugaggcaugaaauagucacuuucuucccuccuguucucugcaucagccaauccucucuguguucuuagcuggaccgaugaagggcucucauaggagugcagucacgcggcauuugugugucuaugucugucucauuucgugucacacuuuuuaaaaccccacuguagcagcuauuggucuucuccgugauucugaggccggcagcacuucacugucuaucuaucuccuuccucaugcgcugcuguggugacgauccucugcuacacagaaacuguagguacuggcguuaucaguacuuuucgugauuucugggcuuugccuaauuugggaaagucuuggucacugaaaacuuaaaugaucuuauuucugcaaauacuuuuacuaguuugguuuuuaugucauaacauuacacaucguauuucuaagaaaaaaugaacugaagauaaugaugggacuuaguucuuuccuaaaauucuacaugguucuucccaugcucuauuuauuuaaugcucuaucauucaaaacucagcuuaugcccuguggggaggguguauaaaacuaaggauaaacuuaaacucagaacucccuccccugcccuccugaaugcagagaugcuuguaccaaggugaacuuugguuuucaucauaaaaccaguuaucucuuuguacccagccuguuucuggccuguguucuucccagugauccuugagcuucuuuccugucaauaccaugaugcuaaguacuggagcuuuaauagaauauuuauaagucuaaaauauauauauauauauuuuucaaaauagauuucagagauguuucuccuacauuuuuuuacuauucuuguaaaguuccuaaucuguuugguuuaacaaaauucggugggaauguuuuuuaccgagucugcaguuaucagcagggauuuuuuuccucacuguccacucuaauaugaacaccaagcauggaggagacaaugguguauagguagggguuggccuuuagcaaguggcucaccugguuucaaguacuaacuugauaggugacaagcugugucacagggcaacuuaccuuugacuuacauuauccuuagcauccuuguuugcuucuagggauaguaguagacucgccuccauagggcuuuuggaaaauucauccucuagcucacuuaacaaagcagcaggcaaaacauuggucuccaggacacaguaccugacagcacuuucacaucucaauguauagccuacauugggcuguucugggugucuugcugauagugggaacuaaccaacccuagucuuuauuuaucgauaguauucuagaaaacacacgugugcaguaaaugcuggcuguaauacagugccucaagcauccacaugcuguucagucaccagggguuguggcuuauuugccaauuucucuaccaagucuacuuuaaagugugcccuggguuuuucacuccgaacaagcaaucacauggcuuccaugaccucuaacauaaccagccacuguccguccucaguccacauuuuuuaauauauaaucuuucaaugaagucuaaaauuacauugcgaguaauuauacuuccuauuugcgauaugcggggcugacgugccguauaagcuguuuucuuugauuauugcaugguaggugccgagcacacaucucagucgauaaagugauugcugagaaagaaugagucccugaguuugaucuucaauaccugugauguaaaacaaagaagagaaaagccaggcagggugacaacggcuucuaauucugcugcuguggaaguagaaacaggcagcuagaucccuggaacucacuggccagccaucccagccuaaaucaucuagcacuuaguccuaaugagagacccugccucaaaacgcaagguggauagauccuaaggaacaacaccuaagacugaccauuguccccacacacacguuuacauauauagccauaacuaaauuaagauauuuuggauuaauuuaacuucacauauacauuuagcgucuauuccucagaagaauggaaauauguuuuuccacucaggacacgguuucuuauugcaauuggaauguauuaguuuagugucugcacugagggccuacaagcucacagguuuuaaacauaacaaaggacauacccuaggcuuauuaggguccuaaaacuuguuaaccucuuucagagcugcuuaguugccauggcuuagaauaaaaucagaaaacaaagucagcuagucaauucuccuggcauauauggugcaaauguaacuuuuuaauugaaauucucaaaaaguaaacagaguaauuacuaacaaaagcucgcaaaggaggauuaacuagaauaaaggucaugcguccagagaaaaauguagaucaaagaaagcaaaaacccuuucagagcacaaugaaaagaaaccuauaaagaagaaacuggggugugaaguaucaguuuaacaguucuaaaagcaagcaaagagaccaugcugagaggaaagaacagcuaauaaggggaaggggauaugcaaagaaaaauagagaacaauagcgaugaaagaaagaaagaaagaaagaaagaaagaaagaaagaaagaaagaaagaaagcaagcaagcaagcaagcaaauauaugugcaacuaaacuucauuaaaaaccgauucaaaccccaacaguuacacccuguuaaaugaguacauuuauuacauuauuuaauacacacgcaugcaggaaugcacacccgcacagauagugaagaggaccuguguggaggacugcuuccagacagggugcuaugcuuuagcuagaauagggacagaccuguugaagcugcuucucggaggaguccauugcaggaggcuuagcuucgucacucaucaguggauacagucagucacgaugcccaauugucaggcucuguaggacggagcucugagcaacccugcagcccagugcugugcuuuuccugcagagaggcuccagugcaaaugcugcucugaagcuugcuuguccacuaaguaucuuggaagacuccuuuaugucaauacauaugucuacuuuaaccuccucuaacaccguggagauuccccuugugggaugccugguauuuaacauuucugguuccucugaauggucauaugauauauuugcuuuaucuguaggguaaaauccuaacaauauagccauaauugguucuggaucaagucaaugcacacuguaagcuaauggggucaauaugcgagguuacccuccuugauucucaaugagcaguaugaugugugugucuugaacacuuacuggugaacagcauuggugaucucaagagcauugcuaucucuguuguugcccagacauuuguguguacaauuauggcuuuccuuguuuauuguaacuguuuugagacaaggccucacugcauagcugugggcucuccuagagcuuguuaugaagaucaggcuggccucaaacuugcuguaauccuccugccucugcccccaaagugcuagcauaacaggcaugcaccacauaucuauuuuaaguugacuuuuauuaauucccacuaaucuuucuuaauuucuuuuuuuuuuaguaugugcuuuuucuucuuuucuugaauuacauuuuccuguuuucuauagcuguuugcccuuuaaucuuauuuuuagcagauuucugcauauugggaaccauaacucuuuauuguacauuucuaguuaauauuaaaucuuaaaaaugugugugugggggggggucaggaaagcaaccuuuaucuuuacugcuuuacugauuuuugguuuuguaugauggcugcgagauuacaaaaaaaaaaaaaccaaaaaacaaaaaccaacaacaaaaaaccccaaacaaacaaaaaacaaaagaaaacaaaacaaaaauacccagacauguuuuauugagccgcuuuuguugguuucuaucuggaaugucuuuugcuggaaggaguagcaauaaugauaagacucacuggauuuacuaugugaacugucucuuaaucucaauccauuaauccuccugucucuacacuaauauagccucuuucauucucauuuacagaagaggcaagaaagagcucucacuuggucauacagcagcuaaguggugcuugacccuauuagucuccuaucacaguccaggacagggcagauacuccuucuuauuguucuaauaucauucaugggaauaguauagcucuucuuaaaugauuuugauaccacauuuagcauauacuaaauuucugcaucucuuuuaaucuggaauauuccuuggauugggguuuccauuucuucuuuuggcuucaccaguucaaagcuuagagacuaagcauuaacuaacugaagcugaggucacacaucccagaaauguuuaacugaacauugaguuagaacuaauucagcuccuuaagacaggauuugcuuuacgaacuugguggacagauguuauccacuggagagaugcacaguggggauggagaaggaauucugaaaucucccaggggcauuuguccuggggguggagucugagcagaagggaaacuugaggguggggcuggggugagguggggcuucaagucaucagucuuauagagaagcgaugagaauccuucaaaggggcuucccaauccuaauggcagugcccuugaaagaggagacgaugcagaaccuccuccaaacacaugccacuccgcgcugccgcacagagcucgcgauguugacuuccaauguuuccucguugagguugaaaccgauucuugcuaugauuucaauuuuuagaaauuuguugagacgugugguuuaccauauaaccucucucggagaccauucaauucuaaaaaaacgacuuucuaccccccccccccccacacacacacguaaagagagagacauagacagacagacugacagaauggcauuugcaugugauagcaguggcucaccgagccaguuuuuaagaauuuggcaacacacccagguuugaggaagcaaaggacuguugccacugcugugucucaugaggcuuaucugugguagagaaacuucccagggauaucuuagucgugcugagcaagucauccugguaugguccucggcgguacguuuaguaccuguguaacauucacacggagagucagagagccuggagugagaauaggagugugcagauacgguuuaaagagcagccacgaccgccaaagaacacagugaagcaagcaagauuuucacacaugugagguguacuagguugauauaauuaaucggaaucccaagaugaggagaggcauggggagggggcaggagugaguggaggacagagugucgguugaaacaugccuagcaguuucuccagcuccccaaccccugugggccaaagguuaugaacuggguaauauuuggugacagaagauaaaaagaucuaaaaagaaauuaauugguguuuuucauuaaaauaaguugaaagaggagaggagaagcugggagaaaacuggcgugcauuuuucuucauuucccagauguuuccugaacggcagcuguguccuaggacucuggugcauggugugucucagacacagaucugcucucucuagugccacggaguccauugauauuggggagaggcgaaaaccaacagauucgggggaaaggacuuagcggugccgacagacacaccccucgccaucgucuucuuagugaaaauggggagucacauacugcugagagcagggagcuucugaggccgcugugugaauuugaggcuagguuccuggacguguuguaccccgagcaguggggaaucucugcuccauaaguagguacuggucuaccagcccacacacccuccuagccacccacagggcucauccuugagagugcuguauagcuaagcuuacccuggguuuuaauauuucucugcaugguacaugugcagucaguggagacagcguaggccguggaguaccccacagcucucagcuuggacuuugucauauuugauuucugccuugacagucauguagccccaugugguacuuggcuuucuucuacugauacaggaauucuguauauuuagcuggcugcuuaagaucuucucuugcagaucaaacuuucaucuggagcugaguuucggauagacucccaauccauccauuugaucuucugccuugcuaaaugggggcguuagccaaagggcuugagcugaaauuuuugaugguucauuugguccccaccccauggcuuaucagcccugccuuugaaaucucgcccuaacaccaccacacuuccacaguccaacccugcccucuacucucacccggacuguugauucugacacugcugcuuucuacuccuggccccccauuucuuucugcaucucuucgucucugcucuguguucaucaacccaauauaccucuguaguuuccagugccucaccauggcagcccacaggauucaaauaugccugcucugcucugcacaaacuuucaaucucaucccaggacuuccuucccugcucaucugcucccuucagccacaucuuucuccuauuuguucuugaucuucuggccuuucuuccuccuccuuaucgucccaucaaaacaauaggugacauccucagaguaggguaauuugggaaggcucuauuaccaggcauagugcuccuccccugaccacccccacccccccaagguucgcaagugaacgaugacuauuucuccagagccucuggcuguuggaggguuauuccugugugguuuucagaagaaaugcucuauugagucuccgaguuguugcaccugacaacucucauucugcccauuuuaaaggacguuauugauuuugccaggaagacugcaggcaacagugacaccgacagcagcaauggcacaaacaaguggagccauacauaguagcagccauuucagaggcguggggaccuuacugccaagccuagaaccugaacuugaccuuggaguccauaaaacagaggcuguugucugaccuccauguguaccccauggaaugagagugcaugugcacacacauacacacacauauacacauacauacauacauacauacguacaucaugcauacauacauauauacaggcacacauauauacacauaaacauuuacagacacacuuaugcacacacauacacacacuuauauacacauauacaugcagacacauauacagacacauaaacacacacuuacacacauauauacaaacaaacacauauacauacacauacaugcauacuuauauacuuauauacacauauacacucauacacacauacacacauauacgcacauacacacuuauacucauacauacaaacauauaaacacacacaaaacacauacaugcacacaucuauacacacauacacauaugcaugcuuauacacauacacacucauacacauauauacacacacagacacaaagagauacacagacacacauacacagacacacagagacacacacuaaauaaauaaauguaacaauguguaagcuuaccuacuauuucuggacauuuucccauuguguugucaaacuguggcuggcugaggagccccagcugugaagacaguuaaacaggaggaaggcagauuguagaugacaagaaaucagaagcaauucugucuucauggcugcuagaggcgcacgugagaccuauacgguggucuuugagaauaccuguuuuccagcugaguugccuggugaccuuucaccucucguuucugcuuaccaucaccucugaauuucucagcugaguauuucuguaccuggaacuuuaacuucuugauguaaugccauguguuuaggaauguuuuaaauggcccugucauagagaaaccuauuugagguacauaccagcuccagagucuucuguuucaacuuucugauaugagaguuccuucccacaguggccccuucacgucccaagagugaguugggaggggacagugcuaagagccuggacccaggacugaagucacucucagcagagcggcacacacauccggucccacuaggccucuuccguugcucccuggguucugcgcacacaggguuucucccugacuuagcucuccccucugguucuggcauuccguuagcgugugcuguuguaaguagagaucaguuaugaauggaaugauguguuggccaagaauagaaugcagugcugacagaaaugugcagaaaggcuggcugcugcuucagagcucacuggugucuaucauaguccuuuccuuuauccaguucuugucuuuguuguggcuccaauuuaccuguaaaacacucuuugagaauaaacaggugugacgguggaacacauaaacaggcucacggaaggucuagcucuggaaccagaaaucugggcagcagggcgaaggcaagaacuuggcuaaacaugaaucucugcugacccagaguccuaaagagaaaaguaaaagaccaggacuuccccugacuacugggcuuucaaccauuaaacgaagaacgagcuggucuuuuugaggucauccugccaccuugucucugcccccagauuguccucugaucaaagaccugauaagccaguggcucccuuuaaagggccugcaauuugcaauucucuuccagggaaaacaaaacaaaagaaaaggaaaaugguauugaauaaugaaaacuucugugucuuugaauagguuaacuuuucuccagguugaauuuuggugagagggaaaggggagaguauaaaugacuucggugauuauuauuauuuuuuaaauuauuuguuuaaaaaauugaaauaauuuauugauuacuguuugugcaguuauuuuugccugccuguaugucuguguaccguauuugugucuaguacccacagaggucagcauaguauuaguuccccagaacuggaguuacaggugguuuugagcuacugaguggaugcuggaaaugggacccagguucucugccagggcacccagggccuccaaccugugaggcaccucuccagcccuucacgggguucauuuaaacugagcccccuugagacuauauuuguccuuuuuuucaaucagcuuuuguuuguucucuuucauuuuuaacuuuuuucuucuuuaccagcuuuguuuggauuauucaaaugagcuggcuagucauuaagcucuugcuaccaaaccucgguaauccauaguaggacaucuucaccgcucacucaaggcagcaauccaugguaggacauccucacagcugacucaaggcaguaauccaugguaggacauccucacagcugacucaagguuccuugagaccuaggcuucugacuugcacccugucauuugcaccucuuuuauaagcggagggacacuucaugggacagggaaaugugccuucuuccuccaaagacagaugacaagagacacagguaugggaggaauaauggaagacuuucgucccaccucugaccacaguugcccccaagaagcauaccaggaguuaaagcuauauaaaaggcucuuucuugucauuuaucuuuuucagguaaucagaccaauggcuuucucugugguccuucauccagccuuccuccuggcagugcugucccugagggcaucccgaagcgaaggugagagacaagaacacgagaagggagcacggaaaggugcuccaucuggugcuuuggagaacgguuaagcaauuuuccuuccucagagcuggugauuaauucacaugagaggugguaaauuucuggaagccacaauugccucgggcguguccucccucaacugauagcacguuuaguaaguccacuccuuagcccuggcugccugcuaggugcucugcucauugguauggucgugagcggaccugagacuacagagcuucaugauugcucuguuggaucuacaccacugccaagguauuuccuucugaaccuugcugcgcaagauggaacagcccagacuaguucuggcugcugaguuagaacaaguuccaaugccccuuagccacacuuugcugagagcuguuaagcuuauaaaauauggcuaaaagcaaccgaagucuggaaagcaguagaaacucucuugaguacaaacaagguacuaucuucaaugccaaaaucuguugacagagaaauaauguuucucucuuagcucuccucagcagacaguaguuuggaauaaauuaacuuuguaaaugcauacaugaguggaaacuuucuaucaaaugugucuggauacuuuauuacuuugaacuuuguuaaacauagauucuugaaagaguuucuguugggucauaaauuucccugcauuuguccauauuauacaaaacuuuacaguuuuuuccuucuuguacuuauucauugcuguauuugcuuuuuaacaaagagugcagaugacccauccaugcauggauuuaugaaaaugacacuuggaaagaauaugcauagaauuacucguuuaucucuuagaacuacaggaaaaguuauaugggaaagagggaaauuaguucugcuaauaguucaaguucugccucacaucuuuuacaucuagguuuggucuuggcauuugggaauauacuauuuuuucuggcuucuuaaauaucaguuaguugaguucuucaacuauauauaccggggcuacaaggugacugggcucuugcccuguggcauguguaguucccucggucuaucuugccugcuggagucucaguucacugcaacugagcagaggcugagugagcauggaggauauuuuggcccagaucagagccccugguucugagacacaaaguccuugcccugagggacucccaagcaucuacaaaguuuugccacggcuugcucacccagcagagucucacgaugugaccugacuguucauggcacaucuucuccaugugaaacauacugcucucagaucggucucuggggcucuguuucuguuguuuagcucaaacacauuucccucauuuccuggcaaccacuuucccauuucugcuuccaacuuucuuuacaaaacaggacuuccuggguaggucuuccuuuucaccucaacugcggggacuccuuucuauuucugcugccuacuauauccccacacaaacuacugggcuuaccacuuauucggcuagccaggcucaggucggagacuguauuucagauaaccugacuugacuuuuuccaagcauacauauguaagacccuucaguuaacccuggccauguuuccaucaggcuggaagacuugacuugauguauuuuucugucuuugggauauauauauauauauauauauauauauauauauauaaauaaaacaauuguaaguaaguggugaauuuuaaauuauuuuuacauucacuuagcaugugugugguguguguguacacccauacacugauguaccugcauauacaugucaaaguuaacguguggaggucagaagacaggcugugggaguugguucucuucucccaaaguguagguuucagggauggaaacucaaccuuguuuggcuuagcagcaauucccuuuaaacacagagccaucuugcuuuccucuguuacacauucuaacaaagguuaagucaugaucugaagagcaaaacauuauuacguguguguguguguguguguguguguguguguguguguguguguguacaaauacaaugaucuuaucucccuuccaggaaacuuuuuuaaaaaauuuaagcaauuagguaggguaaauguuuccuuuugaugauaaaagcucuuggcaucccacuguuuuaaacacuguuacaugguaucuccuucugggaauucaccacauauuauuuccuccaguaguauuagggcuggucagagaaacuuuaugggaaaagugggaggcugucugugacuaagcccauguuugaguccccagaugaucucuuuagccacacuccaguuucauggaaugagagcugcccugggaaccagaaggccuaggucuagucugguguauauagcuuuggcacaguccuccaccuccacauuuaagcucaacuagcugcucugaaaaaaaucaggggguuggauuuacuaaucuccauggucccuaagaucucuggcuucaccuuggaguuuucucucuucccuccaucccuccccacucccacauuugaguaacuaauguuacucaaaucccugagucauuccacacaugcugauaacauaugucaacuuaaggaacuucccucuugcugaagcaacauaaggcaaguggcuagagcuuccagaaauaagguuagacagggagcugauucauucauuggccaaucgauuguagaacacucacacucacucuguguuauuaaucucugcuucccugagcuaaguaagacuuauucccacucuggucuccaucacagccaacccaccgcagagaagccgccuguuaccgucggcuaugagcagggcugagaaaagccgcgggucagggagacacagagagagcauggacauuauguaaaguuaccaugacaaaacauuugaaaaggagcaggugaaggaaggauuugcuucgccucccaguuugagacacagucugccaugguggggagggccuagagggaggacuggauauggugagagugccucaguagccggcuggcuuugccccuuuuauucagccugagcuacaacuccauugauguugcugcccacauucaugguggguuuucucuucaguuaaacccuuauggaaacauccucguccacacacccaaagcuguguuuccauguugacucuaaauccagacaaauugacaaaaugauccuggguuccaaagaaccacauugauccugucuaagggcagucuaggcaaugacuaaccaccuuucacuaagacccucucucucucucucucucucucucucuccccaccugucucucucuccucucucugucucucucccccuucccccucucucacucucaucuauccauccauccgucuguuuauuaauucauucauaaaauauguuuuaauugaaauagaauuacacuaccacuagucacugucccuuuucucccuccaacucuuccagauaacccuccucuaaccucuccuaugaucucauuaacagccucuuuuccuuucauuacuauugaugugaacauacauacuuacuuucuuacauauauacauguauguaugugugugcacacaaacauauaaauacacugugcugacuccacuuugguaguuuguaucuaugcuuucagggcugaccaccaauaaggggcgcucguuccuggagagacuaguacccugggaaaggcuaauuauucucccagcaaucaucuguuacccaucguucuugaucuaggaguggaaucccuguaguuucccauuccacauuaacauauccauugauguugcuguugguuuagucuuguuuaugcagccaugcccaggagaaagugucucaccaccgacuuucugacagucugccucuugaaaucaguucacccuuucuucugagauguccuuggagccacagaugcagcugugauauagagauauccaucaggacugggcuccacaggauguguuuaucucugauggucucuauuugcuguagagaaaggcuucuuagauauggggugguaacuacauuuaucuguagguacaaggauacaauuaacauguagugaagaauuaugcugguuuaguaaaauggccauaauacauucuuuuuaaaggucugugaccucacuggccauaggaggcuggcuggguuuccaguaccaggugugaauuccauccuuuugugugggccuugugucugaucagagagcuguuguuucccacuggcuuugccucuuaauacuucaaccuucuuuggccacaccagaaccaaguuuccaagaaccucuguuggacacucggacagcuauauagaaaauguuaagucaaaacacaugacccaaguucgacaagggagugagaguggaguugacaggauuccagaaguucaacuuucuguuauuuuuuucuuuuuaucauaaucaugucucuugacacuccuuuugauguaauagucacauaagauuaagguuuuuuuuacgguuacggcgaaacaaucauuauuucauaauauugcuggaaccaugcuggugggagugaagauauucuaauuuuguguguguuucccaagaagagauuucccaguucuaaggacuuguuaggccaucuugcaggaagacuggagcugagccagugaugggcaggaccacaccuugaguggaauugcuuagugacaaugacgcacaccgcuugccuucuguugaaaccuacaccucauuucaagccggaccuagaguguuucucuugccaaugcggucaaauugagucugccugcuuucucugcuguacuuauuacucaugucuuucguuggcuuauuagagaugaauaguggagcccugcuucuugaugcugccagggcacaggcuaccuaacaacuccagagacacagccucuggcggcucaaaacauuaauaccuauuaagcaaagguuuuugguucuucucccuccaaugcuggcaacuaccagaccucccucuugcuguuucuacagguuuaccuuuucuagauauuucacauaagugaaaccauguaauacguaacucuggauucuuuuacuuaucauguuuugaguuccauccaaucaguagcaugggucacccacucucucccuuuuuacuacugagcaguauaguugcacuuuauggagaaaucaccugaaguuuuuccacccuuugcuguuuguaaauggcgcuaaugcaaacauucacaggcagauguuuuauugaauccgguuucacuugggagaugaaugggguguagaccuaggaaucucauugcugggucuuacuuuauaauucuauuguaacuuuccaaaaaaaaaauuaucagaaggucuuccccagugaugggccauuuuacauuucaccugcaguguacaagaacugcaaauuucucuacacccuugucugcaugugggauucccauguuuuaaauuuuugcugaagucuuccuuaagagugugagguacugucucacuugagaugccaucguggauuugaucugcguuuucuugaugacaagcgacaaugaacaucuuuucguguugcucuuuggccauuugucuauuuuaucuagagaaauguccaaauccuacauccaucuuuaaagugagcguucauugcuauucuguugugaauuuguaagaguucuuuauaugcuaugaugguauggaugcuagaaacuuaucuaacgcaugauuuacaauugucuucuuccauuuugccaucuuuauuuucuugguaacacuggacagugguaccugucccugauggacagguuuuaauuuugaugaaguucgagucauucccccccccccccccguggcugcucguguuuuucauguccuaugauaggauccacugcugacucuaaagucaaggcauccgcguugagcacauucguccuuuccuugccauauuugcaaaaaaaaaugucucacagguuaggugaccuauaaauagcugucuuucauuuuaaggauauucuuauaucaauuucugaaaccuucugccaucugaggguaaugccuuaucaggauguggaagccagagacaugaaagcacuucauucucaccucagcuccacccagaaucucauccugucagugguacccuggaugcugcugaggccaugaagcacaccccucgggcaucccaucccagaagacuauggcuagacaacggauccuaucuucccgguugugaaacaguguaacaagggagcauguguuuggauauuagggagauuacuauuaaguuucacagagcuuuuguaaguuauuuaaucucucagagcccugauuuuuaucuauaacaaaacugucuugugguuuuaccgcauuauacuacacagcauuaagugaagcagccaccgccgugccugguaaauaaauaacgugugcucaggauuguuacugcuauccucuaugagaaaaacagcacaggugcacuggcagucuggggagccuucacauuuugcagauugcuaacauuuuuauuaggaagaacuccuuugccuuuguggaugggaaaggcugcagaagaugggacccagggcuuuaaucaagcuaaauauguguuucacaaccaggccauucuuucccuaagcaacuucuugccuuuaaaagaggcuuucagaucacugauuucuaagaaacuaggaaaacaaaugccgagacguggaugucuguucuauacgggucaccagacaccagcugacuucacgaagggagucuuuaacuuuucaaaaccuuuauaacauugauuucagaccccuucaguaggaagaguagaauucgcaacacaugaaaguggguuguuugguuuuuuuuuuuuuucucuuucaauucuauaugcuguuucuuucucacuccuauuauugguaguaacccaaggggauccaggccuguccucucacucgcagcagaauguaucagcugaugcuucucugcucaagcaauggcuguggugcucuuucagauuuacagacagucugagagacacuggucaccucuugcggucagucgccugcacaaaucuguucauguuugaauucuuguucucuuacagacucauuacaccgcucacugcucuaagguugcaaucucaauuaugucuacuguguugcugucucuccaguuggguucuuuuuuuuuuuuuuuuuuuuuuuuugaggaaccuuguuacaggucuuuuugauucacauuuagugccuauaguuauugcugucccacccaaagugaguucuuucuggaggugacuaagcucaguacauugaaauacauagaaccucagucuagauauacaguaugcuuccccauuuucuagucuucuaauaagccauagaacccugaauuuccaaaaccuaauuuuauuuuuuaauuuuagaauaugauauuuuuagaaaaaaaucucuuugucucuauuaugaauuaaaaucugacuacucaggaaagacacuuuugugcuuuuuuucucccccaacauauuauuauguugugcauugcccagcaaguucuuuguuucaucugggucuuaauuucuuccucugcugauaugacuucuaauucuuuuccagcuucucucagauucugaugcuaggaugcauauacaaaucuacuuuccaaagcucacuagugucucuauuugauguguggcuauuuaagcaugcccccacugagaguuguuuuauaccuguuucuggucuuucagucuuggaggagccuuuaccauugacuccugagauacauaaaguuucuuuucaauugaaacuucaagaagugaauuuagaauggacugucccagcccuuacucaugaagaauuaaacaugauauuucagauagagaucaguagacugaacauauccaacaccaucugggugguaaguacuuugugacuuauugucuuaaaaagucuuuuccugugcuaugauuuaucuuuuaugccauuggaaaugccaagaacauuucccucucaauacagauuuccuaaacaauugcaucccuguguguuuuguuaaggcaaugguucucaaccuuccuaauguugugacccuuuacuacaguuccucauguuguggugacccucaaaccauacaauuauuuuuguuuuuauaucauaacuuaaaucuuacuacaguuaucaaucauaauauaaauaucuguguuuucugauggucucagaugacccuggugagggucacaacucacagaaugaaagucacugaguuaagacaaauaauaagaccggcuggguuugauggguucauugagagaguagauuauucucucuguuuugcugugcugaggacaguugcuggguccguccuuguaaagacuggaucugcauguucugugaagagccuuuauuucaccguccuccucucguccaccaaggauuacccaggaaacuuggguuauccugaaugagauauaacgacuuaccaacacuuuucucauggugguccuucuuggggaucugucugcuugcucugugcuccgugcacagaggagccaacucccagcacuuaauauguggccaacacauagacugcacuggauagugacucaguguccucucuuuccuggaauaugaguuuguuaagaaaucaguuaauugauuaaauccuucuugagagguggaggccagagaaucaggaguucaagacaccuugugcuauggagucagcucagggccaacuuggacuacaucaaaccgaaugaaagaaaaucuuucaacuucucuuuugcuuugaauuauucggaguauauuuucacucaucuugauucagaaaacagaaguaucuauuggggccaacauagucucaucuaagaacacauuggucacagguauuagauauugucaugagauguuugucaagaagcccuagaaaucuggagguaaaugaaacagagggcugagauggagcccuaugagccccaucaaggucucccuuuucuugagcagcagaugcugggcacacagggaucaggaauguagguccuuuuagcuaagccuuucacuaauguuagucuucagcuuuuccccauauccauuacuacauaugaaguccaagcaagcagccaaagauaaaucaaaucuggcucaguccauaggacuuauagcaggucuguuacuuggcugcccuuucccacaacaguaguuguugaacguacuaugccaccuccguaacacagauguacaauaaguccacuugccacugucucccaucuugccaccaccccaccuuauacuaugaaaccugagugaugugguucugaugggcauugguaugugacuugggccuauggaaacauucaacaaaggucuuauuggacaaagaugcuccuccaaagacagaaaguugggagaagcacuggagggauuugggcgcauuaauucauaucaccacaacaaaauagcacuaguguagaaacaagggaauccuauucuguuauuucucuaaaaggcaguucacaucaguucucauauuaggaaaggcaaggaacauuaguccauggaacuaaaguggaucccauucuuuguuuucuuaagucugauuuccuuuuagcuuuacaaaaaugucucuuugaacaagaacgcagcagaaauuauucuguaauuuaugaggaguuaagaucucaaaggguggacuauugcaccaucaguuuauuucauugaacucaagaacaugcagccacagccccaggacaacagugacaaaaaccagugucccccuucuucauccccauggccagacagaaagcccuuggaugaccccucuuguaccugaaguugaggagagacaugagaucuuccuucagugaagggagagaacacacuuccuucuggaaauucuucuuugcuugaacaguucuuuguugugcaagccaggaaucccaucacaaccuaugcugagagggcaacuuagagccucaucauucacugcacuuccaacgagccagaggaaaagcacacugaccuaggugcuccgaguuagaauagggcaccucccugacaguacugagcacacagagcccugcugacaggcacacuacaugacacugcuccaggccaaacuucugcucuucccucuaggacauuuucuguauucuuuagucaacagcaagaaaaggcagaauagcagcucaagcuuggaaagagaccuguggugugaaucauggagggauaggacucgugccucagcaaugagucaaugaccucagauacaguucugugucugugugcaugccaguuucugugaccuacuaaugucuucaagggcucuauucaacuugccacuucaauggcugaaaacaaaacaaagaaaaucugccacaauuucuuuuuaaauugccaauuugaauggcacagucaaagcuuuaucuucuucauugacaaggcuauaaagaccacaaagcauacauugagguuagaucaaauccacaauguuuauagggaaacauggcccacugcguacuaaucaagugacuauauuacucagcucagaauauuugagugucggccugcauuggacauuguacaaagaguggggaaucuaaaagcugagccuacaaaugggguguucuaaauucauaugggguguaagggugacuugugaaugcuggaguuaggccuaauuuuuuccccacgauauagauggaagauucguugagccaagauaugaaagagaaaucaaaguuaauuuaaugugaaaguugggaacaagaucucuggggaaacccaaugggagccaucagagaccuugagagaagaguguaggggagcugccaggcuggaaggcaggaugcagugugugggcucagagcauguggagacaaguggggcagucaggggcagggcaagaccacccaagcucauggguagaacacucagguuguguuuagaccaagugcaauaagaauaagaacaccaagauguuuucuuuuuugucguuguuguugucuaguauucacuuuagcuuuaagaauauucacauguaauaucuaaaggcuauuccuuaaguaaggaaaguuucaugaaucaggaucucaaaaccaggccgacaggaauaugcuuugugaucuaagaacagaguaaaauaauaagcugauauaaaauaguaacaguuuaaauauucuguuuuauagagaguagaaaggaggcacacaauugcauguaccugggugggccacaguguucucaucccacugcugagugaauucuguaguguacgugcuuuaagauuggugaucuggacaggagcaaagauguaagaguuguugccuacgagugugacaugugauuacugugcuccacaaacugaggaccuaucacguacaccaaggauaagcguacagacucccacuagcuuccccgggaaauucaccaugauuggcaucuccacuccccagcuguagaaaauuugccuuaguuagagucacuauugcugcaaucaaacacuggguccaaaagcaacuuggggagaaaaggguuuugcuuuuugccuuucugauuguuuuguuuuguuugguuguuuuggagggguuuguuguugguuguuaguuuuuuuuuguuuguuuguuuuauuuuguuugccugcccuuccguauaacauuucaucaucaaagagagucagggcagaaaccuggaggcaugagcugauguccacauaggaguucagcuuauuagcuugcuuuccauaccuuugaucagccuacuuuacuauagaacccaggaccaccagcccagaguuggagccacccacaaugggcugggcccacuaucuucaaucaauguucuacagguuugucuacagccugaucuauggagacauuuucucaauugagguccccucuuuucagaugacacuagcucaugucaaguugacacaagaccauccugcauagacuugggugcaggacaaggauucuggaggggcacauggaagaaaaugaauuccuggagguacaggggaaauaguggucucaucucccuuugguccuugucagcaucauagauaaauuccaagagggcuuugguggguagagaugggaagaguuuaaagcuaagagcaggaaauuaucuaggaacuugaggugcaguucugcaggagaguucuugcugagcaugugugaagcacaucuaugcgugaagacuucucucuucaacacuggacuauucuaagaaggcuucaugaaagagaaggagaauguucuaggcuccaauaacagcuaauuccuaaugcagaggcagguggaggaugcuaagccagcaaugccugaugaucagacacugagauguuccgaaccccucaagagugcuggauagaaagaagauccuucagguuaaugggaaccaggcaauggaggccuugaaaacuggagaaagaaagauguaauggcaccacugaaguugaucaacuuugcaacuugagaugccacugucuuagaaagauuaagacccaguucaccuugaaucaggucaaagagaaguaugaaaaaugcuguuugcuugguaucucuagggccuaagguucuggcggcuggagcuuaguggaaggauaugguccaccuggccaccacaucugaaaagacaggagagaaaaaccaggggacacuuuuggugacguuggggugucauauaggauggauuacccugcucacucagauuuagcuagucugaucuaaccuuggcuaaagugaauuuuuaaaagucccaacaaauagugccuacuucuaaaaguaaguacucaauuaacuagauuguuuagaauuuucguaguggguuguaugugaccagcauggcuggacaucugucucagauauuugaugcaaggcuugaaugguuucucucuuuucucucuugaucuguauggaccccuagagaaugugacagccaaugggacugaggagacaggaggccauagcugcuacugucaagacaucagacuaaggaaucauggguuacaauugagcuuaaauuaaauagaugguggaguuaauguaggguggaagucugugcuuuggaguaauucggguugaccuacuuuccaggauugcagugacuguauauuuccaaacauugucuuuauuauuuuuaggagaauuauagcaccacugugaagcgugaagaagcugugcguuggaacuggacgucugauaucccuuuggagugugucaaacauuucauaagaaucagggcucugguagaugacaccaagucccuuccacagaguuccuggggcaacuggaguuccuggaaagaaguuaaugguaagaagugaaguggcuaaaagggaagugaccccaagaauaaucagauuuaguauaacucagagaucaguaaucaacuggaggauaccccguucucugugaaagacacuggauugccacuggcuuuauuuuucuuuggucaaaacaaaacuaaaaaguggucuugaaauuccccauggagcucuagacaucugaaauuuuaccucugaauaucuucauugagguaauuauguaguucagauaauucuguauucauuuuccaaauaugcaaaacauguuuaccuuaaugcuguguguguuuauuaaagcaguauagauagauagauagauagauagauagauagauagauauagauagauauagauauagauuagaugauagagauagagauagagauagagauagagauagagauagagauagagauagagauagagauagagagauagauauacacacacacauacauauauuugggaaagauaaagggaauguuucuuuuuugggauuguagcagcugugugucaauaaaucuuuauuuauaaaaacagauggcauacuugacuuagcucaugggcugugguucuucaauccucaguuuagagacagggaguaauauggggauaacaaagcagcuuuucauuauagugauagaauugugaacaaauaacuuuaauuauuccuuaauuuugauccuugaacauuguuguaggaacgguuuagagcggacuuuaccaugccuucucgugcuccauuuggcuagaggccagaccuauaacaauagcauuuccguucuucauuguauuacaugaagcucuaccaauauaacaguuccuuugccaaacauugaugcaaauuuauuaacucuaaguggcaaccucuuaacccaggaauaguuuagaguauaccuugauaauaaugaaauuaaauguacauucuacaguuuuaaacaguagacauugguuuagcuaucacauugacacuaaaaaaauaggcuuuauuuuuacccccacuuuacagauacauaaaaugauaaccagggaaagcuaagaaccuacauaggcuaugcacuucacaacuauagcuacugcugaaauaggcagaaggaaaauaucaaugcagaaagguaguaagaaauuccaucacauguuggcacagaucagugcacaggagucugaaugagggguuaagauaaauucaaggucagcuugcauggauuauauagagaauucaaggaugucuaagaauaaauagauuccaugucugaacacucaaacaacagugagagaaagaaagaaauaugucauaaacaacacugguaaaauugacuagacuucucaaaacuguaacuguaagauuuauacaaauauaaaagggaauucuggcuccuagagggcuguuucuccacugugacugaucaguagaaucauuuagagaucuugcaaaccuucagaagagcuaugcacuuggcacagugaggucagcgauaauaauaccuagugaccuaaugggagaccagccagguuacaucaggcugagagcugagguggugaagccugaguggucuucuagaaggccacguagagggagacacuaaagaagguggcggggggaggacguuccucugagaguccuuaggacuuugauauggcaaaggucacacagaaggaaagaugggagcaggagaagcugggugaggagcaucucugggaaggcagagggggugugaugcagugugauggaaagagacauggcuuuggagcucggcuaguuucaucucauuuaagcaauuuaagggagaguucauuuuggcuuuuauuucagggguacaguccaugauggcaggacaguuagguugguuugggcuugcaacagcuguucacaucucagcuaccaucaggaaacagaaauucuagugcucaaaucauguucuccaucuccuacaguccaggcuuccagccagggacugauaccaaccacagugacaaagucuucccaucuugauuaaccuaaucuauaugaucacucauagacucaucucccagacacucaaauugacaaucauuaaggaucucccagggauucugaaucucaaauggacaaucacggagaccuaggagaucugaauaugcguuuaucacuacuggcaaguuaagcaaacucagcuccaagucccggucuaucucgcuguugagaggucuugaggaugacuugagauaaggaacccaaacacuucaugacacuucaugcauaguggguggcccacagagagcagcugcaaacaguaacaacaucacaauaaccagaagugaugauagugaugcuguuuuagcuggaacaguauggcaaaaggucccucacuggaaagguuugguuuuuccccuaccaaaagguccaggaaucacacggaaguuuaagcugcuauuuucccagaagguagaauaaaaccguauuaccugcagggagugggaggggaugugucuugaaaucugaguaauauucuaaccaaggccuuuugucuuucagcaaagguuuccguugaaccugauaaaucauuaauauuuccuaaagacaaaguguuggaagaaggcuccaaugucaccaucugucugauguaugggcagaauguauauaauguauccuguaaguugcaagaugagccaauccauggagaacaacuugauucccacgugucauuauuaaaauugaacaauguaguuuuccuuagugacacagggacaaacaucaauugucaagccacgaaggguccuaaaagaauauuugguacuguucucuuugucucgaguaaguaucagagcagugguucucaaucuuccuaaugcugugaccguuuaauaccauuccucauguuagagcgaccccugacccaaccauucuucacaacuguaauucucuauugcuauaaauccuaauguaaauaucugauaugcgacccccguggguguuaugacucccaggcugagaaccacuguauuagaguguuagaucuccuucguucucauuugccagaaggcaaagaaacauguucaaaugugguuuuaguugucuuugauuucacaaguuuuccauaaagaggcuuugaaaauaaugcccgacagcaauauucccaggauauccuauuuauccacgauguuugguaucaguuuuauuccuagaaccaauaguguuaaaggaaagagacuuccguuuaugaccugcaccacuaaaaauauauucuucucugccuccacucaacugaacuggaaucuucuccaaaucauggagggaggagggguguuguugucagucagcuaacuacagaaagagggugcacagagguucaaagaccuaugauaaccuuaucuccuggcuaggccuaucggcuuggucauuucuguacauggcauaguacugauguagagaauccaugaguaugggaugcgucuagcagcaauguauuaguucaccaaaaguggccaaugcuguucuuaacugaguggccuguuucagugggaugagaacaugcugacuuuucuguaggucacaacaugccugugcuaggugaucuucugugugugcuuucaaauuuccauccaucguauaccuagaccauaggacagaaucugaaacaucucucacuauugcuguaggagguaaucccaggccuggaugcuuccaccaucggaauccccuacucuaggcucugggaacagaagagacucuacauuuuuugaggagcuuugccauucccagaacucucugcucccuacuguaaaagugaaucaguucauagucuggcugacauaccugggcuuuaauggacaucacagaaucaauaugggacaccaacccucucucagauggacacagugccaaccucaugcacauuauaggcuauuuaucccuaagauaucgcaggauggggagaaucuaacacggggaaguaccugaagagccuuucuggggcuauugaucugcugacuuccaucuuuuggucccuucauuguuuggggacugugauuuuagaccccaggcagaacuucccuuugacuugucauucaaucaaagagguuaauuagaucuuucaucuuuuccuuuguauggacagaagugcucgaggaaccuaagaauguuuccugugaaacccgagacuuuaagacuuuggacuguucaugggaaccugggguagauacgacuuugacuuggcguaaacaaagauuccaaaacuacacuuuaugugaaucgugaguuggcucugguuacaucaucuacagggucuuccuuguuuaauggucaugugacaagugauucucucuuagagaagcacacacccuuagagaagacacacauacucuuggaugugucuuccuuucuucuggguacguccuuuccuccuacccauuauaguuaagccuauacuagugugucuuuaaaaaaaacuccaacucuacucauauuaaaaagacaugcggaacagaaguagagcucuaucuagacauuuccgaaaaugugugcugauauuuuagaacuaccuucugggaucaccagaaaacuuuuuuuuguguuuuacaaggguauagaaucuucuaccugaugugcucugaaagaacacguacaauuacauaagaguaauagauugaguaucuuuauauuaaaauagucuuaucugcugauauaacuaacauucuccaauuuuuauaaauuuuuaagaauauucaacuagaucaauugauguuaauagcacccacagggaaauuucauauauagaaauuuagugaaacauuuucauaauugguauccauuggugacagaucaauggauuuaugguuuuaaugucccaaggaauuaggauacaucugcuuugauggaaguguuuaaauccugucuuuccugucuuguuuuuuucccuccacuuuuuaagguucucuaagagaugugagguuucuaacuacaggaacuccuauaccuggcaaaucacugaaggcucacaggaaauguauaacuuuacucucacagcugaaaaccaacuaaggaaaagaagugucaacauuaauuuuaaccugacccauagaggugagacagcaaugucgcagcccaugauggacacuaguaugccauuauauacaauucgacccaguaaauuugcugcagauacuggccuaguuuacaacccgagugaagcuaaucuuuguucuucuauuuguucacccuuacccucauggaugugugcguuccaaagcacuuguuuugauuguugugauaguaaaaagauaaagauauaagaauauguucuaugguuguggugaggugugggggaaggagaugucuuggugggcccauaccaaggcauccuuccccaugccccgagggccggcuacaggaugguauaguauaaaacagaguuuauuuugggcuuggggaggagaguuaagagaguaguauaggcagagaauggcagagagaaggagagaguagagaaguagaggcugaccaugaccauguggagagaagggaggaagggaauggggagagagggagcaagggagcaggaggcaagagaauaagagaacaagagaguaagagagugaggagggggcaagcagccccuuuuauagugggccaggucuaccuggaucuugccagguaacuguggggaggagcauaccugguuguugccagguaacuguagggguagaguccagacagaguaccaacauugaucagaccucaaguaucagugagcucgcuaacaaacuugaaaacuaguaucgaggcauauacuuauugcauggccucucccagaaccucucucucuacucuucuaccuagacugucuauugcuuucaguuguauguaggaauauggauguguauucucauucccuguucuuuuaaggaucugggaaguuugggcccuauuguauaacaaggcgucuauagcaaucuaggaauuacuuuuuauauaauauuauauaauauuggcaugauguguuuacccuggaaacauugcuguaaucucuucuuuguacuacuauguagcacuuccugugaacauacacuauuuguucauucaucucuuucaguggcuuucaaguuguaucauguuuugcuugggguagaguuuuaauuaauuuaggauuuuacaugugccuguagacauguccauauuuucucaguaugugccuaaaauggaauuggcaaagacauaguauuccugagugcuuaccucucaaauguguucugaaguaguuuucccaguuacaugcucacucugugagcuuacuuagucucccgaagguuguagaaucgcuguuuauuuuuuaauugagccuaagaugguauuucuugaugguuacaaguuuaaauaucucucccuauacuggaaacacaaccauuuucuccuuuaugaugugcugggucauguuauuuauucguucauuccucuacugguuguuaguuuucccauggugagggugugacuaauuacucuucucuauaacaaacaccccaccaggcuugguucaagccuuagccccacuucccaccgcuaucccguauguagggggugggggugggggaaugacagggacagacauugugacugucaucacaguauguaguuuggcauaagagcagauuggacuauccaugcucaauuuuagucaaaagguugccaucuacuggucagaugacagccacaacacucauuugguuuugguuugacaaggcugucaguaaaccuugccaauagguuuuuaauucuccacaauuaaauaucgggaagaguuuaaacaucauggauggguaauuugacccuucugauaagugagacaucuguucaagggguaaaugguccccaucuuaaaugcacaauuucacugaauaacuaagcucuguuaacccugcuccauuucacucgcagaauuuguauuuaaccaaguaagaacuggugguuccugccauggcggcgcauguaaagcuuugguuaucugaagccuggucugagaaugguacuuaucagcaagcaaggaacucccaguguuagcaaggcccaagcacuugggaagcugagauagaugagcaugaguuuuacccuauccuuuguaauauagugaaacccuggaaugaagcaaggaagaaagggcugggacaggagguggaggucaaugcccaugcuccaauucugagacuuauauaaaccugguggcaguuuucugcuaucauacucuguacucaagcacacuuggagguucugaacagcgaagacugcauuaggcuagcagagucuaaagguucugagggugagaaugugaggguuggaccaugucuugcugaauggcuugcaaggcauccuguuacaggaggcuccauuuaaaggcagggaugcuguccaucacccugauguagagaaccaaaaugacagaggcugcuuagagagacacuuagucauucccuaccuccuccucauuucuggguuaaucaggccaaccuaucauuuuucucucugggguauucuuuuggcuuucagcucauaugguucuggcauuuggcaugauauaagaagucugcuguuuguuuucaugcuuagaagagcucugugaauggucaacuuggauaucacaaggugacaaggguguuugaaacaucuuuuaaaaaucuauguuaaguuccauauaaacaaggccauguccuguucuccauuuccuaggcaggaguuucccaugugauggcccauagccauucuccacauuucccagcugacuccuagccagggucucauuucccacacuguacuuuccuguucuaaaauguuaaaccgguucuuuuuuuuuuuucuccuccuuucugccauuauuauuuaguuuaccuuuuguuccgcacaccauucuuugcacagagagguagacauuuagaguguaguuugaugcuauguucaucucaccugucuuggccagacuuaugguaccaugcauguguuuccuacucugugaugggccauuaaucccagcauaaaggugcugguuaccccuacagcauucauaccgcuauugcaucuaaaagcaucuuaccacacuggucauuauuacaguucacuggguucacaguuggugacauuguugacggccuuccuacccucccacagcagucuguauaacuucuuccagaaagauacccaguggcaggaaaccuucuggucacuauugacuugauuucuccauguccugugacuaaugugugcuguagcuucagcaguaaggucuuaccgucaaguucgagggggcagccaagagcacugggaauaacuugcacuauuuuaagagucucuggaaugccucugaucaacaauuuaagggaaugugcuggguuccuuuauuugccaauguaccguaccugggaugagcauaguccccgguguaggauaacucuuuuaaaugaaaaguuauacaugcgaugcuucuaaaauacuuguuuucucuauggguuuucaaacauccuuagugucugaaugucccugccccaucucagccaagccucaccaucccuugccuuauguaacccaccucuacguuagccuccccacguucuuuuucccuuuuauuagcuucaguuucuucgcugagaacuacuguccuucuauucauuucaccuguguggcuuucgcucauggacuuauuuuaaacucuccuggggcaguucuagcacgugggucauuuggaggcagguguuuguuaaugaucuuuucccuugaaaauugguaagauuauuaucaaauguuuuguauacuggguugcuuggagguauuccuugauauugugaauauuauuuuaguuagacuuugguugcauuauaaccuuucucuauuggcagccuucuuuaaaguuugacucuccuccacaaccugacugaugguauuuaauuuuaagugccuguguguaguuacauuuuguguuuuauuucagugauuaauguacuuaguauuaauauauaagggcaauuagugaaugaaagagauuauauacuugacacaguacauauggucagcaagcccaguauugucugcauuuuucuaaacauaagcaaaaagcacuggugaaugaauaaguggugaaaugaauugccuauuuacuaagcucuguguuuggaucugcuugaguucuuuuuuuuuuuuuuuguuucuuguucuuuuauugacaguucauccaaaggcuccgcaggacgucacccuuaaaauuauaggugcuacaaaagccaacaugacuuggaagguucacucccauggaaacaacuacacacuuuugugucagguuaaacuccaauauggagaagugauucauguaagaacauuuguucauuuccuguuuuaaaaaucgucaaugugucuuagcagagagauggcagagugggcuuuuuuuuuuuuuuuuuuuucagcuuggguggcacacacuuguaauccuaccauucaaacgguuuacuuaggagaucacaaguuuaaagcugucuuuagcuacauaaccaaaauacaaacaaaaacaugccuuauuucaaaccaaacaugcuggugcacaccuguaacuggagaggcagaggcaggaggauuacuacaaguuggagacuugccugaugaacauagugaguuccaagcuaaccagggauacauugaaagacuuugccccccaaacaaaaagaacaacccaacaauacaugauaaacuacuccaucaggcccuuacuucaacauugguucauaguguggaugaucuguugauaguggguccugcaauugaucuaaauauuuggcaugaaaaaaagcaagcaagcaagcaaacaaaacguaaggaggaaaaauuuucccuugaaagaccuggucuuaauccaaauuagagacuguaguauucagauuuggccuuucgacacaaaugcaacuguagucuguuuuuccuucacuuucgugacccaggagcacaauguuucuguccacaugagcgcaaacuaccucuucagugaucuggauccagacacaaaguacaaggcuuuugugcgcugugcaagugccaaccacuucuggaaauggagcgacuggacccaaaaagaguucagcacacccgagacugguaugugugacuuccugguauugauaucaugguguaagccaaagaauaugggaugacuuucuucagagcuuuuauuugugccaaaugcugggaggaauguguuaaagcagaugucauauuuuauuuuuuuauuaaacuaauaaaauuuauuuuaaaauauacaacucaguaucgacauuuuuaagucaucaaaauaauuuauaggaguuaaugccucuugaauauauaugauaucuucugaagcuaaaaguaauaugcacucagccaguuuuuaaaaucuauuuggaacauuaaacauaauagaaguagaaaaaaaucucuuaugaaguccucuaugaaaggacguuaugacagguuccugguuagacagaaaccauuccaccuccaggggagaauacgcacuguaacuguggcuucauagaaugaacuggguaguguuccuucuguuucuauuuuguggaguaguuugaagaguauuggucuuaggucuuuuuuaaaggucugauagaauucugcacuaaacccaucugguccugagcuuuuuaugguugggagauuuuaaugacugcuucuauuucuuuagggguuaugggacuguuuagaugguuuaucucuuccugauuuaauuuagguauuugguaucugucuagaaaauuguccauuuuaucuagauuuuccaguuuuguugaacauaggcuuuuguaguaggaucugaugauuuuuuaaaauuuccucaguuucuguuguuaugucucccuuuucauuucugauuuuguuaauuuggauacugucucugugcccuccagugagucuggcuaaggguucuucuaucuuguugauuuucucaacgaaccagcuccugcuuuuguugauucuuuuuauaguucuuuuuuuuuuuucucuccuuguuugauuucagcccuguguuugauuauuuccuccucuuggguguauuugcuucuuuuuguucuagagcuuucaggugugaugauaagcugguaggugugcucucuccaguuucuuuuuggaggaacucagagcugaguuuuccucuuagcacugcuuucauugugucccauaaauuuggguauguugugccuucauuuucauuaaauucuaaaaagucuuuaauuucuuucuuuauuucuuccuugaccaaguuaucaaugaguaggguguuguucagcuuacauguguacgugggcuuccuguuguuuuuguuguuauugaagaccauccucagucauggugaucugaugggaugcaugggauuauuucaaucuucuuguaucugcuuugugaccaauuauauggucaguuuuggagaagguaccaugaggugcugagaagaagguauauuauucuguuuuaggauaaaaugcucuauagauaucuguuaaaucuauuugguccauaacuucuguuaguuucauugugucucuguuuaguuucuguuuccaugaucuguccauugaugagagugggguguugaagucucccacuauuauugugugaagugcaaugugugcuuugagcuuuaguaaaguuucuuuuaugaauguggaugccuuugaauuuagaucuucagaaucgagaguucuugguagaauuuuuccuuugaugaguaugacauguucuuccuuauccuuuuugauaacuuuugguugaaagucuauuuuauuugauauuagaaggacuacuugagcuugcuuauugggaccauuugcuuggaaaauuguuuucuaguccuuuauucugugauggugucuguccuugacacugaggugcauuuccuguaugcagcaaaguucuggguccuguuuacauaucuaguccguuuuucuauguauuuuuauuggggaacugcauccguugacauuaagagauauuaaggaauagugauuguugcuuccuguuauuuuugguguuauuuuuguguuuguguggcuaucuucuuuuggguuuguuaaaagauuucuuucuugcuuuuucuaggguguaguugcccucauuguauaggcguuuuccauuucugacuagauuuguggaaauauauuguguaaacuuguuuuugucauugaauaucuugguuucuccaucuauggugauugagaguuuugcuggguauaguagccugggcuggcauuuguguucucuuagggucucuaugagaucugcccaggcucuucuggcuuucauagacuuuggugagaagucugguguaauucugauaggucugccuuuauauguuaguugacauuuuucccuuacugcuuuuaauauucuuucuuuguuuugugcauuugguguuuugauuauuaugugaagggaggaauuucuuuucugguccaaucuauuugggguucuguaggccucuuguauguuuauaggcaucucuuucuuuagguuagggaaguuuucuucuauaauuuuguugaagauauuuacuggcccuuuaaguugggaaucuucacucucuccuauaccuauuauccguagguuuggucuucucaucguguccuggauauccuggauguuguggauuaggagcuuuuugcauuuugcauuuucucugacuguugugucaauguuuucuaugggucucuucugcaccugagauucucucuucuaucucuuguauucuguuggugaugcuugcaucuaugacuccuuaucucuuuccuagguuuucuaucuucaggguugucuacuuugugauuucuuuauuguuucuauuuccauuuuuagauccuggaagguuuuguuuaauuccuucacuuguuugguugugcuuuccuauaauucuuucagggauuuuuuuauguuuccuauuuaagggcuucuaccuguuuaccuguguucuccuguguuucuuuaagggaguuauuuauguccuucuuaaaguccccuaucaucaucaugagaugugauuuuaaaucagagucuugcuuuuguggugucuuggaguauccagggcucgcuguggugagagaacugguuucugaugaugccaaguagccuugguuucuguugcuuaaguucuugcccuugccucuugccaccugguugucucugguguuagcuggucuugcugucucugacuguggcuugucccuccugcaagcccgugugucaguacuucugggagaccauuucucuccaggaggaauuuggguauggagagcugugacaaaauccuggaugcagguggaaacuggaaagauucuguccccugcucuuccuuggcuccuguguccugaugguuccaguugggucccucuuaggccagaaauuugagcagaaguaguggucucaccugugcucacaggugugucggcacuccuggaagaccagcucucaggaagcaguaacauagggcaccauggcacaggaucaacuccagccacagaccagaugccauacuuuaaaguugggcuuaaugccuaaugagcaaaggcauuugauaaccauguuacuucuaguauauguauuuuucaaguaguuucuuugcuauugcugggaauauugcuuuggauuuagguguggaucuuuaacucaggacagaggacaaaagaugucagugccuuggaaagcacuggcuucguuccacauagcagcagagugaccuuggguauguugugguauuugggacagucaucuuuaguaagugguucuucucagugcuuguaugccaggguccucuccaauugccuuugguagauuucuucuguccugagcaugcauggauauucuccaaagaacuauggaugucaagagaugagaugagcuaacccugcucucaaaccuuuccaguucaagauaaaacuauggcuacuagcuauuuucuagaugaggcaacuuaugccuaagcauggaagggacuugcugugguugccuaguugucgaauaacagacgcaugauaaagcaauagaagcucaucucugauucuucaugaugcuccgugcuccuuauugcauauggggcaacuguucuuauccuccugauauguaggagaucacgaaggcagagagguaaagcaugggacugcacuggggcucacuugcagcagccugccuccuuccucucucuuggucagucauuaccccuuugauaucaugcagacucaagcucuaguuauguuaacgucaaaggaaaguuugcaugugcauguuugucacuucuugcugucuguguguaguugguggagauucugugucauucuagaaguaccauuuuaaaggaaaaaaaaugacaaauccacaaucagaauauauacaugagauggccauggaagggcucagccucccauuuccacccugugguugcuucuuaccucccacccaucaaggaucuggccaucuuguaggguaugcagacugcccaagaaagcuguugugguauucaucucagcuguugaauuauuaaaugacuuuaauuuugauacugucagcuuacuuuaaaucuuugcaauuuucauuaguuauaauaaaaguguuguguaaagagaaaguagccaaggggaagggugucuuuggauuauaauacaguaaaucugaaaagaugucugccugcuuuggaugauaagaaaaugaagggagaguaggagaugccucaguggguaaacaagguugccacugagccugccuuugcuuuccuucaauuucaaagcugaguuuggucccugggaccacaagguagaaaaaaggaucaaauuucaucauguuuuccucuuucuauaugggcaucaagacacuagcaccuauacacauacaaacacacaaacacacauaaacaaguaaugaaauaaaucuuuuuuaaagaaagugagauaagucuacuaacagugaaucuauagaugcacugucaucuuaccucauccuaagggcugagaacucuaguguuuaaguggauuuuauuagcauggaguuaaaugagagcacacuagaugcuguacucuauuuacaauauauagccauaccaauuggaugaggcacuugagucuuuuuguuuugucuguuuuuuuuuuuuuuuuuuuuuuuuuuuuuuugaguaaugauuuacagaccagcacaagauggagucuaaugcugugccuauuucuuaugcuuuuuguuuagcaaguuaaaaccugcuccaauaauuuaacgacauauaugaucaccuugaaguuuugugugaagugucaggaauuaaccgaaacaaugagcugguuauugaugcagucggcuguaguuuucuaacacaagagaucaaguuuuguguacugugcccacgcauggccccuucaucucaucucauauuacugcccuuucaaaaacaaaacagaacagaauguagaaaaaggugaaucagcuccauuuuguuaaauauuacacaugugugacaguugauguaacauguccaugucauagauagacacauuuuuuuuaauuagguauuuauuucauuuacauuuccaauacuaucgcaaaagauagcuggcaggaucaggaagcagaggggcaaggaaguacuuccagguuguaacuccagugagaggucagcagaggucauaaaagccaggcagggccccugagcuugcuaccccaaaggccuaggucagugugugucucucucucagccuugcacaaggaaauuguugcugucuagggaaaaaaagggaaacugaucuacauccucauagaauuguucugacaauaaaauaaaauaaaauaaaauaaaauaaaauaaaauaaaauaaaaucauuaguugccuccagaggcucuagggcugauugguaggguucaaguuugguacuguguucagggcagcugaucuuuguuuuuaaaucaccucaaagcaccuacuagaaacauauauggucagguacuuaauguaauauggcaucauguacaaugaauauauacagugaaaguauuuaaaagucacacagugagugcugagugagcagaguggcuggggacccauggauggaagucacagaaagugagaagcuugguuaaccagccccugggaggacuggucauaaccauggcuuggaacagcaguucucaaacugugggucaugaccccuaccaagggucgcauaucagauauccugcacaucagauauuuacauuauaauucauaacuagcaguuacaauuaugaaguaacaacaaaauaauuuuaugguugugggagcagaggucacuacgacaugaagagcuguauuaaaaggcauuaggaagguugagaaccacuuagaagaacauuggaccugaccuaaagcuguaccacagagcaauuuugauaaaaacucaugguacugguauagcgacagacaaguagaccaauggaauagaauugaggacccagaaaugaacccauacaccuauggccacuugaucuuugacaagggagcuaaaaccauccaguggacaaaagacagcauuuucaacaaauggugcuggcacaacuggcaguuaucacguagaagaauacaaauugaucuauucuuaucuccuuguacuaaggucaaaucuaaguggaucaaggaacuccacauaaaaccagagacacugaaacuuauagaggagaaaguggaggaaagccucgaagauaugggcacagggggaaaaaaauucugaauagaacagcaauggcuugugccguaagaucaaaaaucgauaaaugggaccucauaaaauugcaaagcuucuguaaggcaagagacacugucaauaagacaaaaaggccaccaacagauugggaaaggaucuuuaccuauccuaaaucagauaggggacuaauauccaauauauauaaagaacucaagaagauggacuccagaaaaucaaauaaccccauuaaaaauggggcucagaacuaaacaaagaauucucaccugaggaauaccgaauggcugagaagcaucugaaaaaaauguucagcauccuuaaucaucagggaaaugcaaaucaaaacaacccugagguuacaccucacaccagucagaaugacuaagauaaaaaaaauucaggugacagcagaugcuggcgaggauguggagaaagaggaacacuccuccauuguuggugggauugcaagcuuguacaaccacucuagaaaucagucuggcgguuccucagaaaauuggacauaguacuaccggaggaucccgcaauaccucuccugggcauauauccagaagauguuccaagugguaagaaagacacauguuccacuauguucauagcagccuuauuuauaauagccaaaagcuggaaagaacccagaugccccuaaacagaggaauggauacagaaaaugugguacauuuacacaauggaguacuacucagcuacuaaaaagaaugaauuuaugaaauuccuaggcaaauggauggaccuggaggguaucauccugagugagguaacccaaucacaaaagaacucacaugauauguacuuacugauaaguagauauuagcccauaaacuuagaauacccaagauacaagauacaauuuucgaaacacaugaaacugaagaagaacgaagaccaaaguguggacacuuugccccuucuuagaauugggaacaaaagacccaugaaaggaguuacagagacaaaguuuggagcugagaugaaaggauggaccaucuagagacugccauaccuggagauccauuccauaaucagccuccaaacgcugacaccauugcauacacuagcaagauuuugcugaaaggacccaaauagagcugucucuugugagacuaugccggggccuagcaaacacagaaguggaugcucacagccagcuauuggauggaucacagggcccccaauggaggagcuagagaaaguacccaaggagcuggggggaucugcaacccuguagguggaacaacaauaugaacuaaccaguacccccuggagcucaugucucuagcugcacauguaucaaaagauggccuaguuagccaucaguggaaagagagguccauugguagugcaaacuuuauaugccucaauaugagggaacaccagggccaagaagugggagugggugggugggggagggugaggggagggugugagggacuuuugggauagcacuggaaauguaaaugaagaaaaucccuaaaaaaaaaaaaaaagcacauggaaaguaugaccuuccuugcagacaaaaugaccuugggacuugucuuugguucagcucccucacaggcucuugauguauggagacaaguguggucggagaauggaagacgcauugugacuuuauucuggaagguaagacuugcagcuucagaaggucugacuugcugcuucuggauagcaacgcacuccccaguucaccaggagaaaccauggugucagucucauagggcugguuaucagggagaaagacccacuccauaccugguccuagugcuuggccuacaguucccugagcccaacugauggcugaugguugguucugauuguuagaaucuuuccugaauguucuacucagguccacuguaacuuuugcaaggcucaagacaaagaaauaugucuagagucacacacucuacuucugauuuguggauagguaaauacaaaauuuucgaaucaagcuauuaauuuauacuagaucaacguuauuuuucugccuggcccaauccacugcaugacaaccuggaaggccagcuuuguauucagggcucugagauacagagauacaugagauaagcugucucaugccaaagcauaguaauaggagauuguuggcccauugucgcagccucaccaacuuuucuucuccccuugaguuuggcacagucuuuggggucucugcauauauguauggcucugcuaagaugucugaguucuguccacucccuaagggggcagcuaccacuuaaucugagaucuagggguccacaaagcaggacauagccugcuccaggaagaacagaccucaaaaagcacugauggaugcugaccugggagggccagggcuucucugcaaccaugagcaucuucuagaagagggaauaugaacuagcgggcagaggucggaauaagggaagaccagguaaagggaggccaggacacaggcucuucuuacuggaugcugguuccacuccuguaucuucuuuuagcugccuuauaaucuuauuuccucuggagcuaaggagucuacauuucucuugacuuuugacucggucccugcucucuggacacacuauaaaucuuuaauauaagcucuaaaugauuuuagucucugcucucuucaguuagauugacacaccugauucuaagcgugguguugagaugauaacccuauuuaauuuuaugaauguucugguguauguguaugugcucaugugcacacacacacagacauauauuuguucuaauauguuuauauguaugaaugugugaaugugguagauagugcgcacauaggugugugcauauauacauauauauauauauauguauguauauauauacacauauauggauauguucuuauguauauguggauugggcagcuaagggaugggagaaaugaaaaaguuauuuuagacuacagccauuuugaaaggauuaucaucuuuuucagccacuauuaaaaucacaggccaauggcaaaaucauauccuauaauauaguuguagaaaaugaagccaaaccaacugagucagaacacuacugugucugggcaccagcccucagcacaaaccugagccuugaccugcaaccuuacaagauucgcaucacagccaacaacagcaugggggcaucuccugaguccuugaugguccuuucuaaugauucuggacacggugaguuggcauuuggcaauuuggcuuccacucuuaagggaaacauugaugauauuuccaaguagugacagacaaagccaugacuugcgacacauucagagcuggguguaucagcagguugcaauaugaccuucacagugguccagcacacucuguccuugcguucuuccacacauucaagagauggucuaaaauucaugugagugaaugcaaucucacacacaccaauuaucccugagcgucaagacagugcccuagagacuuuugucuugugagauauggauuauauuuacucugcuaugacuugccaauucuuaucccuauaaagaguuuaugguacagccaugcugauggagcaggucuguauccacaacacucaggagguugaggcagggggaucaugauuuugaggccagucucugcuacauagugagacuacauugagagagagaacagugguaggggcugaggagcccaugaauaucauggauaucaaaggagagcugacauacucuuucaggagacauuguaauuuggccaaguuuguagaauaagaacagaugauaaccugcuaaucuuucagccaacgaaggauugggcaaagaggaagugaucucacaucuaaaccuuaagaguaacauuaaugcccuucuugacugagccauagaaaaucugggcauaguauaugcuuagccuuaugcuuugaaacacuguacauaauaaaagacaaaagggaguugaccugcuaaggucauuauuaacguaccuugcgaugaugccauccuacaguucuugcuguaaaggugccagggccuucucaugggacuaggaaagaucgcauaguuccaucccauuucaguuuaaguuuaggcuaagugaaccauauuagaagguauuucauuuuccaacaggcucuaugugaaauccuuucaauugcucuggagcagggcuacacuuuaaccuugacacugaagaucuuuaccaauugccacaaaauuucacuaaaacccacaguucagauuuuucugagcauccugcuucaccuggaaguucugguuacuaguuaaucauugagugacauaagaugcugcuccucuucccagggcacuguuacacagcaggagcacagcucuagacauaaagucaaagucguugagaugcuuucuucaugugcugguucccaguggaagcugacccacacagcuuccuccccuuccuccaucaaagaaagaaaucggucucacgccaaaacugacauuucuucuucacuuguucagagaugucaggaauguggacccucacuccuuaaaagcacuggagacucaaagcagcgggaacaaggagauuuauuucaugaccuuacaaggcugagugugacccgggaaagaccauugauugagcauggaagcagucuuugucacccuaacacacaagucuccuccaucccuuuccacuuuggcugaacaaucaaaaaauucaaucucacagucauccaggacuuaccuuucccucugccacguacuguugccauuccccaaacagagccugugcuggauuccucgagauguuuuauguaacuguugauuuaaacccuaucaguuggacggccuagcaggaaagcuuggcugcuaguaauuugcugcucucugcccuuaguuuggcugcugguagugaaagguauccuuagcaagugucucaucaugguuccuguguuuucuguucccuuggaguugcuggaggcaaucuugaaagcaaaccauuacacacacaucacaagugagccguguacaugagcaucccaaacauaggcccuccuccucagcaagugcugcuuugaagcugguucaaaacaggauguaaaggcuggagauagugaggaacaccuguccucacuaucucacuaacacucaguccucuauagcacuuagauguucuuaccugugagaugcuguguaagucaacuucccaugguuaugacaaaguacuggagggaaacaaacuauaagaagguacaguuuguucugguucauaguuguagagccugggaucgugguugguuaguuuguugcuuugggggcuguggggaacaugaauaccguggugaguaacuuguggaagagcaagagcuacuugccuugcugcuugggaagcaaagagaggacagcgccagggucccagucucuucuuccauagcuuuguccaggaaucuaacuucagucuuccaugucagcaucugaaagguuucacugcaucccaagagugccacagucuggggaccacggcuuuagguacagaagcccuugagagacauuuuaaagcaaaaccauaaacaaacauuacaaguguugguuucuuuccuuccuuggaacucauaagacacacacacacacacacaaugaacugaucagaaguauuauucuauuuguuucuucacagaagaggucaaggaaaagacaauuaaagguauaaaggaugcauucaauauuucuugggagcccguaucuggagacacgaugggcuauguuguggacuggugugcacauucccaggaccaacgcugugauuugcaguggaagaaccuuggucccaauaccacaagcaccaccaucaccucaggugagaguucucagcacuccuccuugcauagcccucuugcaggaaguucagcauagacuucaguucuggucuacauauacuuggugcuaggcuaggcuaacgauuuugaaguggcaaguccaguguggcugcuuggagaucagacuuucugggaauggauucugaccuuugaacuuaaaaucuacugcagaagaguauggaaauguggacgcauagugcagauuuuaacaaaugucuccucuagaugagagggacaucggaacauuugcagaaagcuuuugcagaugcagagaacagccacacuugagacauguagcccagagaguuaauggaaacagaaccagauuucaauuucagugagcuuuuaggcaugaucucuccucuccugcaaugaaucuacaacuugacaaucccugcuguuuuagggagaucaaagaugcucaagcguguggcuuaaguaggaagcgcaggaggaaggacugaugugggaaucaucuagaugcagaaagugauggagacuccugcaagauugaggggcccgagagcacagaugagggagcccgagcacaagugaggccugcugaggauccuggcuccagagcacaugacaguuucuauugacuggagacagcacuguguucuacggcaacacggaaaguucuaaggccuaguggaaggggggaauacucguggaaagagugggaagaucuugagagagaagcuacuagggguugcuugcuuacugucuguccuuuccugcucagcucaaaugaugucaucgugucuucuuaaaaaccuuugacuucucuucucuagaugauuuuaaaccaggcguccguuacaacuucagaauuuuugaaaggucuguggaacacaaagcucgguuaguagagaaacaaagaggauacacccaggaacuggguaaguggaagacaguuggcaugacucgugaagacuuguguuggaccauaguuuuguguuuagaaagauuucguucccauauuuaacguuaugguuccauuuuuuuaaaauggcauuaaguuuuuuuuuguuuuuuguuuuuguuuuucaagacaggguuucucuguauagcccuggcuguccuggagcucacucuguagaccagguuggccuggaacucagaaauccgccugccucugccucccaagugcugggauuaaaggcgugcgccaccaugccuggcuggcauuaaguuuuuaaagucauauaaaugaaacaucuucauucuaggagauggcuaaaacauuauauaaaagaggaugaaaucauugcuaauuuuaacaccuaaagggcaauauccaguuagucuuacuguacacugauacccguuucucuauagcuauauacucuuuuaaauaaaaauggaaugcucgacaaaguucuuuaacuucuugcuugauuaaugccacaaaauaugacuuaacgacugugcuacuuccaugaugggaaggaaucccucuacauaugccaaaccaccuauuggacaauuuagcaugauugcaaugauuuuuucacuuagaaacuguaaaaucugucuucaaguaucuuguagcuccaaguugcaaaccucucuuuugcuguccacucucuuguaucugaauuacuuucauuuuagcugucuuugucuuuauccauaaucgugugugcgcgcguacgugcgugcaugugugugugugugugugugugugugugugugagagagagagagagagagagagagaaagagagagagagagagaaagagagagagagagagagagagagagagagagagagagagagagagagagcaggagaggauuuacuggguguauuuccagagugucuaauaacacacauugccuuguucuuggaacuaaauucuccaaauccccucucauaucuuuaaacauugccuuuucugucccuuccucuucaugucuguagauucucugguuuagaaaaugcuguugagaccucaaggccaggaccaaaccuaggacagaccuuuuauuuuucacguuuucccccuccgacuuucccacaaauuaguuaaucucucuauguaucuaugucuucauuuaugagaaguuuaaacaagauaguugcucagcuccuuccgagcaugaagaacugugucuuggugcacagcauccauagaaaaagauaaaaccccuuaacuugacaggagcucagcguccucagcuaccuguggucuguguuuacuuugcauaaaugaccauuuccacagcaugacuuguucuugccccgucuuccuucccuagcuccuuuggugaauccaaaaguggagauuccuuacucgaccccuaacuccuucguucuaagauggccagauuaugacagcgacuuccaggcugguuuuauaaaaggguaccucguguaugugaaauccaaggagaugcagugcaaccaacccugggaaaggacccuccuuccaggugaugcuugcuuucuugguuguucacuuagacucagaagaucucacagcuugggagccaugaaagcgaggcugaguguguuggcagaguuaggaaaaagcucagaaaaggccccuuacgugacagggccaggcuggggaccagacugaugcucuucccaucccauuuuacaaccaauagcaaaaaaaaaaaaaaaaaaaaaaaaaaaaaaaaaaaaaaaggcugugaguagagggagaggaaguuuaauuucguuaaaaaaugaugugagccugaccauuggccccuaaggaaacccucuuccauuuugaaaaccuguuuguuucccagccucuccuaaaacaaaaaaacaaaaacacuuugucaaaagguguuagauuuacucauauguuuguggugcugaggaccaaaugcacgccucccacauacuaugaguaagacgucuguaagccacaucucuggugccaguuuuauguucccugugugcgccuauuacgccuggcagagcucucuaccuggauuguugccacucccugcuuaguggguauuuuauuuacuguggcacaccuugaacacugugagauuauuauuugauuugagguuggcuuaaggaugcugaugguaccaagagagcggggguaucaaugccuggcucccgcaaaaggucucugccacguuccuuucuuuccuucuuccuaagucagugccaugcaucccaggcuggcuggaacucacuguguaacugaagaugaccuugagcacauugccacugggaucacaggcgugugacgucaugugcggugucuguuguguugagaauuaaggccaugugggugcuaggcgaacacccuacuaacuggccacaagcagggcuccgccaugcccugaauaugacuuucuugacaacguuguuuuucacucacagauaauucaguccucuguaaauacgacaucaauggcucagagacaaagacacucaccguggaaaaccuucagccagagucccucuaugaguuuuucgucacuccguacaccagcgcuggcccaggacccaaugaaacguucacaaaggucacaacuccagaugcacgcugugaguuucuccaaagcaaaugauucccucacgguugacuuccuaugcuuucuccagaugaggacauuucaaucauuucuucccucuucccccgccuccaugccuuuuucuccauuccacacauacauuauucagaauccuguucucgaccccaggccaacccagcaaucaccugaccccuuaugaucuggaaacuucucacugaaacuggaugucuaucucugggacucagccucagugugaccugaaagucacagcauauucugacuugacaucaagcaucuugacuugacauuucugaguugacaucagaaaagccacaggcuucucacuccagcaggcccuggauggugguggguagccuuccgccucagccuuccuucuggcuggguuuucugggcugacuggcaacuuuuggcucugcuggggcuucugaggagagcuagagguugguaacgugcacuagaucaggccauaaauacugggucaguaaccucaaaggaagaacuuuagagucaaucugauugguaagagcaccaggagcccgcuucagaguccagagaccccagugccaagcauucagugggaagagcgagcaucccaugcugguaccgggacaggugcugguucccuaccaaaugaugggucaacuuaagaucccuuugaauugcugcgguguaaaagcagggcccacucagaagaagauguucuuugcagugugaucuuuucccaggcugguggaaugcaggaugguguggcacaagccacagcuccaacagccaggccauuccaaggggagucugcggcagucugcagucacugcagugaagccggggggcugucggcaggccggguguguggcaaagcauccucuugcaguacucagaacucacaguuuugccaggauguugucccuugcuaggcaagcagccccuggaguuaacuuuucagaaguuuucaaaacucaccugauggcuguugaaaucaaacauuuggaaaaacaaaaugaaaaccaauguuggcaaagauguagaaaaacuggaacucuuacaccuuguauguagggaggaaaaaguuggcacaguaacuuagggaaacuggucauguuagugucuucuaaggaagguguaugcucaauguggagcuuaggcccucauuucuugauguacagcuuaaagaaauuuugucuguauauagguauacacucauauacaccacaaaugccuacagaugaguauuagaauagaacauccacaucugcacaauuccugagacucacaaacuggaaguauccacucucugucccgugagaaggauaaacaacucugcuauagccacacaguggaguaucacauaguaaugaaaacaauguuucuacaguuauaaacuuauauggugcagcaaggagugacaggaagcagguaugaguucugcugugagguucuacuucagagcacaggaagacaccggcuccacgcccugaaagggccagucugcuuggagauacacagugcgggggugguccacuggguaaugcuccucuugaucuguacacugguuagauggaugugucaggguguaagaaauucacugagcuguauacaaugucugucucucuacauccaugucucucucucucucucucucucucucucucucucucucucucucacacacacacacacacacacacacacagguugaauaugcuaaauuggaaaguccaaauuccaaaucaaaacauuuugagggcugcaaugccacaaguggaaaauucaaccucuggccguguauaaaggggcacacugcacgcacugcauaaaauuaucuucagucuauacaaugcagaugaaucuugugugaauuuuguaaucagacucucaucauacaucucaccauggauaugcaaauauuccccaaaucaaagcaaucugaaauccuaagagccucuggcuccaagcguuucccauaauggauacccaucccccauuugcccuucaguaaagaguauguaaauccauacuuuuaccaaauuuuaaaacugaucacagcacuagaaggucuugagaguaaguauucucaccacacugguacgggccucuacccagguggggcucccuuaagaaacuccaacacuucucaacacccagcuggggauccaaaccaagucguguguguguguguguguguguguguguguguguguguguguggugugugugugugugugugugugugugugugugugugugugugguguguguguguguguguguguguguguguguguguguguguguguguuuguaguccaggcagguacuggguaaggagugaggaggguaggggaagcgcacuaaaagaacaggaccaugugugccugcaugcacacuguccucagagccugcccagucauuugccuaggauguucucuuugcgaaagccaagcgauugacuaguugaguuacaagcacuaaaaauaguaguguuggacacauuugagaaauaaagcagaauuauuaaaggcgguuaaggugcacaaggguaaaggaauguaaggcaagguuugucucccucuccgggcugcagcccgcuagucacauauaacccugggacaguccugaauguggcucaacuucguuaauauuaugaucuaugugauuuuuuugguagcucuaucguguaacuccugagugugaacuuuauaggagauaacugucacgauaucaaaaguucagacacuccuuuaccuagccaaauuuuaacauaugauaagcaaccuuagaaucucaguggcaaacagauauuucccuucugaucagagguuccaugccaacguggcuuggcugacugggccacacugaccucugggcuugggucuggucagguauuuuuauauaaagucacuugugaaaagcagcacuacauugggcauacucuuuucauggugggugaaagaagagagugacuauacaagcauauuugaagccucuccuuagaccucagcuaugacccauugaucaucauauuggccaaacuaaggcaugugguuaugccccgaggcaaguggaggaaaauacucccaccuaccgcagagcuaggguagugucuuaguuugcuaugaagagacaccgugaccaaggcaacucuuauaaaggcaaacaaaaaaaaugggggggggggcugacuuauaguuucagagguucaguccauuuucaucauggggggaagcauggcagcaugcaagcaaaccuggugcuggaggagccaagaauucuacagauccgaaggcagccaggaggaggaggagggucucuuuuuucacuagguggagcuugagcacuaggagaccucaaagccugccuacacagugacacacuuuuuccaacaagaccacacucccaugggccaagcauauuuaaaccacuucagguggggaaugagaaacuggacaguaaugguaucuucuaucagacuuaaugaguuugaacuauggaguguuuguugacucauggcaaaggguacucugcauugguuggugucucauaugggccauguuggccuugaacuccugcuauuucugcucugccuccuucauguuaggaggguuacagguaugcacccccauaccuagucuccuuugacuucucucuuucuagucaggcaagacucagauuaauuuucccuauaaguuccacccaguuaaguuucucuaaaucuaauacauaagaccuauucauuugugagaagugauuuucuuuuuucagaauuaaacucauuuuaaaagacuccuacugagucuuggauaaauacauggaguugaggaucagucaacauggaaaauucgucacuccaccccccccauaaccuuuucuuucuuuaaggaggccaacguauguguggaaacgacuccuuucucuuuucuucuuuagcccacaugcugcugcagaucauacuacccaugacccucugcgucuugcucagcaucauugucugcuacuggaaaagucagugguaaguggagaggaagccuucagucaagaguuggaagcagaccguaagacagaagugguacggaauaauauggggaaaggaugagggggagagcaaagguacggaggugagcauaugcaaucuaguugacaagcuugccuucugggucacuggauggggaaaagaagacucauguaugaggauacuugagagcgcucccucuuaccgaccccucugacuuguucaucagucuuguucuugccacucuuccagggugaaggagaagugcuacccugacauucccaauccguacaagagcagcauucugucacucauaaaauccaagguaaauguggggaugcuguauguguaccaugcccaugaagaacuaauccagccgggcacgguggcucaugccugcggucccuaccuaugugagccugaguccagucucaucuauauaguuaguucuaaggcuauguagugagacucuccuucaagaaaaacuaaagugugugugugugugugugugugugugugguaagugacagaaaagaacucaucuugguuugaggcuuuauugaucaagcuuucuuauacaucuucaggaaaagcuaauaaauuagaagcacaaacacagugaugaggcaggcuggaccagggcacagcucagcggcagaguagccuugccuagcaugagugaaguccugguuuugauccaucccagcauagagccaacaaaugugauuacaucuuacucauugcgggcuaccagaaaagucaguggugagagaggagggcuucauccaucugggagucagacagauuccuaagacagaaaugauuuguucuguccuggugagucauaugguuuuugucacaaccuucaaguucacauauggccaggaaggaaugagaaacucagugcacacuguacacacgauacacuuggauacucccucgugcauuuaucuuaacauauguuugauuccguugcagaagaauccucacuuaauaaugaaugucaaagacugcauuccagauguccuugaagugauaaacaaagcagaaggcagcaagacacaguguguaggcucugggaaacuucacauugaagauguacccacuaagccgccaaucgugccaacagaaaaggauuccucagggccugugcccugcaucuucuuugagaauuuuacuuacgaucagucagcuuuugacucugguucccauggccucauuccagguccccuaaaagacacagcacaccaacuuggacuauuggcuccaccuaacaaguuccagaacguauuaaaaaaugacuacaugaagccccuggucgaaaguccaacugaagaaacuagcuugauuuaugugucacagcuggcuucacccaugugcggagacaaggacacgcuugccacagaaccacccgugccagugcaugguucagaguauaaaaggcaaaugguaguucccgggagccucgcaucaccuucucugaaggaggauaacagcuugaccucaacgguccucuuaggccaaggugaacaguaaacaccacgcagcacaaauaaaugcacuccacacacuauaggcacuuugggagauguagcuguuaccaugccaacaccacgugcccugguugguuccagggguggggguugaggggagacucauuaucugcagugcugauuuaucaacgaucacuacagaccaacagacuuaaggaccauauaauaugguguucacccugaaggcguucccuagaaauggcagauccgagagcaugcugaccuugcuauuauuugguccaggcucacccuuauugcaguagcuugacauaggguguacaccagucauuucgcagagccuaccuacucaaaacuacacaccgaggcugugguccuaggauuuugauuugcagcgagaaagcaucuucuuguaaacuuaaccucacacuuaaaaguuuaaggguaaaacaagugggucagaaguuuugauuagcaccgcaagagauugcuuacuuugauugugcagauuuaucacauuuaauggaaaggcuacaaacuagguuuuggccauaccuugaaaugagaacuuguggucacugauaaagcagaaagaacucucuucgugucuacaccuuauguaacuaaccaguaagaugugcaaauggacaggagacucuucaugcgucuccugcagucaaacaggauugcaaggagcuccagaccugcugcccaggcgacugcauccuguccaacagacuccagucuuccucuuuaguuuuugacuaccucagaacaggaaaaaaaggacauuucauugagugaugccuuuuacauauaauauacaccaccucccgccccugcccccaccccaagcuguaucuagaugaccuauuucacgagcugaucucugcuuuuugcacgcuugguugucugguucaagaaaauucugucucacauuccuauugugcuaaaauacuauagccccagaacuggguauaauuuaaacuguagaagucaguugugaaggacccaaagcaugucuuuugacaaaaaucuacuugguccuaucuguggguuucacaucaagauucaaccaauuucagaaagaagauauucuggaaaaaaaaauugucuguacuaaauucauagauuuuucuuguuauuccguaaauaagguauuaacaauuuccauagcacuuacacgcaccagguauuaggccacagcauggaggaguacucacuguauacaaugcuauuuuuagguuaaggccuaaacuucugaagaucuugguaacagcagagcuccuguaaucaacuccuggaaugugccauagaggaaugacuauauguaacagcugaacacuuacaccgguuccuuccucuuaaugcuugucacauugcagaccaagguggagagguucuccuuuuguuguuagcuacgugugguagcagugaugacuuugugcgcaugugcagcuguuaagugcuauagcaugugcuacaggguguggccauagaacauaguaacagcaaccacgaauguucaacacaagcuguccaaucuucucuuuacguaauaccaagccuuugcuagaaagcauggcuacaaccuaagcuaggaucagccaguaucuugaguaguuuaggugggagaagacuuugcucacuauugcagaugcucuguuuacauuuucuugucaauggacuucucacuggaaacuugcacccagaaauguuaaugacauugauuugugauuuuguuuuucauuucaauuuugguuaaaaaauaauccauaaaacauuucugcuguuucaauaaagcccaaauuaaaacauuu

SEQ ID NO: 7671 - RNA, 101129 nt, Mus musculus
cuucacccucuccccaaagcugccuguccugcaggauccuggcccuuugcuuacagaaccagacugacccagaccccuggcgacuccagauuccagcucagggaacucggccucaaagaugugaccuucuagguaugguauggcuggucucugugucucucuucaccuucgggcuucugucuauacguucaugccccaucugaaugucugaguucugccugugguuccuccuuguuugucccauacaacaguauucuuuguggguuaugugcuguuagacauacucucuagucauuccuuggucuuccacugagacuguccuacuuugcccuccggccacuguaaugacagcucugggguagagaagucaauagcgauauggggguggcgucuauauacaguuguauagucugugcaaugcacagagagcucaaggaaggaaggaaaugggacuaacaaucaagcaugaauucugcucaccaggggacugagugacaggaugcucuggacaccugggaaaagguauacuacucuguuuuguuuucuaugauaaauacuuauauaaaucugaaucauauggugagguugaaaccgaaugacugcaucuuguccucauguuaccgcugaugcaauuaucaagaagugauauuuugauuaucugaaaauauuugaugguaaaugguuaagcugugugugauuaauagaugacuuagagcaguuuuagcuuuaacaacaacaaaauaauaagaaaaagcacagaaagguccauauauccuugucuguccuuccaccucuagguccucuagcuacucauaauuugcaguaguaugauauagucauugcaauugauaugucaauauuagguuauuagaaauaauggccacaguacauauuagaguuuaacugugaucuguggguuuagauacauguaugauggcagguaugcaccucuacugaauuacaugcagagaaguucauauccuaaagagccugguguuccacuugaucaagccuucuuuccuuuucccuccaccccagacccuggcaauagucuguggacuauuuccauuguuuuccagcccuaguccccaugcccucuuuaaucaaauggacacacccaccacucuuuuacacaagcuuccauaucuuauaagguuucuuucauuugugaggccaaaguuacucaucuauguuugucuuguauucacuucuguugaauguguaugcuguaucaguaggaaacaguagaguuauuuaacuauuuuggggaguaauggguauaaagcagagguuaaugggcuacuaauacauuuuaccuuagauggcuguggcaccauauugacauauaaaaagagagaugagaagagaaaaugcaaugaacagcaaaagaaauucaagauuuaaaucuaagauuuggcauggaguuaacugaaggagcuguggguuguaacucagagagcuggcauugguugcaaacacacugaugggggucaugucgcuagacucggcuuuauccuuuauaaaaugcaaagaucugaccagauacgauguagcuuagaaacuccccugaggucaaagguaggcuuaaaaauaacgagcuaaagaaaacuaguuaaagcaaacuuuggccacacagaagaguucacauaaucccaccccccgcucgucccucccuccccccagccugccugccuagcaguguuugugagggacacagcaacuuuccugagaguaagaccaaaacaauauuuuaagaagcggcaaccuccaguuuaguuagggugagucauggcuccgcacucugguggcugcacugaccacagacgcuggugaagagucuauaggcugcucuggaaacaucugcacaaaccuuuuauuuccagugcuuugaacggaaauaaacgcggucagugagccaaacuccccauuccacagagcaaaugagaaguuagagcauaaacgagagucgguagcccaagcugccugguucuggccagcauggcuaugugagcugucagcucugucuuaugcaaggagcaggaagccugugcacaggaaagugggagcugagcuaaaguagacagacuuuuauugugcuucugacugccacuuagaccguuuaucugaaggcuucccuaagagcggguaaaaugugacagaucgugaaauaacugaucccugacuuuggagggugugaggggaccguucuuaaccacuugcucucccgucccuguguaaaauaggaacagugugauugugaagacaacgugaagccagaauagguuccccaccuacugcacauagacagaggugggacugagggugcugguaccgcuaugucauuugccuauuaacccauuuuauugacuuguguguuguuuagcuuugcaguccuucaugaauuucgaagauugaccacugucaaaugugucgauagcaaguaugaguggaaggggaaauaggagcacugguggccaaaaaaauacgugagaagaguucacuauccuaaggccuaagggaacugcaaaaggaaacugcuuuccaaaaggaaacugaauuccaucucccaccagccugaagggcuaucacuaggguaacguuggugaggauguagagaaagaggaacccuuuauaaacuguugguaggaaugugaauuguuaaagguaauacugaaaucaauauuaugaagaaaugaagguuucucaaaaguccuucaaaacagaacugugguaagagccaccuguacaccaccugguuacaugcccugucuuuguuaggguuuucauugcugugaugaaacaccgugaccaaaaagcaagcuggggaagaaaggcuuuauuuggcuuacacuuucacaucauguugaucauggaaggaacucaggacaggaacucaagagaggcuggaaccuggaggcaggagcugauacagaagccauggaaugcuugccacucauggcuugcucagccugcucucucacagaacucaggaccaccagcccagagaugguucaacccacagugugcugggcccucccacaucaaucacuaaauaagaaaaugccuucauauuggaucuuauggagacauuuucucaguugagacuccuuccuuucagguaacucaugcuugugucaaguugacauaagacuaacuauaaacaccccaaggacucuuaucauaaacauaguguacauccaugguuacuauuaagcucuucacaguaauaauacagagaaaauacaacuguccuacauaucugucaacagaugacuggauaaaggaaauaggauauauauauauauauauauauauauauauauauauauauauauauauaauggaauuuuuaaagauauauuuauuuauuuuauguaugaguacaauuguagcugucuucagacacaccagaagagggcgucagaucccacuacagaugguugagagccaccaugugguugcugggaauugaaccucaggaccucuggaagagcagucaguauucuuaaccacugagccaucucuccagccccgugauugaauuuuauacaaccauaaggaaaaauaaaaucuugacacuugcaggaauuagaaaugucauagauagaauuggaagccauugggcaaaauaaagaggacccagaaagacaaauacugcauguuuucuuucauaugcagaaccuagauuaaaaugaaugugugugcauguauaugugcaugugugugugcaugugugcgugugugccuauguguguauauuuaggauaugaaacuagaagggggaucuugagagggaagaauagauagguggggugggauggaagaaauagguggggugggauggaagaaaggauaaugagaugcacaugguauuuuaagugcuuuucucuccuuucucguuccucuguuaauuucucacaucuccccucuugccugugugcuccuuuccacucuguggccacuccuucuggagcuuccacaguucauaaguccccugcaggaucugccuccaagcaucagagucaaaggaugcaauccauucucauguguaaggaacucacuaauagaaaaugggugucugacacccauccuucuaucuugaguacaggaaggaaaaaaaaucaucagaugucauucuggcuaauucuagauauugcauuuauacagucaccucugguuaauugaugaauugugucacuaccaguacgugagaagucauuagaaugagggcuacccucugggcuugugagaauuugaugaaaaggaccagcuaaaagaauugguaaucugggacaagugauaguuucuccacuugcaccaugauaguuaaccuucaucguuaacuaggcuuaauuuggaaucacauaagaaacaauccucucgguguaucauuucuagagaaguuuaacagaggagagaagguauccuguaucaaggugguacuaccuccacuguaguccuggacagaggagggcagagguagaaggagaggggaagagagaagagaggaggggagagcaggugagcaccagcguucaucucucccugcuuccugacugcaggggugauguggccuucagcuccugccgcugggcuugcccccaaacgccucucuccuugcagcaccugccugucugguguuuugucacagcaucaagaaaaggcacugagauaccuguucucaaaacugucaucccccucuccagauugaccuaagagaucuggcacaggaccuuuuugcacgggaccucucuuugcagaaccuuauggacugauggggucuaccauucacccgcagaugcagccaaagagagaggaccucugucucuccuccccugccucucuucugccuucugacccuuugauagccuacuuuaccuugugaauuaaguuuuauagagcugcuuauucugcugcaguguuugccaugaacuacuguuuaauggaaugagguugugaaaucguauccuuaacccuggccucacuuuuuaaaaauuuaaugacaccagacuugaauuuuauggcauuuucaggaauagauuuuuuuggccuguugaaauugaauaauuugucauuuguuugagaacugacuguuggaaaauuaaauuaucuucaacaugcagaauuacuuuaacccauuuaauuguguuuuacaguuaagggacuggaacuauguccgcaguucuuugaaauaugauuauaugcauugcuaugucuugucuaaacauuaucuaauaggauuaaaagcuaacuucuaaaauaaagaugaaggggaaaguuaaaaaguacaguuaaagagucaauaucccaaugaauacaauugcaaacccugcgaacaaguucaaggacgucuucagugauaacaaauaauaccuaucaagaaauauaaacauagaaggaacuauacauaauuugauuuauccuauccuguggauagagcauagagaagcauuagaaacuguaguuagaagaccugaaagcaaacagagagaucagagcacuuuucagugccucuuaaagcaauucuucuuaguuuuaagagaaacuaucaaaaccaugugacagaucucaaugugcccuuuguccuguuaggagcggcuuuuucugagcauuaaaaggacaaaacccaggcuaucaagauggcuuagcaggugaaggcuuuugcugucuuuacugauaaugauuuuauuuauguacacaaaaucuaggaugugcaaaugagagaaaauauggcauucgucuuccuguacagggcccaguucaucuaacaggaccagcuccauucauuuuccuguagauggcaaauauuauucuucauagccaagcuaugcauauauaugcuacauuucucaucuaggcuaauuccauagcuugucaacugcuaaaagggcugcagggaacauggauguguaguaucucuaacaauuuugccaauucugagaaccagaauuugauucccaggucuugcaugguggaaggaaagaacuaacucccaaaaguuguccccuggcuuccacacaugcaccauggcacaacccuuucacaacaaacacacagaauauauaaguauaauaaucuuuauacaacagaacuaaaguuacauuagaauuuacaucuuccgcuauagcuuguuucuuaaaguuuuuuuuaauccaaguaaaauguagauaucuuaauaagagcucuaaccagauguagaaaacauaaugaaaaaaaguaaaggagagggauaggguuuaguuggaacugaaaaaaauguauuuccucuugcugaaacauugacuuuuaugaggcuuuuuaauagugagguaggcaaccacucccgggaauacacccaaggaaaucuaggucagaauguuagcgauaucaacacauccauguucccuguggcccuguuaacacugggcaaguuaaccuauaugaaaaaaaaaaacugugguauauauguacaacucaguuaugaaagaagaacgauacuugccaucuauauggaaauggauggaacagguccuguuaggugagcuaagcuguguucagaaagacaaagagcacaucuucugucauuuacagagcucaaguguuauauaaauacauaagucaugauacacaugugacacggaaagagaauagagacugagggugggaagggaucaagagagagagagagagagcgauuacggaugagaggacauggguugacuauggucaaaacucuaugucuuggugaagccaccuccacguacaauggugucuaucaauuacuggaaggauguugaaacccugaggaaugauggugcagacccauaucacccaagagacgucgucucugugucaagguuguuucuuccccgugccuucccuuucucagucuguuuucuaucuccuuuuucugggagcaggaaccuaguuagaggauagcuaggaagagcauaguuaggaagccuuagcaauuucccuuucagggaacagacccuugccuuccagccuagaacuguauaccuggguagcuuuggacuaguagugucuuuuucuucggaacuucagucuacuuaucuguccccagaugcugacauccaguuaacacugccgggacucaggcaagcaguggggauuuguuagcaggacagcugcacccgaggccuccacuugcaaggaaauuucacuuguagcgccccggauguggaaaugggucagaaaagcagacuuccucagaucgggagauggcucagucaaugacauucuggccaugcaaccaugaagaccugaguucaaauccgcaacacucauauaagugugugacccuaugauccuggcacuggggagguggaagcagaaagauuccuggagaguccuggcuagggaguuuugcugaguaagugagcuuaaauuucagugagagaucagaagggagggaggaagggagggagggagggagggagggagggagggagggagggagggagaaagcuacacagaaauauaccccaccucuggccccuauaaguauguguguaccuguacacacacacacagagagagagagagagagagagagagagagaauacagauuccaguucuacaauagccacuacaaaagagcaggaucccuggaaacccuaguguggguacacaagcuuuggucugguccuucaauuaaucugguagugagaaagaggcugagggcaugaaguugcucagacuggacuaccagucacuuuaaagugucuucacguggaguuaguuauuuucucauaauuaaauuucucaaaaucucuggguauucuuuucuucccacauacucauagccaccaucgaccuuaauggcuuugcauugucuuuaagauaaagcccaaggccgagucugcucugcccucaccagucuuaucuuccauugcuucuuuuaucugucgacaguagcucuugauucaguccuucagaggaaucaccugacaccuccauauccaguagcaucuugcuccuccuccugugagaacuuuuacuguguuuacuguaccaguucuucuuugcucaacagcucuuugggugcaagugugccguuuguaaaguggauauguguuuguguggaucgauguggauguguguguguguguguguguguauauaaauauaaauauauauauauacacauauauauauauguguguguguguguauagauguguguuuauguguguggauguguguuuguguagauuuaugugaaugugugcagauuuguguauaugugugugugaauguguggauguguguggaugaacuuaguuccuugccuagcaagcaauguauagcuguguuggcuccuuaguucuugccuuuccaacucuuucccccauucauucauucauucauucauucauucacuuuacauucuggucauggcgccuuguccauccucuccucccagccccacccucacacaucccucucccauuuacccauucugaggagaaggggacacccccuuggguaacagccugccugcccugggacaucaaguugaagcgggacuaagugcauccucucccacugagguccaagcaguuaguucagcuacaggcaaaggauccaaaggcacacaacagagucagggauagccccugcucucauuguuaggggacacacacgaagaccacauugcacagcugcuauauauguguaggggucaguccaugcaugcucuucgguugguauuuugaucucugugaggccucaaugggcccagguuaguugucucuguaagucuucuugugguggccuugaacuuuccagcucauucaauucuauuccucacucuuccacagacucccgagcucugccugacauuuggcuguggaucucugccucuguuuccacuguuacugaaugaagccucugggagacaguuuugcuaggauccugucugcaagcauagcagagaaucauuaauagugucagggguuggcuuucuuccaugggguggguccaaguuaggccagucauugguuggcuguucccuccaucugugcuccaucuuuaucccugcauauguuguaagcagggcaaauuuuggguagaagguuuuauggauagguuuauuucccacucuguccacuggaaguccugcccagcuauaggggguggccacuucaggcuccauguuccucuugacaacucucaauagcagacauuaacauaucuuccuuuggccuuuucuuccacccuuaccuaggucagggccuccuccauguaccucaguucccuuuaauaacuuacuguauuauaacggcacuuuuuccaucagacuuugugagacuucaguaucucuaagaaguagaagccggacuccacugggaaucaugaagucuaggguuuugugaacagauucccagagccuggcucuuggaugauccaaaaauguuugaaguucucucaccgggagcuaauauccaaccucauagacugguaaagacuaacggauggugugcacacaaggcucaaaaaugccuuauuagcuguugccagugguacaaaugcguaugaaugggaggaaucugcucccuuucuugggaacagaugaauccuuccuacuaggugagcauauuucuaagugagaaaguuaaaggaagauuaaugcgcugucuuuugcaucccauucuucugaacuauuuguauuuugauguaggaggagauaaaacaacauacucagucuaaaacuggagucagcacagagaauggcuuugauguaaugggccugguguaauugcaugcuugcaggagccuggggccuggaugcgcuccaggagcaagcauucauaacccauccaugagucagaugguaccacuuuggagagguuuuguuuuuuaacacaaauaugggcuaugucuauaguguuugggaaacguuugcaggagaucucacauaaagcucaguuugcaaauggcaaucaugaaacccacuugagcgccucguuuaaaucuucugccugaguaaccagggacaaguagccgacaucuggaauucuaggguagaaccuucauaaggggauccagguuauacagaucuuggugcaauaaagucuaucuuauaucuuuaauuuuuuuuauagcagugaaauugaaccuaggacuucaugcaugcugggaagcccucuaccacggacccauaucccuggcccucucuuacuuuuuagacagggauuuguaguuugcauagacuggccuugaacuguuuuuguuuuuccagacagggcuccaguaaucagcuccuggcuguccuggaacucauucuguagaccaggcuggccuugaacucagagauccaccuaccucuagaauuaaaggggugcacacagugcccagagagggcacucuugaccuuuuagcccuccuuggccuuucaagccuuuuggguagcugggauuacaggucuauccugccaugcccugcaaaauauucuaagccaaugagacuuuuuuuuuaucuccauugaacauuuuuuacauuauaaacuuuacugaaaaccuaaccgagguaggauaacugauaaaacuuccuaguguugaaagaacuuuccuaauucaaaggauugaaguuauaacguugguguguccuugugugaacacugaugccuuaacaugaaaguuccgaauuccauuuucugaaccucacccggaacuggacgagagguggguaauaaggaggccuuuuaaaaugacaaaaaaaaaaugugaauuccuucaaucucucccaaaguaguauuccuuuacccucauagcccacaagccuggcugauuaagccuccauuggcagauuugguggaugagaagggagaauguuugauaauagaggauacaagcagagacugucuuugcauagcacggaaaaggaacgaugguugcaagcauuguuauaggucaugguuaagccuagcucucugcugugccuucuacaguguccaguauguaguucacuucagauacuugcuccagaugauucugccucauucagacaggaaguaaaaagcuuaugauaccagagccacugggcacauaucuauaggucauuguggcuuaugaagugaauauuuagcuguucagugugggaaggggaauuauguugggcacauacccaacaguaaugcuauauuugccuugaugcuugguacuaccauacucuccugauugcacaugggagauugagagaaagacucguugaauggagugaaucaaacaugcuaucuugguagagagcggaugaacaagagaaugaacagguucuucuggggaacuucgaauccaccaaggaucagcuagguagagaucucaugggaaauacguugcuaugcugaaucagguagacagccauuuuaaggccagcuagaugcagaaggguaagagugauugagugacuguuugugugaccaugucccagugcuuuggaaugacccaggccuucugucuguguuggcacagaaccuuucuaccaaguuggaacgggaucugaaaaucugcauccaauuuucgggggccaccacggcacuucugcuccuaacagaagccuauggagaucacugaaccuuuguguccucaugugcuucaacucugauguuuaaguaagggcuaugauaaaaaacaaccuucaaacauaacccuggcaaaagucaauaaguagccuugcuuccucuggccacgucccugacaugcggauccagggcucuaagaagguuuauuuuaauuacaagcucuuucacccuuucucucucugacacucauggccucuuacauaacauguaguacagcuaccaagcugaaauuuuccuucuugagauaauuaaauagagcaauuugcacuuggcuucuucuucuucuucuucuucuucuucuucuucuucuucuucuucuucuucuucuucuucuucuucuucuucuuuuuuuuuuaacgauucugguuaagucagcaugugggauaguuuuucuaagauauaugacuuaaaauucuccuggagcuguagaccugagugacauguuugcuuuucugcaccaacaauaguuuucuaacuuuuccuuugaccuccaguauuuaugagacguugcuaauguuucuuguuguuggguuuugauuggguuuuguuuguuuguuuguuuguuuguuuguugagacacaauuccaguuccauguagaucaggucggcuucuugugacuaugugguugagagcaucuugagcuccugaucuucuugccucuacagucagaguucuggacuugcagauaacgcaccauuaugccuguccugaaaaaaaaaaauguuccucuuaaagguauuugauucuucuuuuacaauaaauuuuauuacuuauauucgagguugcaacaugauguuaugugauauuacaguaagaugguugcuucaaugaaacaaaucuagcauauuuaucaucuacaauucucaugcauaguaugauuuauuaacaacaguuaacauguuguacauuagcucuugauacugguucauccuacaucugcgccauugugucuggaccuguuucccugccccuccuaccucaucccuaacuccacuccuagugguaaguguuaacuucuggguacacaugugaccgucauuccucagauuccaugaauaagugagaguguggaguauuuucucucugguuuuguaugcuucauuggucagaaugucauucagguccauucaugccauaguaaaugacagagucuguucuuuaaauguuucuguagaucacaguugccuuauauuugucuguuuguagauacagauuguuccuccaucuuggcuauuaagaacaacacuguaaggagcccaggagugcagagcacacuacacguuggucacccuacauacauaaggggcauugcuggaucauaucacagucccauuuuuaaucucuuuagggaucaucuacuaauuuacaugauggcuguaccaacgagcaucuccaccuauucccacuguuuguuaguucuuccuuuucuucuugcuaacacuugacaguagccuuccuaacaagugcaaacugguggaucauagcaguuugauuuugcauucuucugaugaggaaugugauguugaugauggugaccacuuuuauauauaucuccuuugaagauaugucugcucauuuuuaauugauuuuuuuccugcuuuuguauuauaagaauuauuaacaaauuuugacuauuaccucuguauuggauaugaaguaugcaaauauuuuccuaguccauagguuguuucuucacuauguuaauauuuuucuuuagcaguguaugagcuuuuuaauuuaagauaaucugaguuauuuauuuuugcuuuuccagaauggacucuugauauguuuuuuccuaaauauuuuaauaauucuuugugagaacuaguuuacuuccaaaaacucuuauauggaacugauauuugacuauugaaauuuacauacagagucuacuggaaacaauccacucucuacaacucauggaaaguuagcguacauuguaucauaucaaaauaugcuuaaacuuguacuacagacuacaaaauuugccuucaguuuaacaacauguugauguacuaaccauuaacugaaaauguuacuucaaugcugaccaccagcuccaaguaaagagaauuagauuauaaagcacauggugucagaggacucuaguuccauuaagaagaaacagacacauaaacaaauacaggugauucuaagcacacaauagggcuauguccucauaagugcauauuaggcugaaaauauacacagcucuccaacaucaugccuugacuauauagcaugcgcagaaccgcugcuguugaccuuguaauccauugggacuuggaagcuaugggucaccaccacugcccugcacugucaaaguaccaugcugagcauuucuccucugggggugggggaagggggucgagguucaaaauuugggguaugauuacuccagaauauuuaucacauuuacauuauugcaaagucaaaagcuuauuagacaagugaucauaaaucuaggauugucuguuggaagggucuugugcucuguugggagaccaggaccaaaggacaggagagagaaguuagauaaugccuaauacaaagauuuucuauuuuaaaggcagccuuagggcacaauccggggaggaguaacagggacuaauagagacagucccagugaggaccugcuggaggugaauucgcaguagacuggagauaacugagcacuuuggcaacuuccuguaguauuuucaagggggguggggugugcagaggagaaacaguuuccaaaacaaggcauuggugauucauugagauaauuuuuauggucuugucuguuucacaaauccucugauuuauagccaaguuuuaacaaacguuguaaggcaugaucugucuucauuugaagaauguauacuuauagcccacggcuaauacgcauaaacaguaccuucccaagguguuuguucuugguacauagcaacagagcaaagagaaaauaggaaaaugacacacacauguguuugcuggaguggagaaaaagaaguaacugccuuccucacuggccuucauaucuccgacugucugaauaaagauguauaaugucacaagugucugcucauacagaaaagggcuuccagccuugccugacaaaguaacaaccugcuuuagucaugcauucugucagcauguucugagaggcuuggaacugggaagagggaaaccaagaagugauccuugcccgcaagagagauguaaacagauacuccuagccgagcgugauaagcacuuuauuagaaguggggccagaacccugagcaaacucagacaagugagauggcugugcuugcuggcaacaggagaacccagugugaacgaaggaggaggagggagaugcaguggcauuucaaacauaggaaacaugagaggauuauuaaauuauuauugcuaauuauuucuucuacaucucugugauaaguuuagauuucccacccgugaucaaggccaagguuggucccaugacuagccuaggacauaaaauauugcuuaaaagaguuuugugcauuucugagcaaaaccuuaaauacuauguaggcauuccaaugccacacuuuacucucugcuaaaggagaaauccauuucagaaacagguggcucaguuuugcuucaagaauaaagacacugaaguacagcuaaagcaagccugcaggacaugcguaaauaauacaguaggaauuaaacucacaccguugaagccacaugagaagugaggauuguuguuauagcagcaugcuucaagaaagcagacuaaaggaguacagaggcacacagcaagggcagggaaucugauugugggccagggaauaaauuugguguuggagugaguaggcaguuagauauaaaccagacauauaaauggguagaauguuaaaggauaucuuuuuucuuuuuuuaaauuuuccuugacuuauuuauuuauuauaugugacuacacuauagcugucuucagacacuccagaaaagggcaucagaucucauuacagaugguugugagccaccaugugguugcugggauuugaacucaggaccuucggaagaagggucaguguucuuaaccucugagccaucucuccagcccuguuaaaggauaucuuaaaggcuccuuugaaaaccugaacuugucuuuacaugguggaaaccuagcagaagccaagcagugacauaucaggguuuguuucuuaggaugacaacucuaaugggagugaaaagagaccaggaugguugaaugagccaaaacauuguuacaauauuaauagcuaccauguacugcacacauauuauauaggcagacaucucauauaugcucaccaaagcaauccucucaauggucccaugagggagauauuguaguguuuccuuuuuuaaaaaaaauuucuuuauuaauucuuugaaaauuuaauagacuguauuuagauuacauucguuuuccaacucuucccccuauauccugccucccuaccacuccacaagauuguaacuucauagcuuucuuuuaaauaacccagcaacugcaucaacuugaauuugugccucccacaagcuccuggggauagggucauccaguggaauguguccaaccuaucaggagccauacccuuaaagaaaacugucuucucccucacccagaagcuguuagcuguccauagcuccccaguuaggauuugggacucauaaacccauucaucuuccauauauugacugucuugaucaugugcaggcaaugagagcugcuguguaugcccauggguggagugcccugucauguguaggagacauuguuuuuucucugaucuucucugauaccuguuucauaucaucuuucuaauccuccuccuccaaggugcugagccuggggaagggaugagauguagauguuccacuuagagcagagcaagcauccacugaugcuucuccccugcacuuuagccaacugugagucucugcauucacuacuaucugguguacaaagaaacuccucugaugaagucugagggaugcucgacucuguggcuauagagauaaggaugcagagggcaggucagugcuaugcccauucaccagaauaggagauguaguuuugcuuccagggccucugaacuccccaaugauggguuguguuucuuuucauauagugggucaaaaauucaaucagagaccaguuggcuaccucuauaagacucaugcagcuaucacaucuagagacauaucuugccacaccagucuuuauuucagcacccagaguucacagcuggggaaggcacaugacucccuucuucuuaacucugggaaccugcagagcaccuucuauaaggcuagccagcaggggaaaagauuucuggccaauaucaacuuuaaccauguccugucacugccauaggaugguauauugagcaauagggaucuaucaaguuguggugggcgagugauuuauuucuuaagagaggaagaaacugagguacagagaaauugacugauauucuaaggcaagguuucauucaaccucaggcugaccucaagccugccuucugaccuagucauuguuuugcugcugugaagagauacuacaaccacagcaacucuuauaaagaaaagcauuuagcugggacuggcuuacaguuucagaggcuccgucuguuguguaugguggcgcacaggccaauguaguagcugagaguuauacaucugaauccacaggcagcaggaagacugggccuggcuuggguuuugaaaccucaaagucccaguucuauacuugcuuauagugccgcuuccuggugaccaagcacucaaagcucugagccuaugggggccauccuaauucaaccaugcuccugccgaguacugagauuagaggugguucaucaucauaccuggcuagaaguucacuaacucagcuaggccacagcuaagaacuggguaguacgcugucccuguaaccuuuauacaaaugugaagauagaaaagagagggucggcucccauguuuccaagaucacacgggcuauuggguguauguuggcucguaggaaggacagacccagggaaaauuugccugagaggcugaggauuuggaagaagaccaagaaacagcaggggaaacacucaaagaaagcaucaugggguuaggaagaagagaugugaagagguccuugaguggaggggaaagaaagcagacugccagcuccaacuaagucaacaguagaugccaguaggccuugugcauauuuaucacuacagaguugcucgugaauuucaaagucaaguuucccauaaacggggagacaaaggcgcacugcuuuaauuuacaggaauugccuaauuccaaacagaguaaugaaaaggcuuuaaaaguaaaaucuuuucuggaacucucaccugcccggaagaaccggcuuuuuagauucaccucaucugagcuuuccauuaauacuauuaaauuucaacagcuuggaacuaguuagcauaauauuagagacauuugcauagaauuccuagggcuuuuuaaagaacaccuauuagaauacucuguuuugcuuguuuuugacuguguaaagaugcuaggaacugaaagcuaccguuugugaugagauuuucuacuggggauuucucauauccacacuuucaugaagaagauagcauugugucuguaacacaggggcuucccuggcuggggcagcucaccuuguugggguauuucgagacacugcuugaaaguauccgaugaaaucagagaugucacaugguuaacaagcuugguuuuccuuuucuucauuguaggacuagggccuucuguacaaguuuauacaccccagcucuagagguaauaaaacacggaacuggcccugcacuuaucuuaccauugagucucuccucuuguuuuauuaaaauucuugugaggccgauuauauuugucuucaaacuaucugcuauuccuuuucuguccgucuugcugccuugaauguaagggccaccugaccuugauuuggccaauguaagguggcugcaggcaaccuuugcuauuucuaaauagacaccucaaaagccacccauuggcuaccuauucuuuuuaucuucugcuguaaaacuagccaugcguguggaaggaguuuuggguuuuuguucuguuuuuguccagaguucuggcacaucuagcaauggaaauaaggacgccuaagaaagaaacauuggaaguuaucgauuauuaauauugugagucaguuguugccacaaguacauuagccgacauuggcuaguacacauagccucuaaauuaccugagcuguuuacauucugucucggauuucuaaaugaugaaauguucuuucuuuacacuaggauagcaucgugguuagcuuuaacuguuuccuggccguaacuuuaaauuuuuauaaccuuacguuuaaugaugggucuuaaagucuuuaaccucccuuguagccuaccacacacuagagguaguagaaaaggauauggggguggggguggugcggcgggagggagaggugaaccuguuuagaaagguucuuuggagcaacucccaucuauguugucuggaaauuagcaguucaauucacaggucagcaagcuauggcagcuugauccacucacaaauacuucacagauacaccagcaguccaguucgguagagucagguuagcaacagaggugacacgaccuagcagagacagccaggccucagcaggagggaccuggggaugccaggagaaguucuuggcugugccucucucagggaagcaaagaucaacaaagacucacaagucuugcacagcuagcuguaccagcaggucaagcucucucucugucacuccauagaguccuauuuauacccuccauacaucgugugucuuccacaugccuugccucaguaugguucuugccucaucacaugcauccaaucagccugagucuguguaagcagcaagaaacugagcacaccaccagaaguuuuuuggaguccugacaaaugcugcucaacuacgaaauguaagggagaccaauacaugcauguuguuagcaaagacuccuucaucacaugucuuuucaugugcuugcuuuagcagaacauccucucuccuguguccacuucagugaaacuuuccuucacaaguaugccuuagccauucacaucuguauccacuuuaaugaaauguuccuucauguauuugccccagcaaaacaccaugcaaccgacuuucuaaaaaacccuuaaguuuccaccucacuuggcauagucuagagacaucugagagaagaaaucuccauugagaaauugcuuacauccaaguguccuauggacaugucugcuuugcaugcagcaggguccaacccacugcaucgucaucccuaggcaggugguccugaucuguuuaaaaaggcugguugagugcaugcugaccaucaagccaaucaggaaauaucaucuuccaucauucuugccgucccucuuaguuaaguugaguucuuuggucaaagguaaugugguguagaauacuaaacagcccagacucuaaauccuguccggauuuuucuuaaugauuuguuguaaccucuaagugaaaaucaaaccuuuccucccuaaguugcuuuauuugucaagaguguuuauuucagaguaacagaauuaaacuaaaucagacacuuuaagguaaacuaaaagaaaaagaauaaauauacuauauauaaagaguauguacacacacacacacacacacacacacacacacacacacggcaaugaggcuuaaaguccucauacaagagaggccaggcaggcagacaucccaccaacuggacagucugaggacagggaaagugacuaucuaggcuagugauuugcacuaagaaguacuaggaaggugugaucaugggacgucugagaaguugcgcaagaaaugaccagggguuuagggagcagggagguaagacagagaaaagucaucugccugaaaucagggcuucacuuacagcugaaucuaaauaguccaaagauggcuucaagcaucucuaucuacuagagccacauacuucuauguuguccucuguaaauucuccuaugaugagcaagauggcauugugaugaccaauuuagaaaucuuaaacaaggucucacuguuuuggcucagaccaaaagcaaucuugaccaaaucacugaugcaaggaauacucuauauauuugcaagaacugggccaagugcucacuguagacuggggugguccauggcagguuugcuuuccuggcuggcucagccugcuuucuuuuaacacccagauccaccauuccaaggauggcagcacccacaaugggcugagccuuuccccaucaaucauuaauucaguaaaugccuuacaggcuugucuagagcauaucuuagggaggcaguuuuguuuuguuuuguuuuguuuuguuuuguuuuguuuuguuuuguuuugugagacaggguuucucuguauagcucuggcuguccuggaacuuacuuuguagaccaggcuggccuccgaaauccgccugccucugccucccaagugcugggauuaaaggcgcgugccaccaugcccggcguuuuuuuguuuguuuguuuuuguuuuuuguuuuuuaggaaggcauuuuaucauuugagguucccucuucucagauaacuuuagcuucugucaaguugacauaaaacuauccagcacagagggaacuaagaagccaaacaguucugucaugcccuccucuagcuuauuggcucuguggaagagagaaaagauaacuaccagcaugcacuggaaaacuuucagagauauaagaggguuaucagugguagacucuuucagagcuaugagggggucaucaaugguagacucuuucuguuguuuguuuguuugcuuuagcuuggaaaaagaaacuuguagaagucagaauuagaagaaaagagaagaaggcgagagagcuggcugaugcccacaagcaaaaucacaauagccuuuucaaaugguguuuuugaauacuucaagcuuuucagaaaacucccauaaccuugaguaucuguuuauaucaucagugucaguucaaaucauccauuccccuggcagccuggcgaccgagcuucaauuugaucagacgaaugcacuguaguucaccuaugguuuugcuaauggaagcacuucgggacucuguccagagauccaucucuaguuaaagacugaguugucagagcucuguuuuacuaauuugcacaguguaagcuugagcuacaucuggauuuuacuucaaaucccucccccagcaggaauguagcaaaaugucagguagaaauaguuauguuacugguuacuugauuuuuucuuaucagagacaacuaaccauuguauccaaguaagucucugucaacagcauggugcuguggaacuugucuggugucacaucaauguguuaaaagugauggccaaccuggacaccuagccuccuucaauggcagcugugcuguaugucacucuuggcacuuacagcuguuugcuuacugaaugguguccuguuucuauggcuccaagugcuggcucacauuacagucaaauggaagcaagaaaauucaagcaagccccauaucgaaaaauauggcugauguaauuuaaguuuucuuuguaaacaaacagagcacgaaaagguacaagcucuucugccccucccaaggcuuugacagaaggcaguagaaaagauugggauguagaugucauaaugagagcuagugagacuugcagcagguuaaagcacuuguugucaaaacugacaaccugaguuugaacuccaggacccacacaguggaaggagaaaacuggcuccuaaaaguuguccucaaauauccacguuuccucuagcacacauguacuguucccuucacaaguaaauaaauguaaaauaauuaauaauaauaauaguuuauuuuuaagauuuauuuauuuaauauaugaguacacuguagcugucuucagacacaccagaaaucgccauugaauccccuuacagauugugagccaccaugugguugcuaggaauuaaacucaggauuucuggaagaauagucaguguucuuaaccccgaaccaucucuccagcccuaauauuaauaguuucaauaucacaauaaagcccauuguuuuguacuuaaauuuuuuauuuuuauuuuuaaagagguaauugaguucagcaauagaguacuugucuggcuagcucaaggcccuaggucacacacacacacacacacacacacacacacacacacagacacacacacacacacacacacacacacacacaagauaacaacaacaaacaacaacaacaagaagccuuuaaugaaaguagcaacuuuuguaaaauuuuaaaaguguaaucaguggaagacaugacaucaucugauaaaaauagaauaccuuaucuuggacacuaagcuuauaagaucugugaagaaaaaaaucgauggauagguagaugauagauggauggauagauagacagacagauagauaauuuuaacaagcuauaaaaaggaaaggacaguuguucaauccuaaggcacuuuguuacaacuaugcuugugcuagagacaggagagggguccugugcucaucccugacuccugcaugccugccaggccugagcuaucauauagagcuuacccguucauuuguucagguuuucaucgaauaccuuaaccaggugaaagcagaaggaacaggucauaggucauuaugggaauagucagagguaaugguaagggugacauaagucaguaagagguucuugaacacaaccuuaagcuugaaagucuauuccuaaaguagagaagaggaagcaggcucagagaagaggaaguugacaggguagcauagcugagagaccaggguuagggugugugccccaaaucucuuccccuuucauguuccucagaacuucuguguccauugaagugaaaacccaguagcauggagauaagaucaggccagagagaugacaaacgaacgggacuuagccaagcucccccucaguucuacuauucugagugucugggggaaagugauggcacugggcccaucaaucauccaaacugagcuguacccuuuuccuaaggacauagcuggccucaaaccugcaacaagaugagcguguagauggaggguguguuuaaguagagaugauaugcaagagguaugggauacacugcauuuucuagcucuguauacugacccaucucaugggccuaaaauuauuuuuugacauagugaaaauacagagccuuuuuacugaucauuuuuauuuaaacaauaauaaaagagaacuaucuuuguagaauuuacauugccuuaggcaguauaagcaaucuagagauguauuuaaacugcccagauuuuuauacacacacacacacacacacacacacacacacacacaacuaaaguucuaugucauucuauauaagagauuuaggauugauagggggucuaggaaccaauucaucuuagauaccaagaggugaaggucuacauuuuuguugggcauauauuucuaaggcagaaagacacaggcugucuugauaagaugaaaaaauaaauuauuacagguaguaauaaaacaauauauauacacacacacacacucauauaaugaaaaugaagguuugaauagauucaagaauaaaaggcaacaucagaguuagggaugggaagggcugucacugaggguagagauggguauagcuuaagcugagugaaguuuaagcuaaggagaaugauggagggguacacauggagguuguagaaacuacuauguguaaugggguagugguggggauagaaggcuauacugauagaaggccagcuauguccuuaggaaaaggguacagcucaguuuggaugauugaugggcccagugccaucacuuucccccagaauugggaaaauaugagcuuacgucuuccucugccaaucaugacugugcaacagaaugcgucaugugacagcucagagccugaacuugaacuuuacaucacaggaaagcccaggcuguuacacagcguaaaucuacucauuuauguauagacugacuaagugccuacgugaagggcccuggaggaaacaaaagggaaaugcucuuguccaguugguccuucagcaugauuugacugaggaagagcacagaaaaggaggaacacuugauucuaaagaugaugaaggccugagggaccugggaggaauucccgaagccaauaguuuggagucaggacaaagaguagguggguggggagagauuccaggaaaugaaacaacuucacggaauccugggcaggaugaggaguucagaaugugugaggaaagagagacgugauagucacagguagugacagcaauucuaaccccacagcuguggagagagggggcuccugaggccaucuuagcagaaucagugagcugugguuucaaagaaagacccugucucaaaaauaagguggccagcaaugaaggaaacagugguuggaacugugugaagcagaguagcaaugacuugagagcucugagcuaaggcacucugucuugauuaccuuguaagcacuuuaaguggaagauggguaagcagaacaauagaggcuuugugaauuugcauuuccauguccaagaaugcauucauuuacauaugcaaauaacaggaccgcggacuccggaggaacuucuguaauguuugacacuauuucauuguaacuauugaauggaugaagcuaucaaccggaaccuacacaauuaauagaucuuggaaaaauaaguugucugacacuaacucccuuuacacguuuuuugcuaggccucccuucuagaaacaauagcuaauauuggcugguggcugacugcacacaguaguguggucuuaagugcuaugcuagaggcauagucucccauuuaauugucacaacuaugacccagagauaaagccuaagguuauccccaguguuuugaugcagauugcauacuagaaagucuccugcucuccugaccugggauuacccaguuaguaagcagaaguaagauuccuccuugggcacagauucuagcucacaaauucucauugacuccuuuuccaaaaacaaggucaccaacaacacaaacaucuggcuugucugaauggggaaaucaguugugcauuacacauuaaucucucgugaguuggucuguaugacuccauucucuagggcuccauucucuuccagugaacuaauaaaauaauccaaacugcaaagccagcuguguguggaucaagggcuagaccacaaggaggauggugggagaggagguuagaaaggaagcagaagcuaaacugugcagaucuugaguguguagacauacugaauuguuuccuaaugcaaaaaguagaccugcuuagaaagugacacuggggugauacuuuuaauagugauuauugaguaccuauaagagucuuacauaaaugguuugaauaauuuguucucuuuaauaauacaaaaagauaaaggaggcuuaagcuauagcaauuaaauaauguguuaguaaauaacacaauccuuuguuuaugcacagaauugaacguaguccgagguauuccagggccaagcccugcaggcccagagugauugacuuuggcaugucaaaagcuuugucuucauuuugagauguuaaaguuuuaggucaggaaacacaauagcaggcuucaguuaagugacuuugaccuugucgaaagcucugucucccuuuugagauguuaaaaguuucaggaaaagaagcacacuaaaagaaaucugggugcuguguccacccccaaacuuuccagaguuguuucaaggagacauuguuucccaccuaacacuagcaaaucauuguuuaauauuuccacucauacauuaaaauuauaucauaacauaauacugugcuaaaaaauucaugaugccucauauuugacccugaacuguguauaacucaacuccuagggcaaaagagagggagauuggagcguauuauuuguuuccugagaacauuccucacgucaugguaacuggcuauggauauggucaguaggcucugaacccgaucacugauuuugugacuaacuauauuuaauacuuauccuuugaagaucauguccuagucugaacccauguucugaagugacuugaacucgaacaacuuagauacacagcagcuauaaauguggcccauucagaaagcaccagggcucauucauuuaaagcuucugauucuuaguucacaguaugaugcauaaaagauaauuuaauuaaauaucuuuugagugaauuauuaaagguauaauugcauagauaauugugguaauuauuuauccucaugaaaaaguuaauuauaagacaaagaagauguuauaccaaaucaagauaaauuuuaaggauaacaaugucuuagacauaaacaaaauucuuuuuuuuuucuuuuuguucugacaagauuuaacaaguuaggucuauuuugguccaaauuauacauacugaaggaaauagcaucuuuuggcugaaauggauaauguuauugaguaauuuuguccuucaagaacuuggauaaguuagugagaauuaggcaagucacuuaaucuccuuguuuucuuguccccuggacuaagaaaucucuaggguuguuuucaguuugcaagugucugugaaccuauucauuuuuaaauaugaugcuuugugcuuuucaaaaaauuuccacauuggaaaacugcauaaucuucauuauaaacccaggucucaguccagacugaaagggccccaggaaagcacagauuccagaguguuuugcaagaauaucuucgcucauuaaagaauguuccugagagaaaacaagagcccugugagcagauuuccccacagagcagcugugaaagagcccuucauugaggcuaugaaucucaucaacaacaguacucagggugagaccgugggcgggcccuuuacauaacuaacguuacaccuuuaguaaucucuagguauauagccaugcuccaacgcuugucuguaugcuuaugaagggcagcuacuacuccuaguauuuacuuagacuaauccguuuuauaccaacuauuuucauuaucagaaccuuaaaggcgaacaaguugaaacaaaacauguuucacuugcucagaguucuagauccgauuuugaauauaaaugguuugggucuugaaucuuuucuuacagucauucauuccucagagugucaucuaggacuggaaaaaguugggaugacccaagacaaguugacauacugaguggcugcugugugcuaugagauuagggacuaagggagacuaaaugacacuggcgugcugcuggucuuacccauccaacagucacucuggguagaauguaauggggacuugaauagaagcagaggccaaagaggaaggugguauuugaacucgucucaaagaauaggcuuuugcuaaguaaaguaggaggagauagucuccuguuggacuauggaauugagggugugcugaucagcuugccugcccagauuauaaggcaagcauuaggcggacgguaggugguuauuagaagguucugagugcugugcuaugacagagcacaggcuucugcuacucuguaggcaauaaggaaccacuuggcuuugacuacaggguguuacucugaugauggaacaucagacaguaggcuaagugagaggaaugagaaauuaaaccaggauagcucgagugacaaauucaaagagaggcaguguggcagaugccaugagaugggugccaagaguuccccuucaagaauaauggccuuacuauucaaguuacugggaaggcugccagcaaagaucccucagcugucgacucccuucaccccaggccacgccucgguccucccaggguuuugcgggaugauugauuacuguuugggguauggaggacucugucuuucaucacaacccaggacagcucuaggggucaucccagcuauaaaacucaagacucugccuguugcccaugaccuuucuuugccagaucuuguccccuuucuccaugacacacuucacugggaacauuucuuuucuuuucuuuucuuuucuuuuuuuuuuuuuuuugguuuuugagacaggguuucucuguguagcccuggcuguccuggaacucccuuuguagaccaggcuggccucaaacucagaaauucacuugccucugccucccgcauuucuaagaaaaccucuacacaagugucugccuaggagacaaugucuugagaaaccccuguaccauagaaacugaagcccugggaugcagcaagugauggacgcuuaaacagugaugguuggugcuccuccucagcaccuagaaugaugcucaucacaaccagccagaucucucaccaggacaacugcaacaggcaauaguuucucuaacgcacccuuccaguccauagacggaccaggaggauuugucuuucaaacacccccauuauguacagagaaaaugaaaaauccgagaggcuaagaaucuucuaccuaaucugguccccagauauccuucagucucuucauucuucgugccugcuagguuccaguuaggcucuucuggcagggcuagaacucgcucagcacccgcuugcuuaaugcuccagauauucucauggaugcugcuuucaugccaugcagcccucucugccucaagcuaucccauuugaaacagcaagcccgucauuauucuuuaaauguacuucauuuccucuccaaaaaugcucguuucaagucgauaaugauuugucauucgccuuuguguuuguguguugucagugucucucuuuggaacaaaaggucauaagugacagaaccuugugaacccguuagcuuucaugucccuggucaggcacacggugaguccaugaguuagugaaaggccggggcguagaaagaguguguuuucaguagagaaugagauuccaacuuugaauguguugaguguaaacagucuuuacagcagucagagcugauguuuacaagacaguuaccaguucaguuuccuugguaaagauagagagguguaaagguccuuagagugagugaacuauggacuauguagagacagugccuccuaacugccauugcuggcuugaccuuuugaagagcuuuuugaauuuaaaaaaaaaaaaaaaaggauaguauucuuucaauaaaacaaaagccaguaugggcaggauuaauaaaaggaaaauuaaugacuaaucaaaaaaaauggaugaaaguuggguggcagagacacaugccucuaaucccagcacgugggaugcagaggcaguuggaucucuugaguuugaggccagccugaucuacagagugaguuccaagauagcuaaugcuacacagaaaaauacccugucuugaacaacaacaacaaaaaccaaaaaucaaaagaacauaaaacaacaacggccaaaggcagaaggagagaaggagcaggaaggacucacugucccgucuaacugccgucuggacggucaggcuggaccaucuccaaggagccaaaugaugaccccacacuucagcucuucacuccucuccucugcucuucucugcucugagcugacuaaauuaugggaagacucuuuccagaggaacccuacgacagguggcucaccaggaaauguuggaauuucuuuauccacacaccuagugccucuuacuuugggcaccauuguuucugaucaagggauaguuuuccccagaugaucaauggucuuuccaauuuccccagugauuucaccguuguggcuuggaauuagccauggccugaguauuuacgcuauggaaauuggucagugcuacaaauaaaggauaucuugccuuggagaccuuguguccuggcacaucacuuacuggucacaugaccacucugaaggugggguaguuguggugguuugaaugagaacagcuugcaguguaaguggggucucucccucugucuuacuuacugucaggcagaucgcaucgacaaagucaaugaauuuguugaauacuaaauuuagaagucuaaugaugacaccauguuuuuauccuuugugcuuccacaugaacguuaucauuucuuccuuuugucacauaugaagguguugccugugcccaucacaguuucuugugguuggacccugaccuucccuagcuuuccuuauagccauguagucuuugaggacuuucuauucuuuuaaaaucuuuguaguguuucuguaugagacgaaucuucacuggucaagcagauguauugaaaguuacacugagagaauagugguagggcuuuguucuucaacugaaauucuuuuuaauuucuaaaaggugcaaaccuauaguauuucaauacucagacaaaccugaguauugaaaaauccagugaaccauaacagcaaacaacccaaguguaacucugucaagcuccccugcugcuaaaucacuuggugugaaauuaagacauaaauacagagaacaaacuaguucacuaagccuagugaaggaucaagggauguuccuggcuuuagcagauuuugaguauaagguaugaagauguuuucaaguugaaaaaagaaagaaagagagagagagagagagagagagagagagagaaagaaagaaagaaagaaagaaagaaagaaagaaagaaagaaagaaagaaagaaaggaaggaaggaagaaagaaaaccuuagguuccaccaaaggugcauaacagugugagagucccagccauggaugggggaugggaaagguccuacugagaaacaaugcugagcucaaagaaacagcaguccaucuauguuaaccuauaauaaauaguauuugaaccagaguggagggaucggucagucuguaaaggaccugccaugcauauguagugaccucagucagauuccuagcacucacauagcaacaacaacaguaauaaaacuccccaaauaauaaaaauuggcauagugguuuauauuugcaauccccuugcuaagaaagcaagacaggaggauuccugggacucaaugguuuacugguguugccucauuggcaagccccauaucacagugagagaccugguuucaaaaaguauggcagacaaguaugguugaccucuguccuuugcacaauguaugugagccacaaaaacauauaaucacaugugcacgcugagauacacacacacacacacacacacaugcaugcacaccgaauauacucaugcauguacaaauguacuccuaccuuaugcaggaaugcauaagagaaaaacaguagacucuuacuaaugaagaccaaggaaaggaacaaaaugcauugugggggguuacuauugucaacucgacagcaucuagaaccaccuuggagacauggucugggcauaucuguaagggagagguugguuaacugaagugggaagauccaucuugaauguaggcugacguauacccuggccuuggguccugggauugcguacagaguagaaagugggcugagcagcaacagucauccuucucagcauccuaacugcagaugcagugugacagcugccucacucuccugcugcuguaauuuucccaccacuaaggacuguaccccucaaagugugagcuaaaauaaacccuuucugccuaaggcugcucuaccacagcaaugaggcuuaguaaccaacaccggacuagagagacacaaagggauucugagcauauccuuggggaacagcaaagcuagaaccuuacauacagcuacaucaaaguguuaacugagaacagccacaacccuaccuccugggguagagaucagaagacauugggagaguaaguuggaggcccaaaugcagugguuugagugguuauguggucucaggcaaguuaugaacuucuuuaccuuuguaaaaaaaaaaauaaaaacaaacacucacaccuacaccuacccacaccaccaccaacaacaacucauaaaggccaaauaaacaaaacccaaaaagagaugacaucccucccuccauuugacuccagagcuauaggguggaauugguaccuaagaagccaugagugccugguaaauauaaaugcucauuacuguuauuaaaugcuugugauuauuauccagccaccaaugagccugagaccugcucuuagccaaugucuucuaaauuacuguagauaauggcaaagucggaauucucuugcuguguauaaauucuuugucgaucuguuucuuuguggucuugacucuuccuguguaggaagagaacagugacucuggcaaaacugugagaggaagagaauaccagguuaguaagcuaugaguguggccucucaccccgagggaggacacccacaaagcugcguuucuuuccuaaauuaagaccgaggaguuuagacuuguggauucuaauggcguucaucgugcuguugggcuugguccgcaauuugagcauaagacuuggugauuuaaacaaaaaaauccugggcaugccagagaaaagaaauuccaagcgacagacuuuuccucugagagcagugaccucaguuaccuuacgugccagugggaaaaccaaccacacaaaugucccuguuuaccagagcugucauagugauggccacuuuuguuuuccgauaggggaccaggcgguguacuagauuagguaccugaagaaaucccaagggacaguccugcuauuuaaauuaauuauuuaacucagcucuauuuuccaaccacccaguguuucagugaccuugagucaugccuacuggcaaauguguaaccacugaaaugucuucagagucagaaacugcaaacaaaagcucacuuucuuacucuuguguuugguuuuacagaauagugaagucugugaauuaaguguauuaguuagaauaauauauucggggauuuaaggaauuugggucagguuuuauaucaaccccacuaccuuuugcugggccucagcucaauccuuuaaucuucuggcuucuuguuccaucugcaagagagaugccucuggcaaagcacuaagugcagcagcugaaggaauaaauuaaauaauggacuuaauauaaccaccgagaauggagcaaauugcucuuuugugggauccauuagcccaacugagaauauuagcacaggacucugaguguaugauugauguaagaaguaagaaagcauccauucucauucugugcuuugcccugaaaugacauugguaacagauaaauaugaaaacggaaggagaagggaggaacagagaagugcuugguaaaggaggaggaggaggaggaggaggaggaggaggaggaggaggaggagggucauagggaagggaggaagagaugggcuaagagugagacagguauggagacaacagaagaaaagaggaaggaggagggaggaggaggaggaagaggaagagaagaaagaaagaaagaaaaaggaaagaaagaaagaaggaaggaaggaaggaaggaaggaaggaaggaaggaaggaaggaaggaaggaaggaaagaaaggaagggagagugaguggggagagagaggugggggagagaaagcaggcaggucagaaaucaaggaugcuaagaagaacaggaaggaugugaagugaagauuccaaucagaccaaugcucacugaaacccuggaggaaaggaagaggggaugaggaaagacaggaaggguuuauuccccaagguuaucccugccuuccuucagaggcuuucucagcuugcugcuuucccccaaugaaucuuaagucgaggcuucuggcucaggaacuuagcuuuaacaacccgaggcaguuaaacuuuccccaguuuaaaugcuugaccuacuagacuggucucuaggagccuuggggugauagcaaacaguacaaggaaguauaggaagaauauucuauagggaucucagccauacccacucaggccucacauucccucccccaggcuuugcccucucuggacagcuggcugcucuaaccacuacuccacccagcaccuccaaccacuacuccacccagcaccuccaaccacuacuccacccagcaccucugugcucagaugaugcauuuaucuaaaaggacaacgaugcugagauucauagcauauaucacuugugugugacgcagauaugucacgcaucuuuacaaaaggacguugacacagugugcacuaaaggcaaugcauggugggcagagaaaaaugucuggccaaggaaacuguagcaaaauugacacagugaugugucacacuauagcaaugaaguuacuugaguuuuuuucugcccacaaaaaagucuuagacuuuuguauauuccucauauaaauacucuuuuuuguuuuucaagacaggguuucucuguaucgcccuggcuauccuggaacucacucuguacaccaggcuggccucgaacucagaaaucccccugccucugccucccaagugcuaggauuaaaggcgugcgccaccacacccggcauaaauacucuuuugaccagguuccuugacgaguuuggcccaggaauaauuucuccuaagugaaacuaugauuucuuuuacuagacagugagaguuaugggaacucccacuuccccuacuucaugguuauggggaagcuuggaguuuaauuuuguauuuauauccuauuacuugccucaaccagguguauuauuauuauuauuauuaauaguuuuaaauguuugucuuccuauguaaacuucuuuuuggaagaaagcacaguacaaauaaucagaguacaaacaaaauacaauucagucagugcccugcuagagaugugaugcguuaccaauguauuuuaugugauaccucugaagccauuuuagcuggaagagaauauauuugggacaggauucuggggagauacuuuguuucaugguguuuauugcuuuaaacaaacaaacaaacaaacaaacaaaaaaaccaaaaaaacaaaaaccaaaaaaacccaugucccuuaaauagcauuccaaaccacuuuggggaaggaauaucaaaucuagagcaaaugagcugauuacccucauaugucuucuuacagggaucuaauuaaaguuuugaaucuuguccaaaacugugcucugaaauaaaccaauuuaaaucuacauucaucugucagacugaaaaugaggagugguuucagccacuucaaccacucgccagugaagaacugugcuuaauuuguagauucuuaucugguuccaacaguucuuccaggaagacagcaugccuuccuugccuugcugacugacaagcucuauacauaugaggucauucaucaagagaagcugucugaagggccacggugaugcugagauucaaaaacaaaccucccgucaucucugcuuugcugcuguauuuuuguucugcgaaggacaaaagccuuuuaauccuagaauguuuauuauggguuaucauuauuauuauuguuuuuuaaauuccuauagagaagaguagaggaggaagaggagaaggagggagaggaggaagagaaagaagaggaggggcaagaggaggaggaauaaacaaaacaaaaaggcagguagacuaggcaauugccguguagaagagucugagucuucaccauagagcaaugagaugagaagaaagcaucgagcgugaggcuucgguaucucacugccuuguaucuauuccauaucagcuugccaaauaacugacccuucuaccucuaauuaugugauuuauuaucucgauguccuuauuugucugucagacguuuaugaagaugugucaggcucuuccuaauaugccauuuaaauagcaaacaaacauuauagcaucucaugaaaaugcaauccauagauauuauauagagugauauuuaaaaacacacuggauccagaaaaaggagacaaaaauaggguccauccauggcacuugcaauugagcugugacuccugguuaauuuacuuuuuuuuuuuuuuuuuuuaacacagagauaaaaagaauugacuugccucuggcaucacugauggcagaguccuagcaaaugccuucacaugaguuauggacuggucccauccaacaugguuacugcuauuuuuaaaagugguuucuuuauaacaaaugguaucuaucuuauguaaauaugaaaccauucuuucuccuagagaagugugcauacugcaauucuucuagccauuccacagaaucaugaaaguguuacagauuucaacaaacaacuugugacgaauuucccaaacucuugccuguggaauggguacauacaaagcggguuuuucugugauggcaaacuuccagauagcuuuucuccgucccuauacgagaaaaccuaggcaguauguuuauacgaccaugugugcuuuguacaauuuguaagguaagguaacuuagccacuauggcugagacagaggccucuuucuggcugcccggccucuuuguucccccaggugcugagugguucuggaccguguuggauauucucauuuguuuuguuuuguuugcucuuuuaagagggccacccaaacugcacaaacuucaggccccacgaaauuuguaucuguuccuacaugugggaacagaacucaguucacagguguguuauaaggauuaaauaguaaauucauaucaagagagcaaggccacaggggccagcguucuaugcaaggugaaaaucaugugguugucuugucugagguuuacuuaucuauuuuuuuccaugcaaaaggaugcuagguccuggacaacgaggcugugccaugcuuuucaugaacucuagauauguaugagucucuuuaguuauuaaacauuaaacauucuuauuuuguuuaccuuagguacaaagauagcaauauuauucuacauuaaaacacuugaaucuauuuuuuucuucugaccugaaaacaaaugaaaauacuuuuguuagcuccuaaaagcucugugagccauaggugcugugucuaauagaaaagacagaauacugcaauaugaauaccaagucucucaaguugugggaaagaauggggauaaaggaaaagcaauaugguccaacuuaaaugggggcggguucagcacaguccagaaacagucauggacagcaggaggcacuucauguucaaaauaugcacuuuaguggaguuggucacuaggauacucuuagugacuuuauuuugaaagauguuauuaagaauuuauuuuuucaugcaguauauuuucaggugucuuguugcccauuuuggaguuacauuauuaacgggggauauuuauuuuagaaaauaagcuucauccugccgauuugcaaauugcuguagauucuaaagucuagaauuucagucaaaggucccucacaaacuccuuggcccuggcgcaccagauaaaucacaucugaaaacaaacaagcggcucccuauggaaggugugucugcacagccaugugacugcgugccaguggcuccgucuggcacauuucugaacuuugcaaaauuaauugugcuaaagagaacaccaucaaacgcguccggcacagagcguaaacaucuucaaaccacgacucugcgccauaaaacacuccuaccaauuucauuuggugcauuacucuggaaggaacaccgaggccaagugaaacugcggaaaugggaacaaugcacggaggaaaaaucucaccccauuaagggauccguuucuucucugcacaaauaagcccaacacgccucagaggcacgacuagauggcuccaggauguucucaguugcccccgcaggcccucaggagcugagagguccccucaccaagaaaguaggggaacugaguggcagcgccccggcuugggggcaguuuagguaaugcacaaaaucagaaagaaagaaaggaaaaaaaaaaaaacccgcaguaauuggcguccgugugccuuuucggggcgacacgaguuuccuccuccgcgcacggcuugcaaagugcaaugacagcgguuugggagccgcgcugcuucccgcagggccgccugggcuccgcuggccuuuccggaggcuuugcacccgcagggccgcugcgcucucgcccgccgcucggugaccuugcaaggcuggccgcgcgaccggagucucggcagaggcaccucccugggcgccgggcccgcgcgcgacccagaggcuccgacucacgcgcggccucgcgggcccgcgggcccgcguccccgugcgcgcggcagggacggcggagaaggcugcgggggcgcgcggggcggggccugggcggggccugggugcugcgccccccgccgagcuccucgcaggcgccgccuccgggcgcgcagucugcgccggagcgucucggcaguggccgcggccguuaucgucgccuggcgcugcgguggcucgcgggguugggagaaggcagcggcggccggucgucgguggccgcuagagccggccugcaaggggacaggggcgccaggacggcggcugcuaccaccggacugcuccuucaggacugcaguccugugcugcaggguccgggcugccccggggcggcggccgacugggauggcaagauagcggcgcgggagcggcuggugagugcgggggcgcggcgcggcagcccggagcgcgugcggggggcgcguccccggcucuggggcaacgccacucgggcucacgccguccgugccagccgaggggucaacccugcagcccgcgcccacgcgggcuacaccgcgggaaacuugugcggcgcgaagggcacugaguuccaaggccagagguuaccagggggaugggcaggaccuuuaauuccccauucggagcugcgaccugccagaugguuuccugccccuaaaccucagcgcuucagaaaaguaguuccucguccuuucuguuuugauggugcauuugacugaccugucuguaguucuaggugcuuguguccgaaggcgcuaaacuuauuaaacucccaaguuaaaguguaggcaagcaaaguuaggcuuccuaauggauggcuuuccggauguguugucuaaagcacaaagcugagaucguggacccagacgcacagaaaacugcacagcaaguguugugaacuuacacaggagcuugaguuaugugauucuagcccccacuucagcugccaagacacacgaaucuuucguuuacacuaggguuaucuuugggucccuuucuguagcuguguuuaaugcagucagauacugaaaggacacgugcgcuguuacugacugacaguuacaugcauucuuugcguuuacuuuguuucuuuaaaguggguuuuucagcagaacuuucaguuuaaacuuugccauccaaugccuucccuugcauauuuaacccagcaaauaauauuugcuuagaguugaccugacuuuacguuagucaggaguucaaaagcggugcccacguuauauuuaaagcaccgcccccagugaaaaacuaaagcauuuguuuauugcaacugaugccguccccuccccuugcaggauuaucuugacacagaucugaagucauacuccacuaggagcagaggcuccucgggugagacuggcagagggaagcaaaucucagcauagccugugcuuuuaaaaaacacuggacugugcucuuuucuuucucucccugacuuuccuucuuccaaccagguggaaacuguguucauuuggaggcauccaugaggaaccuuaagcucaguuucaauaggaggcguauugucaaggaggccggagcugcuguuugcucucaggccagaguugagcugagguguguuugccuugugagaggugagaucacaggcugcucugcuccagugaguggagacuuggagucuccucuggggaaugaggaccgaggacugugcuuuuaaaaccaaaugaauuauuuccugaguuuuaaaaacuuuugcuacggaagacucauuuuuggggggacuguguuaggaauaguguagugauggugugaagacguuaccauauuaauuuguggggcaccucuucacauuagagaaaauccacugguuacguaguucagaguaaagggcacaucucucuccuaccacucccuuagcaucaguaagcaccagcuuucuggcucuuuucucucuccgaauguagcccaaugcuugguagcauuuugcucuuuuuugucuuucugcuggcugggauagucgcaugcccuguucuguaccagcucuuugccuccccaugaaguccuaaguccagacagucuccaguguucuucccacccccaucccuccaucccccgagggagccaccucccucucccucugacacaacaucugagaacuccuuuaaggauaagccauauuuuacuuaagguucucuuucuucacagguauagucuucugauaucuugcugugagguuguuguaaagcacuuuucuuuuugaggcuuuuaaguggguuucaguuauucccagggccccaaaguugcguccucacauugcaggaaguggaggcagcucugcccagugcacauucucugauuuaaugacuccaaagugacccauggggauuuguggcaucuuugcugugaaaugagagcuaugauggccaggaccuaaagucauccuccuaaugacaaaacaaaguaaaacugugcacuuacaagaauaauccaccaggcccuguguggagccuuuaaucccaugacuccugaggcaggggcagguggaugucugugaguucuaugccagccuaggcuccguacugaguuccaagccagggcuauauuaugagauccugucuuuaaaaaaaaaauccuaagaguuuaaauguuuuugaauaugcagugaaggcuuauaccuauuauuaaauugaaggcaggggaguuuuuuuuuuuuuuuuuuuuguguguguguuccagaaaauuugcuucucauuaggauaaagucuguguuucugugguugaucaccacuggcuucuacuuuaaugugaauaaauugcuuuuacaccuucauuguuagagaaaguauuuguccuuggcaucucuuaagagugauuuuggaagcagaauaaauuguagagguuaggccucgcuaaugcuagcauuugagcacaaugcauuauguagccuuaugugauccuauguggaggcucuuccucuucuucgucuucucgcuucuccccuuccaauccccuccucuuccuccuccuucuauaagcugugaggaaccuuuaaaaaucuaauuaaaauccaauccacucuuagcauuuagaauauggucuuuguuuucuuugggaccuaacauuguggugucaauacaaaaguguuguuaacacugguccauauuuguucuucauaaauagguguuuaucagucuucuguuaauauuccaggcaauuuucgggaaacugagauccagcuuauacgggacaaacagacuggcugucaugaguuuccaucugaauuguggagauggauuaaaaacgugagagagcagugaagaaagaugguauccgguuaaggaccagggaaacgaaccuacccugcccuggcagaggggcguggcugagaggggcguggcugagguagagaggggcguggcugagguggauagggucgcccugaagacugcugccuguggcccgagaagccucccuaggguagauugguaggagcugagcaguguaugauucuggagaaaggggaaguguagcucagguagagggcacugcacgaaucaacauccaggcggcgccauagggccaccacggugcuaugcuacuacuggggagaggggcaggcugcgggcaugugcuuggauuggggugcugcgcauggagaagaggguggaagaauuccuccaugcuggcuccaggaguucagggacagggcuugcuguuuccuguggcacgcacagccaaggcugcaccuccguccugcauuauuuguugaguagaugagcaaauaaagaaaaaccuuaagaaauaaucuugccugauuuuuggucagaauucuucggagucuguuaucugaguucuccaccuaggcucuaggccuuaccauguguguuacaguuaacacacucucagauuguugccuuaaaucucauccuucugccaugaaauucaagucggaaguauuaaaaacaaaacaaaacacaacacagccccuuuuaguaagucauagugauuuccaagagauagcccaaauuuucacuuuugauuucaauggagcagccauuuacaugggagugaauaauucagaugcuuuuuuuuuuuuaaauuuuuuuuuucuuaaugugauguuuugguucuucgggcuugcgacugaccaaugagcugugccaagcucagguauguuguucucacagaagaaaugugugugugccugcucuauuuugggaaauagcaggaacuugugguauuuccucuucccaacuccuaaucuguuuguuauucuaaauauauguuccuuuauauuaauugaaaguuugggaaaggaguuucaugccaagcaauuguuagagcugugcgauaagagucuugucucuggugauugacuguugggccccuguucuguauuaggaguuccgugaucuugcagaaugugagcuugaucucucucucucucucucucucucucucucucucugucucccucuucucucucuuucuuucuuucucucccucucucucucucugucugucucccuccucucucucucucuuucuuucuuucuuucuuucuuucccuuccuucugucugucuguccgucugucucccuccgucucucucuuucuaauuuccuauucugacuguugauaccugaugguaguaacuuguuuccacguaagauaauuguaucccccagcucggcgugacacaggcagugcagacacugagaaaacaauggguucuuccacaccuccuuugugagcagaguagucuugguccuuuucagucucacuucccgcaaguagcugaagccagcgaggcauuguagggaguuucgauguuuagaaaugcaagcacucucaagcagguccuuugcagucccuguacagguugcagaaaggcaggaauuccaguugucauacauugucuugaguaaugcugcauguguuccuucuagacacuugcacugccccugcugacgcaggcugaagguggugcucgcaagccuugcccacucaguguugggaggugaggaggaauuuuuggcguauguuuuugguuucuaauguacuuuugcacggugggaaguuuuuggcucuccuucauucuuuuggcuucuaaggcugaauaaguuggaauuagcauucaugucuagaaucgagcauaaucuuguuauguggugguaucuugaagggccacuagggggcaauauuucuuucugaagguccgugugugucuggguuaagccuucauccccgaagcacacacuucuguaagaaguucuuagauccaaggacaguugacacggugguagcaggaacaucugguggaaaauaacaagugcugacagaaguacuucccugcuucuaacauuagaaaacgcuaacggggcagauggguuguaauuguccuguggacagaaccuugugaguuggcugagcccugguggugguaggaugaaggugagaccguggcccacacuuacaugcuguaaccucuggggcuguuugagggccacuguggacauuagggcgugaugacaagaugccagcuguuugcacgcagcaggccuggaggccccaguguacuuaaauauaauaagaaauaaaucuuuuuaaaaaauugaggauucaaacaaccuagccacagcguggagcuugagagucagagggcccuuucggauccccaagucagcuucuggaggcccuucuucgggccuuuagagcauaaaagugaguaaggcgugaacauuugagaaacuucuccaaagaaacaguuaaagcgggaauguaaguuaucugacuggaacuuuaccccaugcuuacuccuugaagguaccaugaucagcaguuuuacugugguaaaaacaacaaacaaacaaacaaacaaaaacaguuuuaggggagagcgugugcaagauacagagggagaugaaaauguaagcucuuaggaaaacauaaaauugaggauucaggggcuggugagauggcucagcagguaagagcacccgacugcucuuccaaagguccugaguucaaaucccagcaaccacaugguggcucacaaccauccguaaugagaucugacucccucuucugcugugucugaagacagcuacaguguacuuacauauaauaagaaauaaaucuuuaaaaaaaauugaggauucaaacaaccuagccacagcguggagcuugagagucagagggcccuuucggauccccaagucagcuucuggaguuuaauauguaaagaaacugagacccagggaugccacgauuugccuggggacagucacugaggacugaccagcauccugacccuucuuggacugacuguuaccugaaagagucugaguucugucuagaggagcaucucccugagggguucgccacugugggcuuccgugugucaucuuaccacuggcacugaguuccgcccacagcaggugccccauauuuuguuaaguaaauacauaccuaaaagaauuccaauuguccgaugggcacauuaucugugagaguguguuuauauaauauggaugaauauauaauuucucauuuaaaaaaaauagagagugcuacuuuugaaacccaaacuccuagcucuagcacuggccaaauuuggcagguguggcugcaucuggucccuuacugaccaggcauugaauuuuccaggagucaccuuguaaacucccuaauuccugguauccuuaaccuuuuaucuuugaugcuugaaacaguauuuacuuuugagaucaaacagugccuugaauugccuuucuuccacaugugucuuaucagucaagugauuucacaauuucagaacuuuaugggcucguuggaauuuggauauuugaaaucaaaucucacaaagcccccacaggcucuggaaauugucgcuucgagaugccuggcggauguuugaauugugguaacuuuccaggagggcaauuuugcauuacucaucaaaagccucaaaaaugugccacguaucagaaccaggaagggagaucagggggaaaagcugucugcagaugcugaaggcugcuccacuaccaugcacauaucaaaaccaccccugcaauuugacaaagcuauccuuguaacuucuuuggccgggggggggggggggugucuagacaggguuucucuguguagcccuggcuguccuagaacucacuuuguaguccaggcuggccucgaacucagaaauccgccugccucugccuccugagugcugggauuaaaggcgugugccaccacacccggcuccuuguaacuucuuaaaacaccuguuccccaguggaaacagcuuccgugcucaguaauaggaauugguuaugguuuucaugaguaaugaagggacagugcugcaggggaugcccacugguggagcugcaccaaauuuaccauuugucaagccagaugaccaagaggccuauguagggucauucaucuagguguugucuuugcagcgagcgugcacaugcauacaugugaucagcucugugacacuguguaggaugaccccaagauuacugucuagacgcuagcugagaugaauucugugugcaacaucaauagcucuguugcuuuuagcagccacccccccagcccccccagaauucccaauaucuaaaaagcaugugguacaguguaggggccggggaggaaguugcauuuccguucccagugguugugugaacuugaguaaguuccgcgucuguuucggucccuguugugugggugcuuagcggcagagaaggcuggcuaaacauacccugccugagcugcugggaugacggacacugggcgcccugaacaguagaggaguucuagauugcuagaucaauuucgugggucuugaaaauuucagggcauccugacacagcauugcuccuggccauugggaagugauuugagguuuuaaaagaaaaaccauccauguauuugugcgugaguauguacaagccgaggucggaggccaacucccaggagaggccuuucuccuuccaccauuacgguucuagggauugaacucaggucggugggcuugcugacaccggcuuucgcccacuuagaugcaaauacucuuuguugcuagugcuuguuuuuuuuuguuuguuuguuuuuuguuuuuuuuguuucuuuuuuuuuuguuuguuuguuuuaaagacauuuuugcuuccuucuguuguugucuugaguaguccagccguacauuccucaagguuaggucugucugacucagucagugaugggugugucuguguuaccaguacugcauaggccacggugccccagguacaggugaccuugcccgugcaacaacacacaggaacaaccacggcacugcgaagccaggaggucacugagguaagguagcaagcugcagauccuggccuccuguccuguccuuucagaagaaagcacgugauguuacuuuccagugaacacaaacacugccguccacuuguucgacccgcugggugagcagcagcucggugacgucaccguguugacauuuacagaugacuuuuauugaaguugggugacacuuuucuuaggcuucugggcuggaaacugcuauugcaccuucugugaagggcacacuccugccacugcgagggagaccucaugccguuuugaaauuuuaucuuuucguaaaauugccaggcccucccucauaaaucuaggaggcauggcguuuaugcaucuucugagugagaaauuccagcaugcaucuucccaggagacaagggcagugagaccugcacccgagaguacgugcaacugcacuagcucucaugaacggugcaaagacaaauauuuuacccucaguaaccguugaagacagcauacgcuuugugggucugcaguaugaacaugacagguucuaugaugaaaguggagagucagucgucacaaaagguaccuuugugacaaaugccgacuuuacauuccauuuccucauauagcuaaauaaaagaacacaacgucuugaguuguggacagcaugcccccccaugggaagucauagacauagguaggggacacaagcaagauccacguuuuauaugucacgcuccuaucuauggcaucgcuucccacagcccacuacggucccacuccuccgccggaacuagcaguagcgugcuucucuuaggggucaggucacucugcagaauuucuccuagugagaggcaaggccugugugcgauggugccuaggcggcagcugggccguguuggcacggagacuguuggcugaguguaggauggagcaacacugcucucaaggccaggaucaaugggaucacagaggacucuguucuggaacguuccaccuuauagcagguaaagccgcgagugcuggagugcugucagcaugcaccacaggcuguauuguuggggucaguaccugugggauguccuuaggucacugucaugugggucaguagcgcccuccccacuuacucuuccacucucugauaugcugugaguugguuugcuccucuucaugcccccacuauagugucuugccucauggaacauguauagcgaagggucucaugggcacagaccuuuaaaacgguggcaguaaaccaccauuaugcgcugguuuucuuugauguuuugugacagaaagugaacacagaaaucuauaaggcaagaugggcucuaugggaaaggcuagagcgacacagcugacuguccaccuguggauaugggggcacuguuugcaggacuucuggauguaggguuuguuuuuuaaaugucaagaggcauggcugggaauggcuagcuuuaaacuauaguauuuucucaucuauguuuucccguaucccauaacguagauuguguuggguuuuguuuuguuuuuuuguuuuuguuuuuucauuuuguaacaugggccuucaggauauguuccacaugcuacaaaaaauucuucaauaugaauugaugcagcggggcauucugucuuaugaacaaaccacaauuugagaaucuaugcugcuuaucuuuuaaaauucauaauuaaggcaauagucacugggcauaaagcccuuauccucccccaccccaccccaguauguugcuuagaagacaggcuacguauagagaagaccuguaguuagcuccugguuuugccagugaaaggcgugauguuggccuugacucaguucuggugaggacccucugcucuaaucaucacugagggagggauugauguacgggaaagcccaccucacccaacuggaaaagacugagauuccacaaguccuucugaguacacaccuacugugaccagcagacuugccacuacaucucaucucucaaaguuccaugugcuaauacuaccagccccaagaccuuggcagccaguuacguggaccccugggggauguuagcccucaaaccaggguuuccagugacuuucaaacucuuuuccugagucagaaguuaaagacguuguuauaguuuuuauuacuuugaucuauaaccaaguagucagaaaaauaacauguucaucuuauuagcugccauuuccuuacugggaauuuuuuuaugcuacaucuacagcuguacauuguuagaauuugaacuaucuuuagaguacaauagacacuauuaauuccagugcuugggagacagaggcagguagauuaguggagcucugugaauuugguuuguguagugaguucuaggcuagccagggcuauauauauaucugucucaaaaaauaaaaauaaaaaaauggaacuauuuuuuaaaguuaauacagggaaagugcuuuauaaaaacugagaaagcuuggagacaaauucuuuuaaaguuuuagucucacuuuuagagguaacugcauaugauaugauaugauaugauauuacauuauacaugauagauuaauuucugugcauaaccagacauuguacuggcuaguuuugugucaccuugacccaagcuaggguuaucagagaggcaggugucuuagucgagaaaacaccucccuaagaucgagcuguggggcagcuuaaucagugaccaaugggggauggcccagcccauuuguggguggugccaccccuggguacuggguucuauaagaaagccagcugagcaagccagccuccgggagcaagccaguaagcagcaccccuccguggcauuggcuccugcccagggugagucccugcccucgcugcuuuugaugaugaucuguuuuguggaacugcgagugaaauaacgucuuccuucccagguugcuuuuggucaugguguuucaucagagcaacagugacccuaacuaugauagauguauauuuaguaucugugccucuggguguguuaagcugugcuuggaacauacuuauaugguuuuuguaauaugacuuaaaaauguaacuuaagucaaucaucuuccaugauuauugugcauaguguucuuuuuguaaaguccuuuauucugaguguggacguaucuccuccacaccugcuggggcugcagcacuggggaggaggggugggucuuacccugugaagcuuuccugccuuuugggaagcaccagccaguaaacaagaaguacauguccagauaucgaugagugcccuaaggacaggaagcugggcacggugucguggggcaaggacagugggugccagggcuccugggagcucaguagcggauacuucuuucccugggggaugggagaggacaugcugagcaagagaguucuaucucaaagccuagaugacacacaggaccuauggagaaguccauggaaggaugcuccugagggguccagaccugaacagaaggagcagaagggccgugugacugcuggaaggagagcgggaugucggaaggggaacagagucaugggagggagagagaguagagcguguuuauaagaauuggccccaguuuuaaauccacagugacaggguccgauggauauuuuuggauggugacugccugcucugugcagagugugugggaagugaggauggagacgagacgggaggaccuugucgcugaucgauagucaugcaggcaagaggcuggcgugaagggacuggguuagcagcgagcacagugggcagggucugguuucagagcugaggaagcuguagcugccagacaugcagaggaggugcaggaaggggugaaucgagaacggccccggagcuuuggcuugcuuugccuuggggggaauugagacaggauccuuguggcuuaguugguugaacuguguucauuaagaugauccucucguuuuggccuccccaaugcugagaucacaggcacgaagcaccaugccuggccuauggcuuuggggagccguguccguaccguuuuuugauagggagaacauuaaggaagaauaaguuguguguguguggggugcucugugaaucaacaaucugcuuugugugugagcugaaaauguccgagacuugcaagaaacaaauugugcuucuaucaggagacaaaacuguugggagcuauauagaacauccggggaaaagccagaaucaacuuaaacugaauguagguuuuacuuaaauuagcauacguucuuaagaaaauuuuaagagugcagcaagagaugggccagaaugcuuauggagguaggaccggccgcgggccuccaagugacagacacucuggucuucagugaacauuuucuuuacagucuugccuaaugucucuuguagaacaguuuguugugguugguuuugguuuuguuuguuuguuuuguuuuguuuuguuuugagacaaggucugucuacauaguccuggauauccuagaacucgauauguagaccagaucggccuccucauacucagagauucuccugccucucucugccuuuuuacugcugggacuaaaggcaugugccaccacgccugguacugacugaucagauagugaaugcucaauaaacuaucagauuggucugucauugucaccaccaccaccaccaucaauaucaacaucaucaucacuaucaccaccaccaccaucaucaccaccauuaucaucaccaucaucaucaaguaaaaugacauuauaacaugacucagaccuuggagucagaauccugggucccauuucuggcuuuguucuuuacaggucacgagacucuggcaaagucacuuaaccccuuuguuuccucuuugaguaccacgugaaagacaccagcccccaccuucccccuaagcacugugauggugccagagacagucauacagucagucgcucaguggcugcuuaccucuuucucacgaacuuugucuaaaccaucaugggacagcaucucacaccacacucaccguucacuauccaucgaagucucugcauuugaaucugugugucuugacugcuguugaacaugggguucaggggugcagcuggcaggaaauagcagagaacuugugccaugugcagauugggacuucuucaaggccagggagggccguggaugauuucagcauaauaugacugacuuccugcgcugggggacauugacugggaucauuggaguaagugagggcugagagggacucuggacguuugucuuauuuccccaguaccacuguggcccugaagaagagggugauuaugauguccuuaaaaggugccccgugugcucauuuuaccauggccuuuauagagagcuucuugaggguggagcauuuggugcgugauuggagauccuuggagcuugcuuacccauagucccauagacccuuagauggguccuguagguagggaguagcuggacccugcgcagacuggaggagaacacuuaagaguaaguaagguuuuuguugaacuagaauuuguaaaauuugaguaaucauuuuguguauuuuaucuguugcuuuuuuuuuuuuuaagacuaaaaauaaaccuuccaauuuccauaccccuggagggcagaguugcaaacacgauuguuacuucagcagccauuuucuucuucacgguuguuucccacauacugcuacuaaguuuuauuuuucuccacaaccuguaucuguucuucccacuguugccauuuucacugagucccugaaaugcccaguguuacacuuguuuccuugaauucacugucugguacuuuuuuuuuucuuccacacauuuaaugccugggauucccuuauccggcacauucaugaaaaaugucacacagacaacugucacaguuguccucuaucaccuuuguccucauugccaucaucauauagcauccugaguaagcuugucagcugguaaaaggagccuuuagcacuauuauguaagugugaucaucugguugucgagcauccuugggacauuagagaggaccccuuucgaccuaagaugugguccaucuuuuccugccccuugcucucccaguccaacaguuuuaucaggucaggguugccgcuggcugcacugauccaaccucccuuccagauaccuuucucaauacuuuccugauccaggaucaacgccaggcuuaucgaucucuggggguguagaucacagccgugcagaugcuuaacccguauccucaccuaggaagcagaccucugggugugugcaugaggguguuuccagagaggugguuuacgugauggggcggggaacccacccugaagccggguaaccucacgccucagggucgucaaguaggacugaaggagcaggcaguaguauagcaggaacuucggcuucauguuaauuagcgacaggaagucacugcugcagccagccgugcuuugcccaccuggcuggccugauccuuaaaaugggcagaguaaacccucucuuaagcugcuucuugccagcugcugucacaaacaccuaauacagccugcuucucgacaaagaagacucugagauauuucugccaaaugccaguuauuuccaaacauuuuuuuccuguuccauucguucuguccucuuccucugcccccuuccuuccugucaauuccuuuugaaaagcauuuguuguagucugaacugauaccuaggguuuguauuucugaaauuuaaggggguggggguggggaaagcaggguucuuuuaacguaaaagcuucagauuauaacucuaaaaaaauauaccacuagggcacauuuagguuauuaugugugcauugaaaugcagauauuagaacaauuuguauuuugagacauggguuugguuuguauguuuugugaguuuuuuguuugucuguuuuuuuguuuuguuuuguuuuguuuuguuuuuuucaguuuuaaggcaggcuucuuaguuggcucccuaagaagucuuuuggccuggaaauguguuuuguuuggcuugaaugcuguugugguauuucccccacccccuaaauuagcugcuagcauuugaaaaugagauuucacauguuuuucguuuuauuuuuguuuuuaaaagauagcaagcccuucugagucuaagagggaaggccuggcuagaccugcaguacgugcugguuaaggugccugcucugcagguagcagcgcucucucuuucuuucugagucuguguaaaacaagacaguagcucaguuggaagacccguggcuaugggaugccgugucuauuuccuguauaaaacagacagaggcucuggcugcuagcugcuggccaccccacuguccuuggcaagccucaacuacuuugucuggcuggcuuuuggaguguguuuggguuugcaccugcucacuuaaagaacucagcuaaucaaaagucuacuuaagaguuggaagcaggacaggaagauggcaguuauuuuccauucggcccccucccugcagacugucagagcgggauacgacgaucacaugccccgcccguagaagcaggugacgcuugcuaguauggcauucaccugacaggauggaaggagagaaaggcccacagcugcugguugcuugagguauccugaaaguacaauggccguaggguugugcucgucucaguuaguuugaugacauggaaguaaggacugcccugaguccgagucgggucaguugagagcuaaagccuaacauuccagcuguuugcugugguccuguucagcugugaccauguuagugccagaagggguguuagagcccuggacgccugaggucucgggggucuucuguuguggauucacaguuaaauguauugcuccagagcugagauugguaaauggugcuaaauucagguucccagcucugcuucuuagaugugugacccccucugugccucagugacuuacuggaaagagagggauagcgacacuggcuucauagaguuggcacgaggauucaacccaacugcacacauggugcaugcugucugaaaacgggaguugcuuauugccuggcagagucagccagaauccgaauuugaagugcaucaagugauugcauaauuaucguuuuuuuuucccucccucaguuucagcaggccuuuaggaguggguuuaaucuguguauuugaaaaagaaacuaacagcaauuugagccaaguugcugguuuaucucuagauauauguguuuaccuuacucuuggggauauaaaggaagagugggugggugggggacagacaagaaagacauuguaacuccucauuaagaacuugguuugaaugaguuaggcacaauugucaaguaaguccugaguauacagugcuccuaaaagauacuguucgguucaaagacuuuaaaaagcaauaggaaauaaaguagaaagaggggguauauuaucucccuauuuugugauaaacauggaaaacacaaauuaaaguacagguaaugucuugcuugagaaugagcaucagccucagacugaagaaguaucaauacccuuaguaaggagagggugggaagauggggaguggcugcuucguaaagccccgaaucucacggggaagauuccuugcuucguacggaugugaaaugaauuaauggcuuaagcuacccaugccagaagugaugagggccguagcaaaggagauagggaugggaagaacacgggggugauugguggucaguugggaaggaugaagacaugaaugggugucuugaguaaucuggaauuggcccgggccugagagaacaugccuagaggggaaagugaauuuccuuguguuuccuuuuggguuuuuugaggacucugaggcauccaaguauacaugcagcauccaagaguuuuccacauggguucgggaaccuccuggagugguucuguguggguaagcacacacucaucugguaaaugauuagucugaagcuggccaggggccaauuccgugaagcaaauuuggaagucauucgugcugaguggugguugaagccacgagggaggauaacauucauggagggggaaaaaaaggaugagaugagccagccaucaccaagcucaggagugcuuccaauuauuuaaugcacgcgccuggcauggcugguaacucguggggcugagucgaaggauucuagccauauacuaaaaggaaucuuaucuguaugugaaagauucuggcagaauguaaaaggacacagaagcccugaaauuggcaagauagacgucaguguuagcaugucaguuaugcauguaugauaauucuccaucggaaagaaggagauaacgcccagcugcugaaaaacaaacaaaauccagauugaaugauuuuaaagaaaacauugcaaauuaccaaaaaaacauuugaaguauuuuuauuguaaaucaaggaauugguaccuucacaacccacgaguuaaugaugagauuuggaaagacaucauccuuaguguuggugggagaacagaaacauccaucuguuuccuaucuauuaacuaucuauaauccaaaagucagagaacugcagcuucaaacuugggaacuugaaaugccaccaugcuuccugucuuagucaggguuucuauuccugcauaaacaucaugaccaagaagcagguuggggaggaaaggguuuauucagcuuacacuuccauacugcuguucaucaccaaggaagucaggacuggaacucaggcaggucaggaagcaggagcugaugcagaggccauggagggauguucuuuacuggcuugcuuccccuggcuugcucagcuugcucucuuaucgaaccaagacuaccagcccagagaugauaccacccacaaggggcccuccacccuugaucacuaauugagaaaaugccuuacagcuggaucucauggaugcacuuccccaccugaagcuccuuucucugugauaaccccagcugugucaaguugacacaacaccagccaguacacugucacgguggggaaggcugcgccuggcagucuacagccuaagugaagcgucaccaagaacacuguguaagauaccuuuggacuauccacugugugcccaguaggaaauguaaaggagccucauguuuggauuugggcucccuucucugagauaguucauuauacacacccaaaugccagggugcaaaggaagaccaguccaggcucugacacaccaggcucugacacaccaggcucugacacacucaaguucugugagcuggaugaggaggauaugacccguucugaggaguggggauguucaugguuguuuugaauguaagcuuuuuccguguuaauaacauaggaauguuuggguuacuuauuuccuuauuuuucuuaaucuuaugucuguguuaauguacacaggugugcacacaugaguaugcaugcggaggucagaggucaaccucuggcucuguucuucaggggcugucugccuugcauuuugaagcaaugccugucucucaguuagacccgaugcucucagauguccaggaguccuaguguaucugccugucuggcacugagaauguaagaaggccucaccaugcccagcugguuggcauggguggcaggaauugaacucagggccucguacuugcaugacacauacuuuaccuacugagccaucucccuagccagguaauuuaaucauagaauguuuugcucuuguaaucagugcaaguucauuuguuugguagugcuaguguugguguauauaguuaguuccacuguccuacucccagggaccuagcaguugcuuaugucagugccugcugccagguguacugcagaccucccaccaucucagcucgcucucucuguucuucuccacgcuuggccccucucucuccuccucugcccccucugccaguucucauggcucugcuccuugucugccugucuuccugcucccaaucugcgugccucuguuccuuccccagguccucacuucucucccuucucccaauaaaccccuuuuacaccagaucuguugcauaggguacauuucucagagggguacaccuggcaugggcccaccaaagguaucccccucgccacauuauuucauaacagauacaguaauauucauugagauacuugcaugccagucacucaaacagccuggcugaaguuugaggguggggaguguggcacuuccagcccugacaggugggaaguauuggaggcacugaaugggagacacugcaaggaacagcccauaggaacuagguuugggggaggcacugagaccaauuggaguguguccuguuuagggagcuauuguggucuggaggaggcccauagucaaccauccagaagcgccuuguucaccacaggaaaccagcuguagguagagaccacuggcaaucuuuaaaguguuuuugagaacauucuuauuuugauauucuggaguguauaauggauaggcuuuugaauuaacaaaaaaggccucaacagaaugaaaauuagccaaccugacaugaaagaucuugaaaaaccaaaaaucuugaugacguaugcacugaaaacaguuccuuggaaauugugauaaauugagacaaaaaagaaacaaaaauaaucuauuuaaauuguauuaacauguucucugggagacugaauauccuacaguauccauucacaguggugggugccuuuaaaauaacaaagguuacauugucccaggacgucugcagagugcugauuaaagucugaugcaguggacuccuuaagcacucucaugcccagaguauuuuacucauguuuucacaguguccuagucaaaagacgaacuuaaccaucugaaauugccaagucaaaccaaguuaauagcuauuuaugaccuagauggucaaaacugauuggagaaguccacacguguuaccucagaaggaaaaauaaugacccuauuucauucccccaaggccacgaugacugagguggcaugugaaccuacugggcaccacacgguuucucagacuuuggaaacagaucucacaccacccucuuuuccaugggcaugcagaucuuuggggaugauccuugugguuuauuccgucagucaccaaagugacacugucacugaaggacaucugacacgaccgaauauggaagccgaguaguauugggccaaggcuuucggaagcauugaguacauuaccgcuuuuccagagagucugcaagccccccgcgauaacccuggcaguuugcuuuggugccuggccuccgcgcaugcgcaggaaccaccucucaaacuuccguuccaugugcgggcaacacuugggauaugauccggccuaaugaugagagcagugagugggccugucaugaugcuuaaugggccagacacuacaccgcucugggagagaugcgacugugcaugcaagcaucacuacgucccuuucuguaaagacuccaccgugacaaugagcacaucauuccuccugccagauuuuugguacaaaggucugaggagguuacagaaguggacgcagaggaaucugccuagaaaggaacaggcagacggcaguggagagauggcacaauggcuuagaguuccccuucuuaugcagccuggaaggagaucccugcuggacauggggugcaguuuagaguccccucuccucccccuccuccccuucuccccccccccacguccuccaucucuugccuuccauucucccugcuucauuuucauaagccuuguucuucacaaucuuccaaagaacgaacaacaagggauguaccuuuugcagucucacaggucuugauaacugaaugcccuuugucuucucagucgaucguucagugucuucaucaagucugaaaacaauuacuuaauauuucgaaaagcauuccuucuaaguuuccgguguuaagaagcugggugugcauugcccacuaaagaauauuagugaggaccugcucagguguccugcgcagcaucaccccagcuguggggaugguacugugagucccugcggugcaggcugggguauguguacagaugcacuuggcgaguuccccagagucgugccucuggacagcugguaaccucccauugcuucggugccuugugaccucuaugaccggcuugugcuucucugcuuuccaguggguucuccugugaaucacaacgaugggcuaucucacugagguggagcugggagaugcucugggcagcaggcucccuggcuggggcagagcagguguucagaugcuuccaauagcaccaggguuaagggccuguaugcccaaggcucaccugaugccagcgagguacgggaacacuccgaucccauuagguccuccucuauccagcuuccucucuccccaacccucucccaaaaacaaauaggaaaaccagaaauggacuaaacacagucuaucaggaccauagcuucuggcuuaagcuugacuuuucucagcuuacuuuuuuggguuagccucagcagagaguccagaaccucauggaccuggacccagacucugcggugcugaguacaaaucaaggcagauuguacgcgcagauguaccauuuccccggaaggagcucaagacuuccaggcacauuguggacagaugagugcccugccacguggggcaggcuccauccagcccugcccugggcuucaagauaccugaccgugucagacuguucauugaggacaacgccggacuuucuucuuuccauguaacaguuggauaagucuauucuauauaauaacucgucuucaacaggagggcuuaagaacauuuuaaaaucuuuuaagauaauuaaacauaggaaauaaucuugcaagguauggagucugaaggugcuguuugcuuggagucuggaauaccuaaaaaaaaaaaaagucuaagaauuccauaagaaaucccugauuccuguggaaucuugaagaaucugaugacuuuagcaaaacauacccucuggccaccuccuuuaacuugcuggggacuaugggccccaccugccauaugcuauuugcuuuggccaccagauauuuguaguagcucuguggcugcuucaagagauagcaucggggcugaggaauggugggaugucagaacaugggucacagaauaaguccuaauaguggugggcucugccagaagugggaagagagauguuucuuaacaucauuuuuauccgcgaagugcauuggaaggcucuagccauguuguuguucugacccuggaaugagcucauugaaaguccaggcugggagagaaguugagugugcuauuaagugacgcuuccccaaaugaccugauccugguggucuauguaagcauuaagacaaagcaccgccuuccgcauuagccugcccaucuuaaguugagcagggcuuucugacaccacguuggcuucucucugcuggauccccuaacccuaaugcacugugcucucuaccugugcuagggcugcaacagccagccagccacccaacguucugcacugccuguuccugcugucugcaauagggccucgcauucagagucugcuggggccaguaaacagaacuugccucugggcuacacugguggaggcugaagccagagggauuaagugauuugccuucagucacacugcuaauuaguaauggagccaagauuagagucccugucuggcagcaccugguccugagcccuuccuuggccaccuccucccagucccucucauccuugcuuccuggcauugcaauggaacccgaguuucccuucuaaaauaaccuuaagcugcuagugaggcauucuuucaacauauguuuagccaguugguggguagguauaguuugugauuauucgagccauucugcacagcuggguaauacuguaaccucagcagcaggcaccgaggacauuccaggaauacauuuccacgcuaauaaguggacucggugacauuggaguuguccagaacuuguucacucaucuagaacauaacggaacgcucuagaagugcaugcuugugggcuauaauggcauaagguaccugagguucauuuuugugcuuuucaugguauuuaacaacagucaagaagagaguguuccuuguucugccagugacaaguguauuccccugggcuuuagcuacugagauguuggaucucuuuuuaucaagucuccaucucucauccacuuccuauuuuuguuucaugguuagucaguauuuccuauuuuuaaagggagguggggggaucucucagugguuaagagcaucuuccggucuuguagagaaucuggguucccaucccagcacccacugugaugcagcuuaagacugcgugcaccuguaacuccuggaguucugacuaccucuccuggcauccucagguagcuguaugcaugugaagauaggggaacacacacccaugcacauauaugcuugcacuugugcacacacaugaacacauaugugcacgugcacacacacacacacacacacacacgcacuaaaucuuuuaaacuguaacaucacccaguagacuucccuuuguagagcucuuuuuguuuccaguuacuccauucauggcacgucugucuuguucuuauggcuguccccuuugcuuauaggaaacuuugugaaguuuugggcuuuucucuucuauuaacuuucuaauaaaaaaauccaugcacacaaacgacaucacacacugaaacuaagcagcccuaagcuuuauacaucucagugaacaucuguguaguucucuguacccuacuguagaaauauuugcaucaucacguugcugcuuuauucacuguagcaaaaaaaugauaaucaaccuaguuguccaucaacaguugaauuaauaaggaaaauuugggguguguguguaugauggaauacuguucagcucuaaagcaauguaaucuuaagaacuugcuauuuuccauguuggucuuguucugggaguaauuuucauuuucuuguucaugccgagucucccucacaauuuagacaaccuucauauguuuugugguccuugguucucugugcaguguaaagguaggcacuguaaggucugacaagaugucagugcaccggaaagcuuuguuagcuaugagaguggcuguggggcugugggaaggaauguaguuauuccaggggcuuugaguucaguagcggaaccaccugugucugugugagcuccuugguucucccuggacaagguuuuaggcucuguagaaagaggccucucuuugcaguguggaguggaaucacuucgcuacagauugucuggggucccguggaguauacuugggaccacacacuaagcgagagaucuaggcuucagucucaaucuauguuaacauccaccaguacauugaguggcuuuuccucuauuagcagauugggguagaguggaugcacacguguucagcuaucgucucaaaugggaagcccgauguuggacuguugaccguggcagccacccaaaagcagcaucucugcgcagcuuuggauguuugagagccagaggagcagaguuuggcuucuccacucagcagugugcagcaugucucuguguguguccugccacaacugccucugguguugcgcaccucgggugaacugugucuucugggccaucugaacagcaucuguguucauccucucucaccuagggcugacugaacagcaaggacaauggcagcuuacucaugguggagacagccaucguggaugguagacaauaaaagaucgaggaugacuccaaaccugccauggcuccugucagcucugacccuccugcaucugacgaugcaugcaaacggucugaagagagguaagugagccucaaagcaaacggcaagcugguuggcaugcgaccguagaguaguccuguuucucugcugaccucuucaggguacugcuuaaaguccaguucucugcauucuuuuucuccuguguauuucuaguuucuuuuuaaaagccccuuuauuaaagggcaaucaaaauauuccuuuacucuauacaaauaauaaagcauaauucucauacaaugcuguccauuccuuaaggauacaguucucugaguuuugacaaugcacauuugcuaaccacaggcacuaucaagaucuggcucuguuccagaacacagaaaaugcccacugugucccugucgccagcucuuuccgccccgccccgcccagccagccaugcuguggucugucucaaauguguuuuaagaauacuuucuaaauggaaucgaaaauucuuuccugugucuccugugucuuauuuugaaacuugaagaauguuucugcagauacggccuggcuuauuucugcgagggaugucuucccucugcccauuggccuugucuucacguuauuuacacaauuaagcagacugcucccccccccaagauuauugaguaaauaacuugauugugauuaacugcuaguuucucaugcgagcauuucuaaggcguuucugcuuuuuugucuuauaugaacuuauauuuuauggcgacugugaauaucaugucuguaauucaugugugaagcaugaauaauuauaagcuuuuccuauuuggggucgggguuaggguuagcuuuuucauagacauuacagagcauaagaugauuucuaguuuccuccuucccccuuuugcucuucuucccuuucucuuguuccucuuucugacugucccucucccucucuuccccccccccucuccuuuucccuacccuuucccauccucuauguucucuuccuuucucuuccguauuccagggugacuguuuuuuuuuucuccccgagucaggguuucucuguauagcccuggcuguccuggaacucgcuuuguagaccaggcuggccucaaacucagaaauccgccugccucugccucccgcgugcugggauuaaaggcaugugcuaccaugccugacuuuucauugugcuguucuuacacacgugccuuccauaaugugacgucacagcacucugaguugaucugaguugcuucuucccccauuguuaaagccguacauacaagacuauuuucuguaggucagugugaguucauugcguuugaagguaaugggcuuugcaguaaugaagagauugauuguagguucccguggagcugcggucugguguaaggagugcagcagccgagcuagguggguuuguaggugugcgguagaccuugaggcuuucuggaauaaucuuuuccuuagagguguuugcuuguaguguaaagucguggguauuauuccacuaccccauuauaguuggcuuuuuaauuaaaaaaacaacaacauauucucaccccccccccuuucuuaauugauugcaguucuuugucuaggugugaggccuauugaguguucccccaugcuaacauaucuauugguaucuuccuuguucagguauugcauaggcagaccuccuggcuauggccuccgacauuuccaagagacaccaucccacagcacauucccuguuccucuggcuuuuacagucuucccacuuucuuuucccagugauccccugagccuagguuguguguagacaggaauuacauuauagacauauauaauggcucuggucucuggucuucagaguucuucacuuggaucuauugcaauuuuaugcaguggucacugccacaaagagaagguuccuugaugagggaugaggaacaacacuuacccgugggcauaaggacaaauauuuagagugcaguuagggguuguaguggcuuagugaagugguaguuguagauuccccuaugguauccaugacuucgguagccccagggaguugguuagauucccaguggcagacaugacuucucucacucuuguugagugggucugaagacaagaaagccgcugguuacugccaagauaggagagagugggagaaauaguuauucccagggaggagcuuaccagucgguaacuaggagcaauggucaggccugaaagcuacauaacaguaacaguauguggacuacacaggcuauaguuuaaguauucaagaauacauauguauacauguauaugcacgcacacacacacacacacaagcauauacguauguagacauauacacacauguauguguacuaacaauuaacaacaauugaagagagaaaggcuaugaauuugaaagagagcaagggaguauacaugggaauuuaaagggcagaaagagaaagugauauggcuguauuauaaucuuaagauacuuagaaaaauauuuuuuuaaaaacccucaaaaaguaggcaaagcaccggugaaguaguaucugaugacugagaccuuucuuccuagagaguggccuucuggaggcccaggacuugucucuccacugagaccccagagagccacacgcaugcucugugucauguauguacauguugcuuuuccuucuuuagggguacaagacuugaaaugcacaaccaacaacaugcgagugugggacugcacguggccagcuccccucggggucagcccuggaacuguuaaagauauuugcauuaaagacagguaaggacauccggggugcguccaaaacuguaacccggagcuucuuccccgguuauuuuugagugcgacaauuuuguuccuagauuuuaaaaggacauuugcauuuaaucuucuuucucuuaaaaauuccaaguuuuacauuaguccagacucggucuucuagccaaaagcgcuuuuccuuugcugugugcagugugaggauggagcaccacucaccauguacuggucugcucaggggggugucuacuccaagccauugucugccuuuaucagguugaagucugugucuaauagaacacgccagcaauaccagcuccccacacaggugucgacucucagggaagugguccggcuguaggcaguccagggcuggcacaguugucaaugagccuguccuuguccucagguuucuuugccaucucuugucuggaaucuaaugguuuaggaaucucaugauacuagagggacagcccuuaagucugcaucugaagaagcaagcaggaaaaggaaggacgauuuucuauuuaaaagacucauaagacgucccauaaaacaccugcacuggccagaccuagucagguggccaauaagucuggcuccucuagagccuuggagauaaguucuucuaggcgggugacaaagcucagaaggcaccaaguccauguuauuaaguaggagggucagugggccuugggugguaggggaagcucaaguagccuugagugggcuugacacauagcuucguagaguggaggccuacacaguguccuucgcuuuccccaaaucccggcaggacagcgaauuacuuagcaaaggcccacagguuuaucaagcuuaucuccaagucccgguuuacaacccaguggccccaauauaaaaggacacaacauguuuaaacagagccagauauucccuuucuuuguauauuuaccaagcacuacugcagacaccaggguggcuuguccguuaugacagauuagggucuguugcagaaacagccuucaaaccuuuauauuuugcucaugaaaaugaagggcuggcuauguucuggugucagcugggguuuccacuuugagccucuucuuauuaugaagucauugguaggggacaaaaagaauauagcccguguuggcuuuuagaacuuucuucaucaaguagguauccaugacuugacuucauauuuuucuggccacauaaugucacauggccauuccuuguuuucagagggacggaggacagucuuaccuugaguccaagggaggagauccuagaacuuuggguaaaugguuuggaugcugacuguggcacgugggggcgaaacuuagguccugcucaccaggggcucacaacagauagcagcaguccuguggguggcuugcuggccgaagugaaggggacuuacaaaggagaagaaaccauggaguaugucagaaggcacaugcguaacuugcuuuguagaaagcgagcaagacuuuguacccaggauaagcugaaugaagagagagagagagagagaggcuugugcugggggugcaggaggccuggaaaguucuuauugguaaaagcaagagugugaauaugcccuuagagauacaaagggccgugaaaccugagagagaaagcagugguuaucugugagacucaggggaucagaagccuuccacauccgcgugauggggucuuguugaaguuaauugugagcccaguggguaagaagagagggugugugcacacugaccacuguguccuguuucacuucugccguggccucuguugggcccugcuuccacuacgaggcacuaggcggugguuccuucauguucugugcugaaggggacagugugccuggagcagagcucuggcaagguugaggugggauuugaagagcgagccaaccucgaggcucuucagagccacgccugcuugcucugugccuucuggcaggcgggacacucuuccucauaucgccauugacuccucuuuuugucguagcauacaguacaugcaacccaacaucacacaaaagcauagggcacucucuagugcuuccaauguuaaucaggcuuuuauaagcggggcgcuauuuuuaucugcuauuuaaaguucccugucuuucauuacagguuccauucuugucacccauuagagacaacaaacguuaaaauuccagcucuuucaccuggugaucacgaagucacaauaaauuaucuaaauggcuuucagaguaaauucacguugaaugaaaaagaugucuguaaguacuuaaaagaaaauucgguucuauuuguuaucaucuucagcauuugcuuuucucucuggccacaggaccuugccauguagccucaggcuagccuugaacuugugauuuucagccucaggccccaaggauugggcucagaguuaugggucaccacaccagguggaaauuaaucuuaaaugaacaaagucucuguugaugcuguggugcugggucgcuggcucaaacucacaacucauugaaguuuguuuccguugcugcugccguucacauggcgggcguccuugcuaaggaaaggagccaguguauguauccuccagucagaguagagaaaauggagguccuucccucucucuguccuaugcuagcugccguagccucgaugccuaaacgugccccaucaugccucugguguacuuuguucuaggaguguagucacugaccaccccagaggugacccugccccacgguccacucacacuugcacaucguccuuuguggcaaauucccucaguugaggucauaguccauccauuguguaguuuggcgcuuaccacgugucuacguuacaggaaguguguucugugagggaaaggagggaagggacagggaccuugugaucuguacugugcacaggcaauugcucuacaccagcaccuagggacacuggccaccaguacagaggaagggcagaggcaacuuaggcacccugacggagaacuugaaguucacagguuucucucacggcagcaaagaggucagagcuuuucacccaugagagguuggagucauagugacagggugagccggggaagguuacugauuuuuuagaccaggggaugaagguacagccaacucugauuuguucacuucugugaaguguaaguguuggaauagaucuagucagucacagucuuuccugguugccggcugagugagguaaagcgcucgcucgcuggacaauuggggcucagucgccagagcucacgcauagguggaaggagagagcagaucccacaggcuguccucugcccugcacacgugugggggugggggugcugugcuggcugagccauuuugucaauauaaauuccuuucuaucuggaaaguucuggguuucuaaaggucagguuaaaucagccccuugaugucuguuuuagacagcaagcaauucaugggccucugggcagcuugcuuuaccauuaggaagagaagggaaaggaaagcaggguuuugucucuucccuuuuuuauuuuuaauuuuuggguggggguugucuuguaaauccuuuuguuuguaaucauggccgucauugucucucaguaaaaauagggacagugacccaucugcuaaagaguaaauuauguggauuucuuagagaagggaacaucugucuuucuuccuuccuuucuuccuuccuuccuuccuuccuuccuuccuuccuuccuuccuuccuuccuuccuuccucccucucucucucucucucucucucucucucuuucaaucuuucuaucucucaaucucucuuucucuuucuuccuuucuuugauauauguauguuuuauuuaaaaaugcauacagccgggugugguggcgcacgccuuuaauuccagcacuugggaggcagaggcaggcagauuucugaguucgaggccggccuggucuacagagugaguuccaggacagccagggcuacacagagaaacccugucucgaaaaaaacaaaaacaaacaaacaaacacacaaaauacauacuaugaugaaaaucacacaauguauuuugaucacauucuuucuguccccuaaauccucccagauccccacuucccuacuuagucaaauucaugugaacaaucaaucaaacaaucuggaaaaaaaaaaagaaaaagaaaaucaagacaaaaaaaaaaaaaaaacaacaaaaaaaccaaaggaaaaaaaaacaaaaccaaaaaacccaaaaaaacccaaacaaacaaaaaaaccagaacaaaagcacacacaaaaccuuggaguccuuucuguuuuggauggcugcucccaggcuugggccugcccucggcuuugcuugauuugcccagugacucuccacuggaggacaccgauuuccccuuucuuaucgagcaucaauugcaaauagcuuuuuuuuuuuuuuuuggaguuuagggagggacuuuguguccacuuccccuucucaggaugacugggauuuugucugguuugaaccugugcagguccugugcuugcugccauggccucuguguucaccucagucagguugugucuggaggacaguguuccuuccuucccuucaagucaggccaccacccccgauucuuaccaucuuuccaccucuucuuuuacauagauccucgugaggagggguuugauggagacagcacauuuaaugaccgagugcucuaaacugucucacccucugcacauuguccaguugugggucucuguguuaauuacugucuauaccgcaagaauagacuucugaugagcaucaggcagcgcucugaccuauggguauagcaauauaucguuagagucaucuuacugcuaugauccucuaguaguagaauaguagcaguagguuuucccuagggccaugaccuacuagucucgggcucuuggcuacucuagcaugucacauaaggguuccaucucauuggguaggccuuaaaaauccaaucagaauauagucgguuauauucauuccacugucgcaccagucuacugcaggcagguugcugggcuuguauuuggaaaucuaugauuacuuucucccucuaguagugugcaaguaccguaugugcugggggggggggcagggcggagguucuaguugaguacagcucaauuucuccauguucaauugcauuaggaaguugugucuucagcaaauagggcuuuaccauuaaguuauggaggauaaccaguagaauuggcaaucaucugugauauuugcagguggugguggugguguggcacuucuuuggccaaugacucaaauaagauauaacccauuuccuggcauuuggggguguuacuucuuggcacacuauguccuguugggacauugucucacccauuauauggugacuccauucauuuaaauuccauucauauguguaugcauuuugagagcuccuauagaaguaggucucuauauggcuuaucaaaagguccccagugauagugguauaagggaagcaucccuaacagguuagcauugcugcaggaugccuguggcaucauguguaagucacugugcuuugaugucaugaaucacagccuuggaugcugcuagcucuguccugguugugcuggcgccuggaccagcucucuccuggcaccagguccacuuugugcuucucgauuaucagugcuuucacaugcagcuuccacgucagcagucgcucucugcgaagcacgcaugcucagugacauguaacugacuugguucuguagcucacacuuuaaauccacacauuccaggucaugugcagcaauaacuauuaaaucuaguauaaaacgccguguucagcaaaugauuuacaaguuuauuuuuaggucccaggacugucagguggugauggcuuauucugccuguguuugacaggcagcugaccuaccccuggacauuuauuucuucuugcaguuucucacuuaccaugacuuuacuuaguggucccggaacgucauaagaagugacuagaagaaagaaaagaaaaggcacaccuuugcauuuucucuaacuuaccuucucacgccuaucauuggaggaagaaucuggcaggaacgucuaugucuguuugugccacuggcauugacaaggucacacaagcgccuucuuucccaugaggcuuugaucgugugcugugggcagggagacgagcaaacuugagcaucuccuguccugcuaccucagguuacagcuuuucccuccacgcaugccugaauucucaagcaagguuuauucuuuauguucuauaauucagugucagagccacagcuguaaggccagacgagcccuuccuucuuugaguugucugagccacgguguuuuaacacagcaauagcaaaguaaccgaaaggaccacacccucguuccucucuguacucuccucucuucucccugaacgcugucuuauuuggacuauuggacacuugcugcugcucagcaucauggucuuggauacuguacugaagcugcgugccggcugcggggccagccuuuguaggccuucagaguuaguuagccauuggcuuuggcgcucaguaccagacucauuagaacagucucuguuguuuaaugacacccacagcuuggagcagcucuuugaauucuguaaguggggggcguccccacaugugaggggcucugcuccuggaagacacaugagcggcugugagagcacggaagcucuuuucccagcugucaguguucuuaggcucaggcugccaccacccaagcaagcucguuggcugcuuccuuucagguccccagcuaggaaacccugguauuguggaaacuccacugcugccugcaguaggaaaugugucacauauuugaaacagccagcugauaguuuucucagguuugucccuuuaauuaacuggagcugccuguacaaauaaaaaccuugucgggcagugguggcucacgccuuuaaucccagcacuugggaggcagaggcagguggauuucugaguucgaggccagccuggucuacagagugaguuccaggacagccagggcuauacagagaaacccugucucagaaauaaaaacaaaaacaaaaacaaauaaaaaccuccaucucuuccuuuuuuuuuuuuuccccagugacaugguuuucucaacgguuuauuaucaugccacauuauuacauuauuuauuuauggaguguagaaguuauugauaaauugaaaaacacauugugaaaaauauauuauuuaacuaaaugucuucgccuuucuuuucuguuuuaagcuuuaauuccagagacucccgagauccuggauuugucugcugacuucuucaccuccuccuuacuacugaaguggaacgacagagggucugcucugccucaccccuccaaugccaccugggagauuaagguucuacagaauccaaggacggaaccaguagcacucguaaguuugagcaaaaauauauuucccugugauauaacgaaaccuugcagcuuuuaaagcuuuugagggggcauccaugaguuuggggauuaucaaagaaaugcauuguguauccuuagggguucuuuaagagcccaauaaugugacuuaaaaaucacucucaggcugaugggguagccacacaagccuggcugcccgaguuugauccuggagcccuggugggaggagagaacagaguucugagaguucucuucugaccucugucgcacuguggcaugugcugccccccccccccagacaaugacagaaaaauuagcaauaauacaaaaaucacucauguuauacuaauucauaaguuuaagaaauuaaggggaaagcuauucccugauucucccccuuggauauaguaaaugcccagucuuucauuuaagcaugcucuuacaauaaaaaaguuuauuuuggguuuauuuuauucaaucuguaacuuuuuuuguccauuacugacaucaaaugaauauuucaaacaaguuuaacaauaacaacaacaacaauaauaauaaaauaauaauagagaagccaguaaucuuuaauuuagcagucugaaaugacauuguuccauacaguacuucucucccucuccccacuaaguaaguagccccuuggguuucuguaauuuacacuugcuuuccacuagcucuaagacgugaggagcagguauggaaaguuggacaggggccauguggacacugggacaagacggaugcuaggcagugguguuucauguaagaugcagaccgugcacagccaugggaaauguuccacagagcugaagguagacacagggagccccugagcugcccugaagugugcacucauacaugcauacacacacacacacacacacacacacacacacacaccccuucccacuugucucuguuuggaaacaagcuugcauuuguguauggagacagggccucacuguagcgugcagcaccacuccggccggccuucccagggcuaggauugcagcuacauuuaacuccuccagaucauuccugcuguccccaucuccaugccccaggcagcaggcccaugcugcuauuccuuuagaguucccggucagggguuuauuaacugcccaguggaagauggaagcccuuuccucuuuccuaacccacuaugucucgggcucucugguuccccgcucccuuccucucuucguucccauccaaguuuccuaacuucuucaaauguagucgaacuagcgcugaguaauauuccaaauauuagcuucaaccucaucuuuuuacggagcuucuuauccuaauuucucucuaggccaaaugaauccauuauauuagguauuuuuuucuguuuaccuuugugugugguccugaggcugacccuccuccauaggcauggauggcagagugguaaauugcugagagauucuaacuuuaccuaucagaagcuuaaccagccugcucccgcccagaagauggcggcaaguagaagcuuccucucuuacuucuggaagcgugagaggccagcgucgggagcagggcacagcgugccuugggcaggguugcuaguuuaacuagaugcagcuuacacauuggaaaguuuuaccgggguuuugaaggggauccucuguuccuuaauuguguggacauagcuucauccauacugcugaaccccgaguggcucauuauagucuaaucuggcauuguuugauuucuuugaccccccugacccccuguuucccaucugcccuugcucuguuuucuuucugucugcuccuucucuuugcuuuacuucuuuaagauauggauccccugguuuuuuucuccaugagaguauggaaaucauuucuauagcaguguauccucuucguuguuuuauugacugcuuugaugaguaucaaccccuguaaggggauggaaggcaaucccauaggaccaaaugcugacaagggcacauagccagguaaugaucguguuggugucacuuccucguuacacuguguagaaacagaccguuguacaguggugcggaucauuuuccuuuauagcauuacccacccgguggcugaucuaacauguuccgugaggccuuucugucccuuuacccuggagaaaggcaggacauuagcauuauuuggaagcauaauuuuguguuugcuuuuagguguuacucaacacaaugcugagugguaaagauaccguucagcacuggaacuggaccucagaccugcccuugcaaugugccacucacucggugagcauucgauggcacauugacucgccucauuucuccgguuacaaagaguggagugacuggagcccgcugaagaacaucuccuguaagcuuacucuuacagacccuugguucacaugggcuagauugcuuaagaguaaggguugguauaugcccauaguguuuuuuugaauccagguagcuaucuuccaaagugaccaccccagaacuguggauuaaagaaaucugagacccgcucuagaaagcugggcugaaaaaucaugugucuauuaaguacaacuccucuaacagagagauguaaaauucuggcagagugagcaggggcccccgggucaucagagucaguaaaaugaaguccagaaaccauccaguguuuauuacagguggacagucuguggagcaacaucagauaaggggggccggaagcagcuggauaaauaaggagacucuggggcaguugagcaagacacuguaaauauaaccgaggacagcugaguucagacaggaagggacgggagcagcagaaucugaguuggggaccaggugcuugugucucccaacagugucugucccuuugguuggcugagggguaggggugagaggcuguccacagagauacaaaagauaggaaccaguugguugggaaaggacaguuucaucuuuaauacucugaucuguaggcagugagguugaaaaggucauucgggcauccagagacaugggcguagcuggggaaugucccucugggaaucacaaagguguaugugauuggaagugcuuaaauucugaaggccaguguaucuucgggaaagggaauugggacgcacggaagcgcuccugucuacagcacuacugaaggaaggucuagccugaggacuaagaguggcccagaaaguucagugugguagaacccaagagaggagggaguuugaagguguuuggaugauaaaucggaaggggcccuuggaucaaacauggggccggugagucccuucaguagaacggugaacuuagaagccagaugucagggaagagugagggauaaagggcaccagaggucacuguguaaacaccagcuguuaggaguggagcuggggugcgugaccuugaccugcaagggcauugauuaaagcagcagcugugaguuagaguguggagggcuuccccacuuguuugcugaagaacauaggagaguuucaaaagaaucaacgugaaacuucugaaauuaucgagugauucugugugcaucuucugcauguguauauaaacccuuaaaaauuaaccugugaccuucaacaaacggccugugaucagguucugucccugccuaaguaaauaaggcuacaguuucacuuuguauuugugucguacuccuuugaaacccgaguguggugccuugcacugggggcugcauuauuucacaacaucuacaguuugcuuuguaaauguugaacuguuuuaagcucucgaauguggugguuuaugccuguaaucccagcauggagcaggggcaggaggauuacugcgagcuuuaggccagccuuggcuccauggugaaauacaagccauucuggguuacagaauaaugccuuguuucaagauaacagaauugaggcacucuguuggaaaagugcccuccacucaggcaguucuguggccccaagauugauccccagcaucucccucaaagcuggguaucguaacaucgacagcccuaagucucugaggguggguagagaucagagcuucuacuucugucuggucuagcuaaauuagugagauccagguucagggagagccccuaucucaaaacauagaguggagugacauugagaaagacaccccaugucagccuuuagucuccauacacauacgcaagcauguucacacaucacacacacauacaaaaauaaauacaagaagaaauaaguaaauaaaugaaauaaaaaucauuccaggagacagaaaggauguccugaggagacaggugugaguaaaagaugucugaaggguuugugacuccuccuguuuuuuucuagggauucguaauacagagacuaauguuuuuccucaagacaaaguggugcucgcaggcucaaacaugacaauuuguuguaugaguccaacgaaagugcuuucaggacagaucggcaauacccuucguccucucauccaucuguacgggcaaaccguugcgauccauauccugaacauccccguuucugaaaacaguggcacaaacaucauuuucaucacagacgacgauguguacggaacgguggucuuugcaggcuguaaguguaucgugucaaauaguuccucucagccgggauugguccguuuccgaccuuaaugucuuuccugugagcugauucucuuuuuuccuuauuuucuuguuuaauacacacacucuagaggcgggacuuacuucuuucacaccuaauccugucccaguucuaagucucauaauaagguugaugagguugagacaucgagcaacuaggguuuagcuuaaauucuucacuucagaauuaggaaugauuucauacacauuuguuuucuguuucacuaaaguaaauccuuaauuagccaggcuuaaauacugcauacuguacugaguauccgguuuauaaguagcuuauuugaggacagcgaaagacuagggugaggagucuuaaucuucaugcauucugccuguaauguggguccccgcccacuccuguauccuaaaaccagucuagaacuugugggauugggcugcuccucccacggagcuugugcagaguaucccuagaugauucugguuuuaggacucucaguuuugacauugaacuuucuccuuccuccccuguggggcuaccugcaaccgggaugcccuugugucccaaaaugagaauuucuagguucugaguuugcucucugggacucaugaauaaaggugugugggacaguuggaguggauguugugauguuucuucuguuuuaaggaguuuaucccuuuaugacagcuaauaauugccgggauaucacuaggaccugagagagucggguggcuguuggguugauccuccuuuugucucggcagcuuuuggaacccaaggcacagucagcuuagguucacacuuaaguuuuucaaaucgccuuuucuuccucaugggauguggggacacucuuuguaaccguuuuccaaaugagccggagccuaaaaugagaggcagugggaacguagugaagucacuccagaggaaacaaauguaaaaggagggcugugugugugugugugugugugugugugugugugugugugugucagggauccagaauacuugcagcucuuccagagggcucagcucccuucccggcacccaugugguggcucacaaccuuccguaacucaggcuccuggggaucugagguccucuucuggcaccugccggcaccaggcacacacgcagcauauauucaaagcgcugguacacauaaaaacaagaacuaauaaagcuuuaauacaucacacacacgcacacacacacaugugaaaaagcaaaaauguuuuaaaaaaugaggauaugguguucugaaguaacucaguggggaaagcacuggccuuggggucauuucccaggacugcccaaauggguuagguaguggcaggcacacaggccuguaauacaucccuagccacuccucaguacaagcaggaggcucaggacuucaagcucacccuccuccucagccacucccagacccaccuggucuacauuagacgccaucucccaacaacagaaaaguuaaaaauugaggguaugcacuauagacacaugguuuccaucgcugugauuucagacagcauuuuaauauuuuaucaugcauggcacuggaguagaaccuuuaaagucuugcuucaaccuuugugugcaacagcggaagcuuggaauauggcucgguguucaucagcucagggcggugcagcaguagccuuucccaccaggcaaacugagucagaaacuuccaggacagguucuaguauaaaguccagaucaaguuugcugucuugucuuguuuuguuuuuguuguuguucuguuuugcucccuuaaagguauacuguuaauucuccauuuauuaaaaaaaaaccuuuaaaauuguuuacuccucugaacacauucagacucaaauguagaucaauggaagacucucauucuuacaacaugacaacgacaacccgcuuaguagacuauuguggcaguacacgaucuccuaugucuuugguugaguuuagucuuagcagcuugcuguucucugaugucaguuugguuauguuuggggguuuuggagacauggucucacuccguagcucugguuggccuggaauuccuagguaguccaggcuggccucaaacucauagaaaucaguuuuccucugcuagacgguguagaauuaaaccuaugugucgccaugguacuacuuaauggcuuuuuaaaaaaauuacauguuacguucacugguauauuaaaaaaaugaucugaaucaagauuuacccaauuucaauugaauucuuuucuaaguuaauuucuuugcaaagggaaucgguacauuuugaacauucuccucucguuuccuuuucucuugucacacuccuguuucuuuuuaauucauucuuauuauuuggacuuugaauagacgaauguguauauucuauacccuaaaguuaucaucacuguaaauuauucuaaguuccagcaugucauaagagugguagauaauuuugucuugaguuuuaaaauaacuuucaaaauaagcguaucaauguuuaauuaauuguccaauagcaagacugccaaacauucccucgccauccucggugucagcuaaaaugcuagcagaggagccugggagacgucagugaguaagacacuugcugcgcagucccauggccugagugugguccuuggaacucacucccauaaagacagaaggagagaggcagcaggagagagagcgagcccccacuuaauuguccucuggccgccgcacgugcuccaugacacacaugccccacgugccgugcacacaaccaauauuaauaaacaaagaauguuaaacuaaggaaaccguuacggggaucucuugggagaauauagaaaaauuuguguuuugguugacaucuaccuacuaguugaaaaauucagcuccuucaaaaagaguauuauuucuacagaauauuuuaccaggcagauucuuguuuuuaacuuuaauagaaaaaugaaaaauacuugcauaaauaccacuuuaggauggaucuguaucuguagcugauuggcuaugcaaacguaucuuguuuaaucaagcgccagacuauaaugguuuuagauaccacuugaaaguuuuugcaccuuccuccccagaagugaccuuuuucuuuguucucugccccaaaguaaagccagggcgaaugguuccugugagcagcggcuguggcuuuuagcauccugauacauccuucucagccacagugugugaauagaugggauaugguagccguuucacacuguacauucccagggcuugacuuagaagacuuugaagucaagguuaaggaaaagcaauuuaguucauuucuccauuugcuguugggaguuugcauaggagcuggguugagaguaacuccucagagucccuuaauaaacuguuuugaaugcaauacaaauuauaacaacacaucuugcugaagcagugaugauuucugcccuauccaaaauggaaauguguaaacagccaauuguuuuuagggaauuaugcaaaaaucccacuuaacaaaaccguaaaacuguagauuggaggaagacauguguaaccccuuugucuuucuucuuccuguuagauccucccgauguuccucagaagcugagcugugagacacaugacuuaaaagagauuauauguagcuggaauccaggaaggauaacuggacuggugggcccacgaaauacagaauacacccuguuugaaagguaaugucaaccaggaaagagugcugguggcaaaaagucuggaaggaccuguugagugacacaggagugucuuggcacauugccaccauugucacggauguacuguggcacagggcaguguccuggcacauugcuguauugguaccuuauauacuguaauagcugcaguugaccugcaugcagcugcacuuucaggccuucucucucagaugccuaaaaggaagugccucugaugugguuuguuuaugcuuggcuguuuucuauaucacacaugguuuuaugaaccugugaucagucuuuaauuuaaaaaacagacuuuuuauaaaggccaguagaaaucugcucuuguucccccaacuacuuacaucuuacagucuugaaauuguuuuucuuuuuaacugacagcauuucaggaaaaucggcaguauuucacaggauugaaggacuuacaaacgagaccuaccgguuaggcgugcaaaugcaucccggccaagaaauccauaacuucacccugacuggucgcaauccacuggggcaggcacagucagcaguggucaucaaugugacugagagaggugagccacuguuaccaggcagugucuauaaauaaccacaauaaaaauaacuccuaaaaggugacugcacggauuaguguuuacuguuuauuuucuuuagagguuuucucaauuuuauauuaauuaauuaauauauucauuuauaauuuuuauuguaagaauuaaaguaaauaauuuuaaaucugaccuuuuuuucaguugagauaaaaauuugacucauuuagaucaaaacuauauauggcuuuguuuacucauucuugaauucugaacuuuuuuuuuuuuuuuuugccaaguucuugaaaacauuuauuuuaaaauacuuuuuugacucagaagucauugcaaaaauagugagucacaagugcaugaauccgacugucuuuccucagcaacgacccccaaaccagagcggugacccuggugcauauuguucaccagagggauugccggcugcauguggcgugcacucacuaggaugugugucuaaacacacagaagugaugacggggugggggagcuccauggugcugguggagcggaguauaacuuaacugugauggcggucacaguuaagaugaaucccaucacugucucugucucucucugucagauugcaccagccaccugcccugcacccccagggcuauaguauagugaaaccacacaguauaagcauucaaggcuggcauuucuuaggauaauauccuugagggacaucuaaauuguacacuauuaauuguucaucucuuugugugccagugagcucugagguuuuuuuguuuucuuuuugccaauauguaaggcaacucagaauagaaguaggacacauguagcuuuuuuugugguugucucuccaucagcccaguguacuaacuccaugcuaggcucugccuccuccugagaccucacagagacucauggaagacauugguacaagcaagggguuugucaccaauaugauuacuuuuuuuuuuuuugguuuuguuuuguuuuguuuguuuguuuguuuuuugagacaggguuucucuguguagcccuggguguccuagaacucacucuauagaccaccagccuggccuugaacucagaaauccgucugccucugccucccgagugcugggauuaaaggcaugugccaccacacccggcucaauaugauuacucuuuugucacuuuauaaaaauaauuuuucuuuuauauuauuucuguggguaugcaugugcuaagugugccacuuauguugguaccugcagaggccagaagaagggggucagaaccccuguagcugaguuacaaguggcugugagcugccucgugugggugcugggaacugacaugaagugcucugagccaucuccagccccuccuuguuaucugucacuccauccugccaugcucauuucuguuucaucugagagucagaaggugacacuagagcugaagguuuugcuuguguuugucugcccugagucuuucccuccuguccuauguauacggcuuuucccuugaaccucagagucugcagccauuguaagacucccccuccugagccacacugaauuccuguagcagucagcuucauuaaaaugugcgagugcacacacacacacacacacacacacacacacacacacaaacacauacacacacaccccuaguacacguggcugucaguuacucuguaucugucauuccagcuguacacacaaaucucuuaaagguaccuuuaucuucccaccaguuagcauccucaauaccagguaaagaacgucgagcacauugcuucucuaaggccauugggaugacaucaccaguaacaaacagguccauggguuccgcccagacugucuuggcuuuggcaguaauaacaccuccuuguuccccccuccccugccccuacuguauacacaucuacuuugcuucuaguuuaucuuacuaggagagaccuuuuccacacuuaaacguuuaaaggcaugaaucuuuauaauucuauuuacaguugcuccucaugauccgacuucguugaaagugaaggacaucaauucaacaguuguuacauuuucuugguauuuaccaggaaauuuuacaaagauuaaucuuuuaugucaaauugaaauuuguaaagcuaauuccaagaaagaagugguaaguaaaauucucccauagcuuuuuuuuuuugguuauucugaauaaaaaaacccaaucucaaaaauauuuaagcaaauguguguauacacacacacacacacacacacacucacacacacauaaacucuacaaacauuuauuacagagaaucaccaagccaagaaaaaccuuauaauccaaagaaaugguagcauuuuaauuuacauuugcacauuuguuacuggacaguaaagaguauaaguucaacuuuugcugcucugugcaacagcuccguguagguagugcucauuaaguuugugagugaaaaaguaucuuuuacuguagccuuugacuagugggcacagggaaguagaagggaauuuuacauuauuaagcgcaucaguagaagcaaguugaaauugguaauuauaagucaaaacuggacuuuuucauauauuuuaaauaauuagauugacuuauacuguacccuucuguaauuugugguaacccugaaguaaauggcaccguagccgaaugcuaauuuggaaacucgcugguuucugucaaagcauucagcagggagugcacagcuugaccugaaaagccacuuuguaaggagcagcccagacuuugcuggcacauucauccucagacuuguguaaaacugcuucauuuuaacuucauuuauauuaauuaaaauuuuuuuugucuauuuacuacauguucaguacauaauagaggcucuaggugauacauucguaaaccaggacacuugcccccgggaugguucccaguguccuugaaauaacacacuucaucuuccagcuugucucuaauuaccaaauugugucaaaguuuaauggucacuagcuauucacugauuauauaauaauaauaauaauaauaauaauaaacaauaacaucuguauaauuuaacugacccuaaucauuuagaucuaauaaucagaauaaaaugcaucccaauauuuaauugacuacuauguguuaggucccaagaaaauccuuuuucugcggucuggcauuuaaauaaaaccagcauucucucagggacucaagucugauaguuccuagucugugcuugcucgguggaaucauucucccgauggcaggcaagaaaggacggaggaggcugcucuuccauuagccuaugccuguggugccuacuagcauaucaaggguuaugcuagccuccagguucccucagaucuuacuccaaguaccuguuagagucuuccuggauggcauacacacccccagcuucccuucccuucccccagcuucuccaauuccugcguagcuaucuuggcgacagacuucugcucucuuugcucccagucucagucucuucucagugucuugcuccacccacacccccuccauggcccggucuauucugcugaccauguucagucuggacucuucuagaugccucuagcuauucucucccucauagcugcaauaaaaaacccuucuccuuaaucauaccuaagagcggucuuguacucauucccacucacuauggagcauaauucucuuaaugccguauuucaucaagaacuaaaaacuaugaacucuguuguugcaaucgcaaacuaguaugacauccauuugguuuauguuacaagcguagaaugguuuuauaccccccccuaucuauaacguguauggccguauuccauauucauacauaauuacccauguauauuuacuuguuuucaaauagaggaaugccacaaucagaggagccgaggauucaacuuaccauguugcuguagacaaauuaaauccauacacugcauacacuuuccggguucguuguucuuccaagacuuucuggaaguggagcagguggagugaugagaagcgacaucuaaccacagaagccagugaguggggugaugcuagggcugaucaguaauggggagaugggaggguugacagggaggaacacuugcauggccuugagggucaucucucuuacccuguuuucugggcccguguacucuguagacacucagaggcugucucacuuuagaauuucucuguugaaggauuuucuaaauggaagccaccuuuuauggggcauuccagauacccuggaguaaagugucaagcgccuccguuuuagucaccgauacugucccuugccucacaguuugcaucuucaaagucuaacuuaggaaucucuuucccagcuccuucaaagggaccagacacuuggagagaguggaguucugauggaaaaaaucuaaucgucuacuggaagguaaauaucuauuguucccuuggaugcuuaaagauuuuuauuuugcccaagcaugcgauguauggacggugacuuagauuuggugaauauuucaaauuuuacuugcuuauguaguauucagcuguacugauaaaugauauacgaaauacagcaccagagaaauguguucagggagccaaggcuucccagccuggcuacguuugccaucucccagccucaugucucucaucacucccgcuuccccaggcacugggacggccuggccuuggcucugaaccuuuuacucuggucccggaaguuguguauauaguguucagaggaagacuuacaggaauugggucuuuuaccugguggggccuagggguuggacuuagaucuucaggcuggccagcaagcaccuuacccacugagccaucuugccagcccuucuuugaauuuuuguauauuuccuaguguuccuguaacggucgcaugguguguggggguuggggggggggaagaauaccuaugcaagaaccccacaccacacugcuucguuuccuucaggccacgugcuuacauuuuugcuucuggaacuauaaaaauaaacauuguuuucuauuaauguuuaaauuucuguguacuuucaauacuuagccacaagugcaguucuuuuucaguauuuuauuccauuuuuguuuagacuugccccaggauuuuaaaauaugaguuucacaugacuaauggauucauauucuacugucaccauuuauugcgagcuuagccuuagaccucagaacuuuucucugguuuuagugacagaauuugcuucucuguuuuccuagccuuuaccuauuaaugaagcuaauggaaaaauacuuuccuacaauguuucguguucauugaacgaggagacacagucaguuuuggagaucuucgauccucaacacagagcagagauacagcuuaguaaaaaugacuacaucaucagugugguggcaagaaauucugcuggcucaucaccaccuucgaaaauagcuaguauggaaaucccaaaugguaagugcuuggguggcaugggggauguggggugggauggaaacccugugguaucagcuuuccugaugggaggaguauccugccccuccugugcuauuugcaugcugugcauagaauuugcaugcuauacauauauuuacauguuaugcaaauagaggacccaguacuugaaugucugcugcccaaugagagaugcagcuagcauuaauuuuuauuuugucuugagacaagauuuugcuaugugauucaggguagccucgaauacacuagauaaccaggcuguacuugaacaggcagucuucugccucagccucccagauguccucaggauugacaggaaaucuacaguguguaguagguaauaauuacuauauucaauuucuuugucgcagaguaugaaaaguucuggguguggacgguacucuuaggaagaaauguuuaaauguuuguccgaagacuaaaaguuucuuuuuaagaguaagaguuuuaguggguagugguggugcacgccuuuaaucccagcacuccggaggcagaggcagguggauuucugaguucaaggccagccuggucuacagagugaguuccaggacagccagggcuauacagagaaacccugucucgaaaaacaaaaacaaaaaaaaauuaaauaaauaaauaaauaaaaguaagcguuucgguugucaucuaguuuuguacccuguaggacagggaaagaagacaccuguuucaauuggcagcuuuguggugaauugauugccccccccccccccccccccguguauguuguuuggguuuuguuguugugguuguuuuuagagaaggucuauauaguccagguugccacguggcuaggaaugaccuugaacuccugauuuuccagccuccaaacccagcguagaaauucuucauuuaaaaagacccguuucucaaagcuaaauuagaucuuuaauaaggguuuugauuuguuuuuguuuucguuuuuuuuuguuuguuuguuuuguuuguuuguuuuuuugguuuuugguuuuuugagacaggguuucucuguguagcccuggcuguccugaacucacuuuguagaccaggguggccuugaacucagaaaucugccugccucuccacccccagccccccccccccaagugcuggaauuaccaccacgcccggcuaauaaggguuuugaaaaacaaaaauccuuaugacaugauuuuacaauuuuuguguuuuucucuaaauugugcagguugccagccaaugacaaaccacauuccuucuuggcuuuuacauggacguuauuagucuauauucauuacacaaacuagugcauuugaacuggauaguuuuacacagacauauauaacacacuugaucaucuuuauccucagauggccuucuuuuacccccacccccaacugcuuagucuuuccucuucucucguagcuggauuuugugcugaaucaggaguuuaaauggccauuuugugcuccucuuccaguugcuuccuuaguauggaaagaacuuuuuacaagaaaggaaaagucuuguuaggucucuugagugucucuuaguguuguguugaggugguuucuuauuucuugguacugaccugguuugucaguccuaggcagugaccacagagaacuaagaagcaggaauguagcaggguuguuucaaagacuggauacgcccagauguguggccgugcagagaagcaggggucaaggccgggcgccuguccaguggcccucauuuguacccagugcuucugcagacugcagcucuuuuguuuucuguuuaacuggagcacacugauggucgcugcucccaguggcccuugggaaggagagucacagcugaaacugugguuucagcuccacaguugcacccgagcccagagucagaggcuccacagccccagcucaagguuagauuauggcuuuguaaucacauugagccaaaagagcugucuuacguccaacaggugcucagauuguguucaggagggcugcguuaugaacaugcauuuauuuagaaaucuuuccgauauauggcuuuuuuuuucuuuuaaaccaaacccuuaaguauaaauuaauugaagaagucauucuucucuccuguccccaugggagacugcccuugucuuccuuggccaugcugggcuguccuccacucugguccccaugccucaccugcauccucaccuaucugucaggcccagguccagcagaacagacaagcaaaccucccacagccaagcagugccuauucucacuccccagggggugcaccuccaccccaguaucucauggugucugggaaaugccucugcccacacugcucaccucaccucauggcauggccuugucagcccuucugcauuccccucacucccccagcauuugggcgcuggaugcagggguccuggaaaggagaugcucagcucuucaguuuuggaugcuccaucugcaugugcucugccucucccucucucaggagcucugcucaccuuggauggggagagcaagaguuaguuguccccugguucuuccuccacauagcuaugcugaacacuccagaaccagucuagauccuacuaugugucuaccagauucuagaagcgucuauauuuucuccucagcuucugaauaaagguagaugcuauaguuauuccaauaagagaguauuauuucuuugcuaaacauugcuaccuaguuuaaccacuguuuuaaaguuuguguacagcgaaauaacuucaguaacuacugcccauuuucuugaggcuugccuucugguauugcuuugacugucaauaaaauaucuuucuuuucuugcugaagacgacaucacaguagagcaagcgguggggcuaggaaacaggaucuuccucaccuggcgucacgaccccaacaugacuugugacuacguaauuaaauggugcaacucaucucggucugagcccugccuccuggacuggagaaagguuccuucaaacagcacggagacugucauagagucugguaagaauccguggcucucugaggccuuuaaggggcuuuugaaaagccacacagaggugacuuccucucuguguggucaucuacucugauagaucaucagagagagcagcauagauuuguaucugaguguaggguuuuuguugagauagguccucaaacucagagaucugucugcuucuucugcagaaaugaaagguguguuuccacacaccgggcucugaaaugcuagggaauguauaagugguggcauuuugauaaaauaggcuucaaugggagucaaagaugacacaguuugggaacgcacuucuguacaaccaagucagugcagucaaugcccucucgcauuaguguguccaggacuuggguccuugaggccucaaagccaccaccaacaguucccuaauaugaggaccagggaaacucaauggaagugggcaugggaugucuucagcuuugcgaucgagcacaggucugcccgugagccugugagccuuagcaagugagccaccauugacggugcagccugacccauguggcacccagugagguuuggauccucagagcaaccguguuucuccuuuggaaguggcugcuucccucccugcagggccgccaugccuucuacagaaucagugugagccuacgccuuugggguuuuucuugagccaguagugggccuguaggucacgauacuucuagagacaucagcuacuaggucuuccuucuguguuggugaagcaagcuggaggguaaagggcccucaguggcuucccucgcuaagacagguucuggucauuugcuguuucugcuguuaaagggugaaggauugcacuuggcgauuaaccacgaugggcucagcuaucuuucccucuguaagagcacuucugcaguugacuaaggugguggcgguccucucuugcccccuuucuccucuggucaccuccaucuuucucuucccuacgccuacucucaaguccuuuccugugggacugauuuggcugagccuguggucucucccacuugggcuugcagaacaaguagggugcccuuggacagggcgacacaggcaguguuucugggagaacaaguugugacugagaucccucaggaaggggagaagcugcuguaauagcugccacugugcgugagcaggcucucugugguagcugagaaaaacaaagacacagaggacuugggaaaggucacagaguuaggaggcaguggugccagaauugaacgcuacucggggccugggaaagcuggggaucuugguauucccugcugagcuucugugcugaucccuucccuuguucaucucucgaugcagucuuccucuccuucagcccuccguucucucugcaucacccagcaggccccuuugugacauacucgauucaauauugauaaucuguaauuuuaacauaaaacaagguauggguucacaugcaauauaaaaccauagccucgaguauaucuccccuccccagcccccccagggaaggaaggcacaaaauugaaugcacuuagcugaguuggacuuaccaucaguauuuacuuaguaccuggaagcacugagugaacacuuuagaaaaaauaguguagggagaaaaguuagcuagcgacagaagcucggguuuccuuuagacuucugaggcugaccaucuaucucacuugggccucugggguucagguguucuuugggcguguggcuuaaagaagcacuguauuagccacacaggaauaugucccauccagaaacagaugccugcugcacuguuagggccucacgaaggccuugccuccuccugcuuucuccuccuccguccucuuagagagcacuuggaggagcucuuuccaaucuuagaacugaucaguacuucucuuuguauccggugcuuacuacccgagacccauggcugcccucgccccgugucuucccccaggcuuggccagcuucuccgggaugagaagggcucuucguguguuuccuuguuucucaagucuugucuuacagauuugaugagacauuaaaaggugcuuuaggaauugaagaaagagaaucaucuagaaguggggauauggggggcacacaaggaagggggugguaaaggacuggagaguaaggacauccauauggagaugcuaugauaaaacucacuacuuugugugcuaaccuaaaaaaguaauuaaaaaaaacuugagacacgucuuguguguccgucacucaguguacauuauaaagggaagcaagcgaugaaggccugguuccugugucccaaagcuuugagcugagcaggguuucuagugcugggacuaggggaaacaugcguuucuguccauccccaaaaugauggcacauagaugagcgaaagcaccaugaccgugcugaccacacgguggugccugggaaguaggaauaagaugucagccucagcuaccuuugucucuucaaagaaacgucauccugugaucuuuucauuacuauagacgugaagauguucgugguuugcugaguacuccuaaauguuugccaaauuugaaaaaaaaaaacaauauauuuuuauaauagaucuguagcuagcuuuggaaauuuuagcauguuauaaauuuuaugcuucuaagauaaauguucuugcuuuacccacauagacugaugaaaguccacugauuuguuuauccuacagaucaguuucagccaggaguaagauacaacuuuuaccucuaugggugcacuaaccagggauaccaacuguuacguuccauaauuggauacguagaagaacuggguaaguuaaaugucugaguucucuuaaaguuuggcuaacacaagaccguguaaauaggcaaguagcaggggucacgcucuagaacauaccgaauuuaguugguuagaucaaagaagauaaaauaauuccuaucacaaauuuaucaaaauuguuagucacuugucuccaccugcuuguugauuucacaguuucagucuugacacugaggaaguuauaucauggcugucguacuugauuuguguuuacagaagcuuaaaaacuuggaaauguauccaggccuaacaccagagaggggaguaucccugaagucuguuugagcggucacuuaaaauaugcggcacauggggggcuggagagauggcaccgacugcucuuccagagguccugaguucaauucccagcaaccacauggugacucacaaccaucuguaauggggucuggugcccucuucuggugugucugaagagagcaaugguggcauacucauauguauaaaauaaauaaauaaaucuuuuuaaaaaaccauacaugcggcacagguuauccccuggaugccugucuguguaaaggcugugauuccucccugagcuccgccugguuauuagcguagaguuguucaaucaucagaggaauucaugcuugaguaaaaagcacagcuuaauuccaagauuagguguuucuaaagccagaagucucgggagcacucacuccccugcccuucagcccuugacugcuuguuuugacagcucccauugucgcgccaaauuucaccguggaagauacgucggcagacucgauauuagugaaaugggacgacauccccguggaagagcuccgaggcuuccuaagaggguauuuauuuuacuuucagaaaggagagagagauacgcccaagacgaggagcuuggagccacgugaguaaaugaccgccuggguucuagugcuguguaaagacagacagacagacuuccacuggccacauaagagcagaggggcugcugcacagcugagcacaguuuccagaacuaucucagagaauacaauaaauagaacguaaauucuuucaaagucaaaaucgcuuauuuaguuagaaucuuuauaagccccacagaaugguggccacuucuuacuaguguuacaugaaccacaccauaugauauuauuuauuuuuuaaugugguuuuauaucuaauaaccaaagaggcaaaaaauggguucagagccccaguuaugaucuggaaucaaaaugguggcaaacuguaggguuaaugggucccaggacacucugggaggcaggaugaugcaggaguugaccacacuuacccuaugcugucaccuggguggccauggggaagccaauccgaggucaccgcucuggggcuggguaagcagaguaugagguguaggacauccagagcuggcucuggggucccugggccugcaaggagucuggagccaccagguucccagucucucugacacccaggugccgcugggagccguggaagaccugggcuuggcuuggcgguggcuuggaggugaccauggcuaggagugcagagaggccuucugcgggagauuagacagaggcuccauaggugaaggccaucaccgugucuccccacagcggauccugauggaaagaggcaguccacgguuuuaagacguuuauugucauggcugaaaguggaugagugaaaccauacccccuucucagggugggccugagguuaaauaccuugggcagggaggaguaucagaguuuucccuuagucacagacagggaagugauuuuuauggagugccugcuguaugccaggcauuguucuaacaaauguacaugaaaauuuuacaggaugccacauccccuacagagucagagaagccagaguugggaguaguuagaugguuugacuggugggggaagaacuugaauguggccccggagcuuugguugggcgugggcagcagcaagguguucucccucagggucucauccccgaguuuaaagugaccucagggugagugagauuauccuuugcuuuagaucauucugacaucaagcuaaagaacaucacugacauaucccagaagacacugaggauugcugaccuucaggguaaaaccaguuaccaucugguccugcgagccuauacacaugguggucugggcccagagaagagcauguuuguggugaccaaggaaaacuguaaguucaacacggcccuagaaacaccuuugccacuggagcgauaguguccuuagcaucuggggacaucuuuguuccaagcuccaggcccgugauucucaaccuucccagugaugcaccccuuuaauacagguccucauguuguggugaucccccaaccacaaaauccuuuucauugcuacuucauaacuguaauguugcuacuguuaugaauuguaacguuaauauuuugggagauagaaguuggccagauaggccgcaggccgcagguugcggaccacuguuguaagguuucacaguucauugcuuuuuuaugucaggaagagcggacugucaaaggcuaugagagaacuuuuuuuguuuuugcugucaauuauuucccuauaaguauguaagaaauuaaucaauuuagggaugcaccccaaaucuacaacccuaaaugcauaguugggauuuuuuuuaaugcaguuuaaauauuuuccacacuaguuugauuuuaauaggucuagggaauugcguaagagacagucgcucucuaaccuucaguaagaccacacuuguuaagucugagauggcaguagacaagggugguagccuuugcuguccuucaccgggagaaagcuucaguuuggcuucgggcuuccccuccaccagaauggaguccuuguccaggucuggagcacagggccaagaggccgugaggcauuaaaacaguguugcaacuggacgugaugcugccccaucgaagacaacuuggcaaugucuggugauguuccugacugucauaacuggagugcugcuggcaucucaugguuagaaaccggauguggcuaagccuccacaccagagcgcacagggcagcccucccugccccuccucacaccagagagagcuugccuauaugucaccaguggcaggauugaguaaucauacuccaguguugguggcccuagaucaguuagaguuuugucucuucagauaauaaaugucuuguggacuccauacauccgguggugauuuucaauguugauaacuguuucuuuucagcugugggauugauuauugccauccucaucccaguggcuguggcugucauuguuggcgugguaacgagcauccuuugcuaucggaagcgagaaugguaaugguuccuguguguguauucacccucuuguuuuuacaagccucauugugcagucauguuaugcaugucggacauuuuuuuuuuuuaacuuagaagguugacuuucaauaucaaguaagaaauaacauuuuauugaaaauauuuaagaacucaaagaguaaaagccgucauucucccuacugucuuuacuaauaauuuaucccaguaaauggcauuuuaaagaaaguggagcccuuucugugaugacugcagccauuuuguccuguccuagccaggacaguuccuggcagucaccccagagcccacugcucuccuaugaaccccuagccacacucacaccucuaccucuccccaccccacaccccuucaaagauaaauugaccauggcuaucugcaaguuuauauccaaguuaaugaucuagauggguccuaauggccuauuagaccugguuuuuuuguucauauguuuauuucuuaugaaugcuccuuccgugagaaagagguuauaguugugaauaaagcaagccugguccuugggagucucccagcagagcgagagcaagagcgagcgagccagagagagagagcgagagagagagagagagagagagagagggcaugccagggaagcauaaacaugcuuacagggaaggaagaggaagcaggaaggcugcccuggggagagcccuggaggguaacagggcuucggguagagaacguucuagagagagugguuucagguagacucugaaacuggaggcacuguauaauugggcaaagugaggggggggggagaggugugagugggguuagggguucauaggagagcagugggcucuggggugacugccaggaacuguccugacuaggacaggacaaacuggcugcagucaucacagaaagggcuccacuuucuuuaaaaugccaucguuagugacaguuuugaagauuccuggcuuccaaaugaaaggaguaauacacaaauagaauaaccuauuucggcaacuaauuccaacuuuaaaacaaucauuucaguacacgaagaaaaaaagaggcccagaaccuggaacauucagacucauguuaacacagucaccguccuugaggaaucccaaacaauaguguccuuaguacuucugaguauaaaaauacagaguguugaacaaaucuuuccucugauguugaguuucuaccuaagauuguagcuuagcucaauccccccuucagcucagcaggccguuucccugccauucauggcugcaaacucuaauacuuuuuguuauuauuuaaccugauaugaugacucauggcugcaguuccagcacuugggggcugaggcagggagagugagugccauaaguuuaagggcagccugggcuaccauagcaagucucuaccucuaaagaaaaaugaacaaaagugcaugcucuaacacacauacaugcaugcacaugcaugcgcgugcacacacacgcacacacaaaugaaaauagaauugauugcuuuaaugucaaugccugugcacuuaccaaccuuggucgagcacuuccaugcacuggaagugucccuugugcgggccagaccccugugaugaccagaguacugcaugugcucaccggcccuuuugacccugcuuaauccgguucguggugaaaacuuggcucuacuucaugugagacaugauggcagccgucacuguaaguuauuugcuuucauuuccuugagccaaauaaggccuucuagcuagagcauagaguggugguucacagcguucacgccaaagcccugugucugcagcucuggcguaaagagcuucuauuugugucucaggugcucauugacauugucacaagaaagccucaagccaagcuggcuggugccuacauuuuguuacacgaucacugcgugaugguaauuaaaucaaauucauucuuuauuugaaggauuaaggaaacauucuacccagauauucccaauccagaaaacuguaaggcgcuacaguuucagaagagcgucugcgagguaauccguccuucuccgugguugucuuuggggacauggggcccuuuccucugucuguugugagaagcuugggagguguggcuguccccguggagaacagaacaugcaugucuaacucugucugauguccagaggucuucgucuucagcguucacaccgugcuucuucugcugcuauuaauagcaagaaaaauauugacaaggagggggggaaaaaaguagcuucgcucuggaugugaacucuagagcugccgaggcaaagguuuauaaacagauguggaaaaaaaauaugaggggccccacaggagcgugcaacgcugccgucuuaaccacuguaccaaauuuauuuccagggaagcaaugcucuuaagacauuggaaaugaaccccuguaccccgaacaacguugaaguccuggaaucucggucgauagucccuaaaauagaagauacagaaauaauuuccccaguugcugagcguccuggggaaagaucugagguggacccugagaaccauguggucgugucuuacugcccacccaucaucgaggaggaaauaacgaaccccgcggccgaugaagugggaggggcuucccaggucguguacaucgaugugcaguccauguaucagccgcaagccaaagcagaggaagagcaggacguggauccuguggugguggcaggcuauaagccacagaugcgccuucccaucagccccgcuguggaagacacagcagcagaagaugaagaggguaagaccgccgguuacagaccucaggccaauguaaacacuuggaauuuggucucuccagauuccccgagguccacagacagcaacaacgaaguugucucuuuuggaaguccgugcuccaucaauuccaggcaauucuugauuccuccuaaagacgaagacucuccuaaaucuaauggaggagggugguccuuuacaaacuucuuccagaacaaaccaaaugacuaaccaggucacccuuugucacuucagucugccaucucaguaaguccucccugccgcuguccuggcagcagcuggggcauuucuggagggacccugcaaauguugauagccagggaccuucacucugggcaagugacacuagaaguguuaaugugcuuuuaauguauccuaaaagccagagugcagugacucagcccucagccgcggaaacucaagaguugaagcuguuuuugauugagccaaagaacccucccaaaggaccucaagacuaaccaacucuguguaguacauacaugcuaaccagaucucacaaccguuuucuguuguuaauggcuuucucagcguuguaugguaugggauugcuaguggauuuacaggcaagggagaaaaccuucccaagucaaacagcguuaauuugccugacauuuacugcggucuagaggagaaccaagcacagaucuuaaagccguggugaugucucuguccacagcauuuacaaaagcaaaucuaguuuuucauguagcagcagcuaucuggcguucuguuugauaaagcgugcugauuucugugccuacugua

SEQ ID NO: 7672 - RNA, 101129 nt, Mus musculus
uacaguaggcacagaaaucagcacgcuuuaucaaacagaacgccagauagcugcugcuacaugaaaaacuagauuugcuuuuguaaaugcuguggacagagacaucaccacggcuuuaagaucugugcuugguucuccucuagaccgcaguaaaugucaggcaaauuaacgcuguuugacuugggaagguuuucucccuugccuguaaauccacuagcaaucccauaccauacaacgcugagaaagccauuaacaacagaaaacgguugugagaucugguuagcauguauguacuacacagaguugguuagucuugagguccuuugggaggguucuuuggcucaaucaaaaacagcuucaacucuugaguuuccgcggcugagggcugagucacugcacucuggcuuuuaggauacauuaaaagcacauuaacacuucuagugucacuugcccagagugaaggucccuggcuaucaacauuugcagggucccuccagaaaugccccagcugcugccaggacagcggcagggaggacuuacugagauggcagacugaagugacaaagggugaccugguuagucauuugguuuguucuggaagaaguuuguaaaggaccacccuccuccauuagauuuaggagagucuucgucuuuaggaggaaucaagaauugccuggaauugauggagcacggacuuccaaaagagacaacuucguuguugcugucuguggaccucggggaaucuggagagaccaaauuccaaguguuuacauuggccugaggucuguaaccggcggucuuacccucuucaucuucugcugcugugucuuccacagcggggcugaugggaaggcgcaucuguggcuuauagccugccaccaccacaggauccacguccugcucuuccucugcuuuggcuugcggcugauacauggacugcacaucgauguacacgaccugggaagccccucccacuucaucggccgcgggguucguuauuuccuccucgaugaugggugggcaguaagacacgaccacaugguucucaggguccaccucagaucuuuccccaggacgcucagcaacuggggaaauuauuucuguaucuucuauuuuagggacuaucgaccgagauuccaggacuucaacguuguucgggguacagggguucauuuccaaugucuuaagagcauugcuucccuggaaauaaauuugguacagugguuaagacggcagcguugcacgcuccuguggggccccucauauuuuuuuuccacaucuguuuauaaaccuuugccucggcagcucuagaguucacauccagagcgaagcuacuuuuuucccccccuccuugucaauauuuuucuugcuauuaauagcagcagaagaagcacggugugaacgcugaagacgaagaccucuggacaucagacagaguuagacaugcauguucuguucuccacggggacagccacaccucccaagcuucucacaacagacagaggaaagggccccauguccccaaagacaaccacggagaaggacggauuaccucgcagacgcucuucugaaacuguagcgccuuacaguuuucuggauugggaauaucuggguagaauguuuccuuaauccuucaaauaaagaaugaauuugauuuaauuaccaucacgcagugaucguguaacaaaauguaggcaccagccagcuuggcuugaggcuuucuugugacaaugucaaugagcaccugagacacaaauagaagcucuuuacgccagagcugcagacacagggcuuuggcgugaacgcugugaaccaccacucuaugcucuagcuagaaggccuuauuuggcucaaggaaaugaaagcaaauaacuuacagugacggcugccaucaugucucacaugaaguagagccaaguuuucaccacgaaccggauuaagcagggucaaaagggccggugagcacaugcaguacucuggucaucacaggggucuggcccgcacaagggacacuuccagugcauggaagugcucgaccaagguugguaagugcacaggcauugacauuaaagcaaucaauucuauuuucauuugugugugcgugugugugcacgcgcaugcaugugcaugcauguauguguguuagagcaugcacuuuuguucauuuuucuuuagagguagagacuugcuaugguagcccaggcugcccuuaaacuuauggcacucacucucccugccucagcccccaagugcuggaacugcagccaugagucaucauaucagguuaaauaauaacaaaaaguauuagaguuugcagccaugaauggcagggaaacggccugcugagcugaaggggggauugagcuaagcuacaaucuuagguagaaacucaacaucagaggaaagauuuguucaacacucuguauuuuuauacucagaaguacuaaggacacuauuguuugggauuccucaaggacggugacuguguuaacaugagucugaauguuccagguucugggccucuuuuuuucuucguguacugaaaugauuguuuuaaaguuggaauuaguugccgaaauagguuauucuauuuguguauuacuccuuucauuuggaagccaggaaucuucaaaacugucacuaacgauggcauuuuaaagaaaguggagcccuuucugugaugacugcagccaguuuguccuguccuagucaggacaguuccuggcagucaccccagagcccacugcucuccuaugaaccccuaaccccacucacaccucuccccccccccucacuuugcccaauuauacagugccuccaguuucagagucuaccugaaaccacucucucuagaacguucucuacccgaagcccuguuacccuccagggcucuccccagggcagccuuccugcuuccucuuccuucccuguaagcauguuuaugcuucccuggcaugcccucucucucucucucucucucucucucgcucucucucucuggcucgcucgcucuugcucucgcucugcugggagacucccaaggaccaggcuugcuuuauucacaacuauaaccucuuucucacggaaggagcauucauaagaaauaaacauaugaacaaaaaaaccaggucuaauaggccauuaggacccaucuagaucauuaacuuggauauaaacuugcagauagccauggucaauuuaucuuugaaggggugugggguggggagagguagaggugugaguguggcuagggguucauaggagagcagugggcucuggggugacugccaggaacuguccuggcuaggacaggacaaaauggcugcagucaucacagaaagggcuccacuuucuuuaaaaugccauuuacugggauaaauuauuaguaaagacaguagggagaaugacggcuuuuacucuuugaguucuuaaauauuuucaauaaaauguuauuucuuacuugauauugaaagucaaccuucuaaguuaaaaaaaaaaaauguccgacaugcauaacaugacugcacaaugaggcuuguaaaaacaagagggugaauacacacacaggaaccauuaccauucucgcuuccgauagcaaaggaugcucguuaccacgccaacaaugacagccacagccacugggaugaggauggcaauaaucaaucccacagcugaaaagaaacaguuaucaacauugaaaaucaccaccggauguauggaguccacaagacauuuauuaucugaagagacaaaacucuaacugaucuagggccaccaacacuggaguaugauuacucaauccugccacuggugacauauaggcaagcucucucuggugugaggaggggcagggagggcugcccugugcgcucugguguggaggcuuagccacauccgguuucuaaccaugagaugccagcagcacuccaguuaugacagucaggaacaucaccagacauugccaaguugucuucgauggggcagcaucacguccaguugcaacacuguuuuaaugccucacggccucuuggcccugugcuccagaccuggacaaggacuccauucugguggaggggaagcccgaagccaaacugaagcuuucucccggugaaggacagcaaaggcuaccacccuugucuacugccaucucagacuuaacaaguguggucuuacugaagguuagagagcgacugucucuuacgcaauucccuagaccuauuaaaaucaaacuaguguggaaaauauuuaaacugcauuaaaaaaaaucccaacuaugcauuuaggguuguagauuuggggugcaucccuaaauugauuaauuucuuacauacuuauagggaaauaauugacagcaaaaacaaaaaaaguucucucauagccuuugacaguccgcucuuccugacauaaaaaagcaaugaacugugaaaccuuacaacagugguccgcaaccugcggccugcggccuaucuggccaacuucuaucucccaaaauauuaacguuacaauucauaacaguagcaacauuacaguuaugaaguagcaaugaaaaggauuuugugguugggggaucaccacaacaugaggaccuguauuaaaggggugcaucacugggaagguugagaaucacgggccuggagcuuggaacaaagauguccccagaugcuaaggacacuaucgcuccaguggcaaagguguuucuagggccguguugaacuuacaguuuuccuuggucaccacaaacaugcucuucucugggcccagaccaccauguguauaggcucgcaggaccagaugguaacugguuuuacccugaaggucagcaauccucagugucuucugggauaugucagugauguucuuuagcuugaugucagaaugaucuaaagcaaaggauaaucucacucacccugaggucacuuuaaacucggggaugagacccugagggagaacaccuugcugcugcccacgcccaaccaaagcuccggggccacauucaaguucuucccccaccagucaaaccaucuaacuacucccaacucuggcuucucugacucuguaggggauguggcauccuguaaaauuuucauguacauuuguuagaacaaugccuggcauacagcaggcacuccauaaaaaucacuucccugucugugacuaagggaaaacucugauacuccucccugcccaagguauuuaaccucaggcccacccugagaaggggguaugguuucacucauccacuuucagccaugacaauaaacgucuuaaaaccguggacugccucuuuccaucaggauccgcuguggggagacacggugauggccuucaccuauggagccucugucuaaucucccgcagaaggccucucugcacuccuagccauggucaccuccaagccaccgccaagccaagcccaggucuuccacggcucccagcggcaccugggugucagagagacugggaaccugguggcuccagacuccuugcaggcccagggaccccagagccagcucuggauguccuacaccucauacucugcuuacccagccccagagcggugaccucggauuggcuuccccauggccacccaggugacagcauaggguaaguguggucaacuccugcaucauccugccucccagaguguccugggacccauuaacccuacaguuugccaccauuuugauuccagaucauaacuggggcucugaacccauuuuuugccucuuugguuauuagauauaaaaccacauuaaaaaauaaauaauaucauauggugugguucauguaacacuaguaagaaguggccaccauucuguggggcuuauaaagauucuaacuaaauaagcgauuuugacuuugaaagaauuuacguucuauuuauuguauucucugagauaguucuggaaacugugcucagcugugcagcagccccucugcucuuauguggccaguggaagucugucugucugucuuuacacagcacuagaacccaggcggucauuuacucacguggcuccaagcuccucgucuugggcguaucucucucuccuuucugaaaguaaaauaaauacccucuuaggaagccucggagcucuuccacggggaugucgucccauuucacuaauaucgagucugccgacguaucuuccacggugaaauuuggcgcgacaaugggagcugucaaaacaagcagucaagggcugaagggcaggggagugagugcucccgagacuucuggcuuuagaaacaccuaaucuuggaauuaagcugugcuuuuuacucaagcaugaauuccucugaugauugaacaacucuacgcuaauaaccaggcggagcucagggaggaaucacagccuuuacacagacaggcauccaggggauaaccugugccgcauguaugguuuuuuaaaaagauuuauuuauuuauuuuauacauaugaguaugccaccauugcucucuucagacacaccagaagagggcaccagaccccauuacagaugguugugagucaccaugugguugcugggaauugaacucaggaccucuggaagagcagucggugccaucucuccagccccccaugugccgcauauuuuaagugaccgcucaaacagacuucagggauacuccccucucugguguuaggccuggauacauuuccaaguuuuuaagcuucuguaaacacaaaucaaguacgacagccaugauauaacuuccucagugucaagacugaaacugugaaaucaacaagcagguggagacaagugacuaacaauuuugauaaauuugugauaggaauuauuuuaucuucuuugaucuaaccaacuaaauucgguauguucuagagcgugaccccugcuacuugccuauuuacacggucuuguguuagccaaacuuuaagagaacucagacauuuaacuuacccaguucuucuacguauccaauuauggaacguaacaguugguaucccugguuagugcacccauagagguaaaaguuguaucuuacuccuggcugaaacugaucuguaggauaaacaaaucaguggacuuucaucagucuauguggguaaagcaagaacauuuaucuuagaagcauaaaauuuauaacaugcuaaaauuuccaaagcuagcuacagaucuauuauaaaaauauauuguuuuuuuuuuucaaauuuggcaaacauuuaggaguacucagcaaaccacgaacaucuucacgucuauaguaaugaaaagaucacaggaugacguuucuuugaagagacaaagguagcugaggcugacaucuuauuccuacuucccaggcaccaccguguggucagcacggucauggugcuuucgcucaucuaugugccaucauuuuggggauggacagaaacgcauguuuccccuagucccagcacuagaaacccugcucagcucaaagcuuugggacacaggaaccaggccuucaucgcuugcuucccuuuauaauguacacugagugacggacacacaagacgugucucaaguuuuuuuuaauuacuuuuuuagguuagcacacaaaguagugaguuuuaucauagcaucuccauauggauguccuuacucuccaguccuuuaccacccccuuccuugugugccccccauauccccacuucuagaugauucucuuucuucaauuccuaaagcaccuuuuaaugucucaucaaaucuguaagacaagacuugagaaacaaggaaacacacgaagagcccuucucaucccggagaagcuggccaagccugggggaagacacggggcgagggcagccaugggucucggguaguaagcaccggauacaaagagaaguacugaucaguucuaagauuggaaagagcuccuccaagugcucucuaagaggacggaggaggagaaagcaggaggaggcaaggccuucgugaggcccuaacagugcagcaggcaucuguuucuggaugggacauauuccuguguggcuaauacagugcuucuuuaagccacacgcccaaagaacaccugaaccccagaggcccaagugagauagauggucagccucagaagucuaaaggaaacccgagcuucugucgcuagcuaacuuuucucccuacacuauuuuuucuaaaguguucacucagugcuuccagguacuaaguaaauacugaugguaaguccaacucagcuaagugcauucaauuuugugccuuccuucccugggggggcuggggaggggagauauacucgaggcuaugguuuuauauugcaugugaacccauaccuuguuuuauguuaaaauuacagauuaucaauauugaaucgaguaugucacaaaggggccugcugggugaugcagagagaacggagggcugaaggagaggaagacugcaucgagagaugaacaagggaagggaucagcacagaagcucagcagggaauaccaagauccccagcuuucccaggccccgaguagcguucaauucuggcaccacugccuccuaacucugugaccuuucccaaguccucugugucuuuguuuuucucagcuaccacagagagccugcucacgcacaguggcagcuauuacagcagcuucuccccuuccugagggaucucagucacaacuuguucucccagaaacacugccugugucgcccuguccaagggcacccuacuuguucugcaagcccaagugggagagaccacaggcucagccaaaucagucccacaggaaaggacuugagaguaggcguagggaagagaaagauggaggugaccagaggagaaagggggcaagagaggaccgccaccaccuuagucaacugcagaagugcucuuacagagggaaagauagcugagcccaucgugguuaaucgccaagugcaauccuucacccuuuaacagcagaaacagcaaaugaccagaaccugucuuagcgagggaagccacugagggcccuuuacccuccagcuugcuucaccaacacagaaggaagaccuaguagcugaugucucuagaaguaucgugaccuacaggcccacuacuggcucaagaaaaaccccaaaggcguaggcucacacugauucuguagaaggcauggcggcccugcagggagggaagcagccacuuccaaaggagaaacacgguugcucugaggauccaaaccucacugggugccacaugggucaggcugcaccgucaaugguggcucacuugcuaaggcucacaggcucacgggcagaccugugcucgaucgcaaagcugaagacaucccaugcccacuuccauugaguuucccugguccucauauuagggaacuguuggugguggcuuugaggccucaaggacccaaguccuggacacacuaaugcgagagggcauugacugcacugacuugguuguacagaagugcguucccaaacugugucaucuuugacucccauugaagccuauuuuaucaaaaugccaccacuuauacauucccuagcauuucagagcccgguguguggaaacacaccuuucauuucugcagaagaagcagacagaucucugaguuugaggaccuaucucaacaaaaacccuacacucagauacaaaucuaugcugcucucucugaugaucuaucagaguagaugaccacacagagaggaagucaccucuguguggcuuuucaaaagccccuuaaaggccucagagagccacggauucuuaccagacucuaugacagucuccgugcuguuugaaggaaccuuucuccaguccaggaggcagggcucagaccgagaugaguugcaccauuuaauuacguagucacaagucauguuggggucgugacgccaggugaggaagauccuguuuccuagccccaccgcuugcucuacugugaugucgucuucagcaagaaaagaaagauauuuuauugacagucaaagcaauaccagaaggcaagccucaagaaaaugggcaguaguuacugaaguuauuucgcuguacacaaacuuuaaaacagugguuaaacuagguagcaauguuuagcaaagaaauaauacucucuuauuggaauaacuauagcaucuaccuuuauucagaagcugaggagaaaauauagacgcuucuagaaucugguagacacauaguaggaucuagacugguucuggaguguucagcauagcuauguggaggaagaaccaggggacaacuaacucuugcucuccccauccaaggugagcagagcuccugagagagggagaggcagagcacaugcagauggagcauccaaaacugaagagcugagcaucuccuuuccaggaccccugcauccagcgcccaaaugcugggggagugaggggaaugcagaagggcugacaaggccaugccaugaggugaggugagcagugugggcagaggcauuucccagacaccaugagauacugggguggaggugcacccccuggggagugagaauaggcacugcuuggcugugggagguuugcuugucuguucugcuggaccugggccugacagauaggugaggaugcaggugaggcauggggaccagaguggaggacagcccagcauggccaaggaagacaagggcagucucccauggggacaggagagaagaaugacuucuucaauuaauuuauacuuaaggguuugguuuaaaagaaaaaaaaagccauauaucggaaagauuucuaaauaaaugcauguucauaacgcagcccuccugaacacaaucugagcaccuguuggacguaagacagcucuuuuggcucaaugugauuacaaagccauaaucuaaccuugagcuggggcuguggagccucugacucugggcucgggugcaacuguggagcugaaaccacaguuucagcugugacucuccuucccaagggccacugggagcagcgaccaucagugugcuccaguuaaacagaaaacaaaagagcugcagucugcagaagcacuggguacaaaugagggccacuggacaggcgcccggccuugaccccugcuucucugcacggccacacaucugggcguauccagucuuugaaacaacccugcuacauuccugcuucuuaguucucuguggucacugccuaggacugacaaaccaggucaguaccaagaaauaagaaaccaccucaacacaacacuaagagacacucaagagaccuaacaagacuuuuccuuucuuguaaaaaguucuuuccauacuaaggaagcaacuggaagaggagcacaaaauggccauuuaaacuccugauucagcacaaaauccagcuacgagagaagaggaaagacuaagcaguuggggguggggguaaaagaaggccaucugaggauaaagaugaucaaguguguuauauaugucuguguaaaacuauccaguucaaaugcacuaguuuguguaaugaauauagacuaauaacguccauguaaaagccaagaaggaaugugguuugucauuggcuggcaaccugcacaauuuagagaaaaacacaaaaauuguaaaaucaugucauaaggauuuuuguuuuucaaaacccuuauuagccgggcguggugguaauuccagcacuuggggggggggggcuggggguggagaggcaggcagauuucugaguucaaggccacccuggucuacaaagugaguucaggacagccagggcuacacagagaaacccugucucaaaaaaccaaaaaccaaaaaaacaaacaaacaaaacaaacaaacaaaaaaaaacgaaaacaaaaacaaaucaaaacccuuauuaaagaucuaauuuagcuuugagaaacgggucuuuuuaaaugaagaauuucuacgcuggguuuggaggcuggaaaaucaggaguucaaggucauuccuagccacguggcaaccuggacuauauagaccuucucuaaaaacaaccacaacaacaaaacccaaacaacauacacggggggggggggggggggggcaaucaauucaccacaaagcugccaauugaaacaggugucuucuuucccuguccuacaggguacaaaacuagaugacaaccgaaacgcuuacuuuuauuuauuuauuuauuuaauuuuuuuuuguuuuuguuuuucgagacaggguuucucuguauagcccuggcuguccuggaacucacucuguagaccaggcuggccuugaacucagaaauccaccugccucugccuccggagugcugggauuaaaggcgugcaccaccacuacccacuaaaacucuuacucuuaaaaagaaacuuuuagucuucggacaaacauuuaaacauuucuuccuaagaguaccguccacacccagaacuuuucauacucugcgacaaagaaauugaauauaguaauuauuaccuacuacacacuguagauuuccugucaauccugaggacaucugggaggcugaggcagaagacugccuguucaaguacagccugguuaucuaguguauucgaggcuacccugaaucacauagcaaaaucuugucucaagacaaaauaaaaauuaaugcuagcugcaucucucauugggcagcagacauucaaguacuggguccucuauuugcauaacauguaaauauauguauagcaugcaaauucuaugcacagcaugcaaauagcacaggaggggcaggauacuccucccaucaggaaagcugauaccacaggguuuccaucccaccccacaucccccaugccacccaagcacuuaccauuugggauuuccauacuagcuauuuucgaagguggugaugagccagcagaauuucuugccaccacacugaugauguagucauuuuuacuaagcuguaucucugcucuguguugaggaucgaagaucuccaaaacugacugugucuccucguucaaugaacacgaaacauuguaggaaaguauuuuuccauuagcuucauuaauagguaaaggcuaggaaaacagagaagcaaauucugucacuaaaaccagagaaaaguucugaggucuaaggcuaagcucgcaauaaauggugacaguagaauaugaauccauuagucaugugaaacucauauuuuaaaauccuggggcaagucuaaacaaaaauggaauaaaauacugaaaaagaacugcacuuguggcuaaguauugaaaguacacagaaauuuaaacauuaauagaaaacaauguuuauuuuuauaguuccagaagcaaaaauguaagcacguggccugaaggaaacgaagcaguguggugugggguucuugcauagguauucuuccccccccccaacccccacacaccaugcgaccguuacaggaacacuaggaaauauacaaaaauucaaagaagggcuggcaagauggcucaguggguaaggugcuugcuggccagccugaagaucuaaguccaaccccuaggccccaccagguaaaagacccaauuccuguaagucuuccucugaacacuauauacacaacuuccgggaccagaguaaaagguucagagccaaggccaggccgucccagugccuggggaagcgggagugaugagagacaugaggcugggagauggcaaacguagccaggcugggaagccuuggcucccugaacacauuucucuggugcuguauuucguauaucauuuaucaguacagcugaauacuacauaagcaaguaaaauuugaaauauucaccaaaucuaagucaccguccauacaucgcaugcuugggcaaaauaaaaaucuuuaagcauccaagggaacaauagauauuuaccuuccaguagacgauuagauuuuuuccaucagaacuccacucucuccaagugucuggucccuuugaaggagcugggaaagagauuccuaaguuagacuuugaagaugcaaacugugaggcaagggacaguaucggugacuaaaacggaggcgcuugacacuuuacuccaggguaucuggaaugccccauaaaagguggcuuccauuuagaaaauccuucaacagagaaauucuaaagugagacagccucugagugucuacagaguacacgggcccagaaaacaggguaagagagaugacccucaaggccaugcaaguguuccucccugucaacccucccaucuccccauuacugaucagcccuagcaucaccccacucacuggcuucugugguuagaugucgcuucucaucacuccaccugcuccacuuccagaaagucuuggaagaacaacgaacccggaaaguguaugcaguguauggauuuaauuugucuacagcaacaugguaaguugaauccucggcuccucugauuguggcauuccucuauuugaaaacaaguaaauauacauggguaauuauguaugaauauggaauacggccauacacguuauagauagggggggguauaaaaccauucuacgcuuguaacauaaaccaaauggaugucauacuaguuugcgauugcaacaacagaguucauaguuuuuaguucuugaugaaauacggcauuaagagaauuaugcuccauagugagugggaaugaguacaagaccgcucuuagguaugauuaaggagaaggguuuuuuauugcagcuaugagggagagaauagcuagaggcaucuagaagaguccagacugaacauggucagcagaauagaccgggccauggaggggguguggguggagcaagacacugagaagagacugagacugggagcaaagagagcagaagucugucgccaagauagcuacgcaggaauuggagaagcugggggaagggaagggaagcuggggguguguaugccauccaggaagacucuaacagguacuuggaguaagaucugagggaaccuggaggcuagcauaacccuugauaugcuaguaggcaccacaggcauaggcuaauggaagagcagccuccuccguccuuucuugccugccaucgggagaaugauuccaccgagcaagcacagacuaggaacuaucagacuugagucccugagagaaugcugguuuuauuuaaaugccagaccgcagaaaaaggauuuucuugggaccuaacacauaguagucaauuaaauauugggaugcauuuuauucugauuauuagaucuaaaugauuagggucaguuaaauuauacagauguuauuguuuauuauuauuauuauuauuauuauuauauaaucagugaauagcuagugaccauuaaacuuugacacaauuugguaauuagagacaagcuggaagaugaaguguguuauuucaaggacacugggaaccaucccgggggcaaguguccugguuuacgaauguaucaccuagagccucuauuauguacugaacauguaguaaauagacaaaaaaaauuuuaauuaauauaaaugaaguuaaaaugaagcaguuuuacacaagucugaggaugaaugugccagcaaagucugggcugcuccuuacaaaguggcuuuucaggucaagcugugcacucccugcugaaugcuuugacagaaaccagcgaguuuccaaauuagcauucggcuacggugccauuuacuucaggguuaccacaaauuacagaaggguacaguauaagucaaucuaauuauuuaaaauauaugaaaaaguccaguuuugacuuauaauuaccaauuucaacuugcuucuacugaugcgcuuaauaauguaaaauucccuucuacuucccugugcccacuagucaaaggcuacaguaaaagauacuuuuucacucacaaacuuaaugagcacuaccuacacggagcuguugcacagagcagcaaaaguugaacuuauacucuuuacuguccaguaacaaaugugcaaauguaaauuaaaaugcuaccauuucuuuggauuauaagguuuuucuuggcuuggugauucucuguaauaaauguuuguagaguuuaugugugugugaguguguguguguguguguguguguauacacacauuugcuuaaauauuuuugagauuggguuuuuuuauucagaauaaccaaaaaaaaaaagcuaugggagaauuuuacuuaccacuucuuucuuggaauuagcuuuacaaauuucaauuugacauaaaagauuaaucuuuguaaaauuuccugguaaauaccaagaaaauguaacaacuguugaauugauguccuucacuuucaacgaagucggaucaugaggagcaacuguaaauagaauuauaaagauucaugccuuuaaacguuuaaguguggaaaaggucucuccuaguaagauaaacuagaagcaaaguagauguguauacaguaggggcaggggaggggggaacaaggagguguuauuacugccaaagccaagacagucugggcggaacccauggaccuguuuguuacuggugaugucaucccaauggccuuagagaagcaaugugcucgacguucuuuaccugguauugaggaugcuaacuggugggaagauaaagguaccuuuaagagauuuguguguacagcuggaaugacagauacagaguaacugacagccacguguacuagggguguguguguauguguuugugugugugugugugugugugugugugugugugugugcacucgcacauuuuaaugaagcugacugcuacaggaauucaguguggcucaggagggggagucuuacaauggcugcagacucugagguucaagggaaaagccguauacauaggacaggagggaaagacucagggcagacaaacacaagcaaaaccuucagcucuagugucaccuucugacucucagaugaaacagaaaugagcauggcaggauggagugacagauaacaaggaggggcuggagauggcucagagcacuucaugucaguucccagcacccacacgaggcagcucacagccacuuguaacucagcuacagggguucugacccccuucuucuggccucugcagguaccaacauaaguggcacacuuagcacaugcauacccacagaaauaauauaaaagaaaaauuauuuuuauaaagugacaaaagaguaaucauauugagccgggugugguggcacaugccuuuaaucccagcacucgggaggcagaggcagacggauuucugaguucaaggccaggcugguggucuauagagugaguucuaggacacccagggcuacacagagaaacccugucucaaaaaacaaacaaacaaacaaaacaaaacaaaaccaaaaaaaaaaaaaguaaucauauuggugacaaaccccuugcuuguaccaaugucuuccaugagucucugugaggucucaggaggaggcagagccuagcauggaguuaguacacugggcugauggagagacaaccacaaaaaaagcuacauguguccuacuucuauucugaguugccuuacauauuggcaaaaagaaaacaaaaaaaccucagagcucacuggcacacaaagagaugaacaauuaauaguguacaauuuagaugucccucaaggauauuauccuaagaaaugccagccuugaaugcuuauacugugugguuucacuauacuauagcccugggggugcagggcagguggcuggugcaaucugacagagagagacagagacagugaugggauucaucuuaacugugaccgccaucacaguuaaguuauacuccgcuccaccagcaccauggagcucccccaccccgucaucacuucuguguguuuagacacacauccuagugagugcacgccacaugcagccggcaaucccucuggugaacaauaugcaccagggucaccgcucugguuugggggucguugcugaggaaagacagucggauucaugcacuugugacucacuauuuuugcaaugacuucugagucaaaaaaguauuuuaaaauaaauguuuucaagaacuuggcaaaaaaaaaaaaaaaaaguucagaauucaagaaugaguaaacaaagccauauauaguuuugaucuaaaugagucaaauuuuuaucucaacugaaaaaaaggucagauuuaaaauuauuuacuuuaauucuuacaauaaaaauuauaaaugaauauauuaauuaauuaauauaaaauugagaaaaccucuaaagaaaauaaacaguaaacacuaauccgugcagucaccuuuuaggaguuauuuuuauugugguuauuuauagacacugccugguaacaguggcucaccucucucagucacauugaugaccacugcugacugugccugccccaguggauugcgaccagucagggugaaguuauggauuucuuggccgggaugcauuugcacgccuaaccgguaggucucguuuguaaguccuucaauccugugaaauacugccgauuuuccugaaaugcugucaguuaaaaagaaaaacaauuucaagacuguaagauguaaguaguugggggaacaagagcagauuucuacuggccuuuauaaaaagucuguuuuuuaaauuaaagacugaucacagguucauaaaaccaugugugauauagaaaacagccaagcauaaacaaaccacaucagaggcacuuccuuuuaggcaucugagagagaaggccugaaagugcagcugcaugcaggucaacugcagcuauuacaguauauaagguaccaauacagcaaugugccaggacacugcccugugccacaguacauccgugacaaugguggcaaugugccaagacacuccugugucacucaacagguccuuccagacuuuuugccaccagcacucuuuccugguugacauuaccuuucaaacaggguguauucuguauuucgugggcccaccaguccaguuauccuuccuggauuccagcuacauauaaucucuuuuaagucaugugucucacagcucagcuucugaggaacaucgggaggaucuaacaggaagaagaaagacaaagggguuacacaugucuuccuccaaucuacaguuuuacgguuuuguuaagugggauuuuugcauaauucccuaaaaacaauuggcuguuuacacauuuccauuuuggauagggcagaaaucaucacugcuucagcaagauguguuguuauaauuuguauugcauucaaaacaguuuauuaagggacucugaggaguuacucucaacccagcuccuaugcaaacucccaacagcaaauggagaaaugaacuaaauugcuuuuccuuaaccuugacuucaaagucuucuaagucaagcccugggaauguacagugugaaacggcuaccauaucccaucuauucacacacuguggcugagaaggauguaucaggaugcuaaaagccacagccgcugcucacaggaaccauucgcccuggcuuuacuuuggggcagagaacaaagaaaaaggucacuucuggggaggaaggugcaaaaacuuucaagugguaucuaaaaccauuauagucuggcgcuugauuaaacaagauacguuugcauagccaaucagcuacagauacagauccauccuaaagugguauuuaugcaaguauuuuucauuuuucuauuaaaguuaaaaacaagaaucugccugguaaaauauucuguagaaauaauacucuuuuugaaggagcugaauuuuucaacuaguagguagaugucaaccaaaacacaaauuuuucuauauucucccaagagauccccguaacgguuuccuuaguuuaacauucuuuguuuauuaauauugguugugugcacggcacguggggcaugugugucauggagcacgugcggcggccagaggacaauuaagugggggcucgcucucucuccugcugccucucuccuucugucuuuaugggagugaguuccaaggaccacacucaggccaugggacugcgcagcaagugucuuacucacugacgucucccaggcuccucugcuagcauuuuagcugacaccgaggauggcgagggaauguuuggcagucuugcuauuggacaauuaauuaaacauugauacgcuuauuuugaaaguuauuuuaaaacucaagacaaaauuaucuaccacucuuaugacaugcuggaacuuagaauaauuuacagugaugauaacuuuaggguauagaauauacacauucgucuauucaaaguccaaauaauaagaaugaauuaaaaagaaacaggagugugacaagagaaaaggaaacgagaggagaauguucaaaauguaccgauucccuuugcaaagaaauuaacuuagaaaagaauucaauugaaauuggguaaaucuugauucagaucauuuuuuuaauauaccagugaacguaacauguaauuuuuuuaaaaagccauuaaguaguaccauggcgacacauagguuuaauucuacaccgucuagcagaggaaaacugauuucuaugaguuugaggccagccuggacuaccuaggaauuccaggccaaccagagcuacggagugagaccaugucuccaaaacccccaaacauaaccaaacugacaucagagaacagcaagcugcuaagacuaaacucaaccaaagacauaggagaucguguacugccacaauagucuacuaagcggguugucguugucauguuguaagaaugagagucuuccauugaucuacauuugagucugaauguguucagaggaguaaacaauuuuaaagguuuuuuuuuaauaaauggagaauuaacaguauaccuuuaagggagcaaaacagaacaacaacaaaaacaaaacaagacaagacagcaaacuugaucuggacuuuauacuagaaccuguccuggaaguuucugacucaguuugccuggugggaaaggcuacugcugcaccgcccugagcugaugaacaccgagccauauuccaagcuuccgcuguugcacacaaagguugaagcaagacuuuaaagguucuacuccagugccaugcaugauaaaauauuaaaaugcugucugaaaucacagcgauggaaaccaugugucuauagugcauacccucaauuuuuaacuuuucuguuguugggagauggcgucuaauguagaccaggugggucugggaguggcugaggaggagggugagcuugaaguccugagccuccugcuuguacugaggaguggcuagggauguauuacaggccugugugccugccacuaccuaacccauuugggcaguccugggaaaugaccccaaggccagugcuuuccccacugaguuacuucagaacaccauauccucauuuuuuaaaacauuuuugcuuuuucacaugugugugugugcgugugugugauguauuaaagcuuuauuaguucuuguuuuuauguguaccagcgcuuugaauauaugcugcgugugugccuggugccggcaggugccagaagaggaccucagauccccaggagccugaguuacggaagguugugagccaccacaugggugccgggaagggagcugagcccucuggaagagcugcaaguauucuggaucccugacacacacacacacacacacacacacacacacacacacacacagcccuccuuuuacauuuguuuccucuggagugacuucacuacguucccacugccucucauuuuaggcuccggcucauuuggaaaacgguuacaaagaguguccccacaucccaugaggaagaaaaggcgauuugaaaaacuuaagugugaaccuaagcugacugugccuuggguuccaaaagcugccgagacaaaaggaggaucaacccaacagccacccgacucucucagguccuagugauaucccggcaauuauuagcugucauaaagggauaaacuccuuaaaacagaagaaacaucacaacauccacuccaacugucccacacaccuuuauucaugagucccagagagcaaacucagaaccuagaaauucucauuuugggacacaagggcaucccgguugcagguagccccacaggggaggaaggagaaaguucaaugucaaaacugagaguccuaaaaccagaaucaucuagggauacucugcacaagcuccgugggaggagcagcccaaucccacaaguucuagacugguuuuaggauacaggagugggcggggacccacauuacaggcagaaugcaugaagauuaagacuccucacccuagucuuucgcuguccucaaauaagcuacuuauaaaccggauacucaguacaguaugcaguauuuaagccuggcuaauuaaggauuuacuuuagugaaacagaaaacaaauguguaugaaaucauuccuaauucugaagugaagaauuuaagcuaaacccuaguugcucgaugucucaaccucaucaaccuuauuaugagacuuagaacugggacaggauuaggugugaaagaaguaagucccgccucuagaguguguguauuaaacaagaaaauaaggaaaaaagagaaucagcucacaggaaagacauuaaggucggaaacggaccaaucccggcugagaggaacuauuugacacgauacacuuacagccugcaaagaccaccguuccguacacaucgucgucugugaugaaaaugauguuugugccacuguuuucagaaacggggauguucaggauauggaucgcaacgguuugcccguacagauggaugagaggacgaaggguauugccgaucuguccugaaagcacuuucguuggacucauacaacaaauugucauguuugagccugcgagcaccacuuugucuugaggaaaaacauuagucucuguauuacgaaucccuagaaaaaaacaggaggagucacaaacccuucagacaucuuuuacucacaccugucuccucaggacauccuuucugucuccuggaaugauuuuuauuucauuuauuuacuuauuucuucuuguauuuauuuuuguaugugugugugaugugugaacaugcuugcguauguguauggagacuaaaggcugacauggggugucuuucucaaugucacuccacucuauguuuugagauaggggcucucccugaaccuggaucucacuaauuuagcuagaccagacagaaguagaagcucugaucucuacccacccucagagacuuagggcugucgauguuacgauacccagcuuugagggagaugcuggggaucaaucuuggggccacagaacugccugaguggagggcacuuuuccaacagagugccucaauucuguuaucuugaaacaaggcauuauucuguaacccagaauggcuuguauuucaccauggagccaaggcuggccuaaagcucgcaguaauccuccugccccugcuccaugcugggauuacaggcauaaaccaccacauucgagagcuuaaaacaguucaacauuuacaaagcaaacuguagauguugugaaauaaugcagcccccagugcaaggcaccacacucggguuucaaaggaguacgacacaaauacaaagugaaacuguagccuuauuuacuuaggcagggacagaaccugaucacaggccguuuguugaaggucacagguuaauuuuuaaggguuuauauacacaugcagaagaugcacacagaaucacucgauaauuucagaaguuucacguugauucuuuugaaacucuccuauguucuucagcaaacaaguggggaagcccuccacacucuaacucacagcugcugcuuuaaucaaugcccuugcaggucaaggucacgcaccccagcuccacuccuaacagcugguguuuacacagugaccucuggugcccuuuaucccucacucuucccugacaucuggcuucuaaguucaccguucuacugaagggacucaccggccccauguuugauccaagggccccuuccgauuuaucauccaaacaccuucaaacucccuccucucuuggguucuaccacacugaacuuucugggccacucuuaguccucaggcuagaccuuccuucaguagugcuguagacaggagcgcuuccgugcgucccaauucccuuucccgaagauacacuggccuucagaauuuaagcacuuccaaucacauacaccuuugugauucccagagggacauuccccagcuacgcccaugucucuggaugcccgaaugaccuuuucaaccucacugccuacagaucagaguauuaaagaugaaacuguccuuucccaaccaacugguuccuaucuuuuguaucucuguggacagccucucaccccuaccccucagccaaccaaagggacagacacuguugggagacacaagcaccugguccccaacucagauucugcugcucccgucccuuccugucugaacucagcuguccucgguuauauuuacagugucuugcucaacugccccagagucuccuuauuuauccagcugcuuccggccccccuuaucugauguugcuccacagacuguccaccuguaauaaacacuggaugguuucuggacuucauuuuacugacucugaugacccgggggccccugcucacucugccagaauuuuacaucucucuguuagaggaguuguacuuaauagacacaugauuuuucagcccagcuuucuagagcgggucucagauuucuuuaauccacaguucugggguggucacuuuggaagauagcuaccuggauucaaaaaaacacuaugggcauauaccaacccuuacucuuaagcaaucuagcccaugugaaccaagggucuguaagaguaagcuuacaggagauguucuucagcgggcuccagucacuccacucuuuguaaccggagaaaugaggcgagucaaugugccaucgaaugcucaccgagugaguggcacauugcaagggcaggucugagguccaguuccagugcugaacgguaucuuuaccacucagcauuguguugaguaacaccuaaaagcaaacacaaaauuaugcuuccaaauaaugcuaauguccugccuuucuccaggguaaagggacagaaaggccucacggaacauguuagaucagccaccggguggguaaugcuauaaaggaaaaugauccgcaccacuguacaacggucuguuucuacacaguguaacgaggaagugacaccaacacgaucauuaccuggcuaugugcccuugucagcauuugguccuaugggauugccuuccauccccuuacagggguugauacucaucaaagcagucaauaaaacaacgaagaggauacacugcuauagaaaugauuuccauacucucauggagaaaaaaaccaggggauccauaucuuaaagaaguaaagcaaagagaaggagcagacagaaagaaaacagagcaagggcagaugggaaacagggggucaggggggucaaagaaaucaaacaaugccagauuagacuauaaugagccacucgggguucagcaguauggaugaagcuauguccacacaauuaaggaacagaggauccccuucaaaaccccgguaaaacuuuccaauguguaagcugcaucuaguuaaacuagcaacccugcccaaggcacgcugugcccugcucccgacgcuggccucucacgcuuccagaaguaagagaggaagcuucuacuugccgccaucuucugggcgggagcaggcugguuaagcuucugauagguaaaguuagaaucucucagcaauuuaccacucugccauccaugccuauggaggagggucagccucaggaccacacacaaagguaaacagaaaaaaauaccuaauauaauggauucauuuggccuagagagaaauuaggauaagaagcuccguaaaaagaugagguugaagcuaauauuuggaauauuacucagcgcuaguucgacuacauuugaagaaguuaggaaacuuggaugggaacgaagagaggaagggagcggggaaccagagagcccgagacauaguggguuaggaaagaggaaagggcuuccaucuuccacugggcaguuaauaaaccccugaccgggaacucuaaaggaauagcagcaugggccugcugccuggggcauggagauggggacagcaggaaugaucuggaggaguuaaauguagcugcaauccuagcccugggaaggccggccggaguggugcugcacgcuacagugaggcccugucuccauacacaaaugcaagcuuguuuccaaacagagacaagugggaagggguguguguguguguguguguguguguguguguguguaugcauguaugagugcacacuucagggcagcucaggggcucccugugucuaccuucagcucuguggaacauuucccauggcugugcacggucugcaucuuacaugaaacaccacugccuagcauccgucuugucccaguguccacauggccccuguccaacuuuccauaccugcuccucacgucuuagagcuaguggaaagcaaguguaaauuacagaaacccaaggggcuacuuacuuaguggggagagggagagaaguacuguauggaacaaugucauuucagacugcuaaauuaaagauuacuggcuucucuauuauuauuuuauuauuauuguuguuguuguuauuguuaaacuuguuugaaauauucauuugaugucaguaauggacaaaaaaaguuacagauugaauaaaauaaacccaaaauaaacuuuuuuauuguaagagcaugcuuaaaugaaagacugggcauuuacuauauccaagggggagaaucagggaauagcuuuccccuuaauuucuuaaacuuaugaauuaguauaacaugagugauuuuuguauuauugcuaauuuuucugucauugucuggggggggggggcagcacaugccacagugcgacagaggucagaagagaacucucagaacucuguucucuccucccaccagggcuccaggaucaaacucgggcagccaggcuuguguggcuaccccaucagccugagagugauuuuuaagucacauuauugggcucuuaaagaaccccuaaggauacacaaugcauuucuuugauaauccccaaacucauggaugcccccucaaaagcuuuaaaagcugcaagguuucguuauaucacagggaaauauauuuuugcucaaacuuacgagugcuacugguuccguccuuggauucuguagaaccuuaaucucccagguggcauuggaggggugaggcagagcagacccucugucguuccacuucaguaguaaggaggaggugaagaagucagcagacaaauccaggaucucgggagucucuggaauuaaagcuuaaaacagaaaagaaaggcgaagacauuuaguuaaauaauauauuuuucacaauguguuuuucaauuuaucaauaacuucuacacuccauaaauaaauaauguaauaauguggcaugauaauaaaccguugagaaaaccaugucacuggggaaaaaaaaaaaaaggaagagauggagguuuuuauuuguuuuuguuuuuguuuuuauuucugagacaggguuucucuguauagcccuggcuguccuggaacucacucuguagaccaggcuggccucgaacucagaaauccaccugccucugccucccaagugcugggauuaaaggcgugagccaccacugcccgacaagguuuuuauuuguacaggcagcuccaguuaauuaaagggacaaaccugagaaaacuaucagcuggcuguuucaaauaugugacacauuuccuacugcaggcagcaguggaguuuccacaauaccaggguuuccuagcuggggaccugaaaggaagcagccaacgagcuugcuugggugguggcagccugagccuaagaacacugacagcugggaaaagagcuuccgugcucucacagccgcucaugugucuuccaggagcagagccccucacauguggggacgccccccacuuacagaauucaaagagcugcuccaagcugugggugucauuaaacaacagagacuguucuaaugagucugguacugagcgccaaagccaauggcuaacuaacucugaaggccuacaaaggcuggccccgcagccggcacgcagcuucaguacaguauccaagaccaugaugcugagcagcagcaaguguccaauaguccaaauaagacagcguucagggagaagagaggagaguacagagaggaacgagggugugguccuuucgguuacuuugcuauugcuguguuaaaacaccguggcucagacaacucaaagaaggaagggcucgucuggccuuacagcuguggcucugacacugaauuauagaacauaaagaauaaaccuugcuugagaauucaggcaugcguggagggaaaagcuguaaccugagguagcaggacaggagaugcucaaguuugcucgucucccugcccacagcacacgaucaaagccucaugggaaagaaggcgcuugugugaccuugucaaugccaguggcacaaacagacauagacguuccugccagauucuuccuccaaugauaggcgugagaagguaaguuagagaaaaugcaaaggugugccuuuucuuuucuuucuucuagucacuucuuaugacguuccgggaccacuaaguaaagucaugguaagugagaaacugcaagaagaaauaaauguccagggguaggucagcugccugucaaacacaggcagaauaagccaucaccaccugacaguccugggaccuaaaaauaaacuuguaaaucauuugcugaacacggcguuuuauacuagauuuaauaguuauugcugcacaugaccuggaauguguggauuuaaagugugagcuacagaaccaagucaguuacaugucacugagcaugcgugcuucgcagagagcgacugcugacguggaagcugcaugugaaagcacugauaaucgagaagcacaaaguggaccuggugccaggagagagcugguccaggcgccagcacaaccaggacagagcuagcagcauccaaggcugugauucaugacaucaaagcacagugacuuacacaugaugccacaggcauccugcagcaaugcuaaccuguuagggaugcuucccuuauaccacuaucacuggggaccuuuugauaagccauauagagaccuacuucuauaggagcucucaaaaugcauacacauaugaauggaauuuaaaugaauggagucaccauauaaugggugagacaaugucccaacaggacauagugugccaagaaguaacacccccaaaugccaggaaauggguuauaucuuauuugagucauuggccaaagaagugccacaccaccaccaccaccugcaaauaucacagaugauugccaauucuacugguuauccuccauaacuuaaugguaaagcccuauuugcugaagacacaacuuccuaaugcaauugaacauggagaaauugagcuguacucaacuagaaccuccgcccugcccccccccccagcacauacgguacuugcacacuacuagagggagaaaguaaucauagauuuccaaauacaagcccagcaaccugccugcaguagacuggugcgacaguggaaugaauauaaccgacuauauucugauuggauuuuuaaggccuacccaaugagauggaacccuuaugugacaugcuagaguagccaagagcccgagacuaguaggucauggcccuagggaaaaccuacugcuacuauucuacuacuagaggaucauagcaguaagaugacucuaacgauauauugcuauacccauaggucagagcgcugccugaugcucaucagaagucuauucuugcgguauagacaguaauuaacacagagacccacaacuggacaaugugcagagggugagacaguuuagagcacucggucauuaaaugugcugucuccaucaaaccccuccucacgaggaucuauguaaaagaagagguggaaagaugguaagaaucgggggugguggccugacuugaagggaaggaaggaacacuguccuccagacacaaccugacugaggugaacacagaggccauggcagcaagcacaggaccugcacagguucaaaccagacaaaaucccagucauccugagaaggggaaguggacacaaagucccucccuaaacuccaaaaaaaaaaaaaaaagcuauuugcaauugaugcucgauaagaaaggggaaaucgguguccuccaguggagagucacugggcaaaucaagcaaagccgagggcaggcccaagccugggagcagccauccaaaacagaaaggacuccaagguuuugugugugcuuuuguucugguuuuuuuguuuguuuggguuuuuuuggguuuuuugguuuuguuuuuuuuuccuuugguuuuuuuguuguuuuuuuuuuuuuuuugucuugauuuucuuuuucuuuuuuuuuuuccagauuguuugauugauuguucacaugaauuugacuaaguagggaaguggggaucugggaggauuuaggggacagaaagaaugugaucaaaauacauugugugauuuucaucauaguauguauuuuguguguuuguuuguuuguuuuuguuuuuuucgagacaggguuucucuguguagcccuggcuguccuggaacucacucuguagaccaggccggccucgaacucagaaaucugccugccucugccucccaagugcuggaauuaaaggcgugcgccaccacacccggcuguaugcauuuuuaaauaaaacauacauauaucaaagaaaggaagaaagagaaagagagauugagagauagaaagauugaaagagagagagagagagagagagagagagagggaggaaggaaggaaggaaggaaggaaggaaggaaggaaggaaggaaggaaggaaggaagaaaggaaggaagaaagacagauguucccuucucuaagaaauccacauaauuuacucuuuagcagaugggucacugucccuauuuuuacugagagacaaugacggccaugauuacaaacaaaaggauuuacaagacaacccccacccaaaaauuaaaaauaaaaaagggaagagacaaaacccugcuuuccuuucccuucucuuccuaaugguaaagcaagcugcccagaggcccaugaauugcuugcugucuaaaacagacaucaaggggcugauuuaaccugaccuuuagaaacccagaacuuuccagauagaaaggaauuuauauugacaaaauggcucagccagcacagcacccccacccccacacgugugcagggcagaggacagccugugggaucugcucucuccuuccaccuaugcgugagcucuggcgacugagccccaauuguccagcgagcgagcgcuuuaccucacucagccggcaaccaggaaagacugugacugacuagaucuauuccaacacuuacacuucacagaagugaacaaaucagaguuggcuguaccuucauccccuggucuaaaaaaucaguaaccuuccccggcucacccugucacuaugacuccaaccucucaugggugaaaagcucugaccucuuugcugccgugagagaaaccugugaacuucaaguucuccgucagggugccuaaguugccucugcccuuccucuguacugguggccagugucccuaggugcugguguagagcaauugccugugcacaguacagaucacaaggucccugucccuucccuccuuucccucacagaacacacuuccuguaacguagacacgugguaagcgccaaacuacacaauggauggacuaugaccucaacugagggaauuugccacaaaggacgaugugcaagugugaguggaccguggggcagggucaccucugggguggucagugacuacacuccuagaacaaaguacaccagaggcaugauggggcacguuuaggcaucgaggcuacggcagcuagcauaggacagagagagggaaggaccuccauuuucucuacucugacuggaggauacauacacuggcuccuuuccuuagcaaggacgcccgccaugugaacggcagcagcaacggaaacaaacuucaaugaguugugaguuugagccagcgacccagcaccacagcaucaacagagacuuuguucauuuaagauuaauuuccaccugguguggugacccauaacucugagcccaauccuuggggccugaggcugaaaaucacaaguucaaggcuagccugaggcuacauggcaagguccuguggccagagagaaaagcaaaugcugaagaugauaacaaauagaaccgaauuuucuuuuaaguacuuacagacaucuuuuucauucaacgugaauuuacucugaaagccauuuagauaauuuauugugacuucgugaucaccaggugaaagagcuggaauuuuaacguuuguugucucuaaugggugacaagaauggaaccuguaaugaaagacagggaacuuuaaauagcagauaaaaauagcgccccgcuuauaaaagccugauuaacauuggaagcacuagagagugcccuaugcuuuugugugauguuggguugcauguacuguaugcuacgacaaaaagaggagucaauggcgauaugaggaagagugucccgccugccagaaggcacagagcaagcaggcguggcucugaagagccucgagguuggcucgcucuucaaaucccaccucaaccuugccagagcucugcuccaggcacacuguccccuucagcacagaacaugaaggaaccaccgccuagugccucguaguggaagcagggcccaacagaggccacggcagaagugaaacaggacacaguggucagugugcacacacccucucuucuuacccacugggcucacaauuaacuucaacaagaccccaucacgcggauguggaaggcuucugauccccugagucucacagauaaccacugcuuucucucucagguuucacggcccuuuguaucucuaagggcauauucacacucuugcuuuuaccaauaagaacuuuccaggccuccugcacccccagcacaagccucucucucucucucucucuucauucagcuuauccuggguacaaagucuugcucgcuuucuacaaagcaaguuacgcaugugccuucugacauacuccaugguuucuucuccuuuguaaguccccuucacuucggccagcaagccacccacaggacugcugcuaucuguugugagccccuggugagcaggaccuaaguuucgcccccacgugccacagucagcauccaaaccauuuacccaaaguucuaggaucuccucccuuggacucaagguaagacuguccuccgucccucugaaaacaaggaauggccaugugacauuauguggccagaaaaauaugaagucaagucauggauaccuacuugaugaagaaaguucuaaaagccaacacgggcuauauucuuuuuguccccuaccaaugacuucauaauaagaagaggcucaaaguggaaaccccagcugacaccagaacauagccagcccuucauuuucaugagcaaaauauaaagguuugaaggcuguuucugcaacagacccuaaucugucauaacggacaagccacccuggugucugcaguagugcuugguaaauauacaaagaaagggaauaucuggcucuguuuaaacauguuguguccuuuuauauuggggccacuggguuguaaaccgggacuuggagauaagcuugauaaaccugugggccuuugcuaaguaauucgcuguccugccgggauuuggggaaagcgaaggacacuguguaggccuccacucuacgaagcuaugugucaagcccacucaaggcuacuugagcuuccccuaccacccaaggcccacugacccuccuacuuaauaacauggacuuggugccuucugagcuuugucacccgccuagaagaacuuaucuccaaggcucuagaggagccagacuuauuggccaccugacuaggucuggccagugcagguguuuuaugggacgucuuaugagucuuuuaaauagaaaaucguccuuccuuuuccugcuugcuucuucagaugcagacuuaagggcugucccucuaguaucaugagauuccuaaaccauuagauuccagacaagagauggcaaagaaaccugaggacaaggacaggcucauugacaacugugccagcccuggacugccuacagccggaccacuucccugagagucgacaccuguguggggagcugguauugcuggcguguucuauuagacacagacuucaaccugauaaaggcagacaauggcuuggaguagacaccccccugagcagaccaguacauggugaguggugcuccauccucacacugcacacagcaaaggaaaagcgcuuuuggcuagaagaccgagucuggacuaauguaaaacuuggaauuuuuaagagaaagaagauuaaaugcaaauguccuuuuaaaaucuaggaacaaaauugucgcacucaaaaauaaccggggaagaagcuccggguuacaguuuuggacgcaccccggauguccuuaccugucuuuaaugcaaauaucuuuaacaguuccagggcugaccccgaggggagcuggccacgugcagucccacacucgcauguuguugguugugcauuucaagucuuguaccccuaaagaaggaaaagcaacauguacauacaugacacagagcaugcguguggcucucuggggucucaguggagagacaaguccugggccuccagaaggccacucucuaggaagaaaggucucagucaucagauacuacuucaccggugcuuugccuacuuuuugaggguuuuuaaaaaaauauuuuucuaaguaucuuaagauuauaauacagccauaucacuuucucuuucugcccuuuaaauucccauguauacucccuugcucucuuucaaauucauagccuuucucucuucaauuguuguuaauuguuaguacacauacauguguguauaugucuacauacguauaugcuugugugugugugugugugcgugcauauacauguauacauauguauucuugaauacuuaaacuauagccuguguaguccacauacuguuacuguuauguagcuuucaggccugaccauugcuccuaguuaccgacugguaagcuccucccugggaauaacuauuucucccacucucuccuaucuuggcaguaaccagcggcuuucuugucuucagacccacucaacaagagugagagaagucaugucugccacugggaaucuaaccaacucccuggggcuaccgaagucauggauaccauaggggaaucuacaacuaccacuucacuaagccacuacaaccccuaacugcacucuaaauauuuguccuuaugcccacggguaaguguuguuccucaucccucaucaaggaaccuucucuuuguggcagugaccacugcauaaaauugcaauagauccaagugaagaacucugaagaccagagaccagagccauuauauaugucuauaauguaauuccugucuacacacaaccuaggcucaggggaucacugggaaaagaaagugggaagacuguaaaagccagaggaacagggaaugugcugugggauggugucucuuggaaaugucggaggccauagccaggaggucugccuaugcaauaccugaacaaggaagauaccaauagauauguuagcaugggggaacacucaauaggccucacaccuagacaaagaacugcaaucaauuaagaaaggggggggggugagaauauguuguuguuuuuuuaauuaaaaagccaacuauaaugggguaguggaauaauacccacgacuuuacacuacaagcaaacaccucuaaggaaaagauuauuccagaaagccucaaggucuaccgcacaccuacaaacccaccuagcucggcugcugcacuccuuacaccagaccgcagcuccacgggaaccuacaaucaaucucuucauuacugcaaagcccauuaccuucaaacgcaaugaacucacacugaccuacagaaaauagucuuguauguacggcuuuaacaaugggggaagaagcaacucagaucaacucagagugcugugacgucacauuauggaaggcacguguguaagaacagcacaaugaaaagucaggcaugguagcacaugccuuuaaucccagcacgcgggaggcagaggcaggcggauuucugaguuugaggccagccuggucuacaaagcgaguuccaggacagccagggcuauacagagaaacccugacucggggagaaaaaaaaaacagucacccuggaauacggaagagaaaggaagagaacauagaggaugggaaaggguagggaaaaggagaggggggggggaagagagggagagggacagucagaaagaggaacaagagaaagggaagaagagcaaaagggggaaggaggaaacuagaaaucaucuuaugcucuguaaugucuaugaaaaagcuaacccuaaccccgaccccaaauaggaaaagcuuauaauuauucaugcuucacacaugaauuacagacaugauauucacagucgccauaaaauauaaguucauauaagacaaaaaagcagaaacgccuuagaaaugcucgcaugagaaacuagcaguuaaucacaaucaaguuauuuacucaauaaucuugggggggggagcagucugcuuaauuguguaaauaacgugaagacaaggccaaugggcagagggaagacaucccucgcagaaauaagccaggccguaucugcagaaacauucuucaaguuucaaaauaagacacaggagacacaggaaagaauuuucgauuccauuuagaaaguauucuuaaaacacauuugagacagaccacagcauggcuggcugggcggggcggggcggaaagagcuggcgacagggacacagugggcauuuucuguguucuggaacagagccagaucuugauagugccugugguuagcaaaugugcauugucaaaacucagagaacuguauccuuaaggaauggacagcauuguaugagaauuaugcuuuauuauuuguauagaguaaaggaauauuuugauugcccuuuaauaaaggggcuuuuaaaaagaaacuagaaauacacaggagaaaaagaaugcagagaacuggacuuuaagcaguacccugaagaggucagcagagaaacaggacuacucuacggucgcaugccaaccagcuugccguuugcuuugaggcucacuuaccucucuucagaccguuugcaugcaucgucagaugcaggagggucagagcugacaggagccauggcagguuuggagucauccucgaucuuuuauugucuaccauccacgauggcugucuccaccaugaguaagcugccauuguccuugcuguucagucagcccuaggugagagaggaugaacacagaugcuguucagauggcccagaagacacaguucacccgaggugcgcaacaccagaggcaguuguggcaggacacacacagagacaugcugcacacugcugaguggagaagccaaacucugcuccucuggcucucaaacauccaaagcugcgcagagaugcugcuuuuggguggcugccacggucaacaguccaacaucgggcuucccauuugagacgauagcugaacacgugugcauccacucuaccccaaucugcuaauagaggaaaagccacucaauguacugguggauguuaacauagauugagacugaagccuagaucucucgcuuaguguguggucccaaguauacuccacgggaccccagacaaucuguagcgaagugauuccacuccacacugcaaagagaggccucuuucuacagagccuaaaaccuuguccagggagaaccaaggagcucacacagacacaggugguuccgcuacugaacucaaagccccuggaauaacuacauuccuucccacagccccacagccacucucauagcuaacaaagcuuuccggugcacugacaucuugucagaccuuacagugccuaccuuuacacugcacagagaaccaaggaccacaaaacauaugaagguugucuaaauugugagggagacucggcaugaacaagaaaaugaaaauuacucccagaacaagaccaacauggaaaauagcaaguucuuaagauuacauugcuuuagagcugaacaguauuccaucauacacacacaccccaaauuuuccuuauuaauucaacuguugauggacaacuagguugauuaucauuuuuuugcuacagugaauaaagcagcaacgugaugaugcaaauauuucuacaguaggguacagagaacuacacagauguucacugagauguauaaagcuuagggcugcuuaguuucagugugugaugucguuugugugcauggauuuuuuuauuagaaaguuaauagaagagaaaagcccaaaacuucacaaaguuuccuauaagcaaaggggacagccauaagaacaagacagacgugccaugaauggaguaacuggaaacaaaaagagcucuacaaagggaagucuacugggugauguuacaguuuaaaagauuuagugcgugugugugugugugugugugugugcacgugcacauauguguucaugugugugcacaagugcaagcauauaugugcauggguguguguuccccuaucuucacaugcauacagcuaccugaggaugccaggagagguagucagaacuccaggaguuacaggugcacgcagucuuaagcugcaucacagugggugcugggaugggaacccagauucucuacaagaccggaagaugcucuuaaccacugagagauccccccaccucccuuuaaaaauaggaaauacugacuaaccaugaaacaaaaauaggaaguggaugagagauggagacuugauaaaaagagauccaacaucucaguagcuaaagcccaggggaauacacuugucacuggcagaacaaggaacacucucuucuugacuguuguuaaauaccaugaaaagcacaaaaaugaaccucagguaccuuaugccauuauagcccacaagcaugcacuucuagagcguuccguuauguucuagaugagugaacaaguucuggacaacuccaaugucaccgaguccacuuauuagcguggaaauguauuccuggaauguccucggugccugcugcugagguuacaguauuacccagcugugcagaauggcucgaauaaucacaaacuauaccuacccaccaacuggcuaaacauauguugaaagaaugccucacuagcagcuuaagguuauuuuagaagggaaacucggguuccauugcaaugccaggaagcaaggaugagagggacugggaggagguggccaaggaagggcucaggaccaggugcugccagacagggacucuaaucuuggcuccauuacuaauuagcagugugacugaaggcaaaucacuuaaucccucuggcuucagccuccaccaguguagcccagaggcaaguucuguuuacuggccccagcagacucugaaugcgaggcccuauugcagacagcaggaacaggcagugcagaacguuggguggcuggcuggcuguugcagcccuagcacagguagagagcacagugcauuaggguuaggggauccagcagagagaagccaacguggugucagaaagcccugcucaacuuaagaugggcaggcuaaugcggaaggcggugcuuugucuuaaugcuuacauagaccaccaggaucaggucauuuggggaagcgucacuuaauagcacacucaacuucucucccagccuggacuuucaaugagcucauuccagggucagaacaacaacauggcuagagccuuccaaugcacuucgcggauaaaaaugauguuaagaaacaucucucuucccacuucuggcagagcccaccacuauuaggacuuauucugugacccauguucugacaucccaccauuccucagccccgaugcuaucucuugaagcagccacagagcuacuacaaauaucugguggccaaagcaaauagcauauggcagguggggcccauaguccccagcaaguuaaaggagguggccagaggguauguuuugcuaaagucaucagauucuucaagauuccacaggaaucagggauuucuuauggaauucuuagacuuuuuuuuuuuuuagguauuccagacuccaagcaaacagcaccuucagacuccauaccuugcaagauuauuuccuauguuuaauuaucuuaaaagauuuuaaaauguucuuaagcccuccuguugaagacgaguuauuauauagaauagacuuauccaacuguuacauggaaagaagaaaguccggcguuguccucaaugaacagucugacacggucagguaucuugaagcccagggcagggcuggauggagccugccccacguggcagggcacucaucuguccacaaugugccuggaagucuugagcuccuuccggggaaaugguacaucugcgcguacaaucugccuugauuuguacucagcaccgcagagucuggguccagguccaugagguucuggacucucugcugaggcuaacccaaaaaaguaagcugagaaaagucaagcuuaagccagaagcuaugguccugauagacuguguuuaguccauuucugguuuuccuauuuguuuuugggagaggguuggggagagaggaagcuggauagaggaggaccuaaugggaucggaguguucccguaccucgcuggcaucaggugagccuugggcauacaggcccuuaacccuggugcuauuggaagcaucugaacaccugcucugccccagccagggagccugcugcccagagcaucucccagcuccaccucagugagauagcccaucguugugauucacaggagaacccacuggaaagcagagaagcacaagccggucauagaggucacaaggcaccgaagcaaugggagguuaccagcuguccagaggcacgacucuggggaacucgccaagugcaucuguacacauaccccagccugcaccgcagggacucacaguaccauccccacagcuggggugaugcugcgcaggacaccugagcagguccucacuaauauucuuuagugggcaaugcacacccagcuucuuaacaccggaaacuuagaaggaaugcuuuucgaaauauuaaguaauuguuuucagacuugaugaagacacugaacgaucgacugagaagacaaagggcauucaguuaucaagaccugugagacugcaaaagguacaucccuuguuguucguucuuuggaagauugugaagaacaaggcuuaugaaaaugaagcagggagaauggaaggcaagagauggaggacguggggggggggagaaggggaggagggggaggagaggggacucuaaacugcaccccauguccagcagggaucuccuuccaggcugcauaagaaggggaacucuaagccauugugccaucucuccacugccgucugccuguuccuuucuaggcagauuccucugcguccacuucuguaaccuccucagaccuuuguaccaaaaaucuggcaggaggaaugaugugcucauugucacgguggagucuuuacagaaagggacguagugaugcuugcaugcacagucgcaucucucccagagcgguguagugucuggcccauuaagcaucaugacaggcccacucacugcucucaucauuaggccggaucauaucccaaguguugcccgcacauggaacggaaguuugagaggugguuccugcgcaugcgcggaggccaggcaccaaagcaaacugccaggguuaucgcggggggcuugcagacucucuggaaaagcgguaauguacucaaugcuuccgaaagccuuggcccaauacuacucggcuuccauauucggucgugucagauguccuucagugacagugucacuuuggugacugacggaauaaaccacaaggaucauccccaaagaucugcaugcccauggaaaagaggguggugugagaucuguuuccaaagucugagaaaccguguggugcccaguagguucacaugccaccucagucaucguggccuugggggaaugaaauagggucauuauuuuuccuucugagguaacacguguggacuucuccaaucaguuuugaccaucuaggucauaaauagcuauuaacuugguuugacuuggcaauuucagaugguuaaguucgucuuuugacuaggacacugugaaaacaugaguaaaauacucugggcaugagagugcuuaaggaguccacugcaucagacuuuaaucagcacucugcagacguccugggacaauguaaccuuuguuauuuuaaaggcacccaccacugugaauggauacuguaggauauucagucucccagagaacauguuaauacaauuuaaauagauuauuuuuguuucuuuuuugucucaauuuaucacaauuuccaaggaacuguuuucagugcauacgucaucaagauuuuugguuuuucaagaucuuucaugucagguuggcuaauuuucauucuguugaggccuuuuuuguuaauucaaaagccuauccauuauacacuccagaauaucaaaauaagaauguucucaaaaacacuuuaaagauugccaguggucucuaccuacagcugguuuccuguggugaacaaggcgcuucuggaugguugacuaugggccuccuccagaccacaauagcucccuaaacaggacacacuccaauuggucucagugccucccccaaaccuaguuccuaugggcuguuccuugcagugucucccauucagugccuccaauacuucccaccugucagggcuggaagugccacacuccccacccucaaacuucagccaggcuguuugagugacuggcaugcaaguaucucaaugaauauuacuguaucuguuaugaaauaauguggcgagggggauaccuuuggugggcccaugccagguguaccccucugagaaauguacccuaugcaacagaucugguguaaaagggguuuauugggagaagggagagaagugaggaccuggggaaggaacagaggcacgcagauugggagcaggaagacaggcagacaaggagcagagccaugagaacuggcagagggggcagaggaggagagagaggggccaagcguggagaagaacagagagagcgagcugagauggugggaggucugcaguacaccuggcagcaggcacugacauaagcaacugcuaggucccugggaguaggacaguggaacuaacuauauacaccaacacuagcacuaccaaacaaaugaacuugcacugauuacaagagcaaaacauucuaugauuaaauuaccuggcuagggagauggcucaguagguaaaguaugugucaugcaaguacgaggcccugaguucaauuccugccacccaugccaaccagcugggcauggugaggccuucuuacauucucagugccagacaggcagauacacuaggacuccuggacaucugagagcaucgggucuaacugagagacaggcauugcuucaaaaugcaaggcagacagccccugaagaacagagccagagguugaccucugaccuccgcaugcauacucaugugugcacaccuguguacauuaacacagacauaagauuaagaaaaauaaggaaauaaguaacccaaacauuccuauguuauuaacacggaaaaagcuuacauucaaaacaaccaugaacauccccacuccucagaacgggucauauccuccucauccagcucacagaacuugagugugucagagccuggugugucagagccuggugugucagagccuggacuggucuuccuuugcacccuggcauuuggguguguauaaugaacuaucucagagaagggagcccaaauccaaacaugaggcuccuuuacauuuccuacugggcacacaguggauaguccaaagguaucuuacacaguguucuuggugacgcuucacuuaggcuguagacugccaggcgcagccuuccccaccgugacaguguacuggcugguguugugucaacuugacacagcugggguuaucacagagaaaggagcuucagguggggaagugcauccaugagauccagcuguaaggcauuuucucaauuagugaucaaggguggagggccccuugugggugguaucaucucugggcugguagucuugguucgauaagagagcaagcugagcaagccaggggaagcaagccaguaaagaacaucccuccauggccucugcaucagcuccugcuuccugaccugccugaguuccaguccugacuuccuuggugaugaacagcaguauggaaguguaagcugaauaaacccuuuccuccccaaccugcuucuuggucaugauguuuaugcaggaauagaaacccugacuaagacaggaagcaugguggcauuucaaguucccaaguuugaagcugcaguucucugacuuuuggauuauagauaguuaauagauaggaaacagauggauguuucuguucucccaccaacacuaaggaugaugucuuuccaaaucucaucauuaacucguggguugugaagguaccaauuccuugauuuacaauaaaaauacuucaaauguuuuuuugguaauuugcaauguuuucuuuaaaaucauucaaucuggauuuuguuuguuuuucagcagcugggcguuaucuccuucuuuccgauggagaauuaucauacaugcauaacugacaugcuaacacugacgucuaucuugccaauuucagggcuucuguguccuuuuacauucugccagaaucuuucacauacagauaagauuccuuuuaguauauggcuagaauccuucgacucagccccacgaguuaccagccaugccaggcgcgugcauuaaauaauuggaagcacuccugagcuuggugauggcuggcucaucucauccuuuuuuucccccuccaugaauguuauccucccucguggcuucaaccaccacucagcacgaaugacuuccaaauuugcuucacggaauuggccccuggccagcuucagacuaaucauuuaccagaugagugugugcuuacccacacagaaccacuccaggagguucccgaacccauguggaaaacucuuggaugcugcauguauacuuggaugccucagaguccucaaaaaacccaaaaggaaacacaaggaaauucacuuuccccucuaggcauguucucucaggcccgggccaauuccagauuacucaagacacccauucaugucuucauccuucccaacugaccaccaaucacccccguguucuucccaucccuaucuccuuugcuacggcccucaucacuucuggcauggguagcuuaagccauuaauucauuucacauccguacgaagcaaggaaucuuccccgugagauucggggcuuuacgaagcagccacuccccaucuucccacccucuccuuacuaaggguauugauacuucuucagucugaggcugaugcucauucucaagcaagacauuaccuguacuuuaauuuguguuuuccauguuuaucacaaaauagggagauaauauacccccucuuucuacuuuauuuccuauugcuuuuuaaagucuuugaaccgaacaguaucuuuuaggagcacuguauacucaggacuuacuugacaauugugccuaacucauucaaaccaaguucuuaaugaggaguuacaaugucuuucuugucugucccccacccacccacucuuccuuuauauccccaagaguaagguaaacacauauaucuagagauaaaccagcaacuuggcucaaauugcuguuaguuucuuuuucaaauacacagauuaaacccacuccuaaaggccugcugaaacugagggagggaaaaaaaaacgauaauuaugcaaucacuugaugcacuucaaauucggauucuggcugacucugccaggcaauaagcaacucccguuuucagacagcaugcaccaugugugcaguuggguugaauccucgugccaacucuaugaagccagugucgcuaucccucucuuuccaguaagucacugaggcacagagggggucacacaucuaagaagcagagcugggaaccugaauuuagcaccauuuaccaaucucagcucuggagcaauacauuuaacugugaauccacaacagaagacccccgagaccucaggcguccagggcucuaacaccccuucuggcacuaacauggucacagcugaacaggaccacagcaaacagcuggaauguuaggcuuuagcucucaacugacccgacucggacucagggcaguccuuacuuccaugucaucaaacuaacugagacgagcacaacccuacggccauuguacuuucaggauaccucaagcaaccagcagcugugggccuuucucuccuuccauccugucaggugaaugccauacuagcaagcgucaccugcuucuacgggcggggcaugugaucgucguaucccgcucugacagucugcagggagggggccgaauggaaaauaacugccaucuuccuguccugcuuccaacucuuaaguagacuuuugauuagcugaguucuuuaagugagcaggugcaaacccaaacacacuccaaaagccagccagacaaaguaguugaggcuugccaaggacagugggguggccagcagcuagcagccagagccucugucuguuuuauacaggaaauagacacggcaucccauagccacgggucuuccaacugagcuacugucuuguuuuacacagacucagaaagaaagagagagcgcugcuaccugcagagcaggcaccuuaaccagcacguacugcaggucuagccaggccuucccucuuagacucagaagggcuugcuaucuuuuaaaaacaaaaauaaaacgaaaaacaugugaaaucucauuuucaaaugcuagcagcuaauuuagggggugggggaaauaccacaacagcauucaagccaaacaaaacacauuuccaggccaaaagacuucuuagggagccaacuaagaagccugccuuaaaacugaaaaaaacaaaacaaaacaaaacaaaacaaaaaaacagacaaacaaaaaacucacaaaacauacaaaccaaacccaugucucaaaauacaaauuguucuaauaucugcauuucaaugcacacauaauaaccuaaaugugcccuagugguauauuuuuuuagaguuauaaucugaagcuuuuacguuaaaagaacccugcuuuccccacccccacccccuuaaauuucagaaauacaaacccuagguaucaguucagacuacaacaaaugcuuuucaaaaggaauugacaggaaggaagggggcagaggaagaggacagaacgaauggaacaggaaaaaaauguuuggaaauaacuggcauuuggcagaaauaucucagagucuucuuugucgagaagcaggcuguauuagguguuugugacagcagcuggcaagaagcagcuuaagagaggguuuacucugcccauuuuaaggaucaggccagccaggugggcaaagcacggcuggcugcagcagugacuuccugucgcuaauuaacaugaagccgaaguuccugcuauacuacugccugcuccuucaguccuacuugacgacccugaggcgugagguuacccggcuucaggguggguuccccgccccaucacguaaaccaccucucuggaaacacccucaugcacacacccagaggucugcuuccuaggugaggauacggguuaagcaucugcacggcugugaucuacacccccagagaucgauaagccuggcguugauccuggaucaggaaaguauugagaaagguaucuggaagggagguuggaucagugcagccagcggcaacccugaccugauaaaacuguuggacugggagagcaaggggcaggaaaagauggaccacaucuuaggucgaaagggguccucucuaaugucccaaggaugcucgacaaccagaugaucacacuuacauaauagugcuaaaggcuccuuuuaccagcugacaagcuuacucaggaugcuauaugaugauggcaaugaggacaaaggugauagaggacaacugugacaguugucugugugacauuuuucaugaaugugccggauaagggaaucccaggcauuaaauguguggaagaaaaaaaaaaguaccagacagugaauucaaggaaacaaguguaacacugggcauuucagggacucagugaaaauggcaacagugggaagaacagauacagguuguggagaaaaauaaaacuuaguagcaguaugugggaaacaaccgugaagaagaaaauggcugcugaaguaacaaucguguuugcaacucugcccuccagggguauggaaauuggaagguuuauuuuuagucuuaaaaaaaaaaaaagcaacagauaaaauacacaaaaugauuacucaaauuuuacaaauucuaguucaacaaaaaccuuacuuacucuuaaguguucuccuccagucugcgcaggguccagcuacucccuaccuacaggacccaucuaagggucuaugggacuauggguaagcaagcuccaaggaucuccaaucacgcaccaaaugcuccacccucaagaagcucucuauaaaggccaugguaaaaugagcacacggggcaccuuuuaaggacaucauaaucacccucuucuucagggccacagugguacuggggaaauaagacaaacguccagagucccucucagcccucacuuacuccaaugaucccagucaaugucccccagcgcaggaagucagucauauuaugcugaaaucauccacggcccucccuggccuugaagaagucccaaucugcacauggcacaaguucucugcuauuuccugccagcugcaccccugaaccccauguucaacagcagucaagacacacagauucaaaugcagagacuucgauggauagugaacggugaguguggugugagaugcugucccaugaugguuuagacaaaguucgugagaaagagguaagcagccacugagcgacugacuguaugacugucucuggcaccaucacagugcuuagggggaaggugggggcuggugucuuucacgugguacucaaagaggaaacaaagggguuaagugacuuugccagagucucgugaccuguaaagaacaaagccagaaaugggacccaggauucugacuccaaggucugagucauguuauaaugucauuuuacuugaugaugauggugaugauaaugguggugaugaugguggugguggugauagugaugaugauguugauauugauggugguggugguggugacaaugacagaccaaucugauaguuuauugagcauucacuaucugaucagucaguaccaggcgugguggcacaugccuuuagucccagcaguaaaaaggcagagagaggcaggagaaucucugaguaugaggaggccgaucuggucuacauaucgaguucuaggauauccaggacuauguagacagaccuugucucaaaacaaaacaaaacaaaacaaacaaacaaaaccaaaaccaaccacaacaaacuguucuacaagagacauuaggcaagacuguaaagaaaauguucacugaagaccagagugucugucacuuggaggcccgcggccgguccuaccuccauaagcauucuggcccaucucuugcugcacucuuaaaauuuucuuaagaacguaugcuaauuuaaguaaaaccuacauucaguuuaaguugauucuggcuuuuccccggauguucuauauagcucccaacaguuuugucuccugauagaagcacaauuuguuucuugcaagucucggacauuuucagcucacacacaaagcagauuguugauucacagagcaccccacacacacacaacuuauucuuccuuaauguucucccuaucaaaaaacgguacggacacggcuccccaaagccauaggccaggcauggugcuucgugccugugaucucagcauuggggaggccaaaacgagaggaucaucuuaaugaacacaguucaaccaacuaagccacaaggauccugucucaauuccccccaaggcaaagcaagccaaagcuccggggccguucucgauucaccccuuccugcaccuccucugcaugucuggcagcuacagcuuccucagcucugaaaccagacccugcccacugugcucgcugcuaacccagucccuucacgccagccucuugccugcaugacuaucgaucagcgacaagguccucccgucucgucuccauccucacuucccacacacucugcacagagcaggcagucaccauccaaaaauauccaucggacccugucacuguggauuuaaaacuggggccaauucuuauaaacacgcucuacucucucucccucccaugacucuguuccccuuccgacaucccgcucuccuuccagcagucacacggcccuucugcuccuucuguucaggucuggaccccucaggagcauccuuccauggacuucuccauagguccugugugucaucuaggcuuugagauagaacucucuugcucagcauguccucucccaucccccagggaaagaaguauccgcuacugagcucccaggagcccuggcacccacuguccuugccccacgacaccgugcccagcuuccuguccuuagggcacucaucgauaucuggacauguacuucuuguuuacuggcuggugcuucccaaaaggcaggaaagcuucacaggguaagacccaccccuccuccccagugcugcagccccagcagguguggaggagauacguccacacucagaauaaaggacuuuacaaaaagaacacuaugcacaauaaucauggaagaugauugacuuaaguuacauuuuuaagucauauuacaaaaaccauauaaguauguuccaagcacagcuuaacacacccagaggcacagauacuaaauauacaucuaucauaguuagggucacuguugcucugaugaaacaccaugaccaaaagcaaccugggaaggaagacguuauuucacucgcaguuccacaaaacagaucaucaucaaaagcagcgagggcagggacucacccugggcaggagccaaugccacggaggggugcugcuuacuggcuugcucccggaggcuggcuugcucagcuggcuuucuuauagaacccaguacccagggguggcaccacccacaaaugggcugggccaucccccauuggucacugauuaagcugccccacagcucgaucuuagggagguguuuucucgacuaagacaccugccucucugauaacccuagcuugggucaaggugacacaaaacuagccaguacaaugucugguuaugcacagaaauuaaucuaucauguauaauguaauaucauaucauaucauaucauaugcaguuaccucuaaaagugagacuaaaacuuuaaaagaauuugucuccaagcuuucucaguuuuuauaaagcacuuucccuguauuaacuuuaaaaaauaguuccauuuuuuuauuuuuauuuuuugagacagauauauauauagcccuggcuagccuagaacucacuacacaaaccaaauucacagagcuccacuaaucuaccugccucugucucccaagcacuggaauuaauagugucuauuguacucuaaagauaguucaaauucuaacaauguacagcuguagauguagcauaaaaaaauucccaguaaggaaauggcagcuaauaagaugaacauguuauuuuucugacuacuugguuauagaucaaaguaauaaaaacuauaacaacgucuuuaacuucugacucaggaaaagaguuugaaagucacuggaaacccugguuugagggcuaacaucccccagggguccacguaacuggcugccaaggucuuggggcugguaguauuagcacauggaacuuugagagaugagauguaguggcaagucugcuggucacaguagguguguacucagaaggacuuguggaaucucagucuuuuccaguugggugaggugggcuuucccguacaucaaucccucccucagugaugauuagagcagaggguccucaccagaacugagucaaggccaacaucacgccuuucacuggcaaaaccaggagcuaacuacaggucuucucuauacguagccugucuucuaagcaacauacugggguggggugggggaggauaagggcuuuaugcccagugacuauugccuuaauuaugaauuuuaaaagauaagcagcauagauucucaaauugugguuuguucauaagacagaaugccccgcugcaucaauucauauugaagaauuuuuuguagcauguggaacauauccugaaggcccauguuacaaaaugaaaaaacaaaaacaaaaaaacaaaacaaaacccaacacaaucuacguuaugggauacgggaaaacauagaugagaaaauacuauaguuuaaagcuagccauucccagccaugccucuugacauuuaaaaaacaaacccuacauccagaaguccugcaaacagugcccccauauccacagguggacagucagcugugucgcucuagccuuucccauagagcccaucuugccuuauagauuucuguguucacuuucugucacaaaacaucaaagaaaaccagcgcauaauggugguuuacugccaccguuuuaaaggucugugcccaugagacccuucgcuauacauguuccaugaggcaagacacuauagugggggcaugaagaggagcaaaccaacucacagcauaucagagaguggaagaguaaguggggagggcgcuacugacccacaugacagugaccuaaggacaucccacagguacugaccccaacaauacagccuguggugcaugcugacagcacuccagcacucgcggcuuuaccugcuauaagguggaacguuccagaacagaguccucugugaucccauugauccuggccuugagagcaguguugcuccauccuacacucagccaacagucuccgugccaacacggcccagcugccgccuaggcaccaucgcacacaggccuugccucucacuaggagaaauucugcagagugaccugaccccuaagagaagcacgcuacugcuaguuccggcggaggagugggaccguagugggcugugggaagcgaugccauagauaggagcgugacauauaaaacguggaucuugcuuguguccccuaccuaugucuaugacuucccaugggggggcaugcuguccacaacucaagacguuguguucuuuuauuuagcuauaugaggaaauggaauguaaagucggcauuugucacaaagguaccuuuugugacgacugacucuccacuuucaucauagaaccugucauguucauacugcagacccacaaagcguaugcugucuucaacgguuacugaggguaaaauauuugucuuugcaccguucaugagagcuagugcaguugcacguacucucgggugcaggucucacugcccuugucuccugggaagaugcaugcuggaauuucucacucagaagaugcauaaacgccaugccuccuagauuuaugagggagggccuggcaauuuuacgaaaagauaaaauuucaaaacggcaugaggucucccucgcaguggcaggagugugcccuucacagaaggugcaauagcaguuuccagcccagaagccuaagaaaagugucacccaacuucaauaaaagucaucuguaaaugucaacacggugacgucaccgagcugcugcucacccagcgggucgaacaaguggacggcaguguuuguguucacuggaaaguaacaucacgugcuuucuucugaaaggacaggacaggaggccaggaucugcagcuugcuaccuuaccucagugaccuccuggcuucgcagugccgugguuguuccuguguguuguugcacgggcaaggucaccuguaccuggggcaccguggccuaugcaguacugguaacacagacacacccaucacugacugagucagacagaccuaaccuugaggaauguacggcuggacuacucaagacaacaacagaaggaagcaaaaaugucuuuaaaacaaacaaacaaaaaaaaaagaaacaaaaaaaacaaaaaacaaacaaacaaaaaaaaacaagcacuagcaacaaagaguauuugcaucuaagugggcgaaagccggugucagcaagcccaccgaccugaguucaaucccuagaaccguaaugguggaaggagaaaggccucuccugggaguuggccuccgaccucggcuuguacauacucacgcacaaauacauggaugguuuuucuuuuaaaaccucaaaucacuucccaauggccaggagcaaugcugugucaggaugcccugaaauuuucaagacccacgaaauugaucuagcaaucuagaacuccucuacuguucagggcgcccaguguccgucaucccagcagcucaggcaggguauguuuagccagccuucucugccgcuaagcacccacacaacagggaccgaaacagacgcggaacuuacucaaguucacacaaccacugggaacggaaaugcaacuuccuccccggccccuacacuguaccacaugcuuuuuagauauugggaauucugggggggcuggggggguggcugcuaaaagcaacagagcuauugauguugcacacagaauucaucucagcuagcgucuagacaguaaucuuggggucauccuacacagugucacagagcugaucacauguaugcaugugcacgcucgcugcaaagacaacaccuagaugaaugacccuacauaggccucuuggucaucuggcuugacaaaugguaaauuuggugcagcuccaccagugggcauccccugcagcacugucccuucauuacucaugaaaaccauaaccaauuccuauuacugagcacggaagcuguuuccacuggggaacagguguuuuaagaaguuacaaggagccgggugugguggcacacgccuuuaaucccagcacucaggaggcagaggcaggcggauuucugaguucgaggccagccuggacuacaaagugaguucuaggacagccagggcuacacagagaaacccugucuagacacccccccccccccccggccaaagaaguuacaaggauagcuuugucaaauugcaggggugguuuugauaugugcaugguaguggagcagccuucagcaucugcagacagcuuuucccccugaucucccuuccugguucugauacguggcacauuuuugaggcuuuugaugaguaaugcaaaauugcccuccuggaaaguuaccacaauucaaacauccgccaggcaucucgaagcgacaauuuccagagccugugggggcuuugugagauuugauuucaaauauccaaauuccaacgagcccauaaaguucugaaauugugaaaucacuugacugauaagacacauguggaagaaaggcaauucaaggcacuguuugaucucaaaaguaaauacuguuucaagcaucaaagauaaaagguuaaggauaccaggaauuagggaguuuacaaggugacuccuggaaaauucaaugccuggucaguaagggaccagaugcagccacaccugccaaauuuggccagugcuagagcuaggaguuuggguuucaaaaguagcacucucuauuuuuuuuaaaugagaaauuauauauucauccauauuauauaaacacacucucacagauaaugugcccaucggacaauuggaauucuuuuagguauguauuuacuuaacaaaauauggggcaccugcugugggcggaacucagugccagugguaagaugacacacggaagcccacaguggcgaaccccucagggagaugcuccucuagacagaacucagacucuuucagguaacagucaguccaagaagggucaggaugcuggucaguccucagugacuguccccaggcaaaucguggcaucccugggucucaguuucuuuacauauuaaacuccagaagcugacuuggggauccgaaagggcccucugacucucaagcuccacgcuguggcuagguuguuugaauccucaauuuuuuuuaaagauuuauuucuuauuauauguaaguacacuguagcugucuucagacacagcagaagagggagucagaucucauuacggaugguugugagccaccaugugguugcugggauuugaacucaggaccuuuggaagagcagucgggugcucuuaccugcugagccaucucaccagccccugaauccucaauuuuauguuuuccuaagagcuuacauuuucaucucccucuguaucuugcacacgcucuccccuaaaacuguuuuuguuuguuuguuuguuuguuguuuuuaccacaguaaaacugcugaucaugguaccuucaaggaguaagcaugggguaaaguuccagucagauaacuuacauucccgcuuuaacuguuucuuuggagaaguuucucaaauguucacgccuuacucacuuuuaugcucuaaaggcccgaagaagggccuccagaagcugacuuggggauccgaaagggcccucugacucucaagcuccacgcuguggcuagguuguuugaauccucaauuuuuuaaaaagauuuauuucuuauuauauuuaaguacacuggggccuccaggccugcugcgugcaaacagcuggcaucuugucaucacgcccuaauguccacaguggcccucaaacagccccagagguuacagcauguaagugugggccacggucucaccuucauccuaccaccaccagggcucagccaacucacaagguucuguccacaggacaauuacaacccaucugccccguuagcguuuucuaauguuagaagcagggaaguacuucugucagcacuuguuauuuuccaccagauguuccugcuaccaccgugucaacuguccuuggaucuaagaacuucuuacagaagugugugcuucggggaugaaggcuuaacccagacacacacggaccuucagaaagaaauauugcccccuaguggcccuucaagauaccaccacauaacaagauuaugcucgauucuagacaugaaugcuaauuccaacuuauucagccuuagaagccaaaagaaugaaggagagccaaaaacuucccaccgugcaaaaguacauuagaaaccaaaaacauacgccaaaaauuccuccucaccucccaacacugagugggcaaggcuugcgagcaccaccuucagccugcgucagcaggggcagugcaagugucuagaaggaacacaugcagcauuacucaagacaauguaugacaacuggaauuccugccuuucugcaaccuguacagggacugcaaaggaccugcuugagagugcuugcauuucuaaacaucgaaacucccuacaaugccucgcuggcuucagcuacuugcgggaagugagacugaaaaggaccaagacuacucugcucacaaaggagguguggaagaacccauuguuuucucagugucugcacugccugugucacgccgagcugggggauacaauuaucuuacguggaaacaaguuacuaccaucagguaucaacagucagaauaggaaauuagaaagagagagacggagggagacagacggacagacagacagaaggaagggaaagaaagaaagaaagaaagaaagagagagagagaggagggagacagacagagagagagagagggagagaaagaaagaaagagagagaagagggagacagagagagagagagagagagagagagagagagagaucaagcucacauucugcaagaucacggaacuccuaauacagaacaggggcccaacagucaaucaccagagacaagacucuuaucgcacagcucuaacaauugcuuggcaugaaacuccuuucccaaacuuucaauuaauauaaaggaacauauauuuagaauaacaaacagauuaggaguugggaagaggaaauaccacaaguuccugcuauuucccaaaauagagcaggcacacacacauuucuucugugagaacaacauaccugagcuuggcacagcucauuggucagucgcaagcccgaagaaccaaaacaucacauuaagaaaaaaaaaauuuaaaaaaaaaaaagcaucugaauuauucacucccauguaaauggcugcuccauugaaaucaaaagugaaaauuugggcuaucucuuggaaaucacuaugacuuacuaaaaggggcuguguuguguuuuguuuuguuuuuaauacuuccgacuugaauuucauggcagaaggaugagauuuaaggcaacaaucugagaguguguuaacuguaacacacaugguaaggccuagagccuagguggagaacucagauaacagacuccgaagaauucugaccaaaaaucaggcaagauuauuucuuaagguuuuucuuuauuugcucaucuacucaacaaauaaugcaggacggaggugcagccuuggcugugcgugccacaggaaacagcaagcccugucccugaacuccuggagccagcauggaggaauucuuccacccucuucuccaugcgcagcaccccaauccaagcacaugcccgcagccugccccucuccccaguaguagcauagcaccgugguggcccuauggcgccgccuggauguugauucgugcagugcccucuaccugagcuacacuuccccuuucuccagaaucauacacugcucagcuccuaccaaucuacccuagggaggcuucucgggccacaggcagcagucuucagggcgacccuauccaccucagccacgccccucucuaccucagccacgccccucucagccacgccccucugccagggcaggguagguucguuucccugguccuuaaccggauaccaucuuucuucacugcucucucacguuuuuaauccaucuccacaauucagauggaaacucaugacagccagucuguuugucccguauaagcuggaucucaguuucccgaaaauugccuggaauauuaacagaagacugauaaacaccuauuuaugaagaacaaauauggaccaguguuaacaacacuuuuguauugacaccacaauguuaggucccaaagaaaacaaagaccauauucuaaaugcuaagaguggauuggauuuuaauuagauuuuuaaagguuccucacagcuuauagaaggaggaggaagaggaggggauuggaaggggagaagcgagaagacgaagaagaggaagagccuccacauaggaucacauaaggcuacauaaugcauugugcucaaaugcuagcauuagcgaggccuaaccucuacaauuuauucugcuuccaaaaucacucuuaagagaugccaaggacaaauacuuucucuaacaaugaagguguaaaagcaauuuauucacauuaaaguagaagccaguggugaucaaccacagaaacacagacuuuauccuaaugagaagcaaauuuucuggaacacacacacaaaaaaaaaaaaaaaaaaaacuccccugccuucaauuuaauaauagguauaagccuucacugcauauucaaaaacauuuaaacucuuaggauuuuuuuuuuaaagacaggaucucauaauauagcccuggcuuggaacucaguacggagccuaggcuggcauagaacucacagacauccaccugccccugccucaggagucaugggauuaaaggcuccacacagggccugguggauuauucuuguaagugcacaguuuuacuuuguuuugucauuaggaggaugacuuuagguccuggccaucauagcucucauuucacagcaaagaugccacaaauccccaugggucacuuuggagucauuaaaucagagaaugugcacugggcagagcugccuccacuuccugcaaugugaggacgcaacuuuggggcccugggaauaacugaaacccacuuaaaagccucaaaaagaaaagugcuuuacaacaaccucacagcaagauaucagaagacuauaccugugaagaaagagaaccuuaaguaaaauauggcuuauccuuaaaggaguucucagauguugugucagagggagagggagguggcucccucgggggauggagggaugggggugggaagaacacuggagacugucuggacuuaggacuucauggggaggcaaagagcugguacagaacagggcaugcgacuaucccagccagcagaaagacaaaaaagagcaaaaugcuaccaagcauugggcuacauucggagagagaaaagagccagaaagcuggugcuuacugaugcuaagggagugguaggagagagaugugcccuuuacucugaacuacguaaccaguggauuuucucuaaugugaagaggugccccacaaauuaauaugguaacgucuucacaccaucacuacacuauuccuaacacaguccccccaaaaaugagucuuccguagcaaaaguuuuuaaaacucaggaaauaauucauuugguuuuaaaagcacaguccucgguccucauuccccagaggagacuccaagucuccacucacuggagcagagcagccugugaucucaccucucacaaggcaaacacaccucagcucaacucuggccugagagcaaacagcagcuccggccuccuugacaauacgccuccuauugaaacugagcuuaagguuccucauggaugccuccaaaugaacacaguuuccaccugguuggaagaaggaaagucagggagagaaagaaaagagcacaguccaguguuuuuuaaaagcacaggcuaugcugagauuugcuucccucugccagucucacccgaggagccucugcuccuaguggaguaugacuucagaucugugucaagauaauccugcaaggggaggggacggcaucaguugcaauaaacaaaugcuuuaguuuuucacugggggcggugcuuuaaauauaacgugggcaccgcuuuugaacuccugacuaacguaaagucaggucaacucuaagcaaauauuauuugcuggguuaaauaugcaagggaaggcauuggauggcaaaguuuaaacugaaaguucugcugaaaaacccacuuuaaagaaacaaaguaaacgcaaagaaugcauguaacugucagucaguaacagcgcacguguccuuucaguaucugacugcauuaaacacagcuacagaaagggacccaaagauaacccuaguguaaacgaaagauucgugugucuuggcagcugaagugggggcuagaaucacauaacucaagcuccuguguaaguucacaacacuugcugugcaguuuucugugcgucuggguccacgaucucagcuuugugcuuuagacaacacauccggaaagccauccauuaggaagccuaacuuugcuugccuacacuuuaacuugggaguuuaauaaguuuagcgccuucggacacaagcaccuagaacuacagacaggucagucaaaugcaccaucaaaacagaaaggacgaggaacuacuuuucugaagcgcugagguuuaggggcaggaaaccaucuggcaggucgcagcuccgaauggggaauuaaagguccugcccaucccccugguaaccucuggccuuggaacucagugcccuucgcgccgcacaaguuucccgcgguguagcccgcgugggcgcgggcugcaggguugaccccucggcuggcacggacggcgugagcccgaguggcguugccccagagccggggacgcgccccccgcacgcgcuccgggcugccgcgccgcgcccccgcacucaccagccgcucccgcgccgcuaucuugccaucccagucggccgccgccccggggcagcccggacccugcagcacaggacugcaguccugaaggagcaguccggugguagcagccgccguccuggcgccccuguccccuugcaggccggcucuagcggccaccgacgaccggccgccgcugccuucucccaaccccgcgagccaccgcagcgccaggcgacgauaacggccgcggccacugccgagacgcuccggcgcagacugcgcgcccggaggcggcgccugcgaggagcucggcggggggcgcagcacccaggccccgcccaggccccgccccgcgcgcccccgcagccuucuccgccgucccugccgcgcgcacggggacgcgggcccgcgggcccgcgaggccgcgcgugagucggagccucugggucgcgcgcgggcccggcgcccagggaggugccucugccgagacuccggucgcgcggccagccuugcaaggucaccgagcggcgggcgagagcgcagcggcccugcgggugcaaagccuccggaaaggccagcggagcccaggcggcccugcgggaagcagcgcggcucccaaaccgcugucauugcacuuugcaagccgugcgcggaggaggaaacucgugucgccccgaaaaggcacacggacgccaauuacugcggguuuuuuuuuuuuuccuuucuuucuuucugauuuugugcauuaccuaaacugcccccaagccggggcgcugccacucaguuccccuacuuucuuggugaggggaccucucagcuccugagggccugcgggggcaacugagaacauccuggagccaucuagucgugccucugaggcguguugggcuuauuugugcagagaagaaacggaucccuuaauggggugagauuuuuccuccgugcauuguucccauuuccgcaguuucacuuggccucgguguuccuuccagaguaaugcaccaaaugaaauugguaggaguguuuuauggcgcagagucgugguuugaagauguuuacgcucugugccggacgcguuugaugguguucucuuuagcacaauuaauuuugcaaaguucagaaaugugccagacggagccacuggcacgcagucacauggcugugcagacacaccuuccauagggagccgcuuguuuguuuucagaugugauuuaucuggugcgccagggccaaggaguuugugagggaccuuugacugaaauucuagacuuuagaaucuacagcaauuugcaaaucggcaggaugaagcuuauuuucuaaaauaaauaucccccguuaauaauguaacuccaaaaugggcaacaagacaccugaaaauauacugcaugaaaaaauaaauucuuaauaacaucuuucaaaauaaagucacuaagaguauccuagugaccaacuccacuaaagugcauauuuugaacaugaagugccuccugcuguccaugacuguuucuggacugugcugaacccgcccccauuuaaguuggaccauauugcuuuuccuuuauccccauucuuucccacaacuugagagacuugguauucauauugcaguauucugucuuuucuauuagacacagcaccuauggcucacagagcuuuuaggagcuaacaaaaguauuuucauuuguuuucaggucagaagaaaaaaauagauucaaguguuuuaauguagaauaauauugcuaucuuuguaccuaagguaaacaaaauaagaauguuuaauguuuaauaacuaaagagacucauacauaucuagaguucaugaaaagcauggcacagccucguuguccaggaccuagcauccuuuugcauggaaaaaaauagauaaguaaaccucagacaagacaaccacaugauuuucaccuugcauagaacgcuggccccuguggccuugcucucuugauaugaauuuacuauuuaauccuuauaacacaccugugaacugaguucuguucccacauguaggaacagauacaaauuucguggggccugaaguuugugcaguuuggguggcccucuuaaaagagcaaacaaaacaaaacaaaugagaauauccaacacgguccagaaccacucagcaccugggggaacaaagaggccgggcagccagaaagaggccucugucucagccauaguggcuaaguuaccuuaccuuacaaauuguacaaagcacacauggucguauaaacauacugccuagguuuucucguauagggacggagaaaagcuaucuggaaguuugccaucacagaaaaacccgcuuuguauguacccauuccacaggcaagaguuugggaaauucgucacaaguuguuuguugaaaucuguaacacuuucaugauucuguggaauggcuagaagaauugcaguaugcacacuucucuaggagaaagaaugguuucauauuuacauaagauagauaccauuuguuauaaagaaaccacuuuuaaaaauagcaguaaccauguuggaugggaccaguccauaacucaugugaaggcauuugcuaggacucugccaucagugaugccagaggcaagucaauucuuuuuaucucuguguuaaaaaaaaaaaaaaaaaaaguaaauuaaccaggagucacagcucaauugcaagugccauggauggacccuauuuuugucuccuuuuucuggauccaguguguuuuuaaauaucacucuauauaauaucuauggauugcauuuucaugagaugcuauaauguuuguuugcuauuuaaauggcauauuaggaagagccugacacaucuucauaaacgucugacagacaaauaaggacaucgagauaauaaaucacauaauuagagguagaagggucaguuauuuggcaagcugauauggaauagauacaaggcagugagauaccgaagccucacgcucgaugcuuucuucucaucucauugcucuauggugaagacucagacucuucuacacggcaauugccuagucuaccugccuuuuuguuuuguuuauuccuccuccucuugccccuccucuucuuucucuuccuccucucccuccuucuccucuuccuccucuacucuucucuauaggaauuuaaaaaacaauaauaauaaugauaacccauaauaaacauucuaggauuaaaaggcuuuuguccuucgcagaacaaaaauacagcagcaaagcagagaugacgggagguuuguuuuugaaucucagcaucaccguggcccuucagacagcuucucuugaugaaugaccucauauguauagagcuugucagucagcaaggcaaggaaggcaugcugucuuccuggaagaacuguuggaaccagauaagaaucuacaaauuaagcacaguucuucacuggcgagugguugaaguggcugaaaccacuccucauuuucagucugacagaugaauguagauuuaaauugguuuauuucagagcacaguuuuggacaagauucaaaacuuuaauuagaucccuguaagaagacauaugaggguaaucagcucauuugcucuagauuugauauuccuuccccaaagugguuuggaaugcuauuuaagggacauggguuuuuuugguuuuuguuuuuuugguuuuuuuguuuguuuguuuguuuguuuguuuaaagcaauaaacaccaugaaacaaaguaucuccccagaauccugucccaaauauauucucuuccagcuaaaauggcuucagagguaucacauaaaauacauugguaacgcaucacaucucuagcagggcacugacugaauuguauuuuguuuguacucugauuauuuguacugugcuuucuuccaaaaagaaguuuacauaggaagacaaacauuuaaaacuauuaauaauaauaauaauaauacaccugguugaggcaaguaauaggauauaaauacaaaauuaaacuccaagcuuccccauaaccaugaaguaggggaagugggaguucccauaacucucacugucuaguaaaagaaaucauaguuucacuuaggagaaauuauuccugggccaaacucgucaaggaaccuggucaaaagaguauuuaugccgggugugguggcgcacgccuuuaauccuagcacuugggaggcagaggcagggggauuucugaguucgaggccagccugguguacagagugaguuccaggauagccagggcgauacagagaaacccugucuugaaaaacaaaaaagaguauuuauaugaggaauauacaaaagucuaagacuuuuuugugggcagaaaaaaacucaaguaacuucauugcuauagugugacacaucacugugucaauuuugcuacaguuuccuuggccagacauuuuucucugcccaccaugcauugccuuuagugcacacugugucaacguccuuuuguaaagaugcgugacauaucugcgucacacacaagugauauaugcuaugaaucucagcaucguuguccuuuuagauaaaugcaucaucugagcacagaggugcuggguggaguagugguuggaggugcuggguggaguagugguuggaggugcuggguggaguagugguuagagcagccagcuguccagagagggcaaagccugggggagggaaugugaggccugaguggguauggcugagaucccuauagaauauucuuccuauacuuccuuguacuguuugcuaucaccccaaggcuccuagagaccagucuaguaggucaagcauuuaaacuggggaaaguuuaacugccucggguuguuaaagcuaaguuccugagccagaagccucgacuuaagauucauugggggaaagcagcaagcugagaaagccucugaaggaaggcagggauaaccuuggggaauaaacccuuccugucuuuccucauccccucuuccuuuccuccaggguuucagugagcauuggucugauuggaaucuucacuucacauccuuccuguucuucuuagcauccuugauuucugaccugccugcuuucucucccccaccucucucuccccacucacucucccuuccuuucuuuccuuccuuccuuccuuccuuccuuccuuccuuccuuccuuccuuccuuccuuccuucuuucuuucuuuccuuuuucuuucuuucuuucuucucuuccucuuccuccuccuccucccuccuccuuccucuuuucuucuguugucuccauaccugucucacucuuagcccaucucuuccucccuucccuaugacccuccuccuccuccuccuccuccuccuccuccuccuccuccuccuccuuuaccaagcacuucucuguuccucccuucuccuuccguuuucauauuuaucuguuaccaaugucauuucagggcaaagcacagaaugagaauggaugcuuucuuacuucuuacaucaaucauacacucagaguccugugcuaauauucucaguugggcuaauggaucccacaaaagagcaauuugcuccauucucggugguuauauuaaguccauuauuuaauuuauuccuucagcugcugcacuuagugcuuugccagaggcaucucucuugcagauggaacaagaagccagaagauuaaaggauugagcugaggcccagcaaaagguagugggguugauauaaaaccugacccaaauuccuuaaauccccgaauauauuauucuaacuaauacacuuaauucacagacuucacuauucuguaaaaccaaacacaagaguaagaaagugagcuuuuguuugcaguuucugacucugaagacauuucagugguuacacauuugccaguaggcaugacucaaggucacugaaacacugggugguuggaaaauagagcugaguuaaauaauuaauuuaaauagcaggacugucccuugggauuucuucagguaccuaaucuaguacaccgccugguccccuaucggaaaacaaaaguggccaucacuaugacagcucugguaaacagggacauuugugugguugguuuucccacuggcacguaagguaacugaggucacugcucucagaggaaaagucugucgcuuggaauuucuuuucucuggcaugcccaggauuuuuuuguuuaaaucaccaagucuuaugcucaaauugcggaccaagcccaacagcacgaugaacgccauuagaauccacaagucuaaacuccucggucuuaauuuaggaaagaaacgcagcuuuguggguguccucccucggggugagaggccacacucauagcuuacuaaccugguauucucuuccucucacaguuuugccagagucacuguucucuuccuacacaggaagagucaagaccacaaagaaacagaucgacaaagaauuuauacacagcaagagaauuccgacuuugccauuaucuacaguaauuuagaagacauuggcuaagagcaggucucaggcucauugguggcuggauaauaaucacaagcauuuaauaacaguaaugagcauuuauauuuaccaggcacucauggcuucuuagguaccaauuccacccuauagcucuggagucaaauggagggagggaugucaucucuuuuuggguuuuguuuauuuggccuuuaugaguuguuguugguggugguguggguagguguaggugugaguguuuguuuuuauuuuuuuuuuuacaaagguaaagaaguucauaacuugccugagaccacauaaccacucaaaccacugcauuugggccuccaacuuacucucccaaugucuucugaucucuaccccaggagguaggguuguggcuguucucaguuaacacuuugauguagcuguauguaagguucuagcuuugcuguuccccaaggauaugcucagaaucccuuugugucucucuaguccgguguugguuacuaagccucauugcugugguagagcagccuuaggcagaaaggguuuauuuuagcucacacuuugagggguacaguccuuaguggugggaaaauuacagcagcaggagagugaggcagcugucacacugcaucugcaguuaggaugcugagaaggaugacuguugcugcucagcccacuuucuacucuguacgcaaucccaggacccaaggccaggguauacgucagccuacauucaagauggaucuucccacuucaguuaaccaaccucucccuuacagauaugcccagaccaugucuccaaggugguucuagaugcugucgaguugacaauaguaaccccccacaaugcauuuuguuccuuuccuuggucuucauuaguaagagucuacuguuuuucucuuaugcauuccugcauaagguaggaguacauuuguacaugcaugaguauauucggugugcaugcauguguguguguguguguguguguaucucagcgugcacaugugauuauauguuuuuguggcucacauacauugugcaaaggacagaggucaaccauacuugucugccauacuuuuugaaaccaggucucucacugugauauggggcuugccaaugaggcaacaccaguaaaccauugagucccaggaauccuccugucuugcuuucuuagcaaggggauugcaaauauaaaccacuaugccaauuuuuauuauuuggggaguuuuauuacuguuguuguugcuaugugagugcuaggaaucugacugaggucacuacauaugcauggcagguccuuuacagacugaccgaucccuccacucugguucaaauacuauuuauuauagguuaacauagauggacugcuguuucuuugagcucagcauuguuucucaguaggaccuuucccaucccccauccauggcugggacucucacacuguuaugcaccuuugguggaaccuaagguuuucuuucuuccuuccuuccuuucuuucuuucuuucuuucuuucuuucuuucuuucuuucuuucuuucuuucuuucucucucucucucucucucucucucucucucuuucuuucuuuuuucaacuugaaaacaucuucauaccuuauacucaaaaucugcuaaagccaggaacaucccuugauccuucacuaggcuuagugaacuaguuuguucucuguauuuaugucuuaauuucacaccaagugauuuagcagcaggggagcuugacagaguuacacuuggguuguuugcuguuaugguucacuggauuuuucaauacucagguuugucugaguauugaaauacuauagguuugcaccuuuuagaaauuaaaaagaauuucaguugaagaacaaagcccuaccacuauucucucaguguaacuuucaauacaucugcuugaccagugaagauucgucucauacagaaacacuacaaagauuuuaaaagaauagaaaguccucaaagacuacauggcuauaaggaaagcuagggaaggucaggguccaaccacaagaaacugugaugggcacaggcaacaccuucauaugugacaaaaggaagaaaugauaacguucauguggaagcacaaaggauaaaaacauggugucaucauuagacuucuaaauuuaguauucaacaaauucauugacuuugucgaugcgaucugccugacaguaaguaagacagagggagagaccccacuuacacugcaagcuguucucauucaaaccaccacaacuaccccaccuucagaguggucaugugaccaguaagugaugugccaggacacaaggucuccaaggcaagauauccuuuauuuguagcacugaccaauuuccauagcguaaauacucaggccauggcuaauuccaagccacaacggugaaaucacuggggaaauuggaaagaccauugaucaucuggggaaaacuaucccuugaucagaaacaauggugcccaaaguaagaggcacuagguguguggauaaagaaauuccaacauuuccuggugagccaccugucguaggguuccucuggaaagagucuucccauaauuuagucagcucagagcagagaagagcagaggagaggagugaagagcugaaguguggggucaucauuuggcuccuuggagaugguccagccugaccguccagacggcaguuagacgggacagugaguccuuccugcuccuucucuccuucugccuuuggccguuguuguuuuauguucuuuugauuuuugguuuuuguuguuguuguucaagacaggguauuuuucuguguagcauuagcuaucuuggaacucacucuguagaucaggcuggccucaaacucaagagauccaacugccucugcaucccacgugcugggauuagaggcaugugucucugccacccaacuuucauccauuuuuuuugauuagucauuaauuuuccuuuuauuaauccugcccauacuggcuuuuguuuuauugaaagaauacuauccuuuuuuuuuuuuuuuuaaauucaaaaagcucuucaaaaggucaagccagcaauggcaguuaggaggcacugucucuacauaguccauaguucacucacucuaaggaccuuuacaccucucuaucuuuaccaaggaaacugaacugguaacugucuuguaaacaucagcucugacugcuguaaagacuguuuacacucaacacauucaaaguuggaaucucauucucuacugaaaacacacucuuucuacgccccggccuuucacuaacucauggacucaccgugugccugaccagggacaugaaagcuaacggguucacaagguucugucacuuaugaccuuuuguuccaaagagagacacugacaacacacaaacacaaaggcgaaugacaaaucauuaucgacuugaaacgagcauuuuuggagaggaaaugaaguacauuuaaagaauaaugacgggcuugcuguuucaaaugggauagcuugaggcagagagggcugcauggcaugaaagcagcauccaugagaauaucuggagcauuaagcaagcgggugcugagcgaguucuagcccugccagaagagccuaacuggaaccuagcaggcacgaagaaugaagagacugaaggauaucuggggaccagauuagguagaagauucuuagccucucggauuuuucauuuucucuguacauaauggggguguuugaaagacaaauccuccugguccgucuauggacuggaagggugcguuagagaaacuauugccuguugcaguuguccuggugagagaucuggcugguugugaugagcaucauucuaggugcugaggaggagcaccaaccaucacuguuuaagcguccaucacuugcugcaucccagggcuucaguuucuaugguacagggguuucucaagacauugucuccuaggcagacacuuguguagagguuuucuuagaaaugcgggaggcagaggcaagugaauuucugaguuugaggccagccuggucuacaaagggaguuccaggacagccagggcuacacagagaaacccugucucaaaaaccaaaaaaaaaaaaaaaagaaaagaaaagaaaagaaaagaaauguucccagugaagugugucauggagaaaggggacaagaucuggcaaagaaaggucaugggcaacaggcagagucuugaguuuuauagcugggaugaccccuagagcuguccuggguugugaugaaagacagaguccuccauaccccaaacaguaaucaaucaucccgcaaaacccugggaggaccgaggcguggccuggggugaagggagucgacagcugagggaucuuugcuggcagccuucccaguaacuugaauaguaaggccauuauucuugaaggggaacucuuggcacccaucucauggcaucugccacacugccucucuuugaauuugucacucgagcuauccugguuuaauuucucauuccucucacuuagccuacugucugauguuccaucaucagaguaacacccuguagucaaagccaagugguuccuuauugccuacagaguagcagaagccugugcucugucauagcacagcacucagaaccuucuaauaaccaccuaccguccgccuaaugcuugccuuauaaucugggcaggcaagcugaucagcacacccucaauuccauaguccaacaggagacuaucuccuccuacuuuacuuagcaaaagccuauucuuugagacgaguucaaauaccaccuuccucuuuggccucugcuucuauucaaguccccauuacauucuacccagagugacuguuggauggguaagaccagcagcacgccagugucauuuagucucccuuagucccuaaucucauagcacacagcagccacucaguaugucaacuugucuugggucaucccaacuuuuuccaguccuagaugacacucugaggaaugaaugacuguaagaaaagauucaagacccaaaccauuuauauucaaaaucggaucuagaacucugagcaagugaaacauguuuuguuucaacuuguucgccuuuaagguucugauaaugaaaauaguugguauaaaacggauuagucuaaguaaauacuaggaguaguagcugcccuucauaagcauacagacaagcguuggagcauggcuauauaccuagagauuacuaaagguguaacguuaguuauguaaagggcccgcccacggucucacccugaguacuguuguugaugagauucauagccucaaugaagggcucuuucacagcugcucuguggggaaaucugcucacagggcucuuguuuucucucaggaacauucuuuaaugagcgaagauauucuugcaaaacacucuggaaucugugcuuuccuggggcccuuucagucuggacugagaccuggguuuauaaugaagauuaugcaguuuuccaauguggaaauuuuuugaaaagcacaaagcaucauauuuaaaaaugaauagguucacagacacuugcaaacugaaaacaacccuagagauuucuuaguccaggggacaagaaaacaaggagauuaagugacuugccuaauucucacuaacuuauccaaguucuugaaggacaaaauuacucaauaacauuauccauuucagccaaaagaugcuauuuccuucaguauguauaauuuggaccaaaauagaccuaacuuguuaaaucuugucagaacaaaaagaaaaaaaaaagaauuuuguuuaugucuaagacauuguuauccuuaaaauuuaucuugauuugguauaacaucuucuuugucuuauaauuaacuuuuucaugaggauaaauaauuaccacaauuaucuaugcaauuauaccuuuaauaauucacucaaaagauauuuaauuaaauuaucuuuuaugcaucauacugugaacuaagaaucagaagcuuuaaaugaaugagcccuggugcuuucugaaugggccacauuuauagcugcuguguaucuaaguuguucgaguucaagucacuucagaacauggguucagacuaggacaugaucuucaaaggauaaguauuaaauauaguuagucacaaaaucagugaucggguucagagccuacugaccauauccauagccaguuaccaugacgugaggaauguucucaggaaacaaauaauacgcuccaaucucccucucuuuugcccuaggaguugaguuauacacaguucagggucaaauaugaggcaucaugaauuuuuuagcacaguauuauguuaugauauaauuuuaauguaugaguggaaauauuaaacaaugauuugcuaguguuaggugggaaacaaugucuccuugaaacaacucuggaaaguuuggggguggacacagcacccagauuucuuuuagugugcuucuuuuccugaaacuuuuaacaucucaaaagggagacagagcuuucgacaaggucaaagucacuuaacugaagccugcuauuguguuuccugaccuaaaacuuuaacaucucaaaaugaagacaaagcuuuugacaugccaaagucaaucacucugggccugcagggcuuggcccuggaauaccucggacuacguucaauucugugcauaaacaaaggauuguguuauuuacuaacacauuauuuaauugcuauagcuuaagccuccuuuaucuuuuuguauuauuaaagagaacaaauuauucaaaccauuuauguaagacucuuauagguacucaauaaucacuauuaaaaguaucaccccagugucacuuucuaagcaggucuacuuuuugcauuaggaaacaauucaguaugucuacacacucaagaucugcacaguuuagcuucugcuuccuuucuaaccuccucucccaccauccuccuuguggucuagcccuugauccacacacagcuggcuuugcaguuuggauuauuuuauuaguucacuggaagagaauggagcccuagagaauggagucauacagaccaacucacgagagauuaauguguaaugcacaacugauuuccccauucagacaagccagauguuuguguuguuggugaccuuguuuuuggaaaaggagucaaugagaauuugugagcuagaaucugugcccaaggaggaaucuuacuucugcuuacuaacuggguaaucccaggucaggagagcaggagacuuucuaguaugcaaucugcaucaaaacacuggggauaaccuuaggcuuuaucucugggucauaguugugacaauuaaaugggagacuaugccucuagcauagcacuuaagaccacacuacugugugcagucagccaccagccaauauuagcuauuguuucuagaagggaggccuagcaaaaaacguguaaagggaguuagugucagacaacuuauuuuuccaagaucuauuaauuguguagguuccgguugauagcuucauccauucaauaguuacaaugaaauagugucaaacauuacagaaguuccuccggaguccgcgguccuguuauuugcauauguaaaugaaugcauucuuggacauggaaaugcaaauucacaaagccucuauuguucugcuuacccaucuuccacuuaaagugcuuacaagguaaucaagacagagugccuuagcucagagcucucaagucauugcuacucugcuucacacaguuccaaccacuguuuccuucauugcuggccaccuuauuuuugagacagggucuuucuuugaaaccacagcucacugauucugcuaagauggccucaggagcccccucucuccacagcugugggguuagaauugcugucacuaccugugacuaucacgucucucuuuccucacacauucugaacuccucauccugcccaggauuccgugaaguuguuucauuuccuggaaucucuccccacccaccuacucuuuguccugacuccaaacuauuggcuucgggaauuccucccaggucccucaggccuucaucaucuuuagaaucaaguguuccuccuuuucugugcucuuccucagucaaaucaugcugaaggaccaacuggacaagagcauuucccuuuuguuuccuccagggcccuucacguaggcacuuagucagucuauacauaaaugaguagauuuacgcuguguaacagccugggcuuuccugugauguaaaguucaaguucaggcucugagcugucacaugacgcauucuguugcacagucaugauuggcagaggaagacguaagcucauauuuucccaauucugggggaaagugauggcacugggcccaucaaucauccaaacugagcuguacccuuuuccuaaggacauagcuggccuucuaucaguauagccuucuauccccaccacuaccccauuacacauaguaguuucuacaaccuccauguguaccccuccaucauucuccuuagcuuaaacuucacucagcuuaagcuauacccaucucuacccucagugacagcccuucccaucccuaacucugauguugccuuuuauucuugaaucuauucaaaccuucauuuucauuauaugaguguguguguguguauauauauuguuuuauuacuaccuguaauaauuuauuuuuucaucuuaucaagacagccugugucuuucugccuuagaaauauaugcccaacaaaaauguagaccuucaccucuugguaucuaagaugaauugguuccuagacccccuaucaauccuaaaucucuuauauagaaugacauagaacuuuaguuguguguguguguguguguguguguguguguguguguauaaaaaucugggcaguuuaaauacaucucuagauugcuuauacugccuaaggcaauguaaauucuacaaagauaguucucuuuuauuauuguuuaaauaaaaaugaucaguaaaaaggcucuguauuuucacuaugucaaaaaauaauuuuaggcccaugagaugggucaguauacagagcuagaaaaugcaguguaucccauaccucuugcauaucaucucuacuuaaacacacccuccaucuacacgcucaucuuguugcagguuugaggccagcuauguccuuaggaaaaggguacagcucaguuuggaugauugaugggcccagugccaucacuuucccccagacacucagaauaguagaacugagggggagcuuggcuaagucccguucguuugucaucucucuggccugaucuuaucuccaugcuacuggguuuucacuucaauggacacagaaguucugaggaacaugaaaggggaagagauuuggggcacacacccuaacccuggucucucagcuaugcuacccugucaacuuccucuucucugagccugcuuccucuucucuacuuuaggaauagacuuucaagcuuaagguuguguucaagaaccucuuacugacuuaugucacccuuaccauuaccucugacuauucccauaaugaccuaugaccuguuccuucugcuuucaccugguuaagguauucgaugaaaaccugaacaaaugaacggguaagcucuauaugauagcucaggccuggcaggcaugcaggagucagggaugagcacaggaccccucuccugucucuagcacaagcauaguuguaacaaagugccuuaggauugaacaacuguccuuuccuuuuuauagcuuguuaaaauuaucuaucugucugucuaucuauccauccaucuaucaucuaccuauccaucgauuuuuuucuucacagaucuuauaagcuuaguguccaagauaagguauucuauuuuuaucagaugaugucaugucuuccacugauuacacuuuuaaaauuuuacaaaaguugcuacuuucauuaaaggcuucuuguuguuguuguuuguuguuguuaucuugugugugugugugugugugugugugugugugucugugugugugugugugugugugugugugugugugugugaccuagggccuugagcuagccagacaaguacucuauugcugaacucaauuaccucuuuaaaaauaaaaauaaaaaauuuaaguacaaaacaaugggcuuuauugugauauugaaacuauuaauauuagggcuggagagaugguucgggguuaagaacacugacuauucuuccagaaauccugaguuuaauuccuagcaaccacaugguggcucacaaucuguaaggggauucaauggcgauuucuggugugucugaagacagcuacaguguacucauauauuaaauaaauaaaucuuaaaaauaaacuauuauuauuauuaauuauuuuacauuuauuuacuugugaagggaacaguacaugugugcuagaggaaacguggauauuugaggacaacuuuuaggagccaguuuucuccuuccacuguguggguccuggaguucaaacucagguugucaguuuugacaacaagugcuuuaaccugcugcaagucucacuagcucucauuaugacaucuacaucccaaucuuuucuacugccuucugucaaagccuugggaggggcagaagagcuuguaccuuuucgugcucuguuuguuuacaaagaaaacuuaaauuacaucagccauauuuuucgauauggggcuugcuugaauuuucuugcuuccauuugacuguaaugugagccagcacuuggagccauagaaacaggacaccauucaguaagcaaacagcuguaagugccaagagugacauacagcacagcugccauugaaggaggcuagguguccagguuggccaucacuuuuaacacauugaugugacaccagacaaguuccacagcaccaugcuguugacagagacuuacuuggauacaaugguuaguugucucugauaagaaaaaaucaaguaaccaguaacauaacuauuucuaccugacauuuugcuacauuccugcugggggagggauuugaaguaaaauccagauguagcucaagcuuacacugugcaaauuaguaaaacagagcucugacaacucagucuuuaacuagagauggaucucuggacagagucccgaagugcuuccauuagcaaaaccauaggugaacuacagugcauucgucugaucaaauugaagcucggucgccaggcugccaggggaauggaugauuugaacugacacugaugauauaaacagauacucaagguuaugggaguuuucugaaaagcuugaaguauucaaaaacaccauuugaaaaggcuauugugauuuugcuugugggcaucagccagcucucucgccuucuucucuuuucuucuaauucugacuucuacaaguuucuuuuuccaagcuaaagcaaacaaacaaacaacagaaagagucuaccauugaugacccccucauagcucugaaagagucuaccacugauaacccucuuauaucucugaaaguuuuccagugcaugcugguaguuaucuuuucucucuuccacagagccaauaagcuagaggagggcaugacagaacuguuuggcuucuuaguucccucugugcuggauaguuuuaugucaacuugacagaagcuaaaguuaucugagaagagggaaccucaaaugauaaaaugccuuccuaaaaaacaaaaaacaaaaacaaacaaacaaaaaaacgccgggcaugguggcacgcgccuuuaaucccagcacuugggaggcagaggcaggcggauuucggaggccagccuggucuacaaaguaaguuccaggacagccagagcuauacagagaaacccugucucacaaaacaaaacaaaacaaaacaaaacaaaacaaaacaaaacaaaacaaaacugccucccuaagauaugcucuagacaagccuguaaggcauuuacugaauuaaugauugauggggaaaggcucagcccauugugggugcugccauccuuggaaugguggaucuggguguuaaaagaaagcaggcugagccagccaggaaagcaaaccugccauggaccaccccagucuacagugagcacuuggcccaguucuugcaaauauauagaguauuccuugcaucagugauuuggucaagauugcuuuuggucugagccaaaacagugagaccuuguuuaagauuucuaaauuggucaucacaaugccaucuugcucaucauaggagaauuuacagaggacaacauagaaguauguggcucuaguagauagagaugcuugaagccaucuuuggacuauuuagauucagcuguaagugaagcccugauuucaggcagaugacuuuucucugucuuaccucccugcucccuaaaccccuggucauuucuugcgcaacuucucagacgucccaugaucacaccuuccuaguacuucuuagugcaaaucacuagccuagauagucacuuucccuguccucagacuguccaguuggugggaugucugccugccuggccucucuuguaugaggacuuuaagccucauugccguguguguguguguguguguguguguguguguguguguacauacucuuuauauauaguauauuuauucuuuuucuuuuaguuuaccuuaaagugucugauuuaguuuaauucuguuacucugaaauaaacacucuugacaaauaaagcaacuuagggaggaaagguuugauuuucacuuagagguuacaacaaaucauuaagaaaaauccggacaggauuuagagucugggcuguuuaguauucuacaccacauuaccuuugaccaaagaacucaacuuaacuaagagggacggcaagaaugauggaagaugauauuuccugauuggcuugauggucagcaugcacucaaccagccuuuuuaaacagaucaggaccaccugccuagggaugacgaugcaguggguuggacccugcugcaugcaaagcagacauguccauaggacacuuggauguaagcaauuucucaauggagauuucuucucucagaugucucuagacuaugccaagugagguggaaacuuaaggguuuuuuagaaagucgguugcaugguguuuugcuggggcaaauacaugaaggaacauuucauuaaaguggauacagaugugaauggcuaaggcauacuugugaaggaaaguuucacugaaguggacacaggagagaggauguucugcuaaagcaagcacaugaaaagacaugugaugaaggagucuuugcuaacaacaugcauguauuggucucccuuacauuucguaguugagcagcauuugucaggacuccaaaaaacuucugguggugugcucaguuucuugcugcuuacacagacucaggcugauuggaugcaugugaugaggcaagaaccauacugaggcaaggcauguggaagacacacgauguauggaggguauaaauaggacucuauggagugacagagagagagcuugaccugcugguacagcuagcugugcaagacuugugagucuuuguugaucuuugcuucccugagagaggcacagccaagaacuucuccuggcauccccaggucccuccugcugaggccuggcugucucugcuaggucgugucaccucuguugcuaaccugacucuaccgaacuggacugcugguguaucugugaaguauuugugaguggaucaagcugccauagcuugcugaccugugaauugaacugcuaauuuccagacaacauagaugggaguugcuccaaagaaccuuucuaaacagguucaccucucccucccgccgcaccacccccacccccauauccuuuucuacuaccucuagugugugguaggcuacaagggagguuaaagacuuuaagacccaucauuaaacguaagguuauaaaaauuuaaaguuacggccaggaaacaguuaaagcuaaccacgaugcuauccuaguguaaagaaagaacauuucaucauuuagaaauccgagacagaauguaaacagcucagguaauuuagaggcuauguguacuagccaaugucggcuaauguacuuguggcaacaacugacucacaauauuaauaaucgauaacuuccaauguuucuuucuuaggcguccuuauuuccauugcuagaugugccagaacucuggacaaaaacagaacaaaaacccaaaacuccuuccacacgcauggcuaguuuuacagcagaagauaaaaagaauagguagccaauggguggcuuuugaggugucuauuuagaaauagcaaagguugccugcagccaccuuacauuggccaaaucaaggucagguggcccuuacauucaaggcagcaagacggacagaaaaggaauagcagauaguuugaagacaaauauaaucggccucacaagaauuuuaauaaaacaagaggagagacucaaugguaagauaagugcagggccaguuccguguuuuauuaccucuagagcugggguguauaaacuuguacagaaggcccuaguccuacaaugaagaaaaggaaaaccaagcuuguuaaccaugugacaucucugauuucaucggauacuuucaagcagugucucgaaauaccccaacaaggugagcugccccagccagggaagccccuguguuacagacacaaugcuaucuucuucaugaaaguguggauaugagaaauccccaguagaaaaucucaucacaaacgguagcuuucaguuccuagcaucuuuacacagucaaaaacaagcaaaacagaguauucuaauagguguucuuuaaaaagcccuaggaauucuaugcaaaugucucuaauauuaugcuaacuaguuccaagcuguugaaauuuaauaguauuaauggaaagcucagaugaggugaaucuaaaaagccgguucuuccgggcaggugagaguuccagaaaagauuuuacuuuuaaagccuuuucauuacucuguuuggaauuaggcaauuccuguaaauuaaagcagugcgccuuugucuccccguuuaugggaaacuugacuuugaaauucacgagcaacucuguagugauaaauaugcacaaggccuacuggcaucuacuguugacuuaguuggagcuggcagucugcuuucuuuccccuccacucaaggaccucuucacaucucuucuuccuaaccccaugaugcuuucuuugaguguuuccccugcuguuucuuggucuucuuccaaauccucagccucucaggcaaauuuucccugggucuguccuuccuacgagccaacauacacccaauagcccgugugaucuuggaaacaugggagccgacccucucuuuucuaucuucacauuuguauaaagguuacagggacagcguacuacccaguucuuagcuguggccuagcugaguuagugaacuucuagccagguaugaugaugaaccaccucuaaucucaguacucggcaggagcaugguugaauuaggauggcccccauaggcucagagcuuugagugcuuggucaccaggaagcggcacuauaagcaaguauagaacugggacuuugagguuucaaaacccaagccaggcccagucuuccugcugccuguggauucagauguauaacucucagcuacuacauuggccugugcgccaccauacacaacagacggagccucugaaacuguaagccagucccagcuaaaugcuuuucuuuauaagaguugcugugguuguaguaucucuucacagcagcaaaacaaugacuaggucagaaggcaggcuugaggucagccugagguugaaugaaaccuugccuuagaauaucagucaauuucucuguaccucaguuucuuccucucuuaagaaauaaaucacucgcccaccacaacuugauagaucccuauugcucaauauaccauccuauggcagugacaggacaugguuaaaguugauauuggccagaaaucuuuuccccugcuggcuagccuuauagaaggugcucugcagguucccagaguuaagaagaagggagucaugugccuuccccagcugugaacucugggugcugaaauaaagacugguguggcaagauaugucucuagaugugauagcugcaugagucuuauagagguagccaacuggucucugauugaauuuuugacccacuauaugaaaagaaacacaacccaucauuggggaguucagaggcccuggaagcaaaacuacaucuccuauucuggugaaugggcauagcacugaccugcccucugcauccuuaucucuauagccacagagucgagcaucccucagacuucaucagaggaguuucuuuguacaccagauaguagugaaugcagagacucacaguuggcuaaagugcaggggagaagcaucaguggaugcuugcucugcucuaaguggaacaucuacaucucaucccuuccccaggcucagcaccuuggaggaggaggauuagaaagaugauaugaaacagguaucagagaagaucagagaaaaaacaaugucuccuacacaugacagggcacuccacccaugggcauacacagcagcucucauugccugcacaugaucaagacagucaauauauggaagaugaauggguuuaugagucccaaauccuaacuggggagcuauggacagcuaacagcuucugggugagggagaagacaguuuucuuuaaggguauggcuccugauagguuggacacauuccacuggaugacccuauccccaggagcuugugggaggcacaaauucaaguugaugcaguugcuggguuauuuaaaagaaagcuaugaaguuacaaucuuguggagugguagggaggcaggauauagggggaagaguuggaaaacgaauguaaucuaaauacagucuauuaaauuuucaaagaauuaauaaagaaauuuuuuuuaaaaaaggaaacacuacaauaucucccucaugggaccauugagaggauugcuuuggugagcauauaugagaugucugccuauauaauaugugugcaguacaugguagcuauuaauauuguaacaauguuuuggcucauucaaccauccuggucucuuuucacucccauuagaguugucauccuaagaaacaaacccugauaugucacugcuuggcuucugcuagguuuccaccauguaaagacaaguucagguuuucaaaggagccuuuaagauauccuuuaacagggcuggagagauggcucagagguuaagaacacugacccuucuuccgaagguccugaguucaaaucccagcaaccacaugguggcucacaaccaucuguaaugagaucugaugcccuuuucuggagugucugaagacagcuauaguguagucacauauaauaaauaaauaagucaaggaaaauuuaaaaaaagaaaaaagauauccuuuaacauucuacccauuuauaugucugguuuauaucuaacugccuacucacuccaacaccaaauuuauucccuggcccacaaucagauucccugcccuugcugugugccucuguacuccuuuagucugcuuucuugaagcaugcugcuauaacaacaauccucacuucucauguggcuucaacggugugaguuuaauuccuacuguauuauuuacgcauguccugcaggcuugcuuuagcuguacuucagugucuuuauucuugaagcaaaacugagccaccuguuucugaaauggauuucuccuuuagcagagaguaaaguguggcauuggaaugccuacauaguauuuaagguuuugcucagaaaugcacaaaacucuuuuaagcaauauuuuauguccuaggcuagucaugggaccaaccuuggccuugaucacgggugggaaaucuaaacuuaucacagagauguagaagaaauaauuagcaauaauaauuuaauaauccucucauguuuccuauguuugaaaugccacugcaucucccuccuccuccuucguucacacuggguucuccuguugccagcaagcacagccaucucacuugucugaguuugcucaggguucuggccccacuucuaauaaagugcuuaucacgcucggcuaggaguaucuguuuacaucucucuugcgggcaaggaucacuucuugguuucccucuucccaguuccaagccucucagaacaugcugacagaaugcaugacuaaagcagguuguuacuuugucaggcaaggcuggaagcccuuuucuguaugagcagacacuugugacauuauacaucuuuauucagacagucggagauaugaaggccagugaggaaggcaguuacuucuuuuucuccacuccagcaaacacaugugugugucauuuuccuauuuucucuuugcucuguugcuauguaccaagaacaaacaccuugggaagguacuguuuaugcguauuagccgugggcuauaaguauacauucuucaaaugaagacagaucaugccuuacaacguuuguuaaaacuuggcuauaaaucagaggauuugugaaacagacaagaccauaaaaauuaucucaaugaaucaccaaugccuuguuuuggaaacuguuucuccucugcacaccccaccccccuugaaaauacuacaggaaguugccaaagugcucaguuaucuccagucuacugcgaauucaccuccagcagguccucacugggacugucucuauuagucccuguuacuccuccccggauugugcccuaaggcugccuuuaaaauagaaaaucuuuguauuaggcauuaucuaacuucucucuccuguccuuugguccuggucucccaacagagcacaagacccuuccaacagacaauccuagauuuaugaucacuugucuaauaagcuuuugacuuugcaauaauguaaaugugauaaauauucuggaguaaucauaccccaaauuuugaaccucgacccccuucccccacccccagaggagaaaugcucagcaugguacuuugacagugcagggcagugguggugacccauagcuuccaagucccaauggauuacaaggucaacagcagcgguucugcgcaugcuauauagucaaggcaugauguuggagagcuguguauauuuucagccuaauaugcacuuaugaggacauagcccuauugugugcuuagaaucaccuguauuuguuuaugugucuguuucuucuuaauggaacuagaguccucugacaccaugugcuuuauaaucuaauucucuuuacuuggagcugguggucagcauugaaguaacauuuucaguuaaugguuaguacaucaacauguuguuaaacugaaggcaaauuuuguagucuguaguacaaguuuaagcauauuuugauaugauacaauguacgcuaacuuuccaugaguuguagagaguggauuguuuccaguagacucuguauguaaauuucaauagucaaauaucaguuccauauaagaguuuuuggaaguaaacuaguucucacaaagaauuauuaaaauauuuaggaaaaaacauaucaagaguccauucuggaaaagcaaaaauaaauaacucagauuaucuuaaauuaaaaagcucauacacugcuaaagaaaaauauuaacauagugaagaaacaaccuauggacuaggaaaauauuugcauacuucauauccaauacagagguaauagucaaaauuuguuaauaauucuuauaauacaaaagcaggaaaaaaaucaauuaaaaaugagcagacauaucuucaaaggagauauauauaaaaguggucaccaucaucaacaucacauuccucaucagaagaaugcaaaaucaaacugcuaugauccaccaguuugcacuuguuaggaaggcuacugucaaguguuagcaagaagaaaaggaagaacuaacaaacagugggaauagguggagaugcucguugguacagccaucauguaaauuaguagaugaucccuaaagagauuaaaaaugggacugugauaugauccagcaaugccccuuauguauguagggugaccaacguguagugugcucugcacuccugggcuccuuacaguguuguucuuaauagccaagauggaggaacaaucuguaucuacaaacagacaaauauaaggcaacugugaucuacagaaacauuuaaagaacagacucugucauuuacuauggcaugaauggaccugaaugacauucugaccaaugaagcauacaaaaccagagagaaaauacuccacacucucacuuauucauggaaucugaggaaugacggucacauguguacccagaaguuaacacuuaccacuaggaguggaguuagggaugagguaggaggggcagggaaacagguccagacacaauggcgcagauguaggaugaaccaguaucaagagcuaauguacaacauguuaacuguuguuaauaaaucauacuaugcaugagaauuguagaugauaaauaugcuagauuuguuucauugaagcaaccaucuuacuguaauaucacauaacaucauguugcaaccucgaauauaaguaauaaaauuuauuguaaaagaagaaucaaauaccuuuaagaggaacauuuuuuuuuuucaggacaggcauaauggugcguuaucugcaaguccagaacucugacuguagaggcaagaagaucaggagcucaagaugcucucaaccacauagucacaagaagccgaccugaucuacauggaacuggaauugugucucaacaaacaaacaaacaaacaaacaaacaaaacccaaucaaaacccaacaacaagaaacauuagcaacgucucauaaauacuggaggucaaaggaaaaguuagaaaacuauuguuggugcagaaaagcaaacaugucacucaggucuacagcuccaggagaauuuuaagucauauaucuuagaaaaacuaucccacaugcugacuuaaccagaaucguuaaaaaaaaaagaagaagaagaagaagaagaagaagaagaagaagaagaagaagaagaagaagaagaagaagaagaagaagaagccaagugcaaauugcucuauuuaauuaucucaagaaggaaaauuucagcuugguagcuguacuacauguuauguaagaggccaugagugucagagagagaaagggugaaagagcuuguaauuaaaauaaaccuucuuagagcccuggauccgcaugucagggacguggccagaggaagcaaggcuacuuauugacuuuugccaggguuauguuugaagguuguuuuuuaucauagcccuuacuuaaacaucagaguugaagcacaugaggacacaaagguucagugaucuccauaggcuucuguuaggagcagaagugccgugguggcccccgaaaauuggaugcagauuuucagaucccguuccaacuugguagaaagguucugugccaacacagacagaaggccugggucauuccaaagcacugggacauggucacacaaacagucacucaaucacucuuacccuucugcaucuagcuggccuuaaaauggcugucuaccugauucagcauagcaacguauuucccaugagaucucuaccuagcugauccuugguggauucgaaguuccccagaagaaccuguucauucucuuguucauccgcucucuaccaagauagcauguuugauucacuccauucaacgagucuuucucucaaucucccaugugcaaucaggagaguaugguaguaccaagcaucaaggcaaauauagcauuacuguuggguaugugcccaacauaauuccccuucccacacugaacagcuaaauauucacuucauaagccacaaugaccuauagauaugugcccaguggcucugguaucauaagcuuuuuacuuccugucugaaugaggcagaaucaucuggagcaaguaucugaagugaacuacauacuggacacuguagaaggcacagcagagagcuaggcuuaaccaugaccuauaacaaugcuugcaaccaucguuccuuuuccgugcuaugcaaagacagucucugcuuguauccucuauuaucaaacauucucccuucucauccaccaaaucugccaauggaggcuuaaucagccaggcuugugggcuaugaggguaaaggaauacuacuuugggagagauugaaggaauucacauuuuuuuuuugucauuuuaaaaggccuccuuauuacccaccucucguccaguuccgggugagguucagaaaauggaauucggaacuuucauguuaaggcaucaguguucacacaaggacacaccaacguuauaacuucaauccuuugaauuaggaaaguucuuucaacacuaggaaguuuuaucaguuauccuaccucgguuagguuuucaguaaaguuuauaauguaaaaaauguucaauggagauaaaaaaaaagucucauuggcuuagaauauuuugcagggcauggcaggauagaccuguaaucccagcuacccaaaaggcuugaaaggccaaggagggcuaaaaggucaagagugcccucucugggcacugugugcaccccuuuaauucuagagguagguggaucucugaguucaaggccagccuggucuacagaaugaguuccaggacagccaggagcugauuacuggagcccugucuggaaaaacaaaaacaguucaaggccagucuaugcaaacuacaaaucccugucuaaaaaguaagagagggccagggauauggguccgugguagagggcuucccagcaugcaugaaguccuagguucaauuucacugcuauaaaaaaaauuaaagauauaagauagacuuuauugcaccaagaucuguauaaccuggauccccuuaugaagguucuacccuagaauuccagaugucggcuacuugucccugguuacucaggcagaagauuuaaacgaggcgcucaaguggguuucaugauugccauuugcaaacugagcuuuaugugagaucuccugcaaacguuucccaaacacuauagacauagcccauauuuguguuaaaaaacaaaaccucuccaaagugguaccaucugacucauggauggguuaugaaugcuugcuccuggagcgcauccaggccccaggcuccugcaagcaugcaauuacaccaggcccauuacaucaaagccauucucugugcugacuccaguuuuagacugaguauguuguuuuaucuccuccuacaucaaaauacaaauaguucagaagaaugggaugcaaaagacagcgcauuaaucuuccuuuaacuuucucacuuagaaauaugcucaccuaguaggaaggauucaucuguucccaagaaagggagcagauuccucccauucauacgcauuuguaccacuggcaacagcuaauaaggcauuuuugagccuugugugcacaccauccguuagucuuuaccagucuaugagguuggauauuagcucccggugagagaacuucaaacauuuuuggaucauccaagagccaggcucugggaaucuguucacaaaacccuagacuucaugauucccaguggaguccggcuucuacuucuuagagauacugaagucucacaaagucugauggaaaaagugccguuauaauacaguaaguuauuaaagggaacugagguacauggaggaggcccugaccuagguaaggguggaagaaaaggccaaaggaagauauguuaaugucugcuauugagaguugucaagaggaacauggagccugaaguggccacccccuauagcugggcaggacuuccaguggacagagugggaaauaaaccuauccauaaaaccuucuacccaaaauuugcccugcuuacaacauaugcagggauaaagauggagcacagauggagggaacagccaaccaaugacuggccuaacuuggacccaccccauggaagaaagccaaccccugacacuauuaaugauucucugcuaugcuugcagacaggauccuagcaaaacugucucccagaggcuucauucaguaacaguggaaacagaggcagagauccacagccaaaugucaggcagagcucgggagucuguggaagagugaggaauagaauugaaugagcuggaaaguucaaggccaccacaagaagacuuacagagacaacuaaccugggcccauugaggccucacagagaucaaaauaccaaccgaagagcaugcauggacugaccccuacacauauauagcagcugugcaauguggucuucguguguguccccuaacaaugagagcaggggcuaucccugacucuguugugugccuuuggauccuuugccuguagcugaacuaacugcuuggaccucagugggagaggaugcacuuagucccgcuucaacuugaugucccagggcaggcaggcuguuacccaaggggguguccccuucuccucagaauggguaaaugggagagggaugugugaggguggggcugggaggagaggauggacaaggcgccaugaccagaauguaaagugaaugaaugaaugaaugaaugaaugaaugggggaaagaguuggaaaggcaagaacuaaggagccaacacagcuauacauugcuugcuaggcaaggaacuaaguucauccacacacauccacacauucacacacacauauacacaaaucugcacacauucacauaaaucuacacaaacacacauccacacacauaaacacacaucuauacacacacacacacauauauauauauguguauauauauauauuuauauuuauauacacacacacacacacacacacauccacaucgauccacacaaacacauauccacuuuacaaacggcacacuugcacccaaagagcuguugagcaaagaagaacugguacaguaaacacaguaaaaguucucacaggaggaggagcaagaugcuacuggauauggaggugucaggugauuccucugaaggacugaaucaagagcuacugucgacagauaaaagaagcaauggaagauaagacuggugagggcagagcagacucggccuugggcuuuaucuuaaagacaaugcaaagccauuaaggucgaugguggcuaugaguaugugggaagaaaagaauacccagagauuuugagaaauuuaauuaugagaaaauaacuaacuccacgugaagacacuuuaaagugacugguaguccagucugagcaacuucaugcccucagccucuuucucacuaccagauuaauugaaggaccagaccaaagcuuguguacccacacuaggguuuccagggauccugcucuuuuguaguggcuauuguagaacuggaaucuguauucucucucucucucucucucucucucucucuguguguguguguacagguacacacauacuuauaggggccagaggugggguauauuucuguguagcuuucucccucccucccucccucccucccucccucccucccucccucccuuccucccucccuucugaucucucacugaaauuuaagcucacuuacucagcaaaacucccuagccaggacucuccaggaaucuuucugcuuccaccuccccagugccaggaucauagggucacacacuuauaugaguguugcggauuugaacucaggucuucaugguugcauggccagaaugucauugacugagccaucucccgaucugaggaagucugcuuuucugacccauuuccacauccggggcgcuacaagugaaauuuccuugcaaguggaggccucgggugcagcuguccugcuaacaaauccccacugcuugccugagucccggcaguguuaacuggaugucagcaucuggggacagauaaguagacugaaguuccgaagaaaaagacacuacuaguccaaagcuacccagguauacaguucuaggcuggaaggcaagggucuguucccugaaagggaaauugcuaaggcuuccuaacuaugcucuuccuagcuauccucuaacuagguuccugcucccagaaaaaggagauagaaaacagacugagaaagggaaggcacggggaagaaacaaccuugacacagagacgacgucucuugggugauaugggucugcaccaucauuccucaggguuucaacauccuuccaguaauugauagacaccauuguacguggagguggcuucaccaagacauagaguuuugaccauagucaacccauguccucucauccguaaucgcucucucucucucucucuugaucccuucccacccucagucucuauucucuuuccgugucacauguguaucaugacuuauguauuuauauaacacuugagcucuguaaaugacagaagaugugcucuuugucuuucugaacacagcuuagcucaccuaacaggaccuguuccauccauuuccauauagauggcaaguaucguucuucuuucauaacugaguuguacauauauaccacaguuuuuuuuuuucauauagguuaacuugcccaguguuaacagggccacagggaacauggauguguugauaucgcuaacauucugaccuagauuuccuuggguguauucccgggagugguugccuaccucacuauuaaaaagccucauaaaagucaauguuucagcaagaggaaauacauuuuuuucaguuccaacuaaacccuaucccucuccuuuacuuuuuuucauuauguuuucuacaucugguuagagcucuuauuaagauaucuacauuuuacuuggauuaaaaaaaacuuuaagaaacaagcuauagcggaagauguaaauucuaauguaacuuuaguucuguuguauaaagauuauuauacuuauauauucuguguguuuguugugaaaggguugugccauggugcauguguggaagccaggggacaacuuuugggaguuaguucuuuccuuccaccaugcaagaccugggaaucaaauucugguucucagaauuggcaaaauuguuagagauacuacacauccauguucccugcagcccuuuuagcaguugacaagcuauggaauuagccuagaugagaaauguagcauauauaugcauagcuuggcuaugaagaauaauauuugccaucuacaggaaaaugaauggagcugguccuguuagaugaacugggcccuguacaggaagacgaaugccauauuuucucucauuugcacauccuagauuuuguguacauaaauaaaaucauuaucaguaaagacagcaaaagccuucaccugcuaagccaucuugauagccuggguuuuguccuuuuaaugcucagaaaaagccgcuccuaacaggacaaagggcacauugagaucugucacaugguuuugauaguuucucuuaaaacuaagaagaauugcuuuaagaggcacugaaaagugcucugaucucucuguuugcuuucaggucuucuaacuacaguuucuaaugcuucucuaugcucuauccacaggauaggauaaaucaaauuauguauaguuccuucuauguuuauauuucuugauagguauuauuuguuaucacugaagacguccuugaacuuguucgcaggguuugcaauuguauucauugggauauugacucuuuaacuguacuuuuuaacuuuccccuucaucuuuauuuuagaaguuagcuuuuaauccuauuagauaauguuuagacaagacauagcaaugcauauaaucauauuucaaagaacugcggacauaguuccagucccuuaacuguaaaacacaauuaaauggguuaaaguaauucugcauguugaagauaauuuaauuuuccaacagucaguucucaaacaaaugacaaauuauucaauuucaacaggccaaaaaaaucuauuccugaaaaugccauaaaauucaagucuggugucauuaaauuuuuaaaaagugaggccaggguuaaggauacgauuucacaaccucauuccauuaaacaguaguucauggcaaacacugcagcagaauaagcagcucuauaaaacuuaauucacaagguaaaguaggcuaucaaagggucagaaggcagaagagaggcaggggaggagagacagagguccucucucuuuggcugcaucugcgggugaaugguagaccccaucaguccauaagguucugcaaagagaggucccgugcaaaaagguccugugccagaucucuuaggucaaucuggagagggggaugacaguuuugagaacagguaucucagugccuuuucuugaugcugugacaaaacaccagacaggcaggugcugcaaggagagaggcguuugggggcaagcccagcggcaggagcugaaggccacaucaccccugcagucaggaagcagggagagaugaacgcuggugcucaccugcucuccccuccucucuucucucuuccccucuccuucuaccucugcccuccucuguccaggacuacaguggagguaguaccaccuugauacaggauaccuucucuccucuguuaaacuucucuagaaaugauacaccgagaggauuguuucuuaugugauuccaaauuaagccuaguuaacgaugaagguuaacuaucauggugcaaguggagaaacuaucacuugucccagauuaccaauucuuuuagcugguccuuuucaucaaauucucacaagcccagaggguagcccucauucuaaugacuucucacguacugguagugacacaauucaucaauuaaccagaggugacuguauaaaugcaauaucuagaauuagccagaaugacaucugaugauuuuuuuuccuuccuguacucaagauagaaggaugggugucagacacccauuuucuauuagugaguuccuuacacaugagaauggauugcauccuuugacucugaugcuuggaggcagauccugcaggggacuuaugaacuguggaagcuccagaaggaguggccacagaguggaaaggagcacacaggcaagaggggagaugugagaaauuaacagaggaacgagaaaggagagaaaagcacuuaaaauaccaugugcaucucauuauccuuucuuccaucccaccccaccuauuucuuccaucccaccccaccuaucuauucuucccucucaagaucccccuucuaguuucauauccuaaauauacacacauaggcacacacgcacacaugcacacacacaugcacauauacaugcacacacauucauuuuaaucuagguucugcauaugaaagaaaacaugcaguauuugucuuucuggguccucuuuauuuugcccaauggcuuccaauucuaucuaugacauuucuaauuccugcaagugucaagauuuuauuuuuccuuaugguuguauaaaauucaaucacggggcuggagagauggcucagugguuaagaauacugacugcucuuccagagguccugagguucaauucccagcaaccacaugguggcucucaaccaucuguagugggaucugacgcccucuucuggugugucugaagacagcuacaauuguacucauacauaaaauaaauaaauauaucuuuaaaaauuccauuauauauauauauauauauauauauauauauauauauauauauauauauccuauuuccuuuauccagucaucuguugacagauauguaggacaguuguauuuucucuguauuauuacugugaagagcuuaauaguaaccauggauguacacuauguuuaugauaagaguccuugggguguuuauaguuagucuuaugucaacuugacacaagcaugaguuaccugaaaggaaggagucucaacugagaaaaugucuccauaagauccaauaugaaggcauuuucuuauuuagugauugaugugggagggcccagcacacuguggguugaaccaucucugggcuggugguccugaguucugugagagagcaggcugagcaagccaugaguggcaagcauuccauggcuucuguaucagcuccugccuccagguuccagccucucuugaguuccuguccugaguuccuuccaugaucaacaugaugugaaaguguaagccaaauaaagccuuucuuccccagcuugcuuuuuggucacgguguuucaucacagcaaugaaaacccuaacaaagacagggcauguaaccaggugguguacagguggcucuuaccacaguucuguuuugaaggacuuuugagaaaccuucauuucuucauaauauugauuucaguauuaccuuuaacaauucacauuccuaccaacaguuuauaaaggguuccucuuucucuacauccucaccaacguuacccuagugauagcccuucaggcuggugggagauggaauucaguuuccuuuuggaaagcaguuuccuuuugcaguucccuuaggccuuaggauagugaacucuucucacguauuuuuuuggccaccagugcuccuauuuccccuuccacucauacuugcuaucgacacauuugacaguggucaaucuucgaaauucaugaaggacugcaaagcuaaacaacacacaagucaauaaaauggguuaauaggcaaaugacauagcgguaccagcacccucagucccaccucugucuaugugcaguagguggggaaccuauucuggcuucacguugucuucacaaucacacuguuccuauuuuacacagggacgggagagcaagugguuaagaacgguccccucacacccuccaaagucagggaucaguuauuucacgaucugucacauuuuacccgcucuuagggaagccuucagauaaacggucuaaguggcagucagaagcacaauaaaagucugucuacuuuagcucagcucccacuuuccugugcacaggcuuccugcuccuugcauaagacagagcugacagcucacauagccaugcuggccagaaccaggcagcuugggcuaccgacucucguuuaugcucuaacuucucauuugcucuguggaauggggaguuuggcucacugaccgcguuuauuuccguucaaagcacuggaaauaaaagguuugugcagauguuuccagagcagccuauagacucuucaccagcgucuguggucagugcagccaccagagugcggagccaugacucacccuaacuaaacuggagguugccgcuucuuaaaauauuguuuuggucuuacucucaggaaaguugcugugucccucacaaacacugcuaggcaggcaggcuggggggagggagggacgagcggggggugggauuaugugaacucuucuguguggccaaaguuugcuuuaacuaguuuucuuuagcucguuauuuuuaagccuaccuuugaccucaggggaguuucuaagcuacaucguaucuggucagaucuuugcauuuuauaaaggauaaagccgagucuagcgacaugacccccaucaguguguuugcaaccaaugccagcucucugaguuacaacccacagcuccuucaguuaacuccaugccaaaucuuagauuuaaaucuugaauuucuuuugcuguucauugcauuuucucuucucaucucucuuuuuauaugucaauauggugccacagccaucuaagguaaaauguauuaguagcccauuaaccucugcuuuauacccauuacuccccaaaauaguuaaauaacucuacuguuuccuacugauacagcauacacauucaacagaagugaauacaagacaaacauagaugaguaacuuuggccucacaaaugaaagaaaccuuauaagauauggaagcuuguguaaaagagugguggguguguccauuugauuaaagagggcauggggacuagggcuggaaaacaauggaaauaguccacagacuauugccagggucugggguggagggaaaaggaaagaaggcuugaucaaguggaacaccaggcucuuuaggauaugaacuucucugcauguaauucaguagaggugcauaccugccaucauacauguaucuaaacccacagaucacaguuaaacucuaauauguacuguggccauuauuucuaauaaccuaauauugacauaucaauugcaaugacuauaucauacuacugcaaauuaugaguagcuagaggaccuagagguggaaggacagacaaggauauauggaccuuucugugcuuuuucuuauuauuuuguuguuguuaaagcuaaaacugcucuaagucaucuauuaaucacacacagcuuaaccauuuaccaucaaauauuuucagauaaucaaaauaucacuucuugauaauugcaucagcgguaacaugaggacaagaugcagucauucgguuucaaccucaccauaugauucagauuuauauaaguauuuaucauagaaaacaaaacagaguaguauaccuuuucccagguguccagagcauccugucacucaguccccuggugagcagaauucaugcuugauuguuagucccauuuccuuccuuccuugagcucucugugcauugcacagacuauacaacuguauauagacgccacccccauaucgcuauugacuucucuaccccagagcugucauuacaguggccggagggcaaaguaggacagucucaguggaagaccaaggaaugacuagagaguaugucuaacagcacauaacccacaaagaauacuguuguaugggacaaacaaggaggaaccacaggcagaacucagacauucagauggggcaugaacguauagacagaagcccgaaggugaagagagacacagagaccagccauaccauaccuagaaggucacaucuuugaggccgaguucccugagcuggaaucuggagucgccaggggucugggucagucugguucuguaagcaaagggccaggauccugcaggacaggcagcuuuggggagagggugaag

SEQ ID NO: 7673 - RNA, 7258 nt, Mus musculus
aaugccucgcuggcuucagcuacuugcgggaagugagacugaaaaggaccaagacuacucugcucacaaaggagguguggaagaacccauuguuuucucagugucugcacugccugugucacgccgagcugggggauacaauuaucuuacguggaaacaaguuacuaccaucagguaucaacagucagaauaggaaauuagaaagagagagacggagggagacagacggacagacagacagaaggaagggaaagaaagaaagaaagaaagaaagagagagagagaggagggagacagacagagagagagagagggagagaaagaaagaaagagagagaagagggagacagagagagagagagagagagagagagagagagagaucaagcucacauucugcaagaucacggaacuccuaauacagaacaggggcccaacagucaaucaccagagacaagacucuuaucgcacagcucuaacaauugcuuggcaugaaacuccuuucccaaacuuucaauuaauauaaaggaacauauauuuagaauaacaaacagauuaggaguugggaagaggaaauaccacaaguuccugcuauuucccaaaauagagcaggcacacacacauuucuucugugagaacaacauaccugagcuuggcacagcucauuggucagucgcaagcccgaagaaccaaaacaucacauuaagaaaaaaaaaauuuaaaaaaaaaaaagcaucugaauuauucacucccauguaaauggcugcuccauugaaaucaaaagugaaaauuugggcuaucucuuggaaaucacuaugacuuacuaaaaggggcuguguuguguuuuguuuuguuuuuaauacuuccgacuugaauuucauggcagaaggaugagauuuaaggcaacaaucugagaguguguuaacuguaacacacaugguaaggccuagagccuagguggagaacucagauaacagacuccgaagaauucugaccaaaaaucaggcaagauuauuucuuaagguuuuucuuuauuugcucaucuacucaacaaauaaugcaggacggaggugcagccuuggcugugcgugccacaggaaacagcaagcccugucccugaacuccuggagccagcauggaggaauucuuccacccucuucuccaugcgcagcaccccaauccaagcacaugcccgcagccugccccucuccccaguaguagcauagcaccgugguggcccuauggcgccgccuggauguugauucgugcagugcccucuaccugagcuacacuuccccuuucuccagaaucauacacugcucagcuccuaccaaucuacccuagggaggcuucucgggccacaggcagcagucuucagggcgacccuauccaccucagccacgccccucucuaccucagccacgccccucucagccacgccccucugccagggcaggguagguucguuucccugguccuuaaccggauaccaucuuucuucacugcucucucacguuuuuaauccaucuccacaauucagauggaaacucaugacagccagucuguuugucccguauaagcuggaucucaguuucccgaaaauugccuggaauauuaacagaagacugauaaacaccuauuuaugaagaacaaauauggaccaguguuaacaacacuuuuguauugacaccacaauguuaggucccaaagaaaacaaagaccauauucuaaaugcuaagaguggauuggauuuuaauuagauuuuuaaagguuccucacagcuuauagaaggaggaggaagaggaggggauuggaaggggagaagcgagaagacgaagaagaggaagagccuccacauaggaucacauaaggcuacauaaugcauugugcucaaaugcuagcauuagcgaggccuaaccucuacaauuuauucugcuuccaaaaucacucuuaagagaugccaaggacaaauacuuucucuaacaaugaagguguaaaagcaauuuauucacauuaaaguagaagccaguggugaucaaccacagaaacacagacuuuauccuaaugagaagcaaauuuucuggaacacacacacaaaaaaaaaaaaaaaaaaaacuccccugccuucaauuuaauaauagguauaagccuucacugcauauucaaaaacauuuaaacucuuaggauuuuuuuuuuaaagacaggaucucauaauauagcccuggcuuggaacucaguacggagccuaggcuggcauagaacucacagacauccaccugccccugccucaggagucaugggauuaaaggcuccacacagggccugguggauuauucuuguaagugcacaguuuuacuuuguuuugucauuaggaggaugacuuuagguccuggccaucauagcucucauuucacagcaaagaugccacaaauccccaugggucacuuuggagucauuaaaucagagaaugugcacugggcagagcugccuccacuuccugcaaugugaggacgcaacuuuggggcccugggaauaacugaaacccacuuaaaagccucaaaaagaaaagugcuuuacaacaaccucacagcaagauaucagaagacuauaccugugaagaaagagaaccuuaaguaaaauauggcuuauccuuaaaggaguucucagauguugugucagagggagagggagguggcucccucgggggauggagggaugggggugggaagaacacuggagacugucuggacuuaggacuucauggggaggcaaagagcugguacagaacagggcaugcgacuaucccagccagcagaaagacaaaaaagagcaaaaugcuaccaagcauugggcuacauucggagagagaaaagagccagaaagcuggugcuuacugaugcuaagggagugguaggagagagaugugcccuuuacucugaacuacguaaccaguggauuuucucuaaugugaagaggugccccacaaauuaauaugguaacgucuucacaccaucacuacacuauuccuaacacaguccccccaaaaaugagucuuccguagcaaaaguuuuuaaaacucaggaaauaauucauuugguuuuaaaagcacaguccucgguccucauuccccagaggagacuccaagucuccacucacuggagcagagcagccugugaucucaccucucacaaggcaaacacaccucagcucaacucuggccugagagcaaacagcagcuccggccuccuugacaauacgccuccuauugaaacugagcuuaagguuccucauggaugccuccaaaugaacacaguuuccaccugguuggaagaaggaaagucagggagagaaagaaaagagcacaguccaguguuuuuuaaaagcacaggcuaugcugagauuugcuucccucugccagucucacccgaggagccucugcuccuaguggaguaugacuucagaucugugucaagauaauccugcaaggggaggggacggcaucaguugcaauaaacaaaugcuuuaguuuuucacugggggcggugcuuuaaauauaacgugggcaccgcuuuugaacuccugacuaacguaaagucaggucaacucuaagcaaauauuauuugcuggguuaaauaugcaagggaaggcauuggauggcaaaguuuaaacugaaaguucugcugaaaaacccacuuuaaagaaacaaaguaaacgcaaagaaugcauguaacugucagucaguaacagcgcacguguccuuucaguaucugacugcauuaaacacagcuacagaaagggacccaaagauaacccuaguguaaacgaaagauucgugugucuuggcagcugaagugggggcuagaaucacauaacucaagcuccuguguaaguucacaacacuugcugugcaguuuucugugcgucuggguccacgaucucagcuuugugcuuuagacaacacauccggaaagccauccauuaggaagccuaacuuugcuugccuacacuuuaacuugggaguuuaauaaguuuagcgccuucggacacaagcaccuagaacuacagacaggucagucaaaugcaccaucaaaacagaaaggacgaggaacuacuuuucugaagcgcugagguuuaggggcaggaaaccaucuggcaggucgcagcuccgaauggggaauuaaagguccugcccaucccccugguaaccucuggccuuggaacucagugcccuucgcgccgcacaaguuucccgcgguguagcccgcgugggcgcgggcugcaggguugaccccucggcuggcacggacggcgugagcccgaguggcguugccccagagccggggacgcgccccccgcacgcgcuccgggcugccgcgccgcgcccccgcacucaccagccgcucccgcgccgcuaucuugccaucccagucggccgccgccccggggcagcccggacccugcagcacaggacugcaguccugaaggagcaguccggugguagcagccgccguccuggcgccccuguccccuugcaggccggcucuagcggccaccgacgaccggccgccgcugccuucucccaaccccgcgagccaccgcagcgccaggcgacgauaacggccgcggccacugccgagacgcuccggcgcagacugcgcgcccggaggcggcgccugcgaggagcucggcggggggcgcagcacccaggccccgcccaggccccgccccgcgcgcccccgcagccuucuccgccgucccugccgcgcgcacggggacgcgggcccgcgggcccgcgaggccgcgcgugagucggagccucugggucgcgcgcgggcccggcgcccagggaggugccucugccgagacuccggucgcgcggccagccuugcaaggucaccgagcggcgggcgagagcgcagcggcccugcgggugcaaagccuccggaaaggccagcggagcccaggcggcccugcgggaagcagcgcggcucccaaaccgcugucauugcacuuugcaagccgugcgcggaggaggaaacucgugucgccccgaaaaggcacacggacgccaauuacugcggguuuuuuuuuuuuuccuuucuuucuuucugauuuugugcauuaccuaaacugcccccaagccggggcgcugccacucaguuccccuacuuucuuggugaggggaccucucagcuccugagggccugcgggggcaacugagaacauccuggagccaucuagucgugccucugaggcguguugggcuuauuugugcagagaagaaacggaucccuuaauggggugagauuuuuccuccgugcauuguucccauuuccgcaguuucacuuggccucgguguuccuuccagaguaaugcaccaaaugaaauugguaggaguguuuuauggcgcagagucgugguuugaagauguuuacgcucugugccggacgcguuugaugguguucucuuuagcacaauuaauuuugcaaaguucagaaaugugccagacggagccacuggcacgcagucacauggcugugcagacacaccuuccauagggagccgcuuguuuguuuucagaugugauuuaucuggugcgccagggccaaggaguuugugagggaccuuugacugaaauucuagacuuuagaaucuacagcaauuugcaaaucggcaggaugaagcuuauuuucuaaaauaaauaucccccguuaauaauguaacuccaaaaugggcaacaagacaccugaaaauauacugcaugaaaaaauaaauucuuaauaacaucuuucaaaauaaagucacuaagaguauccuagugaccaacuccacuaaagugcauauuuugaacaugaagugccuccugcuguccaugacuguuucuggacugugcugaacccgcccccauuuaaguuggaccauauugcuuuuccuuuauccccauucuuucccacaacuugagagacuugguauucauauugcaguauucugucuuuucuauuagacacagcaccuauggcucacagagcuuuuaggagcuaacaaaaguauuuucauuuguuuucaggucagaagaaaaaaauagauucaaguguuuuaauguagaauaauauugcuaucuuuguaccuaagguaaacaaaauaagaauguuuaauguuuaauaacuaaagagacucauacauaucuagaguucaugaaaagcauggcacagccucguuguccaggaccuagcauccuuuugcauggaaaaaaauagauaaguaaaccucagacaagacaaccacaugauuuucaccuugcauagaacgcuggccccuguggccuugcucucuugauaugaauuuacuauuuaauccuuauaacacaccugugaacugaguucuguucccacauguaggaacagauacaaauuucguggggccugaaguuugugcaguuuggguggcccucuuaaaagagcaaacaaaacaaaacaaaugagaauauccaacacgguccagaaccacucagcaccugggggaacaaagaggccgggcagccagaaagaggccucugucucagccauaguggcuaaguuaccuuaccuuacaaauuguacaaagcacacauggucguauaaacauacugccuagguuuucucguauagggacggagaaaagcuaucuggaaguuugccaucacagaaaaacccgcuuuguauguacccauuccacaggcaagaguuugggaaauucgucacaaguuguuuguugaaaucuguaacacuuucaugauucuguggaauggcuagaagaauugcaguaugcacacuucucuaggagaaagaaugguuucauauuuacauaagauagauaccauuuguuauaaagaaaccacuuuuaaaaauagcaguaaccauguuggaugggaccaguccauaacucaugugaaggcauuugcuaggacucugccaucagugaugccagaggcaagucaauucuuuuuaucucuguguuaaaaaaaaaaaaaaaaaaaguaaauuaaccaggagucacagcucaauugcaagugccauggauggacccuauuuuugucuccuuuuucuggauccaguguguuuuuaaauaucacucuauauaauaucuauggauugcauuuucaugagaugcuauaauguuuguuugcuauuuaaauggcauauuaggaagagccugacacaucuucauaaacgucugacagacaaauaaggacaucgagauaauaaaucacauaauuaga

SEQ ID NO: 7674 - RNA, 226157 nt, Mus musculus
cacuuccgucgggcuugccgggagucgcgcgcugcugcauccacggaggcggugggcucgggcagucauggagcacucgggaaccagcgaagguggguguggguuaggcgggccagccgggguggagggccgugcugggcacuggagcgccgggcugacggccggucuguccuuuguuucuugcuccagugacaggcgcagacacggcgggacccgacccucagcuggcggucaccaugggcuucacaggauucggugagugacugcccggggcagagcccagcccgacuucgcccggggcuugcgaguaaaggguaggagagcugccacuuuugaccggcgccuuccgccgugccaaauccgaaucggucccauuuaaacuguugagaccaguucaggugacaguuggaaaccuugacggaaagggauuacuauggugacccagucugagaaagacauuuaguggcgaccauuaaauaacauuuugguggauauagcguuucuuccucuucagucuuaauguauacccuggucuugucacauuauuaggugauuuaaaagaaaaaacagucucaaaagacauaaucaucuguuaauaguaucagugcuagaaaaaucaaauggaaauugaccuguaauuuguuuugggaacaaaugucucucugauguaccuaguucucauucauucauuguuucauuuauucaucuacuuagcuucuucuagguaauuagucgauaaaaggguaguuacaguauuuacuuuuuuucuuucuuuucucccuucuuuucuucuuuuuccuucccucuuccaccuccucuuuuccucuucuuccuauucauucuccucuuuuguuuguuuguuuguuuuuuguuuuuuucuagacagguuuuguguguguguguguguguguguguguguuuguguaacaguccuggcuguccuggauaucacccuguagaccaggcuggcaucgaacccguaaagaucugcuugcuucggucucccgguugccuggauuaaaggcuugagcuaccaccacccgguggauuuauuuuuuuaaaagauaaauguauauauaguuauauuucugagcgguuguuuugccucuaugucugugcaccauuugccugcaguaccuaugggggccagaagaggucacugggucccauggaacuagaguuacagaugguugugagccaccuugugggcccugggaacuaaacauguccuuugcaagagcaacaaguguucuuaacuugugaaucaucucuccaacuccuguuuuugacuucagaaaauuaggagaaucacgaagaaaaggaagucaaaucuguuuuuuuuuuuuuuuagaucuccuggugcauauuaaaauuuaauaucauauuuaugaguaaacauugcuuuuuaagacaguauuuugcgauuuucauguauuauauucuuccaaaacaugauuuuuuuuuugagacaggguuucucuguauagcccuggccgucuuggaacucacuuuguagacuaggcuggccucgaacucagaaauccuccugucucugccucccaagugcugggauuaaaggcaugcgccaccaugcccggccuccaaaacaugauuuaauuuuugguaguaggaggacucaacagggcuuccugcaugcuaacuaccugucccauuacuaagcugcacuguuagaacuugauuuauuuuaguguccagagaucuuguaucacuuaaauuuuauuuuuuguuuguugagagaguuauuaaaaacuuuaauaacuugauacaagaaucuaauugaguggcugaggcagguuucaaguuugaagcuagccuggacuauguaguuagacugucuuuacuuauuuuuuguuauuuauuuuuauuucuuaguuaaaacaggaccugacacagcucaggcuugccuuagacuuuguauguaagcugaggaugaccgugugcuucugacccuuuuuccucuuagcuccuugguucugggauuuuaccguguaguaugcaccugguuagauacugucuuuuuguugcuauuuagaaaaaaacuaaaaaauuggaaaacaaacaaaaacccauggauaccuuauucaagaguaggagggauggauagucugugauuauguuaguagguggaauuuuuuucuuuuuuuuagcucucauguauauuuaucauagcucauuaauagaccaauuaaaagauaaccuuauuuguuuguuuguuuuguuuugcuugagacaggguuucucuguguagcccuggcuguccuggaagugcucuguagaccaggcuggccuggaacucaagugcucugggaucaaagugugccaccacaccaccaccuggcuuucauacuguguguuuaagauauuuuguaauauuuuguuucuucuuugauaguuucauucauaucuacaguguaucuugaucaucuggccacuccucuuggaacucuucccucuugcucucuucagacuccucuuauacucugcauucagguagugcugccugcauuuaugugggcucucuaccucugaccauaucccuggagagaaauguuuccccuccuccagcuucccuaguugugaauagguccucaauugggggguggagccuuaugagccccuucccuguccauguugcaguuaucaacugccucuuucucugugggucuugugaagguaguuguagcucaugugaguccagagagcauguccaugucacagcuagaggacagauguccugucccuucuccccuggcccugauuuucuuccuacacccucuucuauguauucuguaaacaccacagggguugguccagaugccucuuaggacagagcauccagcagccccuuaucaaagugcuuugacagucaugaaucucuguauuagcauuucucugacugaaguugaaagcagugcuaaucuauggguauaaacauaaauauuuagaagcagguugccacuauugacacuaugagcuccucagucagagacuuuugacuaggcucauaguacuaaguauuuccuucuaugggucggcuuuaaguccagucagaagaguugguuacucucauagccuuccugcuucuguuuccccagugggcaugucuugucuggcaggucagcucuguagcaugcagaguccacugcuggguagucugcucaugacuuuaauccccgacuggccuaccugucauuuauggcacuaugagaagugagccagccgggaggcguuccaggucaguuccagcuugcugucugucugugccacggccacagucagucuucucuucagcaguagguuuuaccaucugguuauguggucggcaacuaagagcaaugacaauagcuuguguuguuuugggagucucuggggccuccuggcacugagguuucucuguaaugguguccuccuggagaagcacuguccaccuaugcagaauacuucuguuuaaacucuuuuaaaaguuauauuuaaaaaauuaguuuacuguggcuggagagauggcucagugauuagaaucacuggcucuuuuuacaggauuugaguuuaauucccaccgggagguuuacaaccaacuguaacuccaguuccaaaauccaacauuuccugguaucuguggacaccaggcacacacauggugcauuagacacauguaagcaaaacacacucaaaacugaaugaaucucaacaaaagguuuucucgaggcuuuuuucagacguccuuaguuuaaauuaaccuacuugaaacuaccucuucuccccaguucccuuccucccauucccacguaagcuuuuaacucagugugcccacaacuuuguucugucucuuccuucccuuaaggccccuuucccuccuaagcaggggaaguuucaagauuuugaacauaguugggggaucagggccagcucuacagcuccaccugucguauuugguguuugguucuuugagaacuuuaugcucuauuuaggauagugaaguagacauagucaccaguguguguauuuaagugcuucuguaagaagucacuauagaguuagcauuuuaagacaacaucaaggcuaugggcucaguccgcuguaagccuaguaagcauaaguaaggcucuggguuccacucacagcuccaaaaaauacaacagccccuacauuuauuuucugggaguucuguacguuaucagcucauguaaguuguguugauuuuccuauucuagauagucagggcugaacccagguguaaacauauaugcucuaaucugguagcucugucauguuuagagugagagcgcugguucuaugaacaacacaguucuuggcaguagacuguagcaucucuuugguuucuggcuauuucuucacuucuucaaaugccuuuaauucuuuuguagucucgugaccuuuaagucagcuacagcacuuuuaguccuagccgggcucucugcuaacugugcugcaucucugagccaggcagucuguuuaaaguccuuauucugcuucuaucugaggaguugcuuugucauguguuaggguauuuucucagauucuaagagucuuuccccaacagagcaaugcuguuucaagauguagacaucuagguaaguuagaggaggaggagacaucuggcuggcuaacauuaaguagguucacaguccaauuuuuuuuuuuuuuuuuuuagguuuuucgagacaggguuucucgguguagcccuggcuguccuggaacucacuuuguagaccaggccaccaugccuggcuaaucuuacuucuaagaaucugaaauuuguauguuuugaacauuauauuagugcucagaaguuuuggauuuuggcucuguuuugguggauaccuguaauaaucucagaucuugggagacugaggcagcaggauuaugaguucaaggcuaauuuguggucggaagcaagaguaaaaaaacucuagaaaaaccaccaacaaaaaaauguuuuaugccgggcggugguggcgcacgccuuuaaucccagcacucgggaggcagaggcaggcagauuucugaguucgaggccagccuggucuacagagagaguuccaggacagccagggcuacacugagaaacccugucucaaaaaaccaaaaacaaacaaacaaacaaaaaaauccacaaaacaaaaaacaaaaaaguuuuauauuuucuguuuugaauuagggaggcuaagcuguguauaaauauuccaaaauaaaacaacagcaccaccucuugauacuugaaacacuucugguccaagcauuguagguaauagugaauuuguauauuuacuguuuaucacugucuuggaaacaugcggucagguagacacauggccugguuauugcuccaucggugaagcuggagcacagaaagcgccuggccagcucagggccagcucagugcucacaguguucuuugcucugcucuagggaagaaagcucgcacauuugacuuggaggccauguucgagcaaacucgaaggacagcgguggaaagaagccggaaaacacuggguaagcagcacauguauuuuccucuauuggcuucagugcuguauaaacauuauacagugagaaagcaggagaaaaccuacaaaaauuuuguuuuuacuugcaaacucccauuuaaaucagaauugcugagagaauuguaauuucugguuccuuccgaaaaagaauguaaauuaucuauuuuccuuuuuaaacaugacaaaacuuguauuuuauuuggauagagaaggucuauacaccagaauccuguaaaaguguggccugugggggcuggagagaugagucagugguuacgagcauggggcuugaucuguaguauucacaugggugcccagaggaccugguacugucuuugguucucuguggacaguaggcacaugugaugcacagagaugaggcaaaacacccauggccacgaaauguaaaccacaaaguguauuuaugagcaagcaaggagccacuguuauaacuuacaggaagcgaagcagaauaacaguuucuuuaauaucucuccucccaccucugucugacuuugauuucauuuuuuucuuuccugcuuacagcggaaccaguauuuggaaggcugggccagagguggcugucaccauugcuuguugacccagacaguauagaacauugugacacacacugauguggcugcugcuguugaaucccugcuuuaaugagcuguaggagauacuuaaugaagccuuacuuccagauggcuuuuccagaugguuggcaguucuaggaaccaccuuagggucuccagagaacacuggcagugugcuuuuuuuggcucuaacucagaucucucuuguacuagaggacggucuggagucugggaacagcuggauuuaaaucagugcugugauaguacuugucauguuuguuuauuuuuguuuuuguuugcaguugagacagggucacacuguaauccuggcugacuuucuguguagaccaggauggcuuugacuucuggcaggguaucuccuucagccuccugaaugcucagauuagaggaacgagcuaccaauaccuagaucugacccaaauucaauuuuagugacaaagaagagauaugggaucuuacaauauuacccuggggaggcuugaacucauggaccaaguuauccuucugucucagcucccugaguaccaaguauuuaggagugcacuacugugcccagcaguuaguuuugguuuuaaaaugcugaauuguggggcuggaagguggcucagcgauuacgaggacuagauauucuuccagagcaccuggguggaguucccagcauccaccagaucucacaaccccuugaccuucagagucuggggauaggacacccucuuccggccuccuuggacacugcacacauauggugcccagacauccaugcaggcaaaagcauucauacauguaacaguaauaaauaaaauguucaaaaguuaaaauggugcauuauucagcaauacauauacuauaugguuagugaacuugaagcuaauaucacuggaaguaagccuuuuuggugagauguaaagaugucgauguguauauagucauauguacguaugguuuuuuugagacaggaucucacuaaaacuuaucauauagacugggcuggccuuagacuuacagagauccucagccucuauuuccugaaugcugggaugaaagacaugugccauuaaggugccccccucacucuccccccuucuuuuuguuguuuuuuuuuuuuuuuuuuuuuuuuuaagacaagguagccugaaacuugguauguagguuagacuggcuucuaacucaaagagauccaccugcuucuaccucccaagugcuggcauuaaaggcguguaacccugugucuggcugcuacugcuuuuuaaaauucauuaugagaaauuauaaacuuauaaguauuacuaucuauauaagcuacuauuauucaugguuaguuauuauuuucuuauugcuauaauaauaaacauuuuuauuugcuuuuccucucugauuauuuugaagcaaagcuuggcuauguugucucauuaauaaauauuagucugcaucuuaccccucuuccguuacucccacucuaaccguuuagugaauccaguuccuugcauaugguuagguaagccucugccagugauguacauccuugcucauguuuuuaaagacaguuggaagucuuguuaggcaggccucaaacucucaaccaucuuacuuuagcaaauuugaggccauguggcuguaacaccaugucugguaguguguguguaucuguccacauggaaggcgagaugcgguagcaugcauccaaccgcagugcucuuagagcaagaugggagaugaagucaggagaaucccuggaacucacgggccaccuagacugaggugcucaguggcaaaaggaaagcaugcagcaaugauguagagggcaaagacugauggcagaagggcugucucaccuucauaugcacagggccugggggcagaaaaagaacaucaguaucuucugaaaggauaaguggaacugcuuucccuacuccggacuuguaauaccagaaugcgugagaguuucucaucauaaaguaaguaggugaucucuugacaucaacugaaggaccaguaauuuaguucaguuuggauauccucuaucuaaagauaccauaggauuccucaacuucccaugcuaaucacagauccuagagugugaccuugacucugauccccugggaagcaauuaggcugauugguuugugagagucuaaagagucuaggugagcagccaggugaagugauucaguggguucgaggugugccgccuuuguuuaaacccacccugaauguucagcagguuuagauucaacaaugagucuauuccacuuucucugaguaguagggacccucccuaacuccagugauguaaaugaccaaaacaguuccuagugaauaauaaaagacaguuccugucacugaggaaaucauaaggauuuuaggagcauugggacaaaaugcuuguaacauuguauguacuccaguucaucugaaaaagucagcaguaacaaagaaauaaagcaaagcaugcuaucuugaguguauuuggaaauaaacaaagguuuuagugaguuuuuagacuaucagaggcaucuuguguuguaaacaucucauucaaaaugcuuuggacagugaguuuuuuuaauuauuuaaauaaguuguuucuggcaacauagguucucaauacacauuugagauuaaauugaauuuagaacuaaaauccguggaucuaucgaucgaccaucuauuuauaugcuuacuuguuuuugaugcacaguuucauguagcucaggcuggccuugaaccguguauagccaugacccuacugugccugcauucaugugcugggauuacagagcuauaccaguaaugcacagguuuuuuuacguugggucuauguaacccaaauacugcuuuaaaaauaaguccuuacguggagaugauuuuaaauggccuaaccuauuagauccuggcauucuagguuggagagccaagguuucaaagcagcuccaccauagaaggaaacgggacaggaggacagcuauaguuuuuccucccugucacguggauaugacaccauuuaccucggcagguucuuggguagguuaaaacauugggcaucuuaaccuuguaaaguacuguuuacauaucuuuuaaauuuucugugggauauuuuuuuuuucuaaaguauguauacauaccacuuaagagugguuuugagcugggcagugguggcgcacgccuuuaaucccagcacucgggaggcagaggcaggcagauuucugaguucaaggccagccuggucuacaaagugaguuccaggauagccaaggcuaugcagagaaacccugucucgaaaaacaaaaacaaaaacaacaacaaaaaaagaagagugguuuugaggaauuauuagguuuguacauuuaagaaaguuaaaaaagaggguaaauucauuguguggaacuuucuuggccuaguaccacauucuuuguucauuucaacugcggcuucuacugaucucaacaugugaaccucuauugaacauuuaguugaaaaagaaaaacaagggccagagagcuggcucagggguuaagaacacuggcugcucuuccagagguccugaguucaauucccagcaaccacauggugccucacaaucaucuguaaugggauccgaugcccucuucuggugugucugaagagagcaacaguguacucacauagauaaaauaaauaaaucuuaaaaaaaaaaaaaggaguuguaagauuauuuuuguguucucccagccuggagcauuaaauuauauucagauuauaaaauuaaaguugauacauaauuuuacugacuuuaaagaaauauuugugggggcuggugauauggcucagugguuaagagcaccugacuggaguucaaaucccagcaaccacaugguggcucacaaccauccguaacgagaucugacucccucuucuggagugucugaagagagcuacaguguacuaacauauaauaaauaaaucuuuaaaaaauauuuguguguguguguguguguguguguggagaggguggaggccagggugauuuuucaggaguccuuucuccuaucacauugguuauggcgauugggucagcaggcuuggcagcuggugcuguuauaagcucuuggcuugcuggcucugacuuguuuacaagugggugaauugcaucaugauucuuacugcugauagugaagucuuuccuugcuuacucaggucagacguaggggucaagcuugugucacacugcuugugugacugaggauggccuugaaguccugauuuucugccuucuccaauccugugcuuguagaugugugguaccgugccuggcuuugaguaugauuucaaugggugauuuaauaucugagaagagaaaauacuaaagaaaaacuuugaaauuaaacuuaugucuuuuuuuuaaaccucaaacucccuuuucucuaguuaagucuuauaucuucuacugaccuggauuguagauuaacuuuucuuggaauuaucucacaucuguguuccaaaguacuuuagagaacacuguaaguuuaauauuuucuguuuugaagcuaaaccucuuuguuugcuuuuauaauuaggauauuuugcuugauucauaguagcuacauuaucaauauuuaaugugauuaauagaguuuaagugcccacauccaauuuuuucucuuaguauguuauuauuaaauagaucaauguuaaguauaaauuuucaugacaugguaggucagugaauugguacaaacaaagaagugaaacauuuucacuuuuaauuccuauggguaacucacauuagaaaaugcucagauuuauauaguuaguaaucuuguuuuucugacuuaguuuuuauuuugagacaaggucucuguaggccaguuuaaccuggaacuugguguguuuguagccgaagcugacuucagguguaaaguagcccuacucugcccugugagcacggggguaacaugcguacaauauggugugauuuuagagaaaugcuuauccaaaauccucauugagauccuuggaagaaaaaacgugugggaaauggguuugcuuuuguaaagagaaggcauauuuagaguuuuugcuguacuuguuuuuguacuggguaaaaaugcccgggcaccuacauucaggaaaucucuuuaccuuugguuucucaucagcccaccaugaaaacacuaauauuuuuccucugcaauuucuucauugaacccccauuuuuuuccuuuaaugaagcaauagauuggcacaaaacaucccucaacugaaauguugaaguuugguaguaaaaaaaaaaaguuaacugcuuuuuuuuuuuuguuguuguuguuucuggaaaagggguucucacuauguaaaaugcuggcuguccuagaacucacguuguagacgaggcuggaccuggacagagauccugccugcugagcguugggauuaaaggcgcacagcaccagaccuggcuaaaguuguuuccuagaaugagaugaguaauuuggaggaccaauucacuguugugaaguucugauagugggugggucugcucaacuagcuguuagugaaggucauacuugauaggccuuugaagagaggugugcuagcuauuguauaaggcagggaugcuugucagggaauucugaagaaacaguccccuagaaaguccagccacaucaaggaaggaugcuguagugggccuacacuccaguuuguugcuaaggcaacuaauguuucuauuaagugggcaaguuuucagcuguaaaguaggguaguaguauuugcuucagagauugccacacagauuaauuuacagaacaaauuuaaaggcuccuugcacuugguagccuccaucuaccuguuaauguguguuaaggcugaugguuaaaugcauuugguuccuuguagagacagaaggcccaguuaagauugauucauguaagaacaguuuagugccuuuuaggacaugaacucuagccuggcgcuuucccuguggugugagggccguggcgguuccccccgugagucguggugugagggccgugacgguucccccccgcuccccccccccccgugaggcguggugugagggccgugacgguuccccccugugagucguggugugagggccgugaugguucccccccugugagucguggugugagggccgugacggucccccccccccaugaccagaggcuccaugucgccuccuacagacagaagaaagaaugaguuucuuagcaaggauaaagggcaaauagcaguuguguaggcagcuaauaauuucugccuuacucuucuguccugauuggcucucuucagcgaagagcaagcauuuacauggucucuuccugaagacuuauuuucugucuuuaauuuggaacauuaguuucuuuuaaauacuugccagguaucuccuuaucccaugucuucuaugcccagcaacaaaaacugcagagaagaaaauacucuuguuacaaagcuauuugccacuguuuagcuucagguguauagauuuaauugaaauuuugacuuuaaaaauuuuauuagcugggcgugguggcacaugccuuuaaugccagcacuugggaggcaguggcaggcggauuucugaguuggauggaggccagccuggucuacaaagugaguuccaggacagccagggcuacacagagaaacccugucucgaaaaaccaaaaaaaauuuuuaaaauuuuuuuaaagauuaauuuauuuguuuuacauauaugaauacagaguuggcuuucuucggacacaccagaagagggcaccagaucccauuacagaugguugugagccaccauguggcugcugggaauugaacuuggaaccucuggagaagcagucagugugcuuaaccacugagccaucucuccagcccuuuguagcacgagcuggccuugagcuugugucaauccuccugacuguguuucuccagugcuaggauuuuaagcauaggggacaacucauuuuaaaaaauguuaugcuggugagauggcucaguggguaagagcacccgacugcucuuccgaagguccagaguucaaaucccagcaaccacaugguggcucacaaccauccguaacgagaucugacucccucuucuggagugucugaagacagcuacaauguacuuccauauaauaaauaaauaaauaaaaauaauaauaauauguauuuggggaauccaaaacauuuaaaaaaaaaaaaguuaaauuauggggaugguagcaaaagaaagccaaaguauuuauguaauuccuuugcuuuucauguccccuucccagaugccaagugagauuagcagaggaaaaauucuuuuggauaaguuuuuuaugucuaaaagcaaaccagccaaccucuagaggcucaguguaguuaaaaaaccugucaugauuuuagcauucuggugaaaggucccggguagggaauccagacggacgagugcugcucccagccagagccaccaagaggggaguuacccaacccucuuccucggagucccuuggucugugcauuucuguuuagcauccaauagcauuugcuuauuggaucuguauucucuaucacuauuuucuuuacagucauguguaauacugcuaucccauuguuucagcaguaugaacuugcugaacaaaaagauucguucuaacaguccugaucacuuuuucucucuugacuguaauauaaauccucaucacuauuuuuauugccuauauuuuauacuauauugagacacuuuauguaauaauuuuguuuaauucuuuucugauuguugguuauuuagguugauaauuuuuuuccaguguuuaaaguugugauaaaauacaacauaaaauuuacuaucuucagcuuuuuuuuuuuuuuuuuuuuuuuucuuuuugagacuggguuucucuguauagcccuggcuguccuggaacucacucuguagaccaggcuggccuggaacucagaaaucugccugccucugccucccaagugcugggauuaaagaugugugcuaccacugcucagccucaauauuuuuucuuuauuugguacuagaucuugcuguguagcucaggcugaccuugaacuuguagcccuacuucuaccucuugaguauuaggauuacagauguacauuaccauaccuggccagcucaaccauuuaaagaaauuguuguguguguguguguguuuguguaugcucauggaagucagaaggucaaguuggauuucuccugcauuaaucuccauauuaucaucaucaccaccaccaucaucauuuuguuauuuugacacauggucucuauuuaguuuugacuguacugguucacacuguguaccagggaaccgugaacuuuuagagauucacuaucccugccucccaagcgcugggguagaagaugugcacuaccacaucuggcuuuucuuugcgaaggucugauuuggagcugcugaaucugguaggcugacuggucagcaaacucaagggauuaauuugucuccacuucugcauagcugagauucggaugaacccaccugaggucagauuuaaaagcauggguucugaggcucuaaaugcagagcaggcccuuaacuauuagaacauuuucuugucaugacagcauuucucugugaagcccuggguguccuggaccucacucuguagaccauuguggccuugaucucagagaucugucugccucugccucccuagugcugggauuaaagauguucggcaccaacaccaaccagcuccauuaaaaccuuuugaauugcauugauugauugacugacugauugauugauugauugauuggguguguaagugggcagugguucaggccacugcacaaggucagaggacaacuugaaggaguuggguuuuggggaucgaacugcgguggucagacuugguaauaacaucuuuaccugcugagccaucucacugcgccccauuuuuuuuuuaaaaagacuuauuuguuuauuuugaguguucuaucugcauguacacuuguaugccagaaaagagggcaucagaucccaguauagaugguugagagccaccaugugguugcugggaauugaacccaggaccuuugcaagagcaggagugcucuuaaccacugagccaucucuccagccccugguccccauuuguaaguguuuaauucuauauagcuguagucacaguccaucagcauaacucuuuacccuaugaaacugaaacuuuaugucauuauauaauacuuuauuuuccucuagcucuuuucuacuuucuguuugauuuuugacuguucuagguuaucuuauauauucuauacuauugcauaaguguauucaguauuuaucuuuugugugacuggcuuguuccacuuagaauagggauucacccauugcugaguacccuuucuuuuaaagacugaauuauaauacuccauuguauggauggauaccacauuuugcucacccauucaucuguugaugggcaauuuguugcaccauuuuagguguuugcaauaaugcuaugauuuugggugaaaaacuaccucugaaaaacucuguuuuuaaagccaagcaggauggugcaugauggugcuacuacacaagagggagagcagggacauaugcuggugaucugaggccagccucaucuacacagcaagcaucaggcuagccaagacuaugcagucagaucuaaauucccaaaaaaacuaaaacuaguaaggcaguggugguuguacaugccuuuaauccuagccccugggaggcagagacagauggaguuugaagucagccugguuuacagaacuaguucuaggacagccacaacuauacagagaaaucaugucucaaaaaacaaaaccaaaaaaaaccaaacagcaacaaaauacuccuggacacucuucaguuucuccuguauaugccuagaagucagauuucugugucauauugucacugugcucagcuuuucuuguggugccugugccacagguuguuuaguuuuugcuguuauaguuuuugugugucugagugugguaggugcacuugagugcagauugcuuauaggcuaaauguauuagacgccccuggagcuggucuuaaaggcuguuguguguugccugcuugccuuuugggaaccaaacauggguccuuuguaagaggucucacuauguggcccucugucacccaggcuugccuccaccauacagagaucuaccugccucuuucucccuagcuuugggcuuaaccgugugugugccaccacaccauccuuuacuguugagccaccuguggcucugccucugcuucccgggggauuccauuccagaugugugccaccucuccugauucuugcucugcucaggaugagacccagcucuguuuguuuugggcaggccuucuagucacacugucuuuguaacuuaauuuucagccuaauauugauaaauccgacugauggaaauuguguuuacuuuuaacuuacagaagcaagagaaaaagaggaagaaaugaacagagaaaaagaauuaagaaaacaaauugaagauauggagccagcaccgucaagcucgagugcagccagagagcgcucacagucaucaugcaggugccugggcuuccgcaaggcuucucaacgcccauucuccauguggccauaaugcaguguagugagaaaagaugaacuguuucuccaccguagacaguuguguaccuaggacauggaaaugcugagucagcuuuggagcuggggaucuugugauacaggguuuuaagagaaagugauguagaaacacuugucccaugcauuuuguugaaguagaagccauucauuguaaaguuuguuuuuggcuccucuugauggcuacguuguauaggcaggcaggcaggcguccaacacuguucuagggaugugccagguuugugauuuugaucauuuucuuucuuguuuuaaauuucuuuuuaauuuuuuauguuuauuuauuuacauuucaaaugugaucccccuucccaguuuccuccacaagccucccauccccucccucuuuuccuucauuuggggggaggcccuuagugguuuugaggugaggcgucucuguuucuagucuccgaaguagcuagcugggauugacaguaagugccacugugacggagucggugauaguuuuuagugcacagguuuaggggaggauacucuagaaaucaauaagagcuugugcaugcuauauauuguguguaugcuguaugguuuugagacagguuggccgggaacuuguguucuuucugcaucuucuuccugaguacuguuauuguaggcaugugccauuaugccuagcuacgcacguaaugguaaacugcugcuuaugauaugaauucauuuccgaucauccuucugcacuccugacggaaauacacagacauagggacaacucacacguauuagcuuauuuuuauuuauucacuuuuguuuauuuacuuacuuuugagacacaggcuugcuuuguaaccauuaauguccuggaauucacaacaaacccucugucuuuaucucuuggaaucuuagcauugcaaauguauaccacuaugccuugucauuaguauaucguaucuauauauuuauaguuguugucuuuugagauagggucucucuaggcaguccuggcuguccugaaacucauuauguauacaggguuggcauugaauucacagagaucugauugcuucugccuccugagugcugagauuaaagguauacaucaccccaccuagcuauuaauauauccugaaauagcaacuagguuauuacuauuauuuugccuugugguguguugagaaucaguaucauguaccuuguaaauaguuucuaaaaauguggaauguuacugaaauguaauuuaggaaaagauaaucaccuaguauuuuccaugugucuuggcuuuaaagaagaggcguaugggcuagguguggccgugcacauccuuagcaccaacgcuuggaagguggggcaggugggucuuugugaguuccaggaguaagacccuggcucaaaaacaaaaccaaagaaaaauguuaugugaaucugcccugguggcccauguaaaugucgcuuguaagaaguggaggcagaggccgggcgugguggcccacaccuuuaaucccagcacucaggaggcagaggcaggcggauuucugaguucgaggccagccuggucuacagagugaguuccaggacagccagggcuacacagggaaacccugucucaaaaaaacaaaacaaaacaaaacaaaacagacaaaacaaacaaacaaacaaacaaacaaaaaacccaaagaaguggaggcaggaagauugggagcucaaggguuauuugagauucuucucaaucaaaaaccaaaaucaaaaggacaaccccccccccccaaucacuauuauguggauauaaauugccacucauaaguucugaaccugaaagacgggugucauugagcuuguggaauaucacuucaguuaggagagaaaugucgugcacaucuguaagguagaaacuguugguuaugugcuuuuuaagcaauucauaggcugggcaugguggcacacaccucuagucccagcccuugggaggcagagguagggggaucuuugaguuugaggucagccuggucuacagagugaguuccuggacagucaaggcuacacagagaaacccugucacgaaaaacaaauaaucacaguaaaaggagugaauuuugcuuaugaacuuacuucguaaauuaaacuugguuguggcuaucaguuaauguuuggcuccaagcugaccugggagacgggaagggaggaugugacucugagcagcuuuaccgucuguaccuuccucaggcuucuguuccugcuuuggcaccacauugagucaggggugcuuuauacauggaacauggaguguaguuucuuucccuguuuuuuccuccuccuccuccacccccaccccccuccuccuucuucuucuuucuucuuuuuuuuuuuugguuuucugagacaagguuuuucuguguagcccuggcuguccuggaacucacucaguagaccaggcuggccucgaacucagaaauccgccugccucugccucccaagagcugggauuaaaggcgugcgccaccacugcccuguggacuuugguuuucaaauuacugaaaauauguuaaauuaaaaaaaaaaaaaguuuagcauuagaaguacaaagccagaaauggaaggagaagcuaacacauuccguucagauuuuaugggagaacuaggcuuagauaacgaaccaugaaaauaacguggauuagcuuaguccucaguuuaaugcuucuuuuugagcuagguaacguaguuaacuuagcguagccgcuaaggaccaacacuuuaguuuaauguuuucaguggccagauaauuuugcauuaaaaaaagaaaaacuucuuucuuuccauucugagugcugggguuaaaggugugugagccagcaugccagccgagacaaaguaagauuuaagcaaugccuuuacucucguagugcuugaacugcaaaucuaaacguaguuggaaaucgcagucauuauaggacaggugggguuuccugagaacuuggugcugugcgcagagaugccuagagcggugaagggucugcagcagcagaagaaagagugacuguuucuguguuuccagggacacaagcagcagugacagugagagugacgacaguucugauucaucugacgaugagcuaaucggcccuccuuuacccccuaaaaugguaggagaauccguaacuacuguggacgaaggcacccuuggcccuuuaccuccaccucugugugaagaaggagaagaugaugaugaugacgaguuagacgaugaaggagaagaggaugugaguauucaaagguuuuguaugaauucagagagguuguaaguuaaaaguaguauagagaacaaauuccugcuaagcugacagucauggguaggauagccaccaccuguugaguaugaaaaucagacuugggcuguugacauggcuuagccaggaaaggugcuagccuccaagucuaaugcccugaguuccaucccuagggucacaugguagaaaggaggcagcugacucugaaaguugcccucugaccucugcaugcacacacauacacaacacacaaauaaguagauguaauaaauuaauuuuuuuuaaaaagcagauuuauuuuugguuagcuuuuauauuuguuucauuuuguggcgcuagagcuugaacccacaguguuggcaugguaacccggcccucugucacugagcuagguccccagcccccagcugacuuuauuacaguuuccagguucucuccugaaaauacagcauccuaccgugucguuuacagcaucacuguccugacacgccacucagaaacagugacuuuaguaaaagguaggcaaggggaagaugcagcagacuuugcuaaguggauauuacaggauacaaugacaggccucaauucaaauguagaugggagcagacuuaacuugucacgcguaaccugagaaauccucaguuucagaacugggaauaauucugugaugcuauuguauuaugggugguauaucuaaaauauaauuauaacgaaagguuaaaaguaaagaaauauacaaggauauugcagagacauggaaagcaaguuagaugauuaaugucacaaaauucacaucaaauaaucuuuagucauuauaauuagugauaagagugacuuuacaugauggucaaaggaaguuugcucuucaggacagcuuggcagccccuagucuuugugcaucugaagugucugcagauguguaacgugaacacugacagaauuacaaggggaaggggaggaguccgcuguuagaaugaucgagucagaugugugaggacaugaguaagaagcauagguuugaauaaugcaggcagacggacucgggcaaggggagcacccuuuucgagcauuuucucuuucagcacacauaggcagucaaaacccacagccguaucuuggccacagagugcuacggaaacaugaagggaccaaggugaagaggugcuaagucauggagcacugugacaugugagacagacggggcuuuguaacagagugaauguuuguaucuggucagaauucuuacgcuaaaacccaaaccuccagguauauuuggaggugagguauggaggaaauaguccagguuaaaauguaucgaaagagccgcuagaacuuauguuguucuaugaagagccaucagagcugugugggcuaugcaggccuauaauccucguccucaggaaugaggcagaagaaucccaaguucggggccauucuagguugcaugguaaggcccugccgacaaaauaagagaacaaacgaaugugagacaucagacaguguaugcuuaucuguguuugccuuccuccugaaacccgaaagaacagcaauuugaggauauagcaggucaccaggguccaagcuugccauccccuugacuauagcuuuccagcacccagaagucugcggaacgugguucuguugguuaaguuaccccgugcgggguguauuaugacggaccaagcugaccauuaggagucugcagggcugaggaggaaaagggauauuaaacauguauacaugcuguaguaugcaggauaacacacauauacaugcuguaguaugcagguacaaauacagugcugagaugucauaugaucaaaacauaggacuauguuuuuuuuuuuuuuuuuuuuuuuuuuuuaaagauuuauuuaauuuauguaugaguucacuguagcugucuucagacacaccagaagagggcaucagaucccaucacagaugguugggagccaccaugugguugcugggauuugaacucaggaccucuggaagagcagucagugcucuuaaccacugagccaucucuccagcccaggacuauguuuuuaugagaauagaagaugaggccaauuagaacaaauucagaaaccaugaagacacgcugucuaggagcagaauuugauggagcuuuguaucugguuauguuguuaggggggcaugguucaggguagguuauagucuagcaagagugauuggaaguaacaaaggcacugggcacaauacuagauuauggggaacaucagccugucuaucagagaaacuucaugaggaggagcagaccuuggccuuggaaccgaugugugaauaagcccaaauuacugcuguucugcaaagucaaagugugguuaaguuaagggcuuuacaaguccauuuguaagcuuaagcuauucauagcuguucuacaaauguaucaaauuacauggcagucaaagcaaggcucuagugacaugugacagcuugauuuuaaaauguacacuuaaugguaaugcaaagcguauuaguaucacugaagacuuaaaucagacucggaggagacagaauggguuggggaauucccuaugucuguuuaucgccucucucucucugauucauagugcagaaucucugagaaguuaggacagaggugguagaugaacaguccacagucuuuguaaauucuuagauauuaaaauuucaaucccuuuaaaacaccuaaucucuuuuaaaauucaaagucuuuuuacaauuaaaagucuuuuaacuaugggauccacuaaaauauuuucuuccuucaagagggaaaaauaucagggcacagucacaaucaaaagcaaaaucaaacuccaacuguccaaugucugggauccacucacgaucuucugggcuccuccaagggcuugggucacuucuccagccaugcccucuguagcccacaccuugucuucuaggcuccagcugccuguacuccacugcugcugcuguucuugguggucaucucaugguacugucaucuccaaaacacugcugucuuccacuauaacuguaggcuucaccaauagccucucauaggcucacuucauggugccaagccucaacuacuuuucaugaccccuucacuccugggucaucaauugcaauugaggcugcaccuucaccaauggccuuacauggccucucacagugccaagccucagcugcucugcgucaccccuucaugccuucaaaaccaguacaccuggguaacucuuauacauuaccaaguccagccacagcguaagguauaaucuuggcuaucucuggaacacagucucugugcucucaggaaacacuucccagaagaugucaccucaaugaugcuggucucuucuuaaucacugcuaauuucuuagcuccagcuaaccagcaucaauauucccagaaaugcaaagguuucacuuaguaguucugguaucuuguuaaucccagcugauucuucagccccagcuaaccagaaccacagaaucuuaacaaucaaacuagcaauggcccugauaagagucuuuaaccuucccucugaaauuucacaagccaggccuccaucuucugcacuguucucagcauucucuuccaagcuccuacacaacaucccauagagcucuuaacaccaaauggaucuucuagcccaaagcuucaaaauccuuccacacuccucccuaaaauauggucauguugucacaggaauaccucacuaugcugguaccaauuugucuuagcuugaagauuuugaaaugggaauguaacaguuguagugguuuucuuagagucccagaauuuauguuaccuucaaaugaaggcuuccaguuuucagaugagagagcuucauuugugcugaguagaaacuucaugcuguguuuaaggcucuaagugagcauauaacuuuucuguuuucucauuaacucagauaucuggaauauugacaacuucuuaggucaaguaacaauggaaauggagcuauggccagaggacggcaugaauauuacuauaggauauagguggauaauuucauauauacauuacagaugauuuauguagcaaucuuuuguuuuucagacaagguuucucuguguaguccuggcuguuuugagaacucucucuguagaccaggcuggccuugaacucagagaucagccugccucugccuccuagugcugggauuaaaugugcuccauuaugccuggcuuuggguagcagucuuuggccuguauuucaauauuggguucaaauauuucugacuuuagaaguaauuuuaucuuguccauuuguacuuaaaagucuagagugcugugcuuguugguucagaaaacuguuuugaggcagaggcaggcggauuucuaaguuugaggccagccuggucuacaaagugaguuccaggacagccagggcuacccagaguaacccugucucaaaaagacaaaaaaacaaaaaacaaaacaccagaaaacugucuuaagguaauaaucaguaaaaguacaagaagaaauaauacuacuaauaauaacuuauuauuguuaucaucgucaucauuugguuauuguuguucuuuuuguguuuguguuugaggcaggguuucuuuauguaacuccggcuguucggaaacucacuuuguagagcagguucuccuugaacucacaaaaaucagccugacucugccucccaagugcugggauuaaagacaucccccauucccugagcagggagcuguauuuccaggauaugucuagguuucaugguuuggauguauugggcgucgcguuucuugaguccuuccuugcucccucuuguguuuucaucauaucaucgaucuuuuguaucuucucuucuuuuuguuuucagcuguuuccugucuauuuccucuuggcccuaacuugugagcacacugaagucguuuuguagucugcuuuugucuccaugcacucucuuaauuaccuuucucuaagaccaaauuuucugaagcagcgacugcuucugauuucacuguucgccucugagccugugcugucagcuuccgccuuacagggaucagugaugcucugagcgugcaaauccagugugcuguggugguauacacuguauuucaggacucuggaaacuucagcaggaggauugcuuuggguuugaagguagucuggccauagggcauuccagacuagcuaaggcuauaucaacauaaaccaauagcaaaacgaaacagaauuaaaagggaaaaaucgaauuccaaagaucuuuucucaggucucauucuaucaugucuguagaguggagcacuuuggcuugugccuugaaacucuuuauuccuucccugaagcuuuugguuugcugccuuucccuugacuguuuaaucaaacaccggcuucgaggcaggcgcuuccuaguuacagaagacacacaggacauacagcagacaaacuccauggcacuggcauccugcugcuacuuccuaguucucugcccugucuggccuaaggcccucuccuuaccucccuauggcuuguuccuugggaguuccuugugucuccuguacucauaacucauguucacuccuggcaacuaaggguaguaucauauagucuaaauuagaucuaauuucugacuacucaugaaacauguucauauugaagcucugugguccauguucuaaagacaacacaucuaugaccaaacucaaugucguuucucuggugaacacuccuuuuaccuggacucauugcuaaaugagcagugggguuguuaucuugcugcggcaggguuaaacuuuccauagcacaagucauacgcaagcccacauccugccuaggagaggugcagagcaguugucuuagucaggguuucuauuccugcacaaacaucaugaccaagaagcaaguuggggaggaaaggguuuauucagcuuacacuuccacauugcuguucaucaccaaggaagucaggacuggaacucaaacaggucaggaagcaggagcugaugcagaggccauggagggauguucuuuacugccuugccucaccuggcuugcucagccugcucucuuauagaaccaagauuaccagcccagagauggucccacccacaaggggccuuucccccuugaucacuaauugagaaaaugccuuagagcuggaucucguggaggcauuuccccaauugaagcuccuuucucugugauaaccccagccugugucaaguugacacauaaaaccagccaguacaauugaccccuugucaacuugacacacaaacacaucacuaguaagccucaacacuuaguucuuacucauccccaagaucuuaaauaacuuuaaaagucccacagucuuuacauauuaaaaguucaauccuuuuaaaauaucaaauaucuuuuaaaauccaaagucuuuuuacaauuaaaagucucuuaacugugggauccacuaaaauauuucuuccuucaagagggaaaaauaucagggcacagucacaaucaaaagcaaaaauuaaacuccaacuguccaaugucugggauccaacucacaaucuucuggauuccuccaagggccugggucacuucuccagcucugcccuuuguagcccacaccuugucuucuaggcuccagcugccuguacuccacugcugcuguuguucuugguggucaucucaugguacugucaucuccaaaacacugcugucuuccacuguaacuauaagcuucaucaauagccucucauaggcuuucuucaugguaccaagccucaacuccuuugcaugaccccuucaauugcaacugaggcugcaccuucaccaauggccuuccauggccucucacagugccgagccucagcugcucuucgugaccccuucaugccuucaaaaccaguaccaccugggugacucuuacacauuaccaaguuccucugcagcacaagguacaaccuuggccaucucugggacacagccucugugcucucagaaaacacuucccagaagaugucaccucaaugaugcuggucucuucuuuuuuuuuuuuuuuaagauuuauuuauuauuauauguaaguauacuguagcugucuucagacacaccagagggugucagaucucauuacagaugauugugagccaccacgugguugcugggauuugaacucagaaccuuuggaagagcagucagugcucuuaccuguggagacauuucaccagcccugcuggucucuucuuaaucaccacuaauuucuuagcuccagcuauccagcaucaauagacccaguaaugcaaaguuuuugcuuuaguaguucugguaucuuguuaaucccagcugauucuucagccccagcuaaccagaaccacaggaucuuuacaaucaaaauagcaauggcccugaagaaagucuuaaaucuucccucugaaauuucacaagccaggccuccaucuucugcacuguucucaacauuaucuuccaagcuccuacacaacaucccucggagcucuuaacacagaaacaaaaaaaaaaguuccagaguccuuccacaguuccccaaaacauggucauguugucacaggaauaccccacuaugcucguaccaauuugucuuagucaggguuucuauuccugcacaaacaucaugaccaagaagcaaguuggggaggaaagguuuuauucagcuuacacuuacacgcugcuguucaucaccaaagaagucaggacuggaacucaaacaggucaggaagcaggagcugaugcagaggccauggagggauguucuuuauuggcuugccuccccuggcuugcucagccugcucucuuauagaaccaagacuaccagcccagagauggucccacccacaagccuuucagucuugaucacuaauugagaaaaugccuuacagcuggaucucagggaggcauuuccucaacugaagccccuuucucugugauaaccccagcugugucacguugacacacaauaccagccaguagagcagugcaggagcagcaccucacccgaggaugucugaggauaaaucgggcuucuuggugcucagaaauuuucagagcacuguuguauuuuauaggaaagcagcuaaguucacauuacagaacagauggaaagacacagugggacaacauggaguauuagaguagacuaauucucagguacuacacucacaaugaaugaguggucuuaucuuaccgagcuccaaaugacuugauauaguuguguaggagagcacagacucggaagaaugaagagaaaaacagaagccugaagauaaagugaacacaggcuauuauuauaaaccacgcugugcccucgcugggugaggcagcaggguagggggccgcaccaaacuuuugccaucauuggcacccuuucucuguuauaagaaagguuuuucuaggggcuagugagaugacuuagcuguaaggagcacuugcucuucuagaggaccuggauuugauuucccgcacuuagaaccaucuguaacuccagugccaagggauuugaugaccucucugguuucccagcccuugggaagugggggcaggaaggccaggaguuuuaagucuagcgaguuucaugccacauagggcaauauaguaagacccugucucuaaaacacacaccacacacacacacacaccaauaccacacacauacaccacacacauacacacacacacucucacacacacaccacacacacacacacuaacacuacacacacacacuuacacacacacacacacuugagcacacacaugcacacacucacacaucauacaccacacacaucacacauucguauucacacacgcacgcuggcauacuuuuuucucucuuuaucuggagcaaaacagugagauuuugucuuaaacaaaaaauacaaaaaaaacaaaguuuguggcuucuaaaccaauauucagacucuuagauuugguuacuauaccagaaugcaugaauuuaaagugaauucuccugugucugucugguuugcuuuuugcuucuucucuugagaaaugaagugcagucuuugcaguucacugacuugcgggaaugcaccauacagcgagcgagccccagcaaagagugugcuuaagcuuacuagauaugugucuguuucauuugugaaaucacugaaauucuucuuuaggaaaugaaggcagagauuguuuuguuuuguuuuuuagauuuauuuauuauauaucuaagaacaugccgggagugguggugcaugccuuuaaucccagcacuggggaggcagaggcaggcggauuucugaguucaaggccagccuggucuacagagugaguuccaggacagccagggcuacacagagaaacccugucucgaaaacccaaaaaaaaaaaaaaaaaaaaagaacacuguagcugucuucagacacaccagaagagggcaucagaacucauuacagaugguugugaaccaucaugugguugugggauuugaacucaggacuuuuugaagagcagucagugcucuuaacugcugagccaucucuccagcaugauucuuuuguuuuguuguguuuguuuuacaggagaauuucaaguaagaggucucaacagagaaugugcauuuuaaaugcuuccuuuagggacagugacacuuuaaugaaacaaguuauagcaguaaauaacauaacuuucccucaguugaauucgauuaauuuuuuuuuaaaggagguuuuaugguaaccccauuguuucuaaaacuaacaugcagcuaagugcccaauucucuuauggacaugucugaaucuuccaucagaauaggcuaaaacagaagccccgaaugacagcccagucagacuuuacuuccuuucgccuacuagaugucucugacaaaggaguuugcugguuuccaguggaucccagucaaauccucagugccccuuuuccgucuuccauguugauuaacauuuugucucacauuucccuuccuguugguuaguuuucugucaacuugacacaaacuagagucaucagagaggagggagcuucaggugagaucugggugucagguauggaggucauuucuuuaaugugggagggacuagcccacugugugugaggucaaguggaauugaauguuuuuauauuaaaacuguuacuuuuuugguauucugccuuuuuuuaguuuuguaaucauacaucagaauggaaguagagauugagugcuugaucguggccagcacggcucuggcggggcucgcccuucuuccccguucucucucuugccuuuagagcacauuccuuuuaaaaaaaaugauuuauuuauuuauguauuuauuuuauguaugugaguacacuauagcuguacagauaguugugagccuucaugugguugcugggaauugaauuuuuuuuggacaucuguucgcucugguuggccccgcuugcucaggcccaaagauuuauuuauuauuauacauaaguacacuguagcugucuucagacgcaccagaagagggcaucagaucucauuacgggugguugugagccaccaugugguugcugggaauugaacucaggaccuuuggaagaacagucagugcucuuacccgcugagccauccuccagcccuagagcacauuccuaaagcuagccaucaagguccauucccucauuuugaccacuuccuucuccugaggcugacuucuaagguccagcuaucaaaguauugaagucuagcaaucaaaagccccuuuuggcucaccuaauuaacaagcccaauuaaaauuaaacaccucacccuaacaugggguuuccucuuguaccuuuauaaacugccauuuuccuuugggucacaucugacuccuguauccagaggcaguccuuuguccccuacucuuggaccucccuuguucccuuccccuucucuuucuuucucugucucauggccuuguuucuuauucucuguucuuugucuccuugguauugagaaguugaucuugggguguccugaguugauuggaucauuucagagauagaaaaugaagaaauguaggucaaaagguuucuguaagaaccaggaucccagccuucuuuauaaaugcaguuagugauugcuagcgcuacccuaagggagaaugagauggaauccugucccuauguccuaaccacuucccuuuguaaagugaguuuugauggcuagggcuggacagggaagagcuagaacagugcuaguuaggaccauauagacugcacugggacacuauagacuguaccaggacacuauagacugcacuaggacacuguagacugcacuaggacacugcagacugcacuagggcacuauagacugcacuaggacacuacagacugcacuaggacacuacagacugcacuaggacacugcagacugcacuaggacacugcagacugcacuaggacacuacagacugcacuaggacacugcagacugcacuaggacacugcagacugcacuaggacacuacagacugcacuaggacacugcagacugcacuaggacacugcagacugcacuaggacacuacagacugcacuaggacacuacagacugcacuaggacacuacagacugcacuaggacacuacagacugcacuaggacacuacagacugcacuaggacacugcagacugcacuaggacacugcagacugcacuaggacacugcagacugcacuaggacacuacagacugcacuaggacacuacagacugcacuaggacacuacagacugcacuaggacacugcagacugcacuaggacacugcagacugcacuaggacacugcagacugcacuaggacacugcagacugcacuaguaaagugucagugcauugccuuuuuuccagcccacacugcccugggacauggaaaagcacccccccccacccuuuaauuugaugaucacagcuuugaaccccuguggcuggcucucucuuacuuuucuuuuuuuguuuguuuguguuuugguuuuucgagacaggguuucucuauauagcucuggcuguccuggaacucacucuguagaccaagauggccucgaacucagaaauccgccugcuucugccucccaagugcugggauuaaaggcgugcgccaccaugcccagcucucuuacuuuucaauggggaaauuuaaccuagggccucugugcaaacugaagaccugacuguugugugguauguuuucagggcaaggguuuauuguagauaugagggagaggacagcuagaggcagcuggaggccagcaugagcuuugcagugcucauaggcaccacagguaaccauaugucccuauaagggaaaugacuucuuugguagaugggagacaguuucacaaguuccuaaggaaugcuggcuuuuaucugacugccagaaauccucuuacaguccagguugagcccaucguggauauuuggauagccuuuuggaguuuccuuuggauuagacauccucacugcccaugcugggcaagcauucuggcaagggucagcaucugcaacccucuuaaauaugugcguuuccuucaguaguuagcuagcauugugguugccgucacugcucaagcuaaugcauuagaaauguuaauauauuauuugcuuuuaaugucaaacuugcuuuuuacucauucuuuauuaggcuuugcuuauguggagguuagugguaauuguucauucaaauagaacuugaggauuuauuuauauuuuucuucgaauuaaauaaacaacaacaguuuagauggaaaaugucagagaaaagaauugaaaaaucauauuuuaaaaauuuccguuuguacauaaucuuaucuuuuauaaggcaaaggagguuacaacacguaauggaacggacggagacuuuggaauuauugcggguuucauuguccucagguuuccguugcuauccuguuucacauuacuacagaaaauggccaguuugaguuuuaugacuguaacuaaaggcuaaauguaacagugacuuuugaguggugaacaccuguuauccaugaacuuugucugacucccuggcuggcacguucuugguagaugacaguccaaguuugggccaccacuguguuucucugucuucugucugaagccuuucauccccuuggccuugcccacugccaaccaccuguauccgucagucuccuccucauggguagggaaagaaagggugaggauuggaaguugcgggggucucgucaagucuuucugaggcgccgugacagugaaacaguucacaggagcagagugagggucgccgcgugugaccggacugcccugagucacugccauccucugcuguuuuagacuguuaauuuacuuguaaauauggugagugugugcaugugugcaagcaggagcacguggagucagaggccagcuuugaggagucgguucucccugccaccaccgcaguggucuugagcuuagguuccgaggcguggcggugaagcccgcuccuccugacggucugccagaccuguugguuucguuaucgcuuuuggucaguuuaacucgaaguugacuuugaagaguuguuuuauuuuuaaaacaccgugaggaagcuuacugacuuuuaaguucaaaggauaguuacuauuuaaaacguuacaccugcgaagugcugucagcagaggcugcuagaggcuuucuucuagagaacucuguuuccacugggcuucacugagggugaagaccucauucuccgaagugggcacuagggggaaggagagacauuuuuauuccaauugucuccuauuuagagaggaagagaaaguguuuuuuuuuuuuuuuuuuuuuuuagagccaggucuggcuggccuugaguuugugaaucuccccuuucccucccaugugcuaggauuacugguucacaccaucgugccuagccagaccuuugauaaauaauaacuucuauaaacugucacaagugacuuguagacugagacaaaggcuggaauaauugucucgucuuagagcguuuuagcuaauagauucuuauuuaggguacacuuuaucggcacaugggcacuuuauaucaugauguuauuuguaaggucagaggauacucauuucucuacucacacuaaacaacggaagucuaaucuugucaugucccuacucucaagccucuaguucaugccuaucauuuguaagcaguccaggucccuugccuuggccucugaggucuagcuuaacuugauuccuacagaaauuuuagacuuuauccccuuuauuuuccugaccuguucaugucucucuagcuauguuguccucucugcuuuccuuuaagcagcagaaugguccagguggagccucugcuuuuuucuguccuguaucugcauggugcccaaagcucuuggugcccccuugucucgcuuggaucuuugcuuccguuguaguucaagucagugaccccuuggccuacugcucuuguccgugcucgacagugcuucagucuucuggaggucuugacuccuggcccguugucucuuuucuacccagaguaagcauucacauugucuugggacuacucuaucuccaguggccauaaagguaccuggcaucaaggaggccccucagaaauacuguugaaugacagaauggccguucuugcuacuggucacuuuugucucuagguacuucacuaaaucaugccaaaucuggucucuucucaguuuugcuuagaggcacucaggcaggaugacucuaccacaguuaucuuggcaaugccauuuuaagcccuuauccagucaaguucuuucugccucugagcaaucugauuuuguucaccaaucaucuaguaaccuucuguugaguguaccacgaucgucgggacccuuucuccuuucuuuucccuuccccucuucuauucguuuuaagugugcaugucuguguaguguguauguauguguguggugucugguauaugcaccuguaugugugcucugcucugucauacuccaccuuauucccuugagacacucacacucacucacucacucacucacuuguucucucucucucuaucucugaaucuagagcgaggcuuacaggcagcaguccucaggaguccucucaucucugucucacagcgcuaggucacaggguuuauuuuuaaugugggcuuuaaguccaaguccuuaugcuugccuagccuagcucucgcucacucagcgacuucacuagccccuuuauucucagugaucaaggucuucuggggagggugcacuagugcauguagauaauacaaggcauauuucaaauacaauuuuuuuaacguguaaauauccaaaccuacauugugguaaacaucugucaagauaauguguaugugaauugcaaauguugcugauguaaaguuucacuauguauguggaaaugguguuugagauguucucugcuucaucaaaaccaugucagaggaggaccugauuguguuagaguggcuaguugaagaacagcaugguugaguguguuagaauguaugggcuaagaggcucagagggagcugcgugagggcuuucaugaccuuccguuuucuauucugguggugcuugccuggaaucucaggacuugagccaugcugcaggaggauuaagaguucaaggccagcuuugguaauaguaugaguacagccuuggcuacaaaagaccaccucgcagaaauacaaauagaaagacagaagaacaaaaccaaacaagauaugaaaacuauaacugaucaaacaaaagguagcuuuuuagauaauaauccugccaaaguaaauuauauaaaauucaguucccaugucauaauaauguuacuuugcaauccauaauucauugugcacucgguuuggaggguggcuuucaggaguuaguucucccucccauccuguggaaucuuggaucuaccccaguauaccuuuucccccugcagggccucuucagcuccuaaauaugauuuaguuaaaaaguucacuguguacuuuaaaugauaacuuaaaauucuguuuuuagaggaaauacacuucuaucuaaaaguuuagguuucuuuuuaagauuuuaaucaaaccuuguguuuuucugagaaaaaugugguuuuccauuugaccaccucucauggucaugaaagacugccuugggcaucugguuuguaucgucucauuucuccccacagugcgccuuguccucugacucaagaccuucuuggcuucucuuccuguggcaugcccugucugcucucacugaaccuuccccauugcaccuaaggauaauuccuaccaccaccaucuuuuacacuguguuaaauuccuuucucuucaucuuuuauucuuguuuuugccucuuccaguucuuguucucuuccuguauauuccucaucuuuuggcuacuuuacuuauguuucauuuuaccguaaaagguuucauuuggguguggguaaucagggucccaguauguagcugaggcuggcauugaguuugugaucuuccugccuccgccuccuaagcguugguauuacagguuaauccccgacguucagugaagauggugucagcaguggcagcugcucuucuguuuuguuuucacaacuggauauaguguaaucaaaguuaucccuguuucucugucucaguuguuuuaguuguguuaugaguugaucuuuucagcuagugaccauucccaaagaauggaagucauaggaugcuguguuaugugcuucucugacuguuggagaagaugcccacggaaacugacucaucaccuuuucaguucggcagguguaagcacaguguguggaagucaaacagaacaagcacucuuugcccuuugccccauguguggguguguaagcuaguucugcuacaccagcagucaacaagccccaucuccaucuccccgauuuggaauuguaggcacgcagcacuuugcccugccuuuuuuuuuuuuaauauuuuuuuauuauguauuuuccucauuuacauuuccaaugcuaucccaaaagucccccauagcccccccccauuccccuacccaccuacucccacuuuuuggcccuggcguuccccuguacuggggcauauaaaguuugcaaguccaaugggccucuuugcauugauggccgacuaggccaucuuuugauacauaugcagcuagagucaagagcuccgggguacugguuaguucauaauguuguuccaccuauaggguugcagaucccuuuaguuccuuggguacuuucucuagcuccuccauugggggcccugugauccauccaauagcugacugugagcauccacuucuguguuugcuaggccccggcauagucucacaagagacagcuauaucuggguccuuucagcaaaaucuugcuaguguauggaauggugucagcguuuggaggcugauuaugggauggaucccuggauauguuugcccugccuuuuaaguaguuaaaagguaggugcugggaacuugaacucagguccucauacuuacaugguaguuauuuuacugacugagccaucucucuuauuuaaguuuuauauuucuaaaguuccauauuuagagacuagcaaaccuguguaaaagcuguuccaauagaacuuucuaaaauuugucuccagaccuugauccuugucuggaagaacauuuguucgcuucauuguuugcuaggagugcagcugauugugaguuugacacaagagcaagaccagcagcaugacuccauggcccccaggccauguugauguggucucacugucuccugccauucccgaauagguguuuuuuucucacaguguggcaagcuguagacuacaaucagcuuuuuuuuuuccauuaaaugaaguaauuaguggcacaauauuuuuuuuuuuuuugauuuacuuuuuuuuuuuuuuuuugagugaauuuuuuucuguguaauucuggcugucuuagaacuugcacugcagaccaggcuggccuggaacucagagauuugccugccucugucuccugagugcuaggaucaaaggcguggcuaccacugccuggcaggugguacagucuugauuuucacugacauacaauguaaugcuucaagcagccagccaccagucccuggcaggcuaaguguugugucuauauuauuccuuacuguguagggaauuguacuauguauaauugcuggcuggaauugagcacacugaauagaggaguaggcuggccuccgacucagagagaucugccugccucugccuacugacagcacucucccuguuguuguuguuguuguuguuuuuuuuuuuuuuuuguuaguuuuggagauaaagucuucaggcccgccuguguaccuuguagucuuuaaaauauuuuuucacauuuauuuauuguguuguauuuuacauuuauauauauguuguguguaucuguguagacaugcaugugccauggugcacauguguaugucaaaggacaacuugccagggagucagaacucugcuuaagccaugugggucccagggagcaugcuugguggcaggagccugguaaaucaucucacaguguccccacccugcagucauuucugcugcuucugccuuccaagugcuaguacuacaggcaugggcucccauuucuagcucccuuuuguuucauauaucauaaagcaaugaguauauguucaucuaagugccuaugggaccacaauguaugcuuccuugccauagcaaaguuccaaguacugaaaugaauuaaguugcccaggcuuuucagaguucccgugacgucaaagcacagucuucuucucuugagcgacaagaaacauacucaaguauuaaguagcuucucauggacaccuaguacuagagggugugucggguuucccauuugugugcuucauggaccguuauguccuaccucuagucuccucucagccucuaagggcgacccauugcuccaccuuccccgucuuaugcgucaugccauacaagcuggagacagucugaccaggacuauuguaacauguuuuuccuuaugucuggaugcuggucauugcuuagcacaacaagcauugguguggcagccugugugagcagugacccuugugaggaacacugugggaggccuaucuccuugaucaagaaagacuuuaguuuuuacaaucuaguuuuuuccucuuuugugcuauauaucuguuugcuauuuuccucuuuuauauuuuaauaguagguuguugaagucuaguccauauauccuaagauuugcuacuuucaaauauauuuaucugucaggguuuaggaugcucgauaggugguauaaucaccacauuaguuucuucuuuaaaaagauuauuauuuuaaaguguguguguguguguguacaugugacugcagggaugugauccccggaagcucgaguuacuagcaguugugaagaaccugacggaagagguccucauuucuggaccuuuggaagagccgcaugugcuuuuuuuuuuuuuuaaucuuuuauuagguauuuuccucauuuacauuuccaaugcuaucccaaaaccgcaugugcucuuaaccauugagccaucucuccaguccuucaguaucugguuuuaaagcauuuuuaucccccucaaagguaacuccgauauuuagcuucuauuccuuauccucucacaacccuaccccuagucuucacagguuucccuguguggauauucucuaacauaagaaucauacacuugaggucuuguguuugccuucuuuggcuuagccuagcauuuucauguucgucuguguuguuacagaaaucaguacuucacugauuuuugauuaucacauaauauuguugucuaauaaaccugauuuguccauuuaucacuugauagacauuuucucuuuucuuuuuuaaagauuuauuuauuuuauguauaugagaacacuauagcugucuucagauagauacacuggaagagagcauuggaucccauuauagaugguugugagccaucaugugguugcugggaauuuaacucagcaccucuggaagagcagucagugcuuuuaacuguugagccaucucuccagacccgacauuuucuugcuuaaacuuuuuuuuguugcuauuuugaguaaugcgguucugagcauuuaugugcaaguuuuauauagguuuguauuuucuuuuugagagaggugugucuaaaagugaaauugcaugauuaaguaguaagaauguuuauaacaccugggggaacuguaaauuuguuuuccaaaggguugagccauuuaauauuuaccaguguuaauuagagguccagcugauccacguccugaccaguguuucucagucuuucucauuguaaccauuccaggaugugcaaagugguauuccaguuuucuagugaaauauguuguauaucuuuucaugcuaauacugaauacugguuuauuuucucuagaggaaggugguguuuagauauuuuucccauucuuuaguuaguaaucauuuuaucauugacuuaucuggguuuuaauacauguuggcaccugucucagauauaugauuugaaaaugguuuugugcuacauccacuccaguaguaaccugccugacaggcugaaaagccugggcgcagucccgaggcgaaaaguucaaggaaacuuagucuccuggaaccguggcauacuguauauggaaugcuccaguguccuugcuuuaguugguaaaugggucugugugcuuucccuuaauauugcuuuauuauaagugcuucuaaggauugaauuuuugacauauagcuaagcuagauucuucaccaguccuaggcagucaguccucgagccgacccugggcauggauagcuaagcccuacacaggaauuugccauuaucuaggaagaaggaaggcuguggucuagggaggaaccagaguagauacuuagaacuguagauagcugaguuacaucuguacacaggcauuuacaauggccuagggggaagguggacuguacaauagacuagaauaggaacuauggcaaggguuugaagcccuugccggggcuucuaagauuaagcugaccuuagguggggcugcuuuugaucccaguuguuaacauugauuuuaucccaguugguuccugccaguccuucagaauccgguagccuccuuguaccuugccagugugucaccuaacuucccuauuuucuucuguauaaaaaguuugaugcucaauucaacaaauuacauuuagauccacacucccuugugucgagucuguuugucaccccauucucgccgacuguccuggacccugaaucccauggauugaggggggccgacugggcccggucaauagcaguuucgguuacauuuauguuuauuuauugugugcucacauucauuaauguauacacauguaugaagguccgcuccagcagguccagugcucuagucuggccucuaagagcccugcacacauaagcagcauacacacagagauacauacaaacauuuaaauguuugugaaugcuguaaagguauugauugcuaguaaagaaugaaaguuuuuaauuaagaacugccuuuguauugaugaguauugucuuuguguugcucgguguugggagaggcacaaacaggaguuaggaaaggccuucugugacuuccuguugugaauaaacucaagauaaguuaugucacuguaacgcagggguuagcgggugggugcuggguguugaaaccagguccucuggaagaauagguagugcucauaacuguugaggcacugcuccagcccccucccauugguuuuugauguacagauauacaagauguacucuuucaugaugcuguugaaagauccugacagaauguaaaaggucacagaagccuugaaauuggcaaaauagauuucauuguuaguagaaguagcuucacugauuuagaaaaauagaggugcacaaugcucuggccgcuccuugaaccugugugucugucaauguucugaccaggugugugcccauugcugcaccuucauuagacucuuuccuuguaccccucccauacccauuuucuugagaauagauauuguuuagaucuggaaauccccuacuccccccuucuacuuuccccccugagggccuauaaaaucugggaccucuuuccccucgaggucgacuccucuaccccugcgugggauaugagucguccccagagcucuggcuuuucccgaauaaagccucaugugguuugcaucugaaagaaccuaguggggaaacccccacucaauucccgauucagcgugcacccaaagaaucacgaacagaccgucuugauguaaauacacgaggugguuuaauggcggagcuccggguugaaacguaucucacacaggagacaguggauucgaccacgaggcuugaaagcuagggguuuuuauagaaaagggucuggggcuuggggaggaauugacgcuguuucacaugauugguccauuuaaacaucagcagacuguacaugcagaucaagguaacagcagagcaucugguuaacauuuaacuuaggucagaaggaagggagauagggaggcgccgggccaguccagacauucuuguaugucuucccuaucuuuauggcuaguugguuccugggaugacuuuacagccuuuguucuuuguucuaagcccaaaaagcccuccuaacuagcaagccgaaugagucauggaccuugaauaaacuuucuggcuagggcuuugaagucuugaauuuaguuuucuuucuuucacaucaagcuuggucucucgugaguucuuggguguccacuauugucccgaggccugagcgaggggcuccucauggagucuuucacuguaauguuuuguuuuuguuguuuuuagauuuauuuuauauguaugagucuuuuacugcuuguauguaaguguaccucaugcccaugaaugucagaagagggaguuggacucccugguacugaguuacaggugguuuugagcugucaggugggugcuggaaacugaucccagucuuccauuagacaacacauacucucaacuacggagucuucucuccagucugcucuauaggguuuaaaagauaguuuccagaggucaagaggcagcucagcagguaaaagcaucuacugcucuucuggagggcucacgugggggcuuacauccuccuguaacucuagcuccagggaucugacucuuuuggacuccacgaaccccuaaacauuuacaugcccccuuauuaaaaauaagaaaauuuaaaauaaugaaaagaauaauuuccaguaaaaguaagaaugaaauagcuacacuguuuuaaguuugucagucuucacuuuaguuaaaaaagaaaguuauucaacaguguauucuaaagcuguauuacugaggaaugugcuacaaaauagcagcuugugauggggcaaaauggcuugcaaguaauuuagagguagcuugggacugguacuaacugaaugauugcaacaagcugugagagcaacauaggacauguuuuucccuccugcaauguuuuugacauguugacuuuacauuuucuuaaagaagguuuuaaauauuugauaaguuguucauauugaggcuugaauaacauuuauuacaacacuuagaaauauuuaggguuaguuuacaaguauuuagucaauuaaaaaacaauuauccuuccuugugguccugccauuugugguugguaccuauugucaccuguaguuggaagauauuaaauggaaaauuccagaaauaaacagcccauaacuuuugugugcagugauuuggguggcauggugaaaucaugugucacuaagcgugagaggugaguugucccuuuguucaacagaagaucuacuaccugaccauuaguuaauuaauguggccacaaaguguaguuaagcgcuuaguuaugauggggaggcauucaaguaugggguuuugugcugucuuuguuucagaaauuugcuugaugucuuggaacacagcuuucacugagaaagggaaacaagcuaauuccauugcaacuuguaagauuggaaguguguucauuaaauagcuccacauuuggccuuccuguaauuucugacaacuaacaugcuguguguguguguguaugugugauaugugcauguaugcauauaugugugcuugcuacauguauaugucagagauaacugcagguccuucuaccuugcuugagacaggauaugugcugaucucacuguguguguuaggcugguggccugaggguuuagggguuuucuccuuuuucugucucccaucucccaacaggagaacuuggauuauacguguaugccgucaugccuucacccucugagccacuuuucugucacauacucucucccucccuccuucccuuucccucccucucucccuccuucccuccuuuucuuucuuuuucucuuucuuucucucccucucucuuucucucccucucucccucucucucucuuucuuucuuucuuucuuuuuuuuuuuuuuuuuuuuuuuuuugagacaggguuucucuguguagccuuggcuguccuggaccucacuuuguagaccaggcuggccucgaacucagaaauccgccugccucugccugccgagugcugggauuaaaggugugcaccaccauggcuggcuggcuggcuggcuggcuuucuuucucucucucuuucuuuuucuuucucucuuucccucuuucuuucuuucuuucuuucuuucuuucuuucucucucucuuucuuuuuuucuuucuuucuuucuuucuuucuuucuuucuuucuuucuuucuuucuuucuuucuaucuuuuccauaaaacuuuuaaucauucuuuuuuaaucauucuuuuggagugagucugcuggagacacauuuccuuaggucuuuauuucuccauucccugcuccuucccacauccucgcccuccucguccuccucaucuuuuugucuuccuccauccacaugcuucucaucccuuuuauuaaucuuucuuuucuuuccuaucuccaccuccucccccucccuuauguuuucuucuucucuuuuucaucccuucuccuagaauugggugcuggaagcacagcugugugcugggcaggcacgaccacugagccacauccccagcucuuuauuucauuuucagacacuucuugcucaguuguccagcuuggccuugauuauaucuuuucuuuuuguuuguuuguuuguuuguuuugcuuugcuuuguuuuuuucgagacaggguuucucuguguagcccuggcuguccuggaacucacuuuguagaccaggcuggccucgaacucagaaauccgccugccucugccuccugagugcugggauuaaaggugugcaccacaacacccggccagcuuggcuuugaacucacugugucaugacagcgaccucagucaugaucuugcuuuagguuuccaaguacauggccuuauagcugugcccugcccccacuuuauugcugugguucguuuuaauuucacuggugauaguauucuacauuuuuauccucuuagcaugccaaaauauuguauuguaucuucgucuccauucuuccaugugagcgauuugcuaucuuuccaguaguuauugcuccacugauaagaucuuucuuugguugcucccuggguuuuuauuuuuaauuaaauuaauuaauuaauuuuugguuuuucuagacaggauuucucuguguagcccuagcuguccuggaacucauguucuagaucaggcuggccaugaacucagaaauccuccugccucugccucccaagugcugggauuaaaggugugcaccaccaccguccagcccagguuuuuauuuuuuaagaaaaguuuaauuuugauauguguagucacagauuucuuugauuuuauuuugucuagguuuuacucaguuucuccagucuuugauuuguuuuucugcgugggaaguuuucagucauuauuucuaucuuauuuauuuuuuuugagagagggucuuccuguguggccauaacuggccuggagcccagucuguagauugggcuucugcagucaguauuucuuuagagagcuuuucaguucucccuccucucuuccagagacucaccuuacacaaagguuucucuuuguugucguuuccaagauugccaagucucuuucagacuguuauuaggcugacauuucaguuguuuuuacugcuggcucaugggccauuccuucugaucauucuuuuguugucgagcuuauaccugagcuugacauuucuggugcucaaaucacacucugccucuaaucauaucauuccuuugcugagguuuuguuuuuuguuuuuguuuuggaugccuuaaaaucugucuaauaauucugaugccuuuguuaccucaguauuuccagcuguuggcugucuuuuuuucuuuaauuccuuucugagaucuuccuguuuuuuuugcauguauaauggagauuuucaaaauguuuugauuucugcaccuuacauaagucuuguauuuaucugucccuacuuugguggagugagauggagggaacauacagcauuguagccaggugagggucaacauguucuuugugaaccccgggagggauaggagggcaaucucacugcauuggugagaugggaguuccaugucccuaccuggucucugcugaugcuuauguucgcugcucuguucccaugagaagauggugagucuugacucuccacuggacugcuuaaaguacccucuagucauacuggcuauagugugcuucauuaccaacaguagaggucugcauauggggucugcuuacaucacaaaacagagagugguucauuaccagccaguggguauaaaguucuuguauuuucuaagagcucucugaauaguaccagauuauagucucagcaggccgacgucuaggcucuacauucagcccuugucugaacgggugagaauagucuguauguuugaccuguagagaucagacgagaacagcaggucccauaaagcuggagucauagauugcuguaagcuaccacgugggugcugagaacugaguccagcuccucuccagcagcaaggaaugcucuuaaucauugagcuaucuaguuccauguuauuuucaauguuuccugugucuuauguguuuucauguguggaaacuagggaacuagaaagaugccucguuucuaaucauugcauuaguguuucuggaguagaaaggagucauggaacaguguuaagaauuuaauggguaagguuuugauguauguagaccacagugcauccagagagauugaaaacuuuuauuucuuucacaucugcuucauuggucaaccaaguuguuguuguuuuccuggucuugucucagacucaggcaugauaaccgcagaccucucagaggcuugugcuuagcaacguuaaguaccugcugacuguuacgguaguacugugccugugguagagacaucgagacugaguuaaggacagcacaacccagcauggagaaaggcccugagugacggugauaugaggguuuaggaaggggguguaacucacugcaacuuaggacugagugugcaaaggaacacacacacacagaagaguuaucuugcuuaguuuuguuuucuguuccgugacaaaauaugcugacaaauagcuuaggggagaaagggcucacuguggcucacaguccagguugcagucugucacuguggggaagucacaguggccuggaagcuggcaccugcuucuguggucaacacauaggagugaaugugugcgugcccauuugugcaugagucaccucuuccugugugacauagccccaggcccagccaugcaacagugcugcccacuucaacuaauguugucaagguaguccugcagguaugccugcuggccagccugaucuaugcagguccucuaggagacucuucccuggcgagucuagaguguauuaaaaccaacucuuacaccacauucccgaggaccucuucauguuucuaaagccgucuccgauaccugucuucuaagcaccugcugcuccaucaggcagaguggagcugagcacugcaugcugggcuggccagcgucugcagcacuuacauuugccaguuuaccagucuguuccucauugugaugauuggcccuagugagcagaagcgguuuuuuuuuuuuuaauuuaauuuuuuacuuauuuauuuuuccaguacaucuggacuugucccccccccccccccuucuccagaucacucuuccuauguuuuucuuuagaaaagagcaaggcuucucagggcuaucaguggaacacaagcccucacuucaaggcugggcaaggcaacucaguaggaggaaaaggaucccaagagcagacaaaagagucagggauucccaugucaggagccccacaaaauggcugugcuaacaggcauaacauauaugcagaggaccuagugcagagccauucaggcucugugaucgcugcuucagucucugcgagccccuaugagcccugcuuuguugauguaggcggacccugcucuucaugugugcugacuccucuggcuccuacaguucuuccucccucccuucagcaggguuaccugagcuccaaggggagagacccaaggcuagggaccugauggagaucuccuguuuggucauccccccacucccucugccuaauauuuggcuaugggucucgagcagaaucuuucuggauuuuuaccuuaacuuuuguauuuaaugcauaacguaugauuaguaugacuaacaaaugaaugaauguuaagucaguuuuaucaacuccucagaguuaucuuagaauuuacuuuaauucugauuuauuuguuuccaaguggucuuuuuauuauggcuuauaguauacugcuauacuauacaacuuucuugacucuugacuuuccaccugaaugaguauaauuugcaaaucuuuuuuuguugcuguuuuuuuguuuuuugagacaggguuucucuguauagcccuagcuguccuggaacucacuuuauagaccaggcuggcuucgaacucagaaaucugccugccucugccuccugaggcagugcgccaucaugccuggcuuuuuuuuuuuuuuuuuuuuuuuuuuuggguuugcaaaucuuuugaaaacauuguagaauguucuucauaaaaaauugcucgugggcuggagagguggcucagcgguuaagagcacugacugcucuuccagaaguguuauugaggcagaacugagagccuggaaauaacacucuaggugguauauuuaaacccaguccaagacaagaauuaauaucuucuuuuuuuuccauuaacuguaacuuuuguuaugaguucucauaauaaauuacugcacugaaguaauuuaaucugugauguuccuuggcagaaaaaucuugaaaauauuuuauuguaauugugaauuucacacuaagucauauuucaaagucauuagcaaaaaguucuggaaaaauacagucaucaagugauaugcuccaaaagauggauugcuacuauuuuagaugauuaaguuaugccaauuaucugggcuuuguuugaguuauaccccacuugauuuccaguaaaauguugguuuuaaauguaaacaauacuuuuaauucacuccuaauguaaauauggccuaaguuuuuugcugaaguguuagaaauugucuauauuuagguacauucugcauugaauuaaaugaaauaauucucauacagcuauuuuuuugcaaugguauuucuauuugcugagugacuaaaaaguaauuaguuaugaaaugagaggcagacuaucguaguuucuucuuuuaaguauuacuuaugaaaugagauguggguuacgauaaauuccuuucuaagugagacauuucaaaugcucucccgguucuuagcacuuauacaugcuuucuugcuuaaauucauugccagauacaggaaaauccuauauaauucaauugggagaaagccgcaaauccauuuguugggccuuuuaauuguuuuugaguuuuuguuggaauguuuucaccucugaaauagguuauguguaauacuucucagaaaauauuacaucuuaaaguaguaucuuuguuuuagaauaagcugaaaauccccagcuauuuguuuauugguauucagcuccccucugguuucugagugccuucuuuaaacuauugcaguaauagaccguagcagccucucggaggaaauagcccgaaccuucugccugcacuucucugcugucucagugcuugaucuguauuuaguugugauagaauaauuuucuuacaagguuuucauuuuggggaauuguuauucucugccucugauuggacugaccugguggaauagcaucugcuucuuuuuauggucauaaccagcaaucccaaaguuucacuguaaaugaaaaauuauuuauucauucccacaacuauucuguguuugccauguguuuucuguuuuguggcccgaggauccagaaaugcgagauacauauauacacuuuaagacacuauuuugcaguuuggauagagaguggucaggaggggcuagguaacauuacacugucccaugauguuagugucugaaguaaugagagauugucauaggauagcuuauaugugcuauuucugaacccauauucugaaguguugagaaauacuuccaggagccaucuuuccagcccugcagguuagguuuuaaacaccauguagcccaggguagccuugaauucaagauccuuuaaucuaagucucucaguugcuagaaucccaggcauaaccaucauggcuaguuucuaauggaugucucuguaauggacauaggauguuaguguaauacccuguucuuaaauaagaggauuugauucaauaauggcaacucauaaugcaaugcuuauuguguacucuuacaucugauguaugcaucccucucuucuaucucucacuuaauccccuccacacuacagucauuuauuuauuaaauuauggucauggucucugccucuuggaucauaugcuuucuugaaaggggagguuaguauaguauaaccuccuguguaguauaaccuccuguguaguauaaccuccuguguaguauaaccucccugaauaaaugcuuauuaaaauaaggacugacuuaacauuccacauggagguuucuaucuguacuguuuauguauuaaauguaugcaugugucuagagagagaagaaagaaaugaccauguuuuaguaagauacagccagaauuugauauaaauuauuuuucuauuuuauuauuuaucugagaguaguaauuuaugaaaaaauacguuuuaaauuugucagccaacaugauuguuauggugauuucuuuuuacucugaauuuauuuauuuauuuauuuauuuacuauuagguauuuucuuauuuuacauuucaaaugcuaucccaaaaguccccgccuccauguuauggugaucuuaauugucagaauauuuuuuaaagauuuaguucuuuguuuuauguauaugacuacacuguagcuguauagauaguugugagcuaucaugugguugcugggaauugaacucaggaccugggcuugcuccaaucccgcucgcuccaggccuguucgcuccagcccaaagaucuauuuauuguuauauguaaguacgcucuagcugucuucagacacaccagaagagggcgucagaucucauuacagaugguugugagccaccaugugguugugggauuugaacucaggaccucugaaaaagcagucaggauuccaaacugcugagccaucucuucugcccucgcuguguucucuuugaguuuuauuauagagauuuugaaaauuauucccacaaaauuaugauagaaguggacucccaaauaucagccaaccucccuaagcacaccacaguauguguacacagacacuggggacagggugggguuggcugacauuugggaguucgcuuucuuuuucuuuaugugugguccuggagacccauccagugucccuaccaauggcgccaucucacuggccuuuauuguaaauguacacuuuuuaaaauuacauuuuacuuguguguggggcacgcuuaugccaugcuauauugcggaggucaggggucagcuuguggaagucaauucucuccccugugaggcccagggcuagagcucagguagugaggcuuggcccagugcuuuacacacugagcugucucacuggccuggauagaagcuuucagguuugcuuuguuuuguuuuguuuuauguaauuuauaacuuaaaggaaaaacuaauccuuaauuucucagacauuaucaguagguacuuguucauuguuuaacauaauaacaacaagaaauaauuucauuuaaccuaaagaauuucuuggagccaggagcaguggcucaugccugugguucuaacauuuggggugcagagacagggaagggaagagacugagggacugggauguagcucagugagugguagaaugcuugucuuggauagcccuugggcccagggacacacacagaagugucuucccuauagugucuguguggguccucacuuauaucaucuuacucauugauguaaugggaucuucuuguuucagaacccuguccagaggauuccugacucgcaugagauaacacugaggcauggcacuaaaacaguaaguuuaaaauguucuuguucuuuuuuuuauuaacagagcuuuucuggaccagucagcugauaagguauaauacacacacaccacacacacacacacacacacacacacacacacacgcacacacacacacacacagccugagaccaugcugcuaaggucaacugaugaaagcuacagacaucaugaaaaacuagaaagaugauuuuucacggucaaucaaaauagcagcaccuuucauuuuccugggguccacuuacugucauuguuauuguuggcuuuaagauccucuuuccuugggaaacaggaccauuauaaagugacacauucaguucuguuuuuaauaguuuugggaaacuugccauugccuucaacauuauugcagucaagaaagacaacauucaguggagguagauccagaacugugggaauugaucgaugggagucuuaacauaguguauucacuccacaggcacuuuucccuuguaaagauuuguuuuauacacaucucuguuaaauauaaucaguuuaaugucauuuuaaauaaaaugaaaauucucauuucuaguguuuagugucaauguacauaaauguuacauuaaaauauacuuugugguuuucaauagauuuugagucuaaacggucuugacagauuuuuagaaguaggcgcauucucccaaauagcugagaacuguuguuguuauuuucuuauuaacauugcuuaaaaauccuguggggcuggggagaugcuucaguggcccuggguucaacccucuucccuacacagcaacucagcaacucacauccuucugauacucuagugccaguccugcaacugcggacccacccucccagccccagauaguagauucuuucuuucaaucccaguauuaggaauucuuucuuuuuugcuuauuuagucuaauaaagguuucuuauuuucuuugaaaaauucacagaaccaacuguucuagcucugugaccuuuucauuuuuuuuucuuucuuuuuuuuguuuuuuuuuuuuguuuuuuuuuuucugagguaagguuucucuguguagcccuggcuguccuggaacucacuuuguagaccagacugucugugaccuuuucugugugugcaaacuucuuguguuucacuuuccacucugaacuuucggcuucccuuuuaugcuuccguugcuuuugauaguuuuuaagaguggaagguuaggcuauugcuuuuagauuuucuccuuuuccacuguuuauaaguauaucaaacucauacauuucucuauaagcauaucuaucuuugcauauuucuucaaugaacugcucauagugauaguuaaaauugauguuuuggccaucuaacaaaaagacugaacuauuuuuauuuauuuauuuauuuauuuauuuauuaauuauauguaaguacacuuuagcugucuucagacacuccagaagagggcgccagaucuuguuacagaugguugugagccaccaugugguugcugggauuugaacucuggaccuucggaagagcagucgggugcucuuacccacugagccaucucaccagcccaagacugaacuauuuaaaaguagaaauuuuguagugguuccuuuuaaauuuugaaggaaaauauaaaaucaaugauuuaauuugaguuaaaaaauuuuuuuauuaaauuucccuuggggcaugauuuuauaaccaauuuaaauuaaaacaguauuuaaaauacuucgcuuuaaucacaagaaaaaacugucaaauauucaagcacuuauacaguuaguuggaugccaggucaaauaaauugccuaauucuagauucacaugugaagcucaagacugagaaaaugaugaauguccuuuaaagagcgagggagagagcugaaguugaagaugcuagagccuguucucaggcuggguugaaagaaacauauaugaauacacuagcaauaguaaagaaaggggccaugagucugaaggggaguaggaagcaagauaugggagguuuggagggaggaaaggggagggagaaaaguauggccugggggagaaagcuaaaacagaaagccuaaauuacuuuguguccuggucagacagaauacucuagaccaucauuccgaauaguuugauaccuguuucuacauuuuaugauaauuaaauuaaaaaauaauuauuucuucaauaauauguuuauaguaaguaucuguugaauuauacugacauaucugugauuaaaauacacugaaaaauuaguuaaacuuucugucuuuuuuaacucuuggaaacccaggguuugagaauuaaauuuaaucugugggaagacacagucucuaacuggggcagauuauuuuguccgcacugaauucuguguucugucuuacagacuuucguauccuugguuauuuggaauaaugcuuuaauauuuuagugaaguuuauaagcaucggcagugacccugcugucugaaugcucgcccugaaagcauccuuuugaagccaagcugagaaugcaugcuuauaacccuggcacagcggaggcagggccggaggaacaucucagguugaguuccaauaggucuaccuauugaaacauugcuuaaaacaaaacaaaaaacuaaguacccccgaaaaacuguccccaauccccaaaauggcuccuuuagaacaagaccaccacgguuaccuugaaaaauaucaagaacaaacucuaucaucuuguuguuuugcccuggaguguguuaucuuuuugcuuuuaguagcacaguaaacuuaaagauuuacuuuguuguucuuuugugauagaggaagaaauaucucauauuuguugcccugucuuauuguuugaauuauguauaaggccggccugccuuccucccuuucucacucucucccucugcuccucccuccuucccucccucccucuccuccucccuuccucccucccucucucccuuccuuucuucuuuuuaaagacagcaucucacuauguaacucugacuauccaggaacucagagauccaccugccucugccucccgaguacugggauuaaaggcaugugcuaccauacccaacugacuuacauaaaauuuucauguuucauguguguguguguguguguguacacugguucacaugugcagguguacauaugugugugugcacauagaagccugggacagacaguaaaugucuuccucaggugcucuuuaucuuccuuuacuaagcuggagcccauugauuuggcuggcgugguuggccaguaaauuccaggaaucugcuuuccuccaacacacacacacacacacacacacacacacacacacacacacacacacacacacacacacacacacaacaaacagcaacaccacacacacauagauaacaauaucuuuauuucaagauaaguaguauaauaaagugaaguaaucugcaggcuguaacucauuaccauucauuuucagaaguagcaccagcugcugguccacaucugcugugccuuucucacaguggugcuggaggcuagaagugggcuuugucuaccccuuuccucugugagcuugcaucuguuuguuuugaacagguuucugcucugggucuggaccccucaggugcccguuuggucacuggaggauaugauuacgauguuaaauuuugggauuuugcuggaauggaugcuucuuucaaggcauuucgaucccuucaaccuugugaaugguauguauuuacuuaacagcuccaugguuagcuuuuggcuuuuauauuuggagguaaugcuguugucauuugaacucagucuacaaugaauaauauugaacuuauauaaauuauauaacuauuaaaugaaaauaaaccauacaucucuuuuccuuagcuucauugacacguaugucacauacauaugugacacacauauaaaacacaucuuuuaugcauuauacaaacuauauauacaucuauuauuuccauguauauguucauguguuauguguguaggugcaugugccaguguacacgugaagaaugagggcagcuugcaggagcuguuucucuccuuuugucacaggggcccuggggaucuagcacagagcuucagguuuggccauaggccgcuuuccccacugagcccucuccuggcccuugaccuuuguuuucaaggcauuuucuaccaguuguuugguuuuuaaaaauacaucuauuuagaacucaguccuuccuugcuuuacuuuaaaauauuccagcaaauaaggcuugguaaugugguguuuuuguuguuuuuuugagacacggucuuuccauguaguccuggcugucuuuggaacucacaguguagaucagauuggucuuaaacucauagaauugccccugccuuugcuuccugaaugcugagauugaagacacaugccaccacaauuggcuuauaauguguuuuuguuuaugguacacacucaguccuuauccaagcagugguccaugucacuuuccuguauggucaguuagcguugcacuaaaaaggcuugacaaggugcguccgauagcagccuuuucuguuucugcccauauaugggcgucgcacaugcugcuccuugugguauccuuuuacuccuuugucuccuccccaguacagucagagaagaguaaagacuugauuaggcuuuauacuguacugauagguuccuacauuaagcgaauauugcugauacuaaugaaggaaucacuucacugugaagugaauuuauauauauauauauauauauauauguguguguauguauguauguauauguguauguauguauguauguauauguguauguauguauguauauacauacuuaacaggaccuuuguggagaaauaacuugguaauauguaauacauaauagugaugaacuugcuggguaugguggcgcaugccuuuaaucccagcacuugggaggcagaggcauguggaucucugaguucaaggccagccuggucuacagagugaguuccaggacagccagggcuauacagagaaacccugucucgaaaaaccaaaaaaaaaaaaaagugaugaacuuauuaccuauucauguuugcuacauagauuauugaucucauugaggcuuauauauuggugguuguugguauacauuuaggcuacuuuauugguucuuauaucuaccauccuuucccccgacucuacccccccaucccuuccaacccccaacuccaggugggagagaaagguuagagggaaagcagggcauagaucucguuagacuacuugcugacuaagggcaucaaguuccuggggcaaguccagucuucauugucaagauaucccauuucuucuucccuguuugcgcaugaccacuugacaaacaguagcaacgggggagcagccgcugccuguggcuuuggcauuuuuauauccucucaaggguccccagaguugcaaacaaaaauaaacucucuucaccuggcagaaucacaccccugccaaagcacgagacaaaucauacagagcucuuguggagaaucuaaagcagcugauaugccaccccugggaucaaaacagaaacauguccacauaagauuucugcguuuguaaagagccagcgcucuuacugacaucguggacucugacccaccaggacaguuaagcagguuuuuuuuuuuuuuaaauaaguugccuugaucacgguguuuugucacagcauagaaaauuaacuacaguauaggcaccucugguuuucuuuuucuuugacuucuguacuuucaguuauuuguuguuaguugcagccauucuuuuuguucuguaaauuguccagauuuguccacuagaaaccuuuaauacuauuuugacaugacuuuauauguauuuaaaagcuuauugucuguucugucugucuguguuuaaaugacaaagucuuauugauucuuaaacguuuuuaauaaaccuaauuuuagaaauuuuauuuauggaaaagugacauuaaaauuucagaaaugaaguuuauuaacugaggauaauaccaagauacagauucucaauauguuuguuguccuggaauaucaguagcuuuaggcagauuauugaugguaacuuauaugagucacacagugcuucucauucuagcccagugucgcuggguuuuucauucugucuuuaauucuguuuugcaucuccucuucugagcacacguacagugugagugaucuagugaucuguucuugguauuuagacaacagagaaguagaaccucuugugcuauggaaaguauucuuuauguucccuacccucugugacagucacugcagauaacuagugaauauuggaaauacaguuaccagguuguacuggugugaguguaggagcccacggaggccagaagagggugucagacaucguggagccgagcugcaggcaguugugaacugcuucacauggcuguggggaggaacaugcauucuuaacugcagaaccaucucucagccucucgugcauucuucaaaagugaaauauggggggggguguauguuucauuuaguuucacugucuuaacugaauugagucauuauuccagccccugauucuagcacucaguacauaaugaccaguccuucuuuuuugccaguuagaaguugaaugaagaugcaguaagaucucuuuuagcuaacaacaguugaauauggcaguuggacuuuggccugcaauuagaacccuuucuuuuugugcugugaaucuguucuuuagaguuccuugaagcagcugaagguaaucuagcuuggaguaacugguguuuucugacaccauccuauagaaauagguccuauagaaauagugggucgcaccacaccccacucacuuccuuggccuguucccggcacugcauuauacauguuggguccauagcccucugccuacagguuccauauccacagaguuagucaacugcagauuaagacaaaguauuggacaagcuugccugagagaccugagcaccuguagauuuugcuaacugcagugucccuugaguuaguucuuccugggaaucgagggaugaucaaaugauaacuauaaauauaaguaugaucuuauucuuuggaaauuaagaaguaauacuaguaacuacuuguuucaaggucucuaguggguaucuuuaugcauauuauuauuauuauuuaauuuugaauaaauguuacguuaguauauagguguuugcuugcauguguguauaugaaucaaguguguuuuugaggccaaugagagugucaaauccccuggaacugcacuuauggauguaguugcugggaaccaugucuuauucaagaguaaacaagugcucuuaaccuuuggccauuucuccaguucugauguauaauauuauuucaaucuauaaguuaaguuuuauucucaacauuuauuuauuuauuuauuuauuauuuuauuuauuuacauuccaaauguugcugccccaguccccccuuccagaguuauucacgccccuccuucuccucugagagggugcuucccuggggcaucaagucucuagaggauuaggugcauccuucucccacgaggccagauaagacauucaucugcuacaaaugugccgggggcuucagagcagcccacgucugcucuuugguugguggcuuagucucugggagcucccaggcgucuggguuaguugacacuguugguuugauuucuuauaguuggguguuuuaucugcaugugccccacaugcacgcaaugcuugcagaggccagaugagggcauuguguccccuagaauuggcaucacagaugguuguaagaagccaugcagaugcugagaagugaacccaggucuucuggaagaucagagagugccuuuaagcacugaggcagcucuccagccccacuguguaauacuguuuuuacaacuuaucccaauccugugaguuaaguauuauucuccuuauucaauggaggaagccgggacucagcagaaugacccagguagcaugagcaugcuguggcccaggaacaucucugucuagucuugcuacuguuccugugugcggguuuucuguaauauaagacagcggggagcagaagggcuugcucauccucauacagccaguuagcagagcgaggguuuggaucucuagauuucugacucacauuccggugcacuuuucacuacagccggacaccuuggcucaugagccccaagugacggcccuggacagcuguguuuaucugucuugcaugucccagcuuguuuugcuagcuaagcaaaagguacuuacaggauccucagucuucaccuccccacuccccucacucucguagucucccccuuugcccugugaauaacuucacagaaggaguugugcaaugcuacuaagccaucaucuggugucagagugccucccugagaacacucacuuccucaugacuccacuuuacugucagauuggcuuucucuguucccucuuugaucagaaucuuaguaguauaggcaggaauuugaagagcagauguacuaccccuuggacaagcccuuucauucuccucaguacugugucuaaugacuccuaaucccguccuuuuaacucuguggccagcagaauuaagagcaaagugggacaggaaugaugagguuggaacugaacauucucauuugagcacuggcaaaguggacuacagagagcacacgaaaaugcuaacguuuuucuuccuagccgaaaagcaaagcaguacccauguggguugcugaagauguaggucucccucugaauauaaacaguguugguagagugguuccagagagaugggaccccugccugcuucuacucccucuccuuaaaguuugcuauuuuuaagauuuuuaacuucccuuugaaaacaaaaaucaaucaccagaaaacagugauaaugcauaggaccagaucucuuaggcuugauugaagaaaauuaacacuucccaaugggagugcuaguaacagaggucugucuuacacgcuagcaaguucucacagucuuacuaaaagaccuuuguugagcagucucaacuguuuaauuaucaaagauuugauguguuuuauguauaaaaccacaauuggucuaaauagacucuaauuuucucaguuccugauugauugccuaaaauuugaucugucagagucuuacuagaguguagaaaugugauguaauuugaucagaaacacuuuaauaagauugcugacucuacuagaagcuauguaaagacuaugcaagcacacaagcagcauccucugucucuggggcugacggacaacauucgaggaggagcccuggguugagauccaggccuucucugaaagggcauggcugugccucucacuggaucgagagagguggcucugguucugauagcaauuuccccauuagugguaggccuucagugggcagggggaagaaagaaagagacaaaggaaaaggaaagaacagaaagaaacugagggaaagaaaaaaaaauuucucacgccuuuaaucccaguauuugggaggcagaggcagguggaucucuaagagcuugaagccagccuggucuguaaagcgaguuccaggccagccagggcugcaucgagaaacagugaaugaacaaaagggaaaaaccaaauaaaggcaucuagguuuaaaaguauaauaagggccaauagcaaugcuccaugguaaaugcucaaccacccugacaaccuggcugcgaauccuagaaccugucuucaaaggauagagcuggcuucugaaaguuguuucccaccuccauaugguccucuucugcacacgugcacagaguuuaaauaacuagauacaaaaugcaaaagcuacaaaaaguaaaaccacugcuaacacccaguacagugauuucuaaaccaggaaucacagcaguaagcaaaagugaggugacggaguugcuuguucucaguagugggcagggucaguugaccuuggggacucuuguuugugucauuugucagugucuagacuuccugugguugucaccucuucucaggacaucaagguugcucuuuuuaaauuuuuuuuauuacauuuacuuugugugugugugugugugugugugugugugugcaugcaugcccacacauuccaugacaugcacagaggucagaggacaaauugcuacuaguugguucugucuuuuaucaacuuggguccuaggaugaacucagguccucaggcuuggcagccagcaagguacccucauuucuuuuuucuuuuucuuuuuuaaaauguuguaguuaacaaauaagauacagcuuuaaaaauuaugcagauaaguuuauuggaaaagagccaggauauucaugaguugguuggauugaaaguguaaguuuuaggagguuuugguaaauuacugugggacauggggggaugauuuugugcuuuuuggaauuauuaauuuuacacuuguauaacauuuuuuacugacuaugcuaaauguagcaaaaguauuaaaaaaccccucuguuucauuagacuguuuuguuuuucuuucuuauagccaucagaucaagucguuacaguacaguaacacaggagacaugauucuuguuguuucuggaagcucacaggccaagguuauugacagagaugguuuugaagucauggaguguauaaagggagaccaguauaucguagacauggccaacaccaagguaaguauggacgguguuuaauggauuugaguucagggcuccuuuucucucccucugccgucccuccucauuccauucucucacuuucucccucuccuucuuccucugcuccaccccucaugcacucccucccucucuccccucucccucccuccccuucuacacuccuuucucucuccucuugcuucacugaccaucccgucuuccuucccucuuuuuccuucuccuccucuucuuccuccucuuccacuucuuucuccuauuccuucuccuccauucugggccugccucaguuuucugagugugggguuacagcacccuauccuaucuggucagcacauuuacuaacaaguaguuucaguugucauguaguaauuucuccugaaaguuaguauguuaagugagugcuacuuugcugcuucucacaguuguguggauuguuugggagguuuuagguaggauagugucaccaggccucccucagauggucacaguugcuguacaagcccguggccucuuugucuccuuucucccucaggcccugccccucaugugccugcucucacucugagucaccuucccucugucaucugcuuguagauugagccuucuuccaacaugcuggaaauuguuuaguauaauauacuucauaguguaauuuugaguucuguauuugugaacucaccuauauacuuaaacuuuuuauaaccccagauucauacacauugcaccuuccuggcuauaugugaauguguguuuacaaagagcagcgaaaaugugacucugaacaagauagcacuaucuuuuauuuccugucucagaacuuggauuuuagucaggguucuuaaaugucuuuuguugaugacuuugguauuuuaaaugacucccugacaugacguugaaagggcuacggugcugucugguguucuccagcacaagucugugguauguauuauaaagacaaugcuugugucagucaagcuauauugagguacaagcuaaauugccauugacuaugaacccaauguuaaugaaucagcaauauaaauuaaacaagguguccuuaaacacagacacauaucaaauaaauuauguauugaucgguugaaaguaugaccagagacuuuucggagcccauuuaaaugcuuauucagcauaccaagaugauaacacacgaaugaggaaaauuggcuauaaucuauuuuaauugcugugggugaauuauuagauucagccgacauaauguguuuucagauugucccauguugaaccuguagagaugccugucuacaggguaggaucacaaucuuuuguuuauugguagauuauuaauggacccugaacauuugguaauuuuccaaacauuugaauacaauuuaaauauuaauuuuauacuaaaacugcaguggugacuugacuuuuuuuuuaauauuuuuauuauguauuuuccucaauuacauuuccaaugcuaucccaaaagacccccauacccucuccccaaccccccacccacucccacuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccaccuauaggauugcagaucccuuuagcuccuuggauacuuucuuuuuuuuuuuuuuuuucuuaagauuuauuuauuuauuuauuuauuacauguaaguacacuguagcugucuucagacccuccagaagagggagucagaucucauuacggaugguugugagccaccaugugguugcugggauuugaacuucggaccuucggaagagcagucgggugcucuuacccacugagccaucucaccagcccuggauacuuucucuagcuccuccaccauccaauagcugauugugagcauccacuuauguguuugcuaggccccggccuagucucacaagagacagcuauaucaggguccuuucagcaaacgcuugcuaguguaugcaauuguuuggaggcuaauuaugggauggaucccucaauauggcaguuugacuauuuuuuuuuuuaaaaugaauuuaucuaguguuuuuaaaaucauuacccugcaaaaagacgguucaguaaguguuaucacuaggguuucuauugcugugaagagauacuaugaccuuggcaacuguuauaaaggaaaacuuuuaauuguggcugguuuacaguccagagguucuguccauuaucgucuuggugaguauagcugaaaguucuguaucuggaucggcagagagcaggaaaagaguaccacacagagccuggcuugagcaccugagaccucaaagccuaccccagugacacacuuucuccaacagugccguaccuacuccagcaaggccacaccuccucgcugugcuguucccugugggcggauggcgcuguuuucauucaaaccgugacccugguuaaaugugcuugcuacugugccugcaaaccggauuucaaucccugugccccacaugguggaaggugggaagcaaacgaguaaacauaguacugugaccugcacauguuccccaugacacaugugcacccauaucaacacgcauugggguuaauagaaguaaggaauuacaguagcuagggcucuggaccucaagauggcaggaacauuauugacuuagcuauuuccuuagccugugguuugaaauugugcuuaugaugacagccuaagcaacauuuagucaagaauguaggacaucaaaauguuaacuaauuuaucaauauauauuaaaaauauuacuauauauguagcugugcacuauagcucaccuuauccuaccaauauuaucuuuauucugacuucaaaauugcuuauuuugcuuucucuauuaauugacugucuagaaauauuacugaucucauuaucuuuggcuugaaugguggguuucacaaaaaugacagguuuuauaggauacuuaaaaaaaaauuaagcccccuucccaguuccuagagaaauuaguagauugugguuuuauaugcagaucuauugugguaaaguauuauauacuuaaguaugaaaaggcuuuucuaguuuaguguuaaaagauuuuauuucugugugugggugugggugugugaaacagagagagagagagagugagagagagagagagagagagagaauaugaaugaaugagaaaggaaguuugaauguacacugauaccacugcauguguguggaggucaaagggcaguuuuggggaacugauuuuuuuucuauccaugaggaucaaacuuacauugucaggcauugcuggugacacucucaccugcccagccaucucaguggcuguuuuuguuuguccuuugagacagggucucacucuguaguuccugcaggccucaaaguuucacucagccucauggggguuaguuacagacaugaaccaccauacacagacuuuuauuuuauuuuugcuauucuuugcaugauuucuauguuuauuuacauauacauuauaaauauauguguuuguauuuaagagcacuuaaggguuauugagccaggcauggugccacauggcuguaaucuagcacuugggagucuaagucuagauuacugcagcaagguagaagacagccagaucuucauaguguguuccaggccaacucgggcuacagaaggaacccauaucauaacaaacaaacagcacuuacaggggcgcauagacaauauuuacaagacuguaguacacuaaagucuaauaugugucuaacacuaguuccuguugaccauggaaaaauggaaaaaccccaaauuauuuguaauucuacucaaauccaguugcuguuaaaguuuuaauuuuaaugucuguuuuuaucugaugcaucugaaaacucgucuuaugucagagaguugaucucucccuuaagucuuggagaaguuagguaugccuaccucagggcugugguggaauguauggagugguguuugagccuuuccugggagaugugcauaagugacucccucuguagguagggcaccaggaacagaccaaagaggagaguucacccaaaccuagcuuggugaacccgugaguuuaauuuggggaaugggugagagguuucaggauaauggacgacaauucaucagaggccauacuauccaggaaaaguucucccucccaauaaacucugcacugcucccauaagcucaggcauggcgggagcuucaugcaguuagugugcugccucuugagggauuguuaaugggccgagucuugugagguuucauguggguaaccacagugucugauuucaggaggguagcaaccgugucgugccugugggauagagaauucccuaauaggggcagauagaacaacuuacuucaggcagagaauacuaguuuuguuugauacuuguuggauuuccccaugaaauacauuuugaaaaucggguucugugaugguguguguuugaaaugccaguaagcggaggaagaugaguguggagccaguguggaugacagagggagagcucaucugggaaacaaaucauguaugcuugacuucaugagcuaccuugcugucuaucuaggaaaguggauuguuacuuuugcagguuuagguagccaggacaagagcaaucaggaaucauuuuauaaucaauauuuaaaccauucaaaaggagucuuuuagcaacuguggugauagaauaaugaaauacauuuauccuaaaccagaacuugggcacauuucuuauagucagaacauauuccuuguuacuuuccgcucucuagcacacauugugcuugguguucauauggggcuucuuggccucacgccuggaaauguguggcugcuaagccagcauaauauaguaaaccagaaguucucaccaauacagaguucuacagaguuaaaggcaaaaguguuuuaguggguuuuuaauaagugaauacuuacugaaguagucauaaucucaucauuaauuuucuuguauaaauucauccagggucucacgucuuuccauuauuggcuucaauuucuuucaacagaaaagcaagucuguaccauuuguuucuuuauuauauaacuaaacugaagaggguugguucaggcgaucgugaacauuugaauguuugaaccuuuuaaggggaaauuuucuuucagugaguggacuuccauuguggggaguagaagggaaggaauguuauaaaagcucuauuuauuuuuauuuuauuuucuacuguucuuggaucuacuagcugagcuacugaagggauuguauuuauuuuuaagcacacaggcagucauccuugaugccuagccacuccaaauaauuacccuuauuacuuggagagcaaauauauuagucauaucuuuuuaguaguaaauuauuuucccuaaaauguaaaaauuuuaauauguauuaaaauaacugugaauucuagguuuauuuuuauuuccuuaagcagcuuuuuuccuuaagcaauuuaauguuuuucuuuucuuuuugugauggugggauagaaucaggagcucauacgugcuagcaaguguuccaucuuaagcuguaacuguuggaguuuaggaauuguuccacaaaccauacgcacaccaguuaagcaagaacagguuacugaaugcacacccuaauacugaauguucaggaccacaaaaaggacucuagagccuaaauguggcaucagccuuuccucagggaagacuuuuuuauaggaaaagcuagcuuccaaaguuuaaaagcaagcagggaagugguauguuuuuggcuaacuagacaaagaaugaucagcuguccuuugggcugacugguccuaggugaaggaaggaagagguguccagguacugaacccggauuccaguacauugagauacccgaggacaagugauccaucaaucuuuuugacuuauuaguaacauuucucagugucagcucuggaugaucacuucugggaaguagagucccagaaccggaacuuaauuucaccuuaugaccuaaauggagacugaauacaaaauggcuccaguuauguuacaaagaggaggccucaccauaaacaacagcugauggucuuacuaauagaugaaacuccauuuuuaguuuuuucuuucuucuuucuuucuuucuuucuuucuuucuuucuuucuuucuuguuuuguuuugagacaggguuucucuguguagcccuggcuguccuagaacucacuuuguaggccaggcuggccuuaaacccagagcucugccugccucugccacccaagugcugggauaaaagguguaagccacuaugucuggcuccuuucuuuuuuucuuuucuuuucuuucuuuuucuuuucuuuucuuucuuucuuuuuuucucuuuggagugggggcugaguuucuuuguauaguguuggcaguccuagaacuagcucuguagaucagacugaccuugaacucacagaggucagucugucucugccuuccaaaugcugggauuaaaggcauacacaccgccaccuggcuuuaauugguuuuucaaggcagccuauuucuguguagcccuggcaguccugaaagcugcuguguagacaagcuuggacuugaaaucagagauuugccugccuuuggcuccagaguguuagaaucaaagaugugugccaccaaugccuggcaaaaguacacauaaugauuucacauauguugugauucauuuuauuuuguuaaccaaagcuuuuuaccuaauagacacucuuuagugcuggauucugagcuguggauguaucuguaucauuuuuggggaaucuggguuacuuucuuacacucuggugcaacagagaguuuuuuucuuuuuucuuuuuucuuucuuuuuuuuuuuuuuuuuugccaucuguagacuuuuaauaaaaccagguaaaauaucaguucuuaagaaacgauagacacucaguaggguuguuggaggcaaucuggagcgaucuuuuuuuuugauuuuuguuuuuuuuuuguuuuuuuuagaagaaaacaacaacaauaauaauuacaaugcaauaaaaacagagaaaaaaaaugagccaaagaucaaagcuacaaaaagcacaagcuuucaaaaugaaauuguuuccauaauaagaggcauagagaacuuccuuccucucuguccacccauacacagcuaggaaaggucccaugaagauucagcaagcaggugauuggcugacugcucuccacaaacacagucccugcugccaccucgauccuuagccuguaaucuccaggagcgucuagugcacuuuuguuggugcccuuuggucggugguguucgguuaggguagcccaacuugcaaaugaggccacuaggccucccucuggccucuuuccgaccaaauuguugucccuaacugcucuugauagaaauucugacauggcaccccuacaacuugccgaucaucugcuguuugccuguauaaccugaugcagugguagcuccgaggugagccauuccaggaucauggagcagaaagacauacagaccaaaaguugacgagcuuagaagaggguccacaggggacagacaagggucauggggccugaauccugagccauccaaagaucgucgcaacagagaguucuaauacauuuccuguucuguuauucuuuauuucuccagggacucauugcugcuuucuuuaccuuuccuuuugggauguggaagagagagagagaaagagagagagagagagagagagaacuugacucaguuuuuucuagaacucaguguauagaucaggguggccucaaauucauagagaucuaccuauuuuguuugccuaccaugcaaugguguuaaagauguggcaucaccagguccuaauauacauaucuaccuuuauugauugauuuauuuuaauuuauuuuaaaaguuuuauugcuugcauguacaucugugcaccuugugugugccaggcgcccgcaaagaccagaagagggcauccuauccccuggaacuggaauuacagauauaguuucugagugcucaugugggugcugaggcuagaacccaguaagugcuuuuagcuguugagcccucaacccccaugucuacuguuaauaugaaauuccuuuuagaaaucaagaucuggguacuagcuguaugcauugucacuggguugucauuuucucuuauacgcagaggacagaccaagcaggggggacacacagaacaaaguauauuaaaaaccaugcauucauauggguagaucugauuuaaucaaaucucacagccuuucuuaguucaguauuuauaaaucacuucuccagcagcgaggaguuuggcuuccaacaucauaagcauaucuacucaucuguuauacauagaacauaguuuuggaauugcuacaucuauagcuauuuuuguagggagaccucucaaugucucccaagaagcuucacuccucuugacuguagcgaugaacucuugaguauaaaaggauaauuaccugauuaaguuauaugguacagggcuauaggaaagaaagauuauguuuguuagauuuagucuauacaggagaccacuuaaaauugaucccugaagccgggcgugguggugcauuuucauaguuccaacuauuggaaaaagcugggaugguaggaugaugaguuuggcuagcuuaggcaauauagcaagacugcuuuucuuuucuuucuuuucuuuuuuuuuuggggggggggauuggacucaggauuuuuuauuauuauuuaaacgauuuuuuauuagauauuuucuucauuuacaacucaaaugcuauccugaaagucccuuauacccuccucccgcccugcuccccaacccauccacucccgcuuccuggcccugucauuccgcuguacuggggcauauaaugauugcaagaccaagagccucuccucccaaugauggccgacuaggccaucuucugcuacauaugcagcuagagacaugagcucugggguacugguuaguucauauugcuguucuuccuuuccacguuauuauuuaagacagggucucacugaaccugaauccauccaauucggcuagaaugucuagccagccaacucugguaauccgccugucuuuaccuccgcaucacugagauuagaagcagguuguuguaccuggcuuuuauacggugcugggaucugaaggcagauccucauguuugccuagcaaacacguucuccaaugcgccaucucaagggccccacagucgaggucuuucugcuccuacugaaagcccaugcuacuauacucuaacacaagcagagaaaaucgcucugucaggagaugguggcacuugccauuucuagucugaggcuacugcuagguguaagcguguuuucagaugaaccuacuucuauccuuuccauuauuaauauaaaaauuuucucuccucgccuucagugcuaaacuuuccuuuuccgcuugauuauuaucccuaccacuucuuuaaggaucauucucacuacuuaauauguuugggguuuuguuuuguuaugcagaauuguguuauguuucaauuguuguguaacauaugccacagauuuaguggcuuaucggacuccucauuuauuaugauguauuucacaacauggcuggacucuguugaguguuucucaggcuggaguaaggauuccaagaggaucgaucacauuccuuucuuggagcucugaggaagaaucugcauccaggcacagucaggugcuggcagaauccauguuccuugugguuacagggcucagauucucauuucucugcuguucacccauggcggcagggaguacuacucugagcuacuagaauccaugcucauuccuugcauuguguaccuucagggauaggaaagaaaaaucuuucucauauugcgucagacaaaagucacacuaacaaauuguuacaugaaaaucuuauccauacuuccuauugaaagagcagagaaucauuaucuugaaacuucuagauauugcaugauuugauugacagcaucaucaaagaguucacuguaugaccgaguacucugaucuggucuuccaagguuccacagcacauaucuuuaguauuauuaucuuuaagauuuguauucccuaccauucugcuugcuucucuugucuguuauuuggauagcugcuuucuaugaucucuucagugguuuuguuaugaucagauaaagaacaggauagcauguguguguuuuaccugaauggaaaugaacccaagugucucuuaauacauuauagcccuuugaucaacugaggaacuagacccucaguccccauucucacuuuauuuagaauauugguggggaauuugaaggaauggggauggacuugaucaaaacacaucauugcacauaugaauucuaaaacauuaaaaauccaaauaguucuuagauagauuauauguuugguaaguuuuuucuuauucauuuaauucaugauuuauguuuucaguuauuucaguucuuucuuuaguguguauugucugaauuuccggaagccaccagggaagaaacaaauagaagugcagugauaggcaacuuguggaaauguuaggaagguuuaauaggaugaguuggaaacaauaaaauauacaguaccucaccauguugccuaguuuuuaagccuugaaagggaugaacauggauuugauuauucgcauuuuaaaugaauuaauaugcaaaagaggugguaaaaacaaacacuaaaagggcucgugugugccagcugaugccagugcagagaagcacuggcccggggcugaugcugcagaugagaaccucucuccuccccuaaugcucucacgucuuucccaccuccauaccuuuccaacuugugugggcugucuuucucagaaaacaaacaaaccaaacaaaacaagaaaaaaaaaaaaagcaaaagcaaaagcaaaccaauaaaacaaacccaacaaaagcauguagaaaaaaucuugagucuguuuuguuuugaccuacuaguaaugguccuggggccugcccuagagugugguugauauagccaguucacuccauuggagaaaacugauuucccguucucagcagguaucaguugcaaguagcuuuuugguuauggugggacuuugugucccuuuugccuucuuggugcugggaucuuaucuggguugacuuuauauggggcauuaacucacaaucuuuauaugugaauuuauauguguacccauccugcugugucugaaagacaguguuuccuuggaguucaccaucacuggcucucacagucuuccugucuucucuuguauauagaucccugagccuugaauggagggguuugauauagacauuccaugcaggccugaguguuccaaagcacaccauucaguuguggcucucugugauaaccaccaaacaucugcuguacaaacaugcuucucugaugaggggcgagcagugaucugaguccccaccuagggucagguuauauguuaugauggucaucaaaauaguacugugucuaugugcaccauauuaaugaugugaacucugauuacuuguauaagaugguguauaucagguuuuucuacgauaagauuuuucuucuuuguaauuaaugaguaauuugcagagagagaagagagagugugugguccuguaaauaucauguucuguuucaaguuuuccucuacuaguuuucugcaucuauugaugauucuucccuuaaaaauuauuucugugacaauugcaaaucauuuuacauucaccaauuaacaucauaugauaaggaaaugagcaagaaagaucucucucucucucucucugcuugugaacacuugaacugguaauuuucuuugcuuuauccgcuuucucccuuccuuccuuccuuccuuccuuccuuccuuccuuccuuccuuccuuccuucccucccucccucccucccucccucuccuccuccuccuccuccucccucccucccucccucccucucucccucccucccuuuuuuccuuccuuccuuccuuccuuccuuccuuccuuccuuccuuccuuccuuccuuccuuucuuacaaucucuuugcuuuauucugagagcuuggauuagucccaccacaauugagacuuuaaauaauuagcuuguuuuauaguaugcacucauagguucuuacuguagccagugguuuacuguaccuugcuaucauuguuuugcuauuguaacuuucccagaaguugaagccccuccagccugucccugagcccuguagugagauguuucaugguccccuuccuuuuccagugcugugggcagucauuucuccaggaagcucugguucuuuuaauuaggaacucauuguuagaguuuagggucucuucgccggacucgcugucguuuccagauacucagcauauggagcaggagaauggcauguccguauacacauaaacaccucuguuuauuuuaucuucacauacguuuaaaacacuacagaguucauuaugauccuuuucuuuccucuuuuucuggcuguuuucuccaacagcgagaaaccugauucacaucagccucagcauacuuauucacaagauuaauucuucacuguauugaaagcaguuuagaauuguuaaugcaugccacugcaaagagaaaacaaauggauuaauuagaauucaauacuauucuugucuuaagcugagaguauuuucuacuuucuguggacuacuguaauuaauuaccacagauauugugguuuuaaacaugauuaauuccuucacaauucuugaggucagaaaugagaaaauacagguauagcaggauucuauucccuacaauggcugaagggggggacuccuuccuugcuucauucuccuaaggugauuuugauguccuugacuuguggcuagauaacucuagugucaacuucauauggcuuucuuuuugugcaaucuacucuuuucuuuuagaagaacacucagcauuauaguuauauaauuuucaucuugcucuccccucuuccaguuccuccagugucuuuuccacucucucaaauucauuacuuuuuccuuguuauuauuguuucacacacagacacagacaggcaggcaggcagacagauagacauacaugcauaugugugcgcgugcacgcgcgcacccacccacccacccccuacuugaguccauuuugggcugcuugucuguagguguguuuagggcugacuccuugggauuggcuaucacaucagagagcucaugccucgauuuucccucugaucagccauugauugccuguagcucuucucuaggaguggcaccuugugaaacucucucuaauccagguuggcauauccggcugcuggugucauuaugcaggucauguuuaggcaaccauaguuuugagaauucuugggugcagcuucccugucaugucuagaagacgcugugcagaauccuggugcucuggcucuuucuggcuucuguaauuuuuuuccugagcuguaggaauuacguuguagauguaccuauccagauccccuuuauuucugaaaauacugcuucagagauuccaggaccugggguaaggacauauuuuggaggccagcgcccaguacacugcaggugcauuuuucucucuacuuccuuuuagcuuuucaugucuuccuuauuggaaacacagcaagguucauguguuuucauucauguuagaucuuagcuugucccaucuauuuuuguuugugaauaugugaaauuucacuuuuuuuucagaagccaaaucagugaaugaagaauaucacguuauuguagagaaaacaucuuguguauuguacggaugcaucaccuguuaauuaaaaagccuauggccuguggcuuaggcaggagauagaggugggacauuccggucgaggcuggaagaauggaagagccaucaugagaaaaugaaaauagaaaggcuuccaguagaugggaacugugcuaucuguggagagagcucuguauaguagaggaagcaaaagccaggcacugaaaagcaggcacugaagggcaggcagcaguuggugcauguugggcagaaaggaacucagugaaguugugaggaaauuaauaagcaggaaauguaguguguuugaguuuauugaaagaugcuggaagcuaguagaggguuagagacgaggagugcgcauuggaacuguauccuguauucuuugacauuucuuguguaugcaguacguucuggugguccuucugagucucugcaucagcuacuacagaacuguucuuuaaauggucuucauugcuguauggaacacgugagauaagaauggacguaaagagacugauaacauaaaaauaacugaugaagaagcauaagauaauguuggcuucuagaggagugguaguacugaaagaaaaauguagacuugaaguauuuuuuucccaaagauuuauucauuauuaaaucuaaguacacuacuguagcugucuucaggggcaccagaagagggcgucagaucucauuaagggugguugugagccaccaaugugguugcugggauuugaacucaggaccuucagaagagcagucagugcucuuaaccgcuaagccaucucuccagccccagauuugaaguauuuuugauagacuuggcaagagacuggcuggaagauggaauuugauuauaucuagaagaccaggggauuaggucuaggggaggauuuaaggaugacucccaaguuuauagcuucacugggaagcaaauugaaaaugaguuagagacuauaaaucaaaauuuccuuauuggacauauguguuugaaaugcacguagguaugucaauuggggaauuagaaacaugcucgcaaguucagauacagaagagauccucaucuuuuuaucuaguccccauagguauugcuuuaguucaugucuccuuauugacucuacaagacucuaccuugguggucccuguuuguuccauagaaucgcuaggaugacacuaaauacuauuugagggauuguggucaauuuaggcuggaaaugauuuuuagauuuugauuucaaauuuauucuuuccagagaggcacugcuauauauauaaaaugguuuuagaacuuuauuguagaaaggcaggggcuaggagagaagguagaaacagagaggcuggccauggcacgugcagagaagggggaagggagagagagagagaaagagggcuagagaugagaguaagaaagggugagagcuuaaagagcgauauuuuucuuguauagcuuuauuuuggacuuuguuagagauccugucauuauucuauaagaacuguuagccucuuuucugccucucccgauccuccugacucaauauguaagagacucccccuaacugcacuccugggauuguguggugugggagguguuuguaugugcaucuguauuugauguguauucuuauugauuugguuguauauuaauuuuuacauuguuaucauguuucuuugauucuaguauuuuuuuccuguucucuauuuuagguagagauaauuucccugcuaguuugaaauauuuuuccucuuauauucauuguuacagcuaggauguggagucaguauuguuaacauaguuuuaggauguacgaauuuucuaccuuggugucuugcuuugcuuguuuguaaaugcuuccuaauuucuuugauuauuuucuauuacauaaaagaucaugacuuuaaaaaagcuccuugucugccuuagguuuugccucuuauuuucccuaaagagaacauaccaguuacucuccuuauuaggcacccgugacagguaagcacugcugguuuccagacuggucagagauggaaaacaagugaaauccaacauguguaugggaugaagcugguacaacauaauacuaguuuauaaguaagguagucuauuuccagggugcccaaaggcuucuugcucuuaaauguaugaugucaguguauuuacauuuuaaccccucuucucucucuucuuuaagggccacacagcaaugcuucauacuggcucauggcaucccaaaauaaaaggagaauuuaugacuugcucaaaugaugcgugaguauuguuggcacuuuuuugaaugcuucaguggauucuaggcucucuuuagcaguuguaucauggcaacccuaguaaaguaaggaguagaguaguaggaauuuugguguuuauguguuccuauucuugacuuugcuuugacuacugucugcaguguaguuuaguuaaacaaauagggaugcuauggaaaugagagauuuuguaaauuccaguagaguuuaucauggggcgcacuggauuagacugaugcuaauagaggaccuaaauggcuuugcaagugugacuaggaucucugcagugaagacugacuccaucugaaaugagacuguaucaccguacaagcuggcugcucuucagccacaguucuguuggggaucacuaaccuugaagcacagacuccauuauccauauccuuuaucacauccuagagaggucugucaguaauaaauucacaucaauugcaauuuggccuuuuucuuggccuuugacuuagaauggcaguuaguucugagcugagguguggaccauuacacucuguucugaggcuccaccuuucugggcccuuuguucccuuggaagugaauacugcaagaugaaaugacaggaauacccaaagauaaacacuguaguuuuauguguggugauuauuguuggauaaaguuaaacuaaaggaaaugaaggguugagagggcuggugagguggcuuagugcguacaggugccuaacagccaagcuugauccguggaccccacauagugaagggagagaguagcccccugaagguggucuaggauugcagggauaccuuggcguguguguguguguguguguguguuuccuugugcacacacacauguaaaacaaacagagaacauagaaggauuuaccacacauaaagcaguuaucauuguuguuaucuuauuaagguuacgcaggccuaggccuuggcaaacauguaguuagucuaucacugaacuacagcuugacccuaagaaagucuccuuuuaguugagauuuaaaucacacagaggagggugcuacaagggaaggugcuuuccugaccaaagugauccugaaacccugagauucgaagacaacagagcauguuugagggaaagaagaugacuuaguugacauuuuguagguugguaggaaagaaagcacuauucuauggaaacuuacaucuuauuuaugauuuuaacuuuguauugacaaguggaaggugcagcuuuccuucuuggguuauuuuuguuugguuugaaaucaccauuacugaccuuuucuauuuaucugguuuuuauuuuuuaagugugugugugugugugugugugugugugugugugugcgcgcgcggugagugucgcugcguacauguguguguagaugcccugaggcauuagacccccccuagaccagccccuugaugugggugcuaggaacuguuuuaugcuguuccuugucucauuauggacaacucauucagacauaguuucuauaagaagaacaugauauaggcauaaaaagaacaugguauaggcagccauugaccucagcuaccuuucuuguuacugugcuaugcacuaagugcugaacacacccaggaguguuugccagccuguggcuucacagcaguguuggaguagaggguagaguugugacugcuguagccaguuuuucauggaaggaagaaaacugugaguuaacuuugauauacuaggagagagggacaauugauguuugugagaacugggucccguggacgcuaaggcggugcuuaugguuuuguucuggcccagcuucuaccagauucaauugaggaacucugacagugugucacagauaaucuuguucucucacuuccauuccagaagauucaguaugaaacagagacugagguuaaucugaucuaggaaugaaaugaaagaaggaagaggggaagauagcagccuuuucuguuuugucaacuuuauuagaguguggcccacauaaagcagccuuuaauaacauucucuugaaggaaaaugguugugaaaaccagauaacacugaagauuaaaaaugcucaugagaggaauuuaucuuuacuuguggguugauaaaaugugauggggagccauuuuauaauuuguaguagcuuugccucaggguaagagugugacccaggguaagaguauggcacagguuaagaaugugacccacaauaagaauaugaccaaggauaagaguauggcacaggguaagaguauggcacugguauaauugaguccucagugcagaaucugucuaaaguagggaggauauauauuauggaguuugugccucaauacucuuaggauuucagaaugcaaccguuuuggcguuaaugccauaagagaaguggauaugaggcugugaauaugagccuaauauugcaugauugguauccuuauaaauaaggugugagggguacauaucccgagagaaaggccacaggaugccacaguaaggaagccuguagcagucaggaagccaaggaggaauggccuuggaagaaacgaacuucccaaacccuucuuuaccaaagccuugaagccucuggagccauuacaaaacgaguuucuacagcugagcaaccuaguguauaacacgcugaaggcuuaucucauuuuuaaugugugugugugugugucugucugucuguuaauaguagugugugcuugcagaggucagaagagggcaucagaccccuggaacugagguuagaggagacugcuagcuaccugauuugggugcuaggaucuuagaacucugcuuuccuaaaagagcagcaucgcucuuaauuaccuaggcaucucuccagccucacugugaacauuaacguucaguucaaagccucucuuuuucuugcaguugauagaugucaucuacuaaaaagcauucucacagcuaaaaugguuagauuuggcugccacuucauauguuucugcauguuuuuaaaauauaauuuucaaaaacaguucuugcuuguucuuagaguugaaaguacuuugugaugauuuuuguaaugauaaugaaauaacuggaauuuuccuucuuuuugucugugaaucuguauauuuugauauauucuuuuuuuagaacaaaacccacaaagugcuagugagauuguucaguagcuaacaaugguaguuaagugucuggacuuuacgugguuggagagaguagacucuucucuccuggcuuccauauguccuccgcagccugugcaccuguacacguucccaaacaaguaugucagccaaucaguacaugagugcaagaaucccucaaaaguuauccaagaugucuaugugcaacauguucauuaaagcacacgugccucuagcucucagaugcucucccucugucugcugggcagcagcaguuaaaguagccuacuguuauuagcacuucugcaugcaagugacaaccacagaaguuuagcaacggagagcaucucaccugacucagucaccuuacguggcuauaaaggaagcugaggugccuguguuggucugucucugcguggcugugcccuucccucacuuuguacagucccuguucacucuguguacuguuccgugcagccuuacuuaagaguugugaagggaaaggcagacguugaguucagaauuugugagguuuccccucuauagcgaaaugcuggcaaaugguuucagcugugggaaauugcuuucugagcaaaaauagagggcugugucuugaagaaagcuuucaaguguuugcauuuuaaugccuuuuuuuuuuuuuuuuuuggugaaguuuugucaucuccccaguguuuguuauucccuucuaaucccaucuacuuuucuguaguaacucauugugaaauguuuguccaugaauuccaggguuuuuaagcuggggaguaaaugucugacuccaucagucaucuggacggagagagagggaauauggaagaguggcagccggguagugcacaugugcaguaauucacugaggaaaaaauugugagcgcagacuagcaguuuguaagcugagggcuagccuucugcagccaccgggagaagcuaagacacacaaagaaguucacucucacuccaggcugcaguggucugcagaaagccaggccacacgugagauauuaacacuccacagcaggggcaccagguggacagcaggcaggagagcagaaggcugccagugcuuuguuuuggggagaaccuggggcguuuucagaugggacuuugaagaccaauucuauaaguugccuuuauggaaauuaaugacagagaaaauggauuuacuaaggaaugaaaggaaaucauauuguagaucuuuaaagauauuacugucuagcacagguaaaaauauaugaagaauccagaggauuuuacuuauaaguaaaagauauauagguuuuauuuuauuauuuuaaacaggcaugcauaucccccuaucauccaucuaaugcuguccaugggugugggcaugccccugccacggcaugugugcagaggucagagaaucaguuuucucuuccuaccaugugagcuuggcacucaggucgucaugcuugcuggcaugacgucucaccagcccuaaguuuaaucucauguacugugaaaugaggagagacauuaagauuuaguuaauuuaguuucugcgucuuuucuuagggcacccuuugcagugugacugugcggccacucccauuagaagggcaggggcuauuccauacaccauucaucugaggcagccagcagcaucacagaaaugaugguguucauguaggcuucuauucauucaggccaugacaagcaucugaugaagcccucugcagggugagcaguccgguacgguggagaagagcucagugucagcuuaggcuauucuagaccagcguagaaagccagaccugugggagagcuucggcuacauuggcagggcuggcacuuguuaauccaguuaagagggaacaccucaguggacuaguagucacgugagaagugguacauguuuguucuucuaaaccauugagcucuaugaaugaguuauuauguacaaacuauaaacuacacagauaauuuuauugaaguauguaggguugugguuauaaagaaaaauauuuguuccuauauaacacugauaugaauagaaguaaaauauaaugagauguacaagauuuacauagcacagcaaauguagagcaugagugggucuguguauacagacaugacacacuaaaguagaccgugagugggucuguguguacagacgcgacacacuaaaguagacuaugagugggucuguguguacagaugcgacacuguugaguuguauacuccgcgugcuguuuguuuauugggcuauuuuagcuuaaaaaacuccuugacgcuuucaaaaaaagucguguguggucuuucuuaauaccuacguauauagaugauacucccacaccuuuguuuuccccucauaaaaacuaauuuuuaagauguagaaaagaaauucaugagacuuauagcucaaccuuuucugacuuaaguuuuuuguuuuuuuuuuugauauauuuucagcauguuuuaagcccugcaauucacuguuguguagacugugagauuugagugauuggggacuuucugcauuggauuuuuaugcuauaguuuccuuugugugucucagauugcuaggguguauaagaugucuguggagaaaagauuucuagucuucauuuggagagugccagcaccaaagaauagaugcauuaaagagcugagcaaucacauuaaagacaaaccaaacaauccccuccauacucccaaguauuuucuaagcauagccaugcagcucuuugccuuacucacagcaauagccuguauugugcucuugggguagaguucccuggaacauaccuugggaaaugaagaccagcaauaaaaaaaugauucugaugauugaauucaguaaauuauaaauauuaaauuuuuauaagcucuaaagacgaauuagacaguaaaaaauuuuccaaguuuuggcauggcgucauggaaagaauauauacuuguaguaagaacuagaggagguggggugcccaacaaguaacuugcuauugaaguuuacauuucugagaaacaggaugcugcugauuuccagaucugaaccugggcuaaguauagagccuguguguucaugcauaggucugccggucaguguggacgugaaggugccuuacacggcuuggugagcgucuccucuuagaacguguguggaacauuuuuuuuuuuucuggaaagcugcuaggcagauuucagauggcuuuuuauaaucaauaacauauguaaccauaauuguucaauucucuaaagaguggugggucacauaaauggauuccaaaaaaguaaauuuccuauaacucaaaggguuuuuuuuuuaacuucaaauauuuuggagggaaacguuaaaacauuaguuuucugcauuauucuugaguauuuggaauauaguuuaacaaauuuauaauguaaauuauuaucuugugguaugcuaugccugagagugucuuggcaguguagaccuauuuauaggguuuuggguucccgacugcuccccugccuuauuucuguuguagcuuuucauuuuagaccgacagaaacaccuguuucuccauuaguuuucugugucuaucaagaaggcuagagcuggaaccauccaauccuucccucccgcucucuccucccgcccucuccucccucccuccuccuuccccucuucccuucccuucuuuuuuuaaaauuacagcaaacaaaagacuauauauaacacauuuuuuuuuagcacaugggcuuuugccauccucuuuggcuacuaggaggcuuuuugcugacuuaguuucggggugaauuuguauugucuagguggcugagcgagucauacagaguuagacucccagcaguucugugugugaggcugucauuaagacagaaaaugcacgguucauaacauggcccugucauguuaugccuagcuuauaucuauauaaauuuuuuuauucucucaguugauacuuuuuuuauaauuuaaaacuguaggaauuuuuuaaacugucgucagcucuuagcauuuuaaagugaauaccuuugcuuuuauuuuuguucccuggguuauuuggauauauguucauuuagacguaaaaacauuuguauauacuagauaauuuuggggaagaguuaguuuagcuuagcaguggggccaaaauuccugaaaauuucucauucaaauuuguugcuagacaaccaauagaagauguucuacgcugccuuuucuuuuucuuuuucuuuuuuuuaaagaggggguaagaugggauucuuccuguauugccucggcuaggcccagaguccugcacucaguugcucucuccugacuuaguccagaauugcugggacuccaggugucagcagcucacugcugugccuggcugcucuggcacauccuaaaguucccucacugcacgaguucuggcgauaauggggcccuguuugaaauuaauuccacaauuuaacugugcacauacuuguauuaguuugacaaacugaagguuuaaaagagaagaaagacguaggucaucuuuaauuuguucuucauuugguccauguaagagccaguguuggacguuuacauagguggauggguugcaguguuguacugaguggcaugggcauguauaguuaaaguguuaauagguuaaaaauuccuuucucaaaauaguuuguuuuuacucaguuuuauguugagaacugcacaguagauacaaagucaguauacuugagacaauaauaacaugucgcagagcuagcagagcacauucugucucuaauguaauuuaagcuguccuuugacaauguuauacauguauauaauauauucuaaucauauucagcccccguccucucucuuauuguccucccacgcacgccucuggaacccuucuuuccacugagcuuaaauacaguuacuugugugagcaugugugagggguugcauauuggaugaugcagcucaucggugucuguacccucagcagcuccuggugggccucccucaagagucccucgccaucccaugcuggaauauugacagucuggauuuugugcagguuuucguguguaagcacagggacugugauguucauggguguaaagugcgucuccucuguggaguacagcauuucacgucaucccuuucauucauguacccugcugccuuggcagggggaugauagaaaugucuacucaaaagucacucagucucagcauugugaccagguaggagugggcauucacugcugccugcggcacaaagaaguucucugaccaaaguuagucaaacuuacucuguggauaagcauuaaucuguguauaagcauaaauguuuugaaggcaguucaacacaugcucacuuagcaaaacagcaguauaggcucucccucccuaggaccucugaccucccuguguuuguagcaccaggcaggauucgaucagaaaaauagaaauucuuaaacaggugguacuuagaacuuauaauuaggguucaugacuacaguugccuuguaaauaucaccauauagguaaacgugugagcaccacaguuuuaauguuucacuuagaauuuaaccacagauguauaaagugauuguccaaauugguguuuauauaaaaguuugcuuugauguauuuauuauguacuuauuuucuaugucuauguguuuuucuguguacgugguuuucuguguauauguuuuuauguguaugugcaugagcgcucugugcaccguguaugugcaggugcuaucagaggccagaagagggugucagagcuuccggaacugaaguuguaggcaguugagagccuuccguuguggaugcugagaaccaaacuugugucucaggcuagagcagcaagcauucugaacugccgagccaccucuccugccccaaguuauuuauuuguacacaauuuaacuugcuauaaagaagacaggauguggacuuauuuuuacuuguaauguagccugagagaaaauguugacuagcauguauguguguguacauguauguagagaccagagacuggugcccagcgucuccucaguggcuucugcauccuauuuuuucacccucacaguaagaugugcguuauucucgcugcuauucuuuuuaauccuuuagugggaaucagucccccuuucuuuugcuguguuuugagucagggguucucaugaauauugaacugauugaacuagacugucuugucagucaucgcugcuguccuccgguguccacuucuuggauguacggcugugucuggcuccacaaccccucaguaugaguuugggggaccaaacucagccccucuuggcuguaugacaucuuccuagcuccauuauaaauuucacuuacuuuguaaggaacacuaaaguuucuaucaagaaacacauugcugugaaacuuugguuccuagaaaagugccaguuuauugagacguugagacuuuagaguaaauguuuuguuaggaauuggugagagcaaaacuagggauuuauuuacccaucgauuuugauguccuuugaaaagaacccuggaaguccuuugaaaagaaccucuuugguacuauguguucagagcccugggucuguuucuagcaccacauaugugugcacaagaagaacugccuguagacuuuuuaauuguauuuuggauuuuuagugauuuaaaguaaauauaugcuaaccuaaaguauuuuaaaaugcuaggcagagaggaauuucauguuugauuuuaaagcugaaaugucuuguuugugacaucauugagucugcuugugaaucuaauauguaauaacucaaaccugagacauuauuuccaggguuacuaacgaaacacauggagaacucuugcugccacucacuuuuuuuuuuuuacucaaaaaaguuaauaaauauuguggaggaauugaauuucugagcagauaaguuauuuagaaguaaccuuguccauggccccauuauacuugaguagcuucuguuuaauuuauacuuuuucuaguacuuucgagauuuauuaaacuaugguauaagacuuuaccuuauauguccagggauaagacauuuaacgccacacugaccguuacguauuuuaugcaauguauucagggaaugcucacacauucuguguugcuguauucuguaugcagcaagcauaauauguuuacaccuucaaaacuguuggaucaauguuugauaaauuccaaguguuuuguaguucacuauauaguuuuacaguuuuuaauuaacaauuucucuuggccaagaaacaucaauacugaauaauucauauguagggauuauaaacuggggaaaugcuaguuagcauuuuucuuucuuuuuggagauucauauaaaaaugucaauauaauuuuaagauuucagaauagcuauuuuuauaugguuguuuuaaguucauuaauuugcguguuuauuuuuaaagaagaauguggaagucugcaagaaauuguaggguauguuuguuuacuagaaugccauuaacaggauuugacagagguagcuugaauuucuucuggggauuucucggucaagguaguaucagauggacuggucaagguaguaucagauggacuggcgcagucccugcguuucuaaaugaacgugugugcucccaggacagcugcggugugugcuguguuagcugcuuucuggggaggagagugggaagaauggugcuccugugagaagucauaaaaugaauuuuguuaugggaaugggaaugaaagguguuuacagauuauauacuuuguaauucuugaaacucauaaauaaagauaaagauauguucuuuuugcuuugacggauuuuuccucucaaagacauggauauaaugagaauucuugucaaaauuaccaaauuuauuugcauuguauuucuuaauccauuuuucuguugugccuuauaaccccgacuccaccucuuccuuggacacguguccucaucuuuuggcucccuguugccaugaguuagaguggcagguuagcaggcacgcuuuuuaaggaagugugaagaaugaguugaccuuucuacuaguucucccuaaacuuuguaaguuuauacaacucgguuagcuauuucugucuuguaaacugucccuccugugauaaugcuucugaaauuuaucuugauggaaguguuagcuuuuguuacugccuuuaaaauugugcccccaguaaaaccagcagcucucuccuggagaaaccuuuccuguuaguaacaaaacaaagcaggagaaaaugugaagguuucagaaacuguugauuacuggguucucuguagugggcugggaccuguuaguuagaaugaaacacaaguucucugugucagcuuaucaugaagcacauaugcauuauacagguugguuuauaccucacggaguucccugaguccuacaguaaccgucaaaaaaaguaucuuuguggaaaaaucaagauucacagauuauauuuuguccagcagaaauugauguacaaaagucuaucuuuacaucuaauaagcagaggaguggaccagcuuuuuguuuauacuauguaacuauguaguaauuacuauuuaaccuuacccaggcaucuuuccuuauguguccaaauaggcaccaucuuacaaaccuuucucauaaucuacgugauuuguuauuuuuuuaucgaguaauauagcuuuuccaaauuguuuuuagauuccucaauuccuuucuguuuuugcuguaaaacugccuugccugucaacuagcauguucauugacagccuauugcauggguuuagcuagagacuagauaaaugagacagucccgaggauuuauaauaccguagacauucacaaauucucauaaaaaaagcaaguagguguaagcaugccauguguuacuaagauuuacgaggggccuaaagcggucuggagggcgcguuuaugaggagucgaugcuuagccuuagcuugguaaaaagagugguuguuuguauucagggagaggagcgugcuuuuuucuucuuuuaaaaaaaacugacaggagguugcucuguguauccuuggcuguccuggaacucucucuguagaccugucuggccuugaauucacagaucucugccugccucagccucccuaguaaugagauuaaaacaucuaccuccaccacccagcuaagaggauagauaccucuuuggauguaguaaacagcacuauauaguauauguauuauauauuauauuauguauuuuauauaauauauuguauauauuauaacagacacacuuuaagaugagggugauggugcucagauguauaacccagcacuugaaaugcuaaagcaggagguuugcugcgaguuugaagccacccugugcuacauagugaguuccagaccagccugggcucaagugauauccuguuuaaaacaacaacaaaaaacuccucaguaaaacagcaacaaaaccuagacaggcauagaaaaucugacauuauuaaauaagagggaacaaaauagagagcugcgugagguagguucuugguagacauguuagucaaccuucgcaguuuuuuuuuuuuuuuuuuuuaaauuuuuauuuauuuuauuauuauauguaaguacacuguagcugucuucagacacaccagaagagggagucagaucuuguuacggauggcugugagccaccaugugguugcugggauucgaacucuggaccuucggaagagcagucgggugcucuuacccacugagccaucucaccagcccccuucgcaguuuuaagaaggggaaauaaugaucagauuuaugugaaaaugacuguggcaucuuuuuguauugguggucagagaggaauuuuuuguauguuaggucuguguuuuuguugucuuugguggcuguuuuguuuuguuuuucuuuuuugagacaggauuuuucucuguaacccaggcuggcuuggaaccguuauggaaccuagccuguccuaaaacucacagcuguccuccugcuaaaauucucuguuuuugucagagaaauuuuucagcccaagaagugcccaguugcugcugcugcuuuuuaaaaugauacuuccuuugacuguaagaaguugaauucugccccugagcuguggccccacccugguucuuuucugccuguggaguuucacagaucucucuguagaugcugauguaugaggcaggaaucauuaagucagucuguuaccuggcuuuccuaauagaaaaguuggcaccgacagaggugacucaccacuggucacaguaagcaauugagagcaucccaauuccuugacauaauuuguuuuagauuuaggagauuaaaaccaccaauucauauguccuuuuuuuccaaacugugaauuggguaguagauaacaaaauauaugaaaccuacugucugaggauauauggguaguagauaacaaaauauaugaaaccuacugucugaggauauauggguaguagauaacaaaauauaugaaaccuacugucugaggauauauggguaguagauaacaaaguauaugaaaccuacugucugaggauauaugggagacaaugaugaagaagauuguuaggcgcagcaacuuuuuaaauguaucagugaggucccugagauccugaagccagaauuauuuucauaaugacaucaaaccuucauuugguauuuucuccacuguguggccauuuguagugaugccagggauacagggaaaagcccuccuggccccuauccaggugguggcagcagcguguacuggaagccacuguguuugcacugccgggcacuuagagccaaguggaagaggaggacuaaaagcgcaccaguuucccuuccgaguguccuugaugaaacaguagaaaugagcuucagcacauggcccuccugcaugcuuguuuuagcacuccuucugagauggggaagggugcuucaggacucuggugcagccaaagaaggagccaaaggagccaaaggagccaaaggagcauuuccugccagcaggaaaacuaucuacguggugguuuucucuagugagcauauagauauacauuauauauaauauauacauauauauauauauauaaaucuuuuaaaggcucugucagguuuuugucagagauuuuuuuuuaaagaaaggauggggaagaggacgaggaugaagacaaagaugaagaagaagucagaugccauuuuaaggaaaacaguugggagcuuuugugcccacuuauuuuuuuaaguugaauuuaaaaauuucagaauuuauaucuguguuugaacuugguagcugcccaauacuaagggaacuuuuuagccugcaguguucuuuacaugagcaaugcacaaagcuccgcgucaggcacaguggagggcugguucaaggggcaggaucccacgcuacccacacucaagaagaugccacuuugaaggaauccacaacugucucacauggcugcuaaaguacuucuucuucugcaucucuaugugcgggacuuuauucuuuuuuuucuuuucuuuuuuucuuuuuauacaugacucuucuauagucuuccuccucccccuccccuccccucccccuucccccucccuuccccuuccuccuuguccuccucuucuucuagaauuauuuauuuuauuuuaggaauaugagaacauuguaguuuucuuuagcaugccagaagagggcauaggaucccacuacagaugguuguaagccaccaugugguuacugggcauuaaacucaggaccuguagaauagcagucagugcucuuaaugcugagugagccaucucuccaccccuccuccuauacuauuagguacauaugcuaaugcuauuugaauuacuguuuuaaugucauuuucaguagaauauuauuucauuaaaugaucuuuuaauuuauuuuguaauuuuaaucaggugucaucucuucuaaauuaguaauacuguuuuuaacuagacaagaugucucaguacugugggaaauuauaguugcaguguauggacaauaagaagggauggggcaguuaaucuuauaaaacagaguaaauggagcccuuaucaaggugaggguaauggaacuuuagucaaagugaauuucuuuauauguggaacccaggugucagucgguuacugauacagugagacucugaaauagcaguauaagaggguccucaaauguucagcugucuagaggauagaauauuaaacacaggguucuugugaaauggaucaaauaaagggugagccauuguugauaguaggaacuaauggcugauucaacauuuuuugacguuuuuauuuccuguuugaauuggaaucauaauuagaaaaucauugaaauucuuguuuucaauagauuguaaguaacuuggggucggggggaaucaucugaauugaacagcguguuucuggccgugguaguuacagaguguaugauagggagugaaauguguggucugucagcaagaggaacuguaagccguuguugcacaacugcacaugacauuuaugaaguucauucuaaagaagcuuuaacaacaucacugaugcugauggccacccaagcagcuaucgugauuaacgcgaugggcuccaaagagcacuggcgagucacaaacccugaguaaaucagacaagaguuuacuaaauaugggcuauuuagcuuuucagugaguguauggagacagacuuuucacaaggcguuuuuugugcuagccagugucacugagcuugucgcacgccaggugcacccucaggguccuucugauuaacucacuucauucucucacaaaagaugacggggauuccuaguacuucuuuuccagacaaaaaugaaauuuuaaacuccauucugggaugcaugauaggaaaggguggaaggugggucaggcucagugaaaagaggacgauuuuaguguugucaguggugacagguaaaugcaguuuuaagugcuugacuucauguaauaaaauacugucuucugguucauggcaauucugaauguuuuauuaaguaucucacuaaguauauuaugaaauauacagaauaugaacauaucauggcacuaauaucccuuuauuaaauacucuacauuugcuaagaacuaaaaacaguuguauaucaaauguuacuacuguccugauugucucaguuccaguaguaauaacaucuguaggaauuccugguucuggaugcagagaaagccccuguccuaugaauguaauuuccaagagaaguaucauuuguuuugauuacuuacugugauaucugucuauauuuuucugacauaguuugcuaaguauuuuuaaguuucuaaguuguauauguaguugguucuaaauuuuauuuuuuuugaguuugugauuguguguguguguguguauguguauauguauguguguguguaugcauguauguguauguauguugcauauguauuugucacaguacauaugugguggucagaggaucauggacagaggucaacucuuugaagugggugucagggauccacuuagcaugucagggauagaagacagauauguuaccugcuaagucaucucacccccucaucccaaauguguuugcaucauauuucacuuugacacuuaaaaaaauuuccuuguugacgguuuauaucucuuugcauuauuauaauauaguaaaaguggugcuauauuuaaaguuacacaaauacaucuucuuguguguuuggaaucauaugguccuuuaaacaaugcaaaaugcuaaugcuauguaaauacuuaugcugcacuguguagggguauagacagugucagcagccacacagugcgcuuucugaaugcuuucucccuggcaucuucaguuaaaugcagccuuuagccaucucauuugugcacguggugcgaggcuuugagcugaacgcagugagagggaagcccccggcccuuacucuccggguguugugguugcccgugaucacugagcucugcuuuacaucuuacagcaagaggaggggacggcucacacuggguucuuaauuucuagagcucugcucuuccugaggggugcaggguaauggcaauguuuauaaauaccuccuucaugcucacaguuuauuuucucugccuuaucuucuacuuacacguauuuauagagauaaacuuuaagucuccuauagagaaaaccaggauguuauacacaaaucuuacuauugaaguaguaugucuaacuugcugcaucugguaagaauuagcaagaauauuaaaagcucaucuucuguugauguuuucauaacuacauauauugauuuucccgauuuuucccacuaagagaugaguugagcuuuucuaugguguggguuuguauuaccucuguuuucucggugccuuccucuuccccuccuuccucaccuuuaucugguuucuuacuuccaucucucauuucaccaccaaauauggauccauagucaacuucuguaaaguugaauggaaauauuaauuugaauguuauuuaccaaaaauguuaauuaauauaaauacaaauucuuuggaaagccuugaaaaauuauaaauuaucuuuugguaaucuuuagugaccuuaaguuuauuuauuuuucuuuuuauauuuaaaaaugucauuugcuuuaguuucuauuucugcuuugacuagugaaguccauuucauuguauuucuugcuuauauuuguaaucucuagaaaauauuuuaauaacuuuuaaaaaucuuugauagaacaagacucugauauuuugauuaaccaauuuaaaacuagugcuaaguaauaaugggaauuuaaagugacgauagacuaauauugacugaguguuguugcuuagugugggucaugacuuggcauaauucaagagacggagacagcuacuaccuuuacucagugaucagagggcguguucuggacucacaggucugcacuaccauuaagugacucuccgcuuuuccucucucaaaagccaucucaguguccgcugugcagcauguuuuucucaaaguggagcauuucuguugagagcuagaauaccugacuguggaggaaaagggaacguuccccuccacccuccaaaugcuugcuggagcaguuuaagccggcaaaaggcuccacauugacuugggaugaaguuucuugggcugcugaacagacaacagaaugugaagaugucccaugagauggaaauagaggauaaucaugugacagacgucuguccaggcaugguuuucuggccacuaaaauuucaguuaagaagauggaagacaauuauguucuucugaaaacuauagaagaucugucuguauuuuaggugggaaaaucaagggaagaccugagggaucuuaauucuaaaucccccucggcuugucaaaucaucaguuuugggguauaguuuucugagcuccaguauucuugagcuccugagaacauggaccauuuccaagauacaggcaucccuuuaugggacuugcaguugaaaaucaauuggaucaucugcuggguaagccacauaagaaccagcaucuugauuauuucggaucgagaaccucucuuucuuaaauugcugcuucaguacauuuuaaaauuuauuuuuauuaguuuauaaguguuucauguguauuauuucaugugucugugugcaccaugugugugucgugccugcagaggcuggaagagggcaugggauccuuuuauacuggauguacagaugguugugagucaacaugcaggggcugggaaucaaaccgggguucucuggaacccaguuuuguuuguuucuugcucacuaaacaaacuguauguaauuauuauuugguuccuacaagaauuuauucaaaauuuuuuuuuuuuggcuauguacucaaauuacaauucacuggugugcuucaguuguucauuucuaaaagcaaagcaaagcaaagcaaagcaaagcaaagcaaagcaaagcaaagcaaagcaaacaaaaucccuccagaaaacaaaggccagggagauaguucaggugguaagauguuugugguauaggcacaggcccuggguuuagucccuagcacuuguagaaagcuaagcaugcacuuguaauccuagagccuaagucccaggucaguuugacagacucuugagaauaaccccugagguugaccuuuggccuccauacacacaggcacacauauaucauauaccuccucauacacccugagggggaagggccgggggagagggaguuacagggucuacagaaucauuuuuuuuuuucaaagcuuugagacaauuauaucuucucugggccuuccacagauaauccaccagccaauuuauucaucacaggaauaagacuuacguagccuaagacaaaaaguaaaaguugaagcaucagucucccuccucagauguugacucuggcuaaggcagucuggaugacugucaggcucaugucaggaauagaagugccguuauuaaaugacaucucaauggaguauagucugucauaugucccuucaaaguagaccuaugagggauagucaugguuaacuguucuagcuucucuguaucucuuaguaaugguaugugggcuauccugccauuuccuuaaauguuuccuaauucuuuucucuuacuauugucucuuugauucaugccccgguuccucuauagccucucccaagugucaggaggguagaacuaacuguacaaaacagggaugaggcuauuauagucaauauguaagccuauauucuaaaacucuuucauuaauauuuaucguucugccaggugugguggcacacacagguaaucccagcacucuggaaucugaggcagcaggauuguggauuuauggccacccggaggccagcuugugccacagagugagacccucuuucaagaaagagaauaagucuuccuggcugacugaagagaugcucaguauuaugcuaaagcaaggguuuaauuauauaagauauuuuuacaugccacauaacuuaaaaggcagcaguaaacagagcagucacguuccuggagcaaaggaaggauggugggguggggucaggaaggacuuggucuggcagcuguuuguuggcgggcugcuagugagcaccugcuccccagcagggacagccucuccuucggaagggucucggcagggggccaaaccauagugagaguuauucuuauaaaauagaccucacuguauuggcaaagauaagcccucuguggguagaaccguuuucauuaugguucacauuaugacauacuacuuuucaguacuaaacgagaaagagucuauuaucuguugacuuaauauaaagauagcauaugaagucauaagugcauuuguuacuuacguguauaaaaacuguuuaauguguuagugugacuucaaggaauuaaagggaaccaugauagcagggggcggggccuagcuuucucccuugcucuguaggcaggggcggggccuagcuuucucccuugcucuguaggcaggggcggggccuagcuuucucccuugcucuguaggcaggggcggggccuagcuuucucccuugcucuguaggccgaugcuccgaugauuguccacuuugcgcagggaacuuguuuuccuggauuucuaggguaggaagugcuggguuaguuucuuugcgauuggugcacuaguccaaaauguauugcuuacugcauuaugcuuaucuugaagggcauccucuugguuugccucuggaguugagggcuuuaggcuucacauuacgguccuugauccauuuaaauugguuuuuguacaggguggaagauaagaaucuaauuguauucuuuuacaauuagaaauccaguuuuucugauacuacuuguugaauagcugucuuucuucauuuaugcuuuuccuuuagauggggaggcuaauaucuaauuuacaaagaauuucaacaauuaaagaccaaagaaacaaaaauuggaaaccaacaaauaggcaaauaaacugaguaagagguuuucaaaaaaaaaaaaaauucaacaaaaacaacagauggcucauaacuguuuuuaaaagugucaaauaucccuagccaucagggaaaugcaaaugaaaacuacuuugagauaccaccucacacugguugggauggcucuuaucaacaaaucugaccacaagugcuggagaggauguggagaaaaaggaaccauuauucacuguugguagagcuacaaguuaaugcagcuaguauggaaucugucuggagauaauaaaaaaacuaaaacggaacuccuguaugacccaacuauuucccuccagggcguauacucagcuaacugcauaccuaccauagagauagcuggauuuaccauggguuuuugcuacucuauucacuauagcaaagaauugaaucaauguagcuguccaccagaagaugugugcucagguacugaaaauuuggaaugugcauguguguggguaugaauacuguuuagcucgugugcauguguguguguguguguauguaugaauacuguuuagcucguguguguguauguaugaauacuguuuagcucguguguguguguguguaugaauacuguuuagcucguguguguguguuuguguguguguaugaauacuauugaccuccaaaguguaaucacaaaaucugcaggaaaauagauggacuuacaaugugcagcauuaagcaaggcucuccguuugugggauagagccaaugauauauguguauguauacucaaacacacauacagguccaguguuacauggggaaaagaaaccgagaaaggcuuaauuagggggugagaaggacugaguguaggcaaugagcccagugugacagaugaugacguaaagauuguggcuuuccuggucuaacucuguuguggauuuuguuuuuguuuuuagguggugggcaagugcauaaaauauaugugauaauaaaaccuagugugucaugccacagcguccuucugaguagccauacaaacuguauugaaggucacugagauguauagacuuggagcaugguuuaugugagugugugaugcuuuccucuuuauaguauaguuaugaaaaauuaaaaauaauaaaaaagaaaugcaugagaggacacguaggcucucacgguucucuuugcacacggcaccuaaggcgagcucauggucuuaggguuaaugugucucaccggcuaaucucauggugagagguuaguuuggugggugacuuccuuuguuuuuuuuuuaauaacuuaaauaaauuuaauagaaaaaucugaagaucaaagugugaaaacuauguaucaacuaacggcuuugauguguaauuucuuuuguucagguaggcaaaucuaaugguuuugagggaugcuuacucuuuugauggaagaugaaaaacugugaggcucccacugacaucacagccguacaggaccugggaaaguuacgccgugaaaaugaggcuguugugcagauggcguguuagggagcugagaguuauucaccucuucuugcauugcaguauucucucucuccucaccucucuucccuuaccucuuucuccuuuccucccccuuugcccacuccuacuguagccaagagugacuugaauuucucauccuucugccuccgucccucccgggcugagaucacaggcuugugcaccacaccugguuuacugguguuuuaacucagacccaggcccuccugcacacuaggcaaguacugugaaacggagcuacaucccuccccacauugcaguauuucugaauuaugugcuaggaagaauuuuuuuuucuguugacguuggaugauauuuuucuaauugcuuuuuuuccuagcaauuauuuaagugcagcccauguuuuauaguaacuuuuguaauugagauuaaaagacaaaacuuucuagccuuucagaaauaaucacaccacgaaaugaacuuuucuaaaaauuauuuaucucguuuuuuugagauuauaauaccuaguagcaagagacuaagacccuguagaucaugccucuguuugauuucucagugguagagguaagaagaggcugucaauagagugcuguuuuuggagaacuugacaugucuugcagcaaucugaagcgaaaggaguuugucauguucuuugugagcagcauucagcaguuucucaggauacacgauacuucagagucuaauuuacagacacaagcaauccauagucuccacaaaccccgccuuucaugguaugcacuguuucuucuuucugucacccugcucuaaagcugcuucuguguccuuacuaacugggcuggugaaauagcuuagcuggcaggcauauuuugcuguaaaagucauccucuuuugaucuuaacaagaugaacccuagucauuuaucaucaugaugaaaggagaaccuugagucgauuuauuuuaucacacaucagccugaugugugaaauuacucacccuggcuguauuuacagccgcuaaugcccaggaaaacaggugucuuuauguuauugagcccacuggaauuuagacauuuuucuuuuuuaauaaguggauccaucaugaugucaaaaucuucaguuauuuagugucaucuuuuuuaauguuuucaaaaguuguuacaauucuauagguauuuagguaaauuagauaaccccaugaaggaaaagaaugaaugcauagggcaacucauauaagauuugaagaugcuuauauugcuuuggaaaaguaauuguuuuuauuggaaauggacauaguuaauaaaaacauugcugucacuggcuuuugagaacacacucaccuagauguaauucauacacuauaagcccuaccccuuaaaacagugcucaggggcuucucccauacucagaguuguguggccauggccaucuaaguuuuagagcaguuucaucagcuugauaaugccaucuaccagggccacuuccugguuccucuugaccucgaccucuggcaacggcuaacccacuuuuggauaucuuuugaauuuuaguuuaguuuugcuuaguucaauccaaggagugagagugaaagauaaaguaauuauucuugauauuggcaauagaauggagguuuuuucuuuuuuuuuuuuuuuuaagauuucguuuguguguauguuucuguguauguguguauacuacauggaugcaagugccccugaaggccagaagagggacuuggacccccggagcuagaguuacaguaguugugcucucugacaugagugcugggaacugagcgccaggccuggaagagcagcaaguguuuuaaccccugagccaugucuuuagucuggaguagaggauuccuaacauagaagucugcuuauaguuccccuggcauuagcucacuuacucuuggugcuugccaccaggcuugacaaccuaaguccaauccccugggaccacauggugggaggagagaaacaucuccaaaccucuccugcaaguuguccccugacuuccacaugcgugcuucugcacuaagugcaaguuugcacugaagaagauacaacgauaaggaagaaagaacuguuagaagcaccgugagccugccauuguauaaagcucucacauguagugaagaggauguugugaagcaauccuaggggaaagacaugcucaagaagcgucccgcuaaggagucucaggcgcccccucugacagugcucaugcacuguagggucccaaaugguaauuguagccauuguuaugugacgauuuaaaauguuucugcugccuugguaguggugauagcaggagagacagaccaucaaaagcuaagguaguaagagggaaauccacagguugaaaagaucccacuccagaauuaaugccuuagguuucuucuguagauuuaaaaaucaaaauauuauuuuugaauuagggaugaccaagagggcuaaacauuagcucugccggccauugagaacagaugcucagggccuggauggacugggcagguggagaacgaguggucaucgcacugcgacuuuuaauguggcacacagaaaucuaaccuaaauccauggucuugggaguaugcuuauauauagacacacaugcugcauuuuauaauagcucucagaggaagaauagguuucacuuuacaacauuuuuuucugccuagagaauuuaagaauaaauugauugcauaacuugaacgcuuuuauguaaaaugagaaaacgaagcuaugcuacuuuaaaaaaugacaaaauagguuuugacacaagaugauaacaguauagucagguuuggaauuuuuuguuuuaugcuaaauucuuuuuucaugcuagguuauucacucuaugagaaaccucugaaggauguauuuuauuucaaugcuucacacguuuucacugccuaaacaggcaggguugucugugccuguagaagacagauuucgcugcccuguuaucaugccugacuuguguaauuggguagucaucagaauaaacagggagggggacuuuuuuuaaccuuugaaagugauauccuuuucagccuuggcagaucucaguguucuaucuuugucucuaaaauccacaucggaaaugcucagcguucccaugcuggaguuaggagaggucguugucaggaggacccuguagcacuuuucagaaauuagagggucauccagcaaaaguaggccacauagucccaggaucaagugcacccaguaaugucacuuggaagcgaagaucugcagcuucuaagcuucucuguaauuuggucugguuucuguuuaccuauucaagcccagcagucuguguggucgcugaaaaaugcucuacuaaugacaguuugcagauauaaacauguuuucuauuuccggcuaauuuuaauucuaguggguugccaagcuacgugugucaugggggaugcuuuaucugucuucaucuacccacucagcuaccugcuugggguacaguguuagggaaugagucagugaauccucuagagagccauaccuguguggcagguggcuggggagagaugccaggggcuaacccuuuuccugaacuguagaaauacuuuccccugcauaguauaaagaucuagcuuuggguuauccuuuguuuaucuucagggagccauucacaaguuuacaguggacuagccuauuacauuucucaagccuuguucauagcauucaguguccgagcagaguauaaugcaaugugagcaauguggucugaaggcacugauauuuacaguaaggugagcuacccaaggccuaucuucaacacuugcuguguggggcguuguagagcgaauuccuugcuuagaguacacugaguaucguuuagcuccuucuugugucugaguuaucacuauggguaucuucauggugcugcaaggcaaguguggaucccagcaggaagugauguuugcgaggaagacauauuuccaaauguugaauuuuaaguauauguaaaauuuguuagugucuaggggccugccagcauuuugggcucuaaagguuaagaaaacauguuauggaagacaggcucaagauucguggauauaugggaaggggucgaaaucaaccaggcagaaagcuuuucccuugugauaaaagaaccagagguuaacucugacaagaagacagugcuuaagagaccaagaagaguacacagagaauauugagugagaucaacuccagagguaggaaaaugaugaaccaugcaguguuacaguaucccagguuguacccagggaaggcagggaagaccuggaagagaaggaacugcugggaaaaggaaguuggcaggaaaggugagaggaguaguuaugggcaaauggaauuaaaguaaguuauaugcagguauaaaaugccacaauuacuuucuacaauuaacauauuuuaauaaaagugucaugaaacucaagagaguuaauaugcauaagggucaaaacuucucugauaccaaggaaaauauaucauuugguuggggaaacacauacauacccuuuguaaggccuuauuuuuucaaugcagacuaucuuuuaccuaauugucuuccuucugaacuccucauuuuucaagaugucugucaaauaucuucauccuugugagacugucuccaaucagaguuacuuccuugugagacugucuccaagcaggcuuacuuccuugugagacugucuccaagcaggcuuacuuccuugugagacugucuccaagcaggcuuacuuccuugugagacugucuccaagcagaguuacuuccuugugagucugucuccaagcaggcuuacuuccuugugagacugucuccaagcagaguuacuuccuugugagacugucuccaagcaggcuuacuuccuugugagacugucuccgagcaggguuacuuccuugugagacugucuccgagcagaguuacuuccuugugagucugucuccgagcagaguuacuuccuugugagacugucuccaagcaggcuuacuuccuugugagacugucuccgagcaggguuacuuccuugugagacugucuccaagcaggguuacuuccuugugagucugucuccaaucagaguuacuuccuugugagacugucuccaagcagaguuacuuccuugugagacugucuccgagcaggguuacuuccuugugagacugucuccaagcagaguuacuuccuugugagacugucucugagcaggguuacuuccuugugagucugucuccgagcaggguaacuuccuugccuaguuuucauggcucuugcacaguuugugagauccacagaguugauuuggggccacaucugugugcucugacaacaaggucaguucucgaauuugucaggcacgacuguagauuucaggacuggcgccuuguaucacacccuuuuauaaaagcugaauguuccauaggacuccuuguaaguaaguaguguucaguaaaugguuauagauuugaguguuugauuuuggacguaauccgagacaaagcaacuuuucaaaaguucacaugaaaauaaucucaaacucaaaauuuguaaauugagcuacauauuuuaugaacuuuauucuauucuuuucucuaauauucuucauuauacauuugauauccuguuccaaauauauauuauuacauaacacugaagaaugggggaagauagguaguuuucugucauuggcuaugaauagacuaguuuuguccucacuaguaaguuucuggaucagaaaugauccuucagaaaguugcuagaauauuaaagucaaagaaucucuugccaggagguuaggaauagauuugauaauuucuagagaaucaagaucauauaaccauuuggggugaguccaucaaaccacuuuaaguggaauaauuaggcuuucaguggauucacaucuaaagaaaguugcucuuaaaaccaagggagggcuggaauguagcugucaguaaagggcuugccuugugaucacugagauccuaguucagucccuacaacccacaugaaaaagccagguauagguguaacaugcuucucaaugcacuggggagaccguucggccagccagccuaucauuuaagugguccucaggccagugagagaccuucucugagaaacaaaaaccaacaaauaaaaaaaagccaagguuguucucgggccuuugcacaggccugcacauguacauauacacauauguaagaauugggcugggugugcucguuauauuaguuacauuugauuuagcaugagcacucaucauguugaaugacaaacacauacuuuauacucuggacagggacuuugaaaguuggugauguuucuccuucaugacugacaguuuaaaugugcuuaaaugaaugcagcuuuuucuaugccguuauaacauuuuuacuauuuuauuuggauuucuauuuaaaagauguucagaauuauauaucaauaagagggaucuguguggugaaaaugaaaagacagagauauuggcaccugguguguggaguuuaaugauugucuuaaacaauagaaacaaggaucuacucagaucaaaugagaguuuuuaguuccugugaaagcuaaagggauaagccagugcuaacagccucagaaacuccccauaaauaaaugcuggguugaggaauuauggccugucagugaaguaugucuaaaauuauauaugaaggucaagagagcaacauuaauaugcaugaccagauuccaacucuagaaggcaaucuuucccucaggccuaaacugagauaguugaagacuguaggagaaguaugcuguguaagccuguguccuauuuaggacuauugcucuguugaaaugccaugaccaaagcaacuuggagaggaaaggguuuauuuugcucacaguuccauauaacaguucaucaucaauagcaguaggagcaggaacuaaaacaggguaggaacuuggagcaguggucauuggggagugcugcuuaccaacuugcuuccuguggcuuguacagccugcuuucuuauagagcccaggaccaccaggcuggggguggcaccacccacaaaaagaaauggccuuguguugugguggaugacuuuaauuucagcacucaggaggcagaggcgggcaggucucugaguuugagagcucuauccauggaguuucaggccagucaagguuaccuggaaagaaacugaagacucauguacuucauacuugauacucauuccguuauugccaucuugucguucacucucuguagaacuuucaacguugucuuuacucccugccccuuuccucaucuggcauucuucacacuagcccuuccaauuaagcuuugauucaggcugcugaagguaccuucuucaggguucucagugcccuuuuugccaauuucacugcucaguuuguucuccauuccuuccuuaauuucuaaggaagcaggccgguguagcaggccaccuuucacuggaaagcaugcuuuuaauguggucuucuaggcugaaggugcaaaaauggaaugaagcugauaagagguaguaggagcagguuguggugaugcacaucuuuaacucugugaguuugaggucagccugggcuacagagugaguuccaggacagccaggacugcacagagaaacucugucucagaaacaacaacaacaacaacauaggugaugagaugagguugcuugcaauagacauggacaaaggaauuaguauuggucaagccuuccagccaagaucugauaccuaugugauaugaaggggaagcaggauuggacagggcaaacuuaagaccaugacacuaaucuaacagucuuugauaaccuaacuuggugucugggagaaaagguugcucacuagaggaugcuuaugauagauagagaugaccagaccacacuagauacacaguguacucagcaaugggggcugggcaagaguaugacugucacucagaggcuacguggauccauagccuacaggaugagguugucaauuaaccacucuguauagcuaaauagcagauuguuuccugaagggagaucccagcugcauaccccaugucuugcauaguggcuaccacauccucgacuaacucuuuccuccugguguccuuugcuucuuucccuguucacccuguuaaagaacacaucuguaguugauccuacagcuacaggaaugcacuggucucuggcacuagcuggguccacagacaagacauugagcacuaagaguugcacuauagguagugccugaacuacaaggagucguccagccacucaggucauggggguaccagcuuuuaaaagacaacacagauguacuugagaagagacaaaaaacugaaggagaggaggaggccuccuguuggaggauagugcauaacuguucauuugggcagcccaggccauacgggauuucauuucgguagaguaguacagacaaacacaggaggacauggaaaacggggaaaugguggggaagggaggcguccuggacgguggagacaguagcagccugagggaugugcauaggugcagacgagagcagagcuuccagaagguugaaaucacugagaggaugauagugucuguauccugggguuuucaugcugucugucuggggcuccaacucaggacacuuugauguucuuuuccagcacuaacuauaagaaacccacuguucgggcaugcauaugaaugugguagacuagcagaguggucaacaaguagaggcagcuuuucacuaggugacauuggccaaacuugcaccugacuuaugaauuuuaauaaaaaaauucuucuuuauugcaaugauuuuuaguuucaucgaagauuaaaacaagucuggauuaagacauaacaauuuauuuuauuuuauuuuuuaauuuuuauuuauuuguuugguuuuuugagacuuuuuuuuuuuuuuuuuuuuuuuuuuuguguagcccuggcuguccuggaacucacucuguagaccaggcuggacccagaaauccaccugucucugcuucucaagugcugggauuaaaggcguucgccaccacugccugacaacauuuuaauuuuaauuucuaaaugcaauuaaucaaucaaauuuuggggggcuuauuuguaaaacaaauggcguuagggguacaaagauuuauaauauuacuuuguccauagagaauucagaguguacuauuggagagaaagguggccuuaaguagaauaugauguaucacccgugugauacgcuagguggugagcagcuuggaagcccuugccggagaagcuaguaagugcuugcguagaccugaacccgagcaaaggcucccacgugaugugccuuauuuaaauaggugcuuuccugcaugacuguagcccagaagcugcuauucaguucucuguguucucaacuauguucuuugaaggcaccccauuaggagaggugcugucaugaaggagcaagcgaauccaucacugcauguaccccacugaccgcuucagacggauguggguuuguggcuguuuugcuuggugcuuuacuuucaacacuuggccaguguuuggcauacaacuaguauauaaauaucgucugacugacugaaagacaggaagaagugaaaaaaagaaaaaaagcauuggaaacaggcagcucucugugaguucaaagccuaccgguucuacaauagugaguuccgggccagccagggauacauaguaaaaucuugguguuguuguuguuauuuguuuguuuuguuuugcuuugcuuuuguauuuaguucugggauaguaaaaaaaaaaacacaaaauacaauucuaacagugaauaauuauggaaaauuaaacauuuaaaggagacauuugaauauaaucugaaaggaauugauuuucuauauacuuaacucuuauguauuuuauuauugugaauaauuauacaauuucucuuuuucuuaagauuuucaguagacuugucauaauggacagguguguguguguguguguguguguguguguguguguguguguguguaagagagagggagagggagagggagagagagaaaagaauagauaguuuuuauggcaagugagaaauucccauuucauagaauguuuuuuuaagaaaaucacuuugcuuugucaucauaguuuuuucuucauuuucuuaaauucucuaggauuuucagaaaacaugcuuaaaacccccaggauuuuaugcugccuuauagauucguuggaggucaugccuuggaaaaacaucucuuaccuguugcaugcuuaaagcaacccccagcaucgcauggguacagagcuccaguauccauagaaacccagucauuccugauaucaacacugaacaaugaacucuuuuguuauucuaucuauuuaguaaauucucguaauuuuuucacuucccuguuuuccauuuucugcucuucacaugugaagcgaauuaagaagguuuauuuggaggccgaauugccaagcagccauggaaggcuucagcgccugcacuugcagaguuuuuccuuugucuuuggccaacagcucagccccuuugguuccccaucuguuuaacacacggcagcuguggcacggcuccauucaucugggucagaaaauagaguucuauaagucagccuggauauuaccuaccaugugguggguccaaaaaggaaagagaguuuuucucuuucucccagggauugauacaaaggacacauuauuguggguaucuuucuuuugauagcuuguucugugaucucuagacauuauugaacuuuuguaauacaaacacuccccccaaaguaauagccaguuccaauauucccccauuauuugacuacuuucauauuaagauuucaugacugggcagggagacagcccggcagcuaagagucauagcacgcuugcagaggaccugaguucauuucccaacacgcauguuagguaguuuccaacugccuguaguuccagccccaggggcaccccuggcuucuggccuccggagaaccuguaccuguguguucaaaaacccugcucccauauagaauaaaaaguaaaauaaauccuuaaaaaaauaccccaugaggguuuugguuucuguucauaagucuugcuucagcaauuuuuugagggauuaaaccagucuagauccuacuuuugaaaguguuuucauuuuucuucuguguaguaaauaucuuucagcuagcaaagcagccccacucugcucuauacugaccucaaagccagcacuauuuauuuuucuauugacuuacuuguuugcuuauuugcuuuucaacuuaauuagcccuuuccaaugacuugagagcuggugagaugccucagugaguaaaaggccgugcacgcaaagcugagcucacccagagaucccaugcuagagagaaucucagccuuuggaaacuguccucucacaucuacacaugcagucucugucucugucucucucucucucucucccucacacacacacacacacacacacgcacacacaguuugagaagcucagaguaauauauguaacacaacauuauaaaaaaaauaaaagcugaggaggacagggcaggguagugauagugugaguuauuuagggagagagcuaugcucagcaggaggaguuagaucuggacaguuagcuucuaaauuuacuaguaaccaaaaugauuguacccugcucguuccaaccccagaggaaauaucugcuuuuuuuuuuuccuuucaauaaaauguaaagcaaagucugacccaagaacucucacaacaguuuaaauaacuccuggggagugcagugaacagagcagauaaaacuaccaaaaaauuauuaaaguaguaguugccugaccaggauguuugacguuacguuuggugaucuggcuggucaguuacaggaggggucggucauugcccucauuucuuuuauacuuuguuuagacuaauuugcuguagggauaggugaagaccaaaugaugaaaucaaauuuugugauucuuagggaucuaugaaaugaguucuggucucuagaaacuaacaacuguaaguacuguuugucauggcaucuagcauguaccucaagaauguccuguucacuuagcaggaucuggcccaauuuuacacaaugaucauacaacuagacauuccuacacauacuucauauguuacagaccauaugguccugaguuaaaaaucuuaccucugaggcugagaacauaacucagagugcuugcuucacaugcacaaaaucuaggauucaguacccgcugccucaugagucuagcauguugcugcacaccugugaucccaguccucaggaggcggaggcggggcuaaggcugcuugagacccugcuaucgucaaucaacaaauaugaccaaucacagauaagcaaaucuuagcuccauuaaagcugacugugaccaugggcggauuaugucucuuucugauaugaaccugaaaucaguucucuccucauaauggugagcuguaauggugauguaaugugagccugacauuuguuuagcauuuauuauguucaguggucauacaguagacuccucagcccaucauaaaggccccaaguggucagaguuugauguucuugcaugguuccagggguuugaucugacugugguggagagagacugaagaagacaaacacucaggcacacagaaggacugauaucaggcgucuugggcucagugauagagaagcugcaacauccuggaugcugcugccauggcaucaagucuguuaauucaacucaaauucuacucaaaugacguaagagucguuauuaacccuuuuguaccuguuuuagucaggaucguguaccugugaggcaacaccauggccacagcaacucuuguaaagaagaacaauuaguuggagcuggcuuacagaugagagguuuaguccauugaccuauuggcgggaagcaugguggcacacaaguagacaugaugcuggagagccgagaguucugcauucaggcagacagcaggagaacaagauucugggccuggcuugagcacuugagacaucaaagcccauccuagugacacuuuuuuucgcaaggccauaccuccuaauaaugccacucccuaggagccuguggggcuacuuucacuccaagcagcacagugcacuaacuggugcugugcucagacaguaccggcuuuauucacaccgagcacucacgugccagcugacaugauaugaguccaaacuuaacuucuuacucaguuccuauucagaccauuagcaugguauuuugaauuuacuaccaaacacauuuugacuuuucaugacuccugaggaaaaaauccugcaaguuccagaguuuuguuguggauuaauuuguuagaaauauugaagagacucacuauuuuuacuguaaacuuuuaaaguagcauugacuucacgacuuaacucuacaacuugauuaaguauuguuuaguucuucggucaggagaaacuauucccuuucgagagacgaauauuuaucucauuuucaaauuugcacugaaucacuuuuuggcaaugcauuuuuaucuuuagaaucuguuuugcagauguggagucugcuacuuuuaaaucugguugguuaagugaaaaauuuguauauguauuccguuuuagaagccuuuaaaaaugagaguaauagcaaugaucauguucauguuucacagcucguugggcagccuguuggcacccggugggucugggggaguugguccacacuacugguaagcccuggcaguaaagagugggugaagacacauugcuguaagaucugucauacucccuuuauccugggcuggcuagcaucaucucuguccucugcccacgguugucagguuacuuccuuucucugacuaaaagccaucagcaaucacagacaccagcccucacauuuuagucuaaacccucauuugacuuccuagcucagaugauguuacaaaaggaagucaauaguggagcagaauggaguggcuugccuuaugacccacguggagucacuuugaguucccuguuguccaguugaguacuuagggauuugauuggagaacugcagaauucuguuuugggucuccgaagccuacuuacucucauuucugauuagucagaaauagguauucuuugaagcacugggucuuuaauauuugaacuacguugcaaucuuuuucucuccucuuaaguucuccacuuaaugggaccacuagcaccauucucauguuguucugggacacugucuuauuuaccuuggcucaauacucuagcuauagguggggguuuauuccuugagccugaggccagcgaccaugagggcacauuguaacuuaugcuguugacaucucuacucucgccuuagauuuuacacuuguauuuacucagccugggagacaugccugccacagcacacauguggaggucagaggaaaacucgugaggaucaguucuuuuccucucaccaaguggauucuggggaucaaguucaggucaucacuuuuuuuuuuauuuuuuaauuuuuuauuggguauuuauuucauuuacauuuccaaugcuaucccaaaagucccccacacgcucccccacccacucccacuucuuggcccuggcauuccccuguacugaggcauauaaaguuugcacgaccaaggggccucucuuuccacugauggccgacuaggccaucuuuugauacauaugcagcuagagacacgagcuccugggggggggguacugguuaguucauauuguuguuccaccuauaggauugcagaucccuucagcuccuucgguacuuucucuagcuccuccauugggggcccugugauccauccaauagcggacugugagcauccacuucuguguuugccaggccccggcauagucucacaagagauagcuacaucuggguccuuuugauaaaaucuugcuaguguaugcaauggugucagcguuuggaagcugauuaugggauggauucccggauauggcagucucuagaugguccauccuuuugucucagcuccaaacuugucucuguaacuccuuccauggguguuuuguucccaauucuaagaaagggcaaaguguccgcacuuuggucuucguucuucuugaguuucauguguuuagcaaauuguaucuuauaucuuggguauucuaaguuucugggcuaauauccacuuaucagugagaacauaucauuugaguucuuuugugauuggguuaccucacucaggaugaugcccuccagguccauccauuugccuaggaauuucauaaauucauuccuuuuaauagcugaguaguacuccauuguguaaauguaccauauuuucuguauccauuccucuguugaggggcgucuggguucuuuccagcuucuggcuauuauaaguaaggcugcuaugaacauaguggagcauguguucuucuuaucaguuggaacaucuucuggauauaugcccaggagagguauugcgggauucaggucauuacucuuggagcaaacaccuuuacccaccaagcagucuuuuuuuuuuuuuuaaagauuuauuuauuuauuauauguaaguacacuuuagcugucuucagacacaccagaagagggcaucagaucuuauuacagaugguugugagccaccaugugguuucugggaauugaacucagaaccuccggaagagcagucagugcucuuaaccgcugagccaucucuccagcccuaaaaaaguuuuauuuuaaagucagacaucucacuuugucguacaggcuggccauguuucuugcaguacuaguuacaauagcuaggaaggggaaacaaccaaaugguccuucaaccgaugaaggaaaacagaugaggaaaaugugcauauacacuauagaauaauauucagcugcaaagaaaaaugaaauuaugaacuuugcagacagauggguagaacuagaaaagaugaaugaaaucuagaccccagaccuagaaagacaaauguccuguguucucgcucaucagaggcggcuagcuccagaucuucagauuugaguacauagccugcagugacugcagaaacugggaaagaaaaaagggacuauugucuucucgcuguaguuucuaaguauauguauaugaguuuccugucaaguguguauucauaaagauuauuguguguuuacauaaaagcuagagcacuguccucauaucuguggaacucgaauccuuaauacuuuuuaaaaagaaggccuuuuuuuuuuccuaccaagagaguauguaaguuucagacucuuaguugaguugcuuguguagucuuuggagaaaaauuaagccaagaucuaagugauuuccgugcagaauuaaugcuuccccugacuugugccgagggccgcgaugcauuuacagagcagaugccagaaaguuuagaacuuguaucuggacacaauccagaacucuaagacagaaagcauuugugccuggggcaauguaaugaccccaccugugucuuuuucuugucuucuggauguuuucauuuuauguccagaaaggcccaggcaggucccucuucuauuuuuaaaucuuucuuaugaaacacaguuuuaauuuuacaagaccagaucucacuccaaguuucaaaauaucuguucuucagcauaaaauguucugacagauaccuaauggccgauuacuuuagcaucuaaguuuuaggcauacauucagagaaucagggccauaaaaccuuagcauaauuagucacuauuagauguuguaugaacuuguauuucacacaucuauauucuaggugaauuaauuucuacuuucuuguuauuuugauaauuagcccaaccuauuaauaaauuaaaauaaacagaaauacuuauuuguuagauuuauuagcuuuuuaaaaaauuuaugaucuaaggggaaaugcagaaaggaacaaguauuuauugagugccuauuauguuccaaguauuguccuggauauguuuaccucccuaaucucacuuugucuucacagccccucaauguugcuaucaucaucccaguuuuagacaagaugagguuuaaacaagccacacgaugauuguuugugcuuguguggggucuuucgcaccauaagucuaaaguaccaucugucauuggggaugcucaguuauaaaaaggagaaguugacuauuguaauuuauccucaccacugcagaacugggaccagaaaaauagaaacacauguaguguuucucaguucuuugugauugcuaacugugggaaacaguuaacagagacaaggaacaaguagacaauacaggauaccuuuaguaaggggaaggcuuuauaauacaaaugaugcugucacagugggcauccacguacaaaaacauuagccugauccugaccuugaacuguguauuaaaaucaguucaaguagaugacagaucuagucauaaaauuuaaacuauaaaacuuagagaagaaauaaaggggauuucuaugauuuuuugguuagguaggaaguuuuuaacuauguggcucccaaauacuaauaaauuaaacuguauaggaauuuaaggaggggauuuagcauuguugguagauugcugaucuagcauguacagagcucuguagucuaucccuagugccacacagcccagacauaguagcacacacucacuuagaauacuaacucauaggaagacuuuccaggucuucugagagguucgagacccugucucaaagaauucugaaagauuaguugacauuuauuuuaugugaaucuuugucuuucccgucugaauguuuauacaccaugucguagcuauagagcccacggugucaaaagucaucagauugcuuggaacugggagcacagaggcuguuggcugcuauguagguacugagagcugaacccuggcccucuugcagaggaccuaaacccuguguaagugugauuaacuagugagcuguuucuccaguccaccaacauguuuuuuuaaaucuguuacugaaacacuuuuuuuuuuuuuaaaaaaaaaggucaugauaauacuuagauaauacuugcuacuuuacaaauacacuucucaucaagaaaugagauccagagcuggagauuaacucaguauguuugugguagcaugugcaagucucuggguuuguguccccacauucacuuccugccacuccuccaaaccaaccaaccaaccaaccaaccaaccaaccaaccaaagcaacaaaacuuguaucuagaauaaagagcugucagcaucuaguaaaaagaaaaugaacuacuuaauauugaaagcaggaaaacauuugaacagguccuucccuaaagaagagaaacgguguguggaccaauccuccacaucacuuaggcauuggaacuguaaauuaaauccauaaugcacaguacucaugaauuucauauucagagaacugccagacuaaaguguuaagaacgugaagaaggaaucucagauguuuccuugaaauccucucaauuacacucuguuaguccaaguuagcugcaugugagugugggaaauacaggcuuaaacugaucagcagauauugaagagcacacacagccaggaguuucuguccuagucuugaggacaucugacuggcuggcugccgggugccuuguaacguggggcucccuacuucccaggagacuagucugaacgcugcagucccauugucccuucugguuuucugagaaucuuuccagaccccguuugagcagacauuaggcaguaugaccucuuucucuucuuuccuucuuuccuucuuuccuucuuuccuucuuuccuucuuuccuucuuuccuucuuuccuucuuuccuuccuuccuuccuuccuuccuuccuuccuuccuuccuuccuuccuuccuuccuuccuuccuccccuccccuccccuccccccuuccuuucuuucuuuugcuuuccccccucuuuuuuggggucuugcucaggcuggccucugaccugcaaucaugcuguuugccuucagcuuuucuuuguguggauuuugacuucuauuuguuucuuaauuuaacuuuuaagaacuuuucuuuaaucuaucuuguaucacauauugaauagcagucaauucucucaggcuuaucuacuugaaaaggcauugauuucagguuuuuuuuuuuuuuuaaacuauauuuucauuggcuguaaacuaucagauauucuucucccuggacuugagcguacccuuggcugcguagcuucuaccaggagguguugaccucauuuuugggguucugaaucucauggcuuuaauccccucauggcaccccuccauucccugucuggggaguuugcugugccccugcccaggccugcgcugccaggaccuguggccugcuucaagcuuggggucagagagcucugucuacucaucucccagagacaugugguuuugcuuggacucuggaguggaacaggagguguuuuuuuuuuguuuuuuauuuuuguuuuguuugcuuauuuagugcauuuucuagugucuacuauagaggaauccacugacacuuguaaauaauuuauaaauuaaugugcacugaauaggaggcuuaugaccaacagcagccuccuuaucaagauacacacaagagcuuggaguccacugcuuuguagggcauugacuguaaguaauugauagauuggaguagaauuugccauuugccuuugaauuugauggcauuauucaaauucuauauaauuuucuaugaauauuaauaaauaagacuuucuuauaauguauaagaagucccuaaaagacaaaguaguauuuaugggccugcuucuucaggcuauuguaaauaaaugauauuguguccuuucuuuuuaguacugugaggcucugggaaguugaaaauccaaagaagcaaaaaaguguuuuuaaaccucggacaaugcaggguaaaaaggucauucccacgacgugcacguacagcagagacgggaaccuuguggccgcugccugccagaacggaagcauucagaucugggaccggaaccugacagugagucaaagcccuuuuuguuuuguuuuauuuuuccagacaggguuucucuuuguagcucuggguguccuacugugcuagaacucacucuguagacuuggcuggccucgaacucacaacaauuggucugccuuugucucuggaguacuagaauuaaagguguguaucaucauguccagauuaaaaguuuaaugacuuuuaaauguucuuucugcaaagaacagcugaagacacuaugaguuuccauuuccugaucuucgaguuacuuaaacugcagucuuaguuuaucaagcacuggggcuuucucaguaaacuguuucagccaauacuccagcucugaguuuuuuagaauauaauuuuaaaauaaguucacucuuuugacauaaaauuuaaaaaucauacuauagcuuauuauaugacaucucaauuugacuuugaaaagaaaacuuuaggaauaauaugaaacaguacucaacagagaacuagaaaacauguuucaaaggauguaagaaaauuaugaaaaaaucuagaauuaugacaguucuuuuaugauaauucuauaauaauuuuaauacauuuuauuuuaauauucuuuccuaugccagucuauuucaguaggcucaaguuuucuuucuacaguuaaaguucauuauuugaauaaguuuuagaccuggcaaguaucauauaguccccagaaauaauaacggugaaagccugugacucauucugagggucucacucugcggguuaccaagaagcuauaaagaggccuuuguguuaggcguagauggaaaaggaaaagauuugaggcuaccaauguuaaaguuguauacaaauguuuugaaauauuguuugcuuguuuguuguggggcaugcaugugugugugugugugcacgcgcgugagcgcacacacacaugugugaccaccaugggucccagcaaucaaacucagguauuuagauuugugggcauguguucuuuacccacugugcaucuuaccagcucuuucuaauguuauaauacaauuuguauuuguuacucaaauaaaagguucuugucaaauuauuaauuaauaucuauugaauguguacgauaagccagacaguauucuagguuuuaugaguauugauuaaaaauuccugccuauguuauuuuuauuacugugaagagacuucaugacuguggcaacucuuuuuuuuuuuuuuuuuuuuuuuuuuaaacagacaaaggcuuguuuucuuuuaaagacugauccaugugaggccacagccaggccgcuauguacagacaggagggaagcuuuauuucuuggucucuuccuccuuggacagagucuagaugagcucuuccuucuuggccuggaggcgcuccucccggcgcuuucgugcuuccuuggucuuagaccugcgagccucagccuggucagccaggagcuucuugcgggccuuguaugccuucagcuuguggaugugcuccaugaggaugcgcuuguuuuugaacacauuccccuugaccuucagguacaggcugugauacauauggcggucaaucuucuuggauucccgguaucuccugagaagccggcgcaggauccucauccuucucauccaggucaccuucucaggcauccgagcauuggcaguacccuuccucuucccuaugcccauaugccugcccuuccgucgggccaggguguuuuuccggcaaugagcccgggaauggacagucacaggcuugcagaugaucagcccaucuuugaucagcuuccugaucugcugacgggaguuggcauuggcgauuucauuggucucauugggauccaaccagaccuucuuuuucccccgcagcggaggacacuagaggcaagccucuucuguagccugagcauacucauggcugcggccgcagcagcgaaaggcguggcaacucuuauaaaggaaaacauuuaauugggguugguuuacaauugagagguuuggcccauuaucaucauggcagguagcauggugagguuuagguggauaugggacuggagaagcugagaguucuacaucuggaucccaggcagcaagaagaguaagcgauacugagccugacucaaguaucugaaaaccugaaagcccacccuagugacacacuuccuccaaacaaggccacaccgccaguaacgccuccagacucccuguagucuauggggaccacuuuuacucaaauuaucacugcccguguagaguuuacauuugagguuuuaaaaaacuguacaugacaggaggcuggcaagaggguucagcaggcaagagcgagcacuggcuguucuucaggaaaccuauguucaauucucaguacccacguagcucacugcugccuggaacucucguuucagggacuccagugcccucuucuggccuuggauggcaucacacacauagcacagaaacaugcaggcaaaacauccacguacauaaaauauauauaaagcaaaaaugaaccgcucaucuucguuccccaaacauuuauacuuuaaaacauuuacauuuugaacaggacccuagggagcauauuugucuuuucggggaguugagacaguuguguugaaauaagguagagcgcaauggugggagggaacuucauacugauaaugcuggaaguaucuucggcauuuucuguuugucagaucuuuuuauuucuguuuucaucuccacuguaaacuccauaaagcuucauaacagcacagagauuuuaaaaugccuuugacuuguaaacugaauuuuaacuaagcaguaaaucuucuaguaacuggcuuucgucgucucuggguacugcuaacuuaaacacagaaauucuaaaauggguggguuucuucugcagcuuuccuagucauguuuucagagugcucucuacacaugugccuagcucuuaggaccugcauuuguuauuauuauuguuuuuagugaaguuggguauagauuuguagaucagucuugcguaucuugaaguaauggcaguguguucuuuucaguuuuguggaaaacaaggugugagcagcagccagcuuccucagucaucugcugaaggcucauggcccaaggcagacugcuaauccagucuuuaguucucuucugcugcgaugugugacaugggaacacauaauuuacuaugcugagucuuauuugcuauguuuuguucauuuuuauauuaguauauuauuguaaacugaaaacaaauuaaauugagaaaaaauucuacuauccuccuugauuuaaaacagguuuuaaaauaauucugaacuauuaucucaaaaguauaaacaagaacaucauagaaccaggaggcugaagggagaaaacauacuagaagcaguuuugacaugggaccgaagguacugugaggacaugcguuuugugaugaguuaguaaagcuuuuuaguugucacaguuaauccuggggcucucauuuaaucaacuucaccacacauguaacaaagcccuuccuuacagaucauguaacuccauuagugauagauccgcaugcccagagugcugucggccauacaguucagcagaaguggaagacacauaggcaguggggguaaugugguaagaaacacgcacugcgcauacacgaaaaucucguaauuaaauuaguuauuguuuauaacuaauauauauauauauauaaauuuaaaauaauuacgguguacauaaaguuuaauucucaaagaacuuguuuuccuacugcuugcugcuucugcucugugcuccuugucugcugugccggcgucccucaguuaccuaguagcuguucucuuuaggacauguucucacuugaggaacauuucauccacauacuuaagaaccagcugcaucacugagaauaugacaaaagaaauuuaaaugagaauaauaugugggaugaucucugagcaacguguuuucuuguuuaaaacccagaauuggugaagucagagaccagagagggcaaucuuguggccucuagagcgguguucauguuggauaagauguaagauggagaucacaguguaagaauauuggcauuuaccaaacugagcagaacaaagccacugagccugcaaaaaucauacugagagccuuuuuugaggucucaaaacaguguuaaauaauuacuuuuacagucugcagccaacuaauugagaggguguuuacuacagagaagaguaaaauaaaaucaacaguauuucauacacgauguggcgcugggucugggcgcuuuccaguugcucccagacuuauuaugagcaccaucugcugccuuauauaaaauaguuuucaggcuuuaacauuuucaauaguauuuucuguuaaaauuucacaaaguaccuuuuagaaguucccggcauuugcauauauccaugguuaagauuuugggcuucauuguggaauuuucauacgugcugccuugcucacgucacugccuucuuuucagauagaagccuucuucuucauuuccuuuucuuucuucuuucuuuugguaaauuaaucuuaaauuccucaugagagaaaauggguaguguaugucucugugagucuagcuguuuuguguaacaugaucuucaguucuguaagucaucuuaugggauccuuuuuucucacuccuggcuccaaauuccaccugcuaacuucucucuguaguguacuguaacuuuuccugcagcguguguuaucagggaggggaguguuugcauaugugcagaggccagaagucagccuuggguguuguuccucugggacuaccuacuuuuauuuuugaagcagggucugucuuugggauugggguucucucuuuaggcgaggcuugcugagcagggagucccauuccccccccccccccccccagcucucccuccagcacugugcuuauaggcucaugucaccacuccucgcuuucuacauggaugcagggccuugaggucaggcuccuacacuuguauggcaagcaucaggugaacuaaaacaggauuuccucugcgccauuuuuauuguguuuggauauuccucuaaagcuaucauagcucccgaaaauacgaacaucauuucauuuuguaaagguuucuccauuuuguguguguguguguguguguguguguguguguguaauuauugacuaugaaggaaaagaaaaaauaacaugaaugagaugaauaaguguucuuuuuguuauuguuguuguuguuguuuuuaagacaagguuaccccaaguaguccuagcuguccuggaacucaguuuguacaccaggcuggccuugaauucaggagguucaccugucucugcuucccaagugcugggauuuaaggucugugccaucuccaccuaccuucuucacccuucuaauagccaagugcaguaacccaaauuucuuucaaauggaugguuaacauggcaguauuaaagauuuucuuucaaauguaaugcuaacaucuuaauauuaaagauuucggaaauuugugauauuuugccauauuauauuguauacuuaugcucaguuuacuuggugauaaaucugucaccuauugcacauuuuucaagagucauaaacuuugacuuggaaaauauuuuucuguaguuauuaaucauuuacuacuaucuacaaaugugaaaaugugugaggaguucauuaaaaauuuaucuuugagauuguauaaaccaaaaauaauugcuuucaguuuguuuuuaaaauuucaguggcaaaccacuuugugucaaccccagauauaauguauggaggaccuuuugguaucuaauuacuguauagucuaugaaugcaacuuugucauuuugauagugguaguggcacaaagauucaucacuuaagcaggacccccagagacuaagcucaguuacagccuagucucaugucccagaccgucugccaggugucuucucccuccuucccacaaagacugaccuguuaauaauaaucacaaccuuucccccuuagagaggcaagaacaagcaaguaaggggcaaggaauuuauaguaaguuauggaggagaguaaauauuuuucaauaauuuuugaauaccaaauuauuuggaaaauguuucugguaucuuacuuugaggggaaaaaaugaucuaccccugaaaaaugcaaaagauaaagguuagaaaccuaaaucuugauguuugucuuuuuguuaggccucguacugaggaucuggaaaguuaggaagagacacagcaaaagcagauccuguggcucuuuagcucuuuagccuguagaugccauccaggacgucaggcaaagugugcaugacuuuguuacuagcccuuacuguguggcuaaccuaaguauccugagaccgaaugcuaguaaccuucaggaacuuuuuaguucagcaucuaaacggggggaaaaggaggauagccaguaguuacuauacuccacuguguguacacccugucuaagugcuuugaauauaugaucaguuacaaacuucauaaccuaugugguagguaguuggucuaaccuuuuauaucaaaaaacaaaaacagcugcauagacugcccaaaauuacuucaauuccaaguugucaaauacugaauaaaaguugcaaagauuuuaauaagguuuuagagagaccccauauuccagguaaaagggaaauaagcuguaaaucuuuacuuacauggaccugccguuccuucucuucagguguuguuggucaucauuucagcuuuauggagcauugucacugccugggcaaaacuuucaccacuuuauaugugauguuucacuuuguccuuauagcuacccuaagauaugaaugcuacugugguuaggaaacugagacacaaagagagugaguugccuaaccaaucucacaguuaguaaguagcauaaccaaagccaguccuagacagucugguccaugagcguugugauaguuugaauuagaaauaacucuccaaagacccugguguuugaauacuuuguuccuguuuacuggugcuguugguggaaccuuuggaaggugagccuggcuggaggaaauaugcucucugguuugggcuuugaguguucauagacaccccccucuccccaccgcccuugauacgaacucucaguuuugccugcuguuuucugaccauuccuccucauuaugauggacucauauccucuggaaccaugagcugaaauaaaccuccuuaaguuauuuuccgucaggguguuuuuaucacggcagcuguacaccacuucuguguaccuuccuuuuuuuuuuuuuuccccuuuucuuuuggagacagaauuucaaaguaucucucaaguggucuugaacuuucaaaguagaccagacuugaacugacgaugcuccugacagcgucuauuacgccuucucuucuucaacuuguuguaagaguguucacuuauguguguaagugugugggcaugugcacauggaggcuggagguggcuguuggcugucuucccugaucacucuccaucuuauuuccugaugcaggguuuuuugcugaccgcagaguuugcugacuuggcuagcuucgcuaggcaggcuugcccuggggaaugcccuaccuccacuuucugagugcugggauuacaggaaggcugccaugccugccuggcuuuuguguaugugcugauugcuggucuuuaugcuugugcagccaggguuuuauccacugaggcaucuccccacucaugacgacuuuaagcuaagaauuguuucuauguuuucaaauuacuguauuauuuguuuuacaguuuuuuucaacaaauuaucaucaauuuauuuguucaaaagaacaaaaagauauuuucccacaguucuguacuuuagacaucacauugugcuaaaaucauaguguugccagggauauguuccuuccuaaaggccucaagggaggauccagucccuuucaggaucuacagauuccucagcuuauuccccucuuccucuggcugaaaggccagggagaacgggugcacuucucgcacugugacagucuuuucuucuucguuuggccacuguuacagguccuuaugauggcauuguggugacacgcucacucaguguaaucucuuucauugaacaugagcugauuagcaacauuaguuuacucugaaacuuuccuccuccguugccaucccagugagcugucuuacagaucccaggaagcagucuguagcgaucuuccaagguaucaaucauucuuucuacuaaaaugauuuuuuaaaaagauuuauuuauuuauauucuguguuuauguuugagugucuacaugugugcugaggcuagaagaagacauuggaucugaagcuacaggcaguugugggccucauaaagagaauaaauccaguuaaauauuuuuguaaaaggggaucaaguuuuuaaguucugguaauguguauauauugaaauuacacucuaaugauuuuguauauauagaagcuagauauuuuuggauuuugcuuauccaacauuaaaaaaacaaaaaaaaauaaaaaaaauuaaagagaaacaagugcucuuaaccauuggaccaucuccuguguaugugugugugugcacacguaugcauguaugcacgcacacacacacacgcgcgcgcgcgccuaugugcgcgcagcucucuuccucccucuuucucucuuucucuuuuuuucucucucugucuuuccucucccucccucuccuccuccccucccccucccucucccccuccucuuccccuucccccucccccucugcuuguaugauucuaccuguauucucacuguucuuagccauguucucugucuugugucucacuggccuccauuacuaauauaaaaggaagucaucuuuucagucuccaaggagaugaacauuuuaugucaugucauuaccacuuuaaugacugaugauggaauuggucuuucuugugucuucagcauuuguggcaaaagaugugaguucaacuucuuguggaaugacuuugacaggaugauaauccagaauguaggcucaguguaccaagcacagcuucucagcucuuuuagaacucaggcuuucuucuuucuuugacuuuaguauuuuucuuuauuuucucuuggcacuucagaguagccucucccuccuacauuuagugacuggcuuacaaaguugguuucagugucucugaaucugcuuccacaauuuuucuuguugccuacuucugcuucuggcugggguugguugacagucccaccuucuccuuugauaugccuggccccaaacugagucaugucaagcuuccagucacugcucagugcuaaucacuucccuaucgagcaucacauuuccucagguggaaucuaugguucuucugggucugucuuuguucagacuuugagugucuuccaugacuucucaguaaguaguuuuuugcuugcuuguuuuuuucaagacaaggucucacucuggagacuaggcugaccuugaacucacagagauccaccugccucugucucuugaguacugggacuaaaggcgaggguugucaugcccacuuggcuguauuaucuccuuuucuuugugaguaaugcugucaguugcuggcuuagacaccuuucucuaugcugaccauucaguccucagaucuuguuucugaaagaacccccauuucugaugggaaucucauccacugaacaaccccuaaaucagacuuguaccuuccagaaugcucuugaaagucagugcuuuauugugggccaggaaagucugcacagaggugucugaauccugaaauagucuaguaaacuacuggguucauguuaaaaaacacaaccaaccaaccaaccaaccaaccaaccaaccaaccaaccaaagcuuccaaaguuuaagauaucaucuauuuagugaaugagaaauacuuugcuguaguuuggcccuuggugauggggaacuuaacuuaaacugcagauguacccagauggaauuggcucaagguaucagauagguguaggucaaaaauggugucccacggggcucgggccacuuggcaagguggauguaguaaguuugacugcaggcagcugcaccccacggcuaaugagaagccaggggacccgcuccggggguggggaaggcgcagucuggguucccuguggaaccugccagaguuggcuggggucccuggguuugcacagaggcuaaggaccacaaguucuuacucugaagacaucccagacgccgcuguauacugcggaagagcugagaacagagugugggccugugggcagacucuggcccagggacaagggaaaagggcaggaggagagagcucuggcugguuacugcagggacgacaguccuaggcuuguuuggacaguggcuugcugggagcacauggaaggcuccucugggagguuagacacacugcuccagcacagaggacccugaugagaagagacaguccgggguuuuaaggcauuuauuguagaaaggcagagagaaggagaagaguagagaaguagaggcaggccaggccauguggagagagaggugaagggagggggaaccguagaggugagaguaagagcaauaggguaagacagagaggagagggcaaacagccccuuuuauagugggccagcuaccuggaguccaaauagacuaccaggagcuuggggcauugccuacuugucugauggccacacaccugcugugggaggcuguaguugggggcccaggagccccagccucccacaucagcuuuggggacacaggaggcauggccgaacaccuggggucccuuagggucaccgaaguucaaggccugugcuugaccagagaccaggcugucugugcacaacucaacaccccacagauagggaagaaauaauucaaacugugaggcagugaucugguuaugucugccuuccucagguuaagugcuccagacuaguugcuacuuuguugagagacugccuguaccaugaggucuuugcaguuguuaaccccugcuacuccuaggccuuugcaccaguuauugccugugauauguuguuuuaugcuggcuucuagaauaccauuucaaauaacuccgauaccuuguagcuagaauauagauuaagaacggauuuagagucaaacuguaguuguaagccgcccgagaccuacaugaaccggguacuccuggaaggcaggcugggguugaaagagagacuagauggcgagaaaagaaugaagccaagacaaauuuucucugaucaaggcccgcgaguuuacuaaaagacugugcuuauaaaggggaaaggcccaucuucugccaaucuuggugccuguuggugucucagcaggcagcaggaucuuggagaugagcagggcaguugacacuucaaaagaagccagccaaguuggaaagcugcaccgcagguggccccaccucaguggugacaaggucugcacaagcccacuucaggcugggggaggcuacaucaaacugccugcaggagcugugccugaacucucuccuguccccaugucaccauccgguuugguuugccuggcucaguuucuucauaacaaccauuucuguguaacuguuucauuuacccauuuauuuguuuuacaauuuuauuuauuuguguguguguguguggggggggauguguguguguauguauguguguguguguuuaugaguguauggaaaguaagaaaacaaaagaagaccaugucuuauuuaggguuucuauugugaugaaaaaccaugacccaaacaacuuggguaggaaaggguuuauuuuauuugccuuacucuccccacauuaguguucaucacugaaggaagucaggacaggagcucaagcaugacagaaaccuggaggcaggaacugaugcagaagccauggaggagugcugcuuacuggcuugcucaucauggcuuacucucuuaagauucaagaaucauugaagagugauaacccagacucaaauuguaugcacaaacaaagaggauuuauucagcugaauuuccugcauucaggggucuccccauuugaggguggagacccgugguggacuugcagggaauuccggggaaggguauguguuauuuuacauugauugguuagcucuaucuguaguggucugacugauucuacaauugguuagacucuggagacuuccuaggaggcugcuuacucauucuaccuaccuauuuuuacuuugggccagaugacaagguauccuuugauuggaugcucauagcuguggcuggcugaccauagguuccugaaucuggguucucauuucugggaagcagaaacuuaggccuagucucccagccugucucuggcuaacucaguucugcuuucuaauggaauuuaggaccaccaguccagggaugucaucacccacaauaagcuggguccucuucuaucagucaccaauuaagaauaugacuuaggggcuugccuauugcccagucuuauggagacgugguuucaacugagguucaauccucucagaugacuuuaucuuguguuugcauaaaacugaucagcacagacaacuugcagaaauugucuuucuucuuucacccuuuagggcaugguauuccaacuaggucuucaugcgugauggaaugaagcugaguaucucacugggcccuauuuauuuguuuauucauuuauuuauuguuuaauggcuuagacauuucaucuuucacuaagauucauaaggucaggagauuugugccuuaacugaugcuucuuuaugucuuacaagaccauuuauugagacgaugaauaaaugaauaaaaaauaucagagcacuauagguuuuguauguaguugauuugauucucaguugcuauauuggucuuuuaaaauugcuuaaucaaacuuuauuauuaucaucugagugugcuaagagcauuuucaacuuguguuccacaacauaugguauucauaaaagauaacauuuauuaaacauuaacuuugugccagguauguuccaaguguuuaauucacucacaugcucacacacguauauguguauucauuugaucuuuguaggauaauacucugaaguaagugcuauuguuagcugauguuucagauaagaauauucagguacagaagcuaaaaauauaaugacuuucccaggauuacacagaccauaagugguagagucagaaacuguggcccuaggaaaucacuuuaugaagugaaaagaaauaauuuuguggaaaugugcugaaaauaacuaauuucaaaagaaugaugaaacuguuuugucaugacuuuuuugaauucagacaaagugaguuauucagacaggauaaaaucucuccuccccugccucugcccugguuucuugagacaggaucuugcuauguagcccaagcuaaccuuaaacuaugugguacaggguggcuuugaacucauauuacuucccugcuucauauuccugagugauaggauuguaggaaugugcugucauacuuguaucuaaauuaaguaucuuacucuuuagcccaggcuggccuugaauucucauucacauuaugugugaccauaauuagagacagucauuucauagcccugucaucaguuccauuagacuauccaaagcauagcucaugaucaacucuggaaacccaucuccagcuuugcucuauuuaauggccaucaaagaaaguugguuuggcuaauuuuuuuuuuccugauuguaaagcuaguccgaauuuauuuggacaaauauucaucaaaaauagaagaguuuauggagaagaugugucagcucuaaagaccucgugaagaaauaggaaucaucuuguauagucacacaagggggaugugccuggcguuuaugugcucggggguucugggcuuguaguugccuguauaauuagucaucuucuuccuugcuuaggucuaaacagauuggaaaguaacacucauuacucaagcaugauggaugaaggccagaauuuaccacuacuagaggcagaauagagaaaaggcagaaauuccuguagacuaacuccugcaaugggacaguaguccacagggaucuuagccagggcugcugaagagagacagggcaggaacagaaaauuacucccguggggcaacuugugucuaagacggggaaagagagggcugccaaggccugcccgguauucuucccacauucacaaacuuuuguuuuucucuuagagucaaacuguuaaacuagcuucauccuaagggaacggugaauaggggagugggcagaagacugggguaagagauucucccaagggucaaauugguggauuugaagagaagaauauaacauggucaggcuuauauuuuacaaagaaugauucuaaccauucugaauggagaguuauuauaaagagaggauggaucauggagacuggcagcuauuucagguucaguuugcuggaugaaaauggugguguucugauacuuggaugugaugaauauuugagguuaaaguugacacaugaguauuaaagauaaaucacauuaaaauaugcuuuuguuguuguugcuugagauagguuucauaucucagacuagccuggaagcagcuguauaauccugucuggccuuuuucuucccaagggcugcagugacuuaguguacaccagcacugucagccauaaaucaugccuuacaaaauaaaauagauggccuuaauuuggaaaaugauuguguaaaucacacuuuauugucuccugucauauuacuuaaugcucuaauuguaaauagacgcagguagcugagaguuuggaucccaguaaauggagaacacuugccuugauuuugugcuucuuagcugauuuuugaacaauuuuuauuuugguuauuauuucaaccaguaauaugggauaaugcucaguaaaacuaaccaacugaauaacuaaauaaaaaucuuuuggcauuuuuuaaggcacaaguaaaguccuuugcaguugucuagguaaggcuguuccaguccucugucuaacauggcuggacucugcugagggcuguaguuucuagaaggccuacaugagggagggacaccucugucucagacagauacuuccugaggcauguuucucagcugcaggacaucucugauuuauuuuguaagcugacaaggccaaacauuacuguuuuaagcauuauaaacaaaacaguaaauguuaaauguucauuuaauagaugcacuaguagggcauuuauauacagaaagcagagacugagccaaaacugugaagggguucucuggugugccugugugcauugggcuuaaccugcucuuugauuggucgccacaggagggcugcagcugcuggggagcuugcucagcacuuagugcucagugcucugcgaguccucucaguuucuuuuguuguguuuucuuucugcugauuacccaagacuuaguaaguggucacauuucuugcagcuucucagaaacuuuguauguuagagucaaauuaaagguuuaacaaaacucuguuaaaccucaaugcuuccaaauguuuuaaccguuuaccaguugucuuuuguuguuguuuguuuugagacaggguuuuucucucuaaccuuggcuguccuggaacuucuucuauggaccaggcuggccuugaacucacagagaucugccucccucaaacuccuaagugcuggacugaagguauuuggcaccacucccagcucagguuucuuuauagauagcugucgcuuuacuguggucaccgguguucugugggggaagagcacugaugggcagagagcuaguaguuaaggauccagcauagauugacuagagagcagugcucugugaagcuguacaucuuacauuuauuauuuauggauugcuugauugauuguuuuucgagacaggguuucucuguguagcccuggcuguccuggaacucacuuuguagaccaggcuggccucgaacucagaaauccgccugccucugccucccgagugcugggaucaaaggugugcgccaccacgcccggcucauuuuacguuuauauuaugaccaaauacagacaugucuuugcguaaacaugcauagaugacauugaggagaaaaugaagcugggaguguggcucagggcuagagugcuagcaagcucaagguccuggguucaguucagucuccaaggaaacaaauguaagcauucuuuugaaaagaaauuuacuaaaagauaaaagaggaaaaaaauuuuaaaaaauguacugaacuggggagauggcucagcaguuaagugcacagaccuagguucaaaucccaccucuacauccuagcuuagaacugucuguaucucuuauaucugacauccauacacagacauacaugcaggcaaagcaucaguauacauaaauaaauguauaaauaaguuuauuuauauauaguauaaaauauuaaauacauucauaaucauaaauaaaauauuaaaauauaaauaaaauuuauuuauuaaaagauuauugaaaaaacacaucugucauugaggcucaguggguaaaggagcuugccaccaagucugaugacauguucgauucccaaaacccacuguuguccucugaccuccaaaaguacauugugugguaugaacaugugugugugaauacuuauacaaauacacaaaaacaacaaaaaaauuaccauaaccuuuaaaaauucugcaauagauagcauauuacaguauuuauauuccacacucuucuguuucuuaaagggcuagauuauaaccuauuccauugauuuuuuuuuaaaugacccauagacuuagaaccagaguuugagaaacacaucuguagcauaccccaaguauauaauuuucuagcagccuuauuaaauaggagaggcuuauauuaauguuuucaaaauacagcugaauacaccuggaaaagaggauguuauacagaauaacuggacauaugcuuggaggggaauagaucaucacgaauagaaagacauuugagcauuggagagaaaggggagugcggggacuuagacugugagguaggugaaggcaaaagauacgcugucuaccuuggacuuuuugccuaagccuaggaagaguugugcuguaacagcaggagucacccacauuaugggaugugcuagguaugguguccugaaaagcuacuccuuuagcuuguagcucgagaacucuuccccucaguuucacacaguucgucuuagaaaucucaccugaaccauugcaccuugguuucucuaaggaauccaugucccaaaggucacuugucggugugcugcagcuaccauuccuccuggauuauuuauauaccaccuuuuguuuacuuuacucuuaaaacgaauuuauuuaaaaauucuaaguacuucaaaaucaagguggcaauuacuuaccauaaaauuaacuauuuacagugcacaccucuggguuuagugcacuaacagcauugugcagccauuggcucugucuagguuaaaaauuguuuucucaagccauaaagcauccaggcacuaucaaguaauuguucucuaccccuuauuccuaaagaaaacauaguaacacaaucacaaauagaaaauagaacauaacuguucuuaaagugcacuaaaaauaaagcaauacaaguaccaacugaauacaguuggcagucaagucccaaaucaagaguuuucuacuaagggauaauuagcauauuaauacgcauaugaaaguaucaguaauucccuuagauuuacaguuaauagaugcuuauaagaggggggauguuagcaaauaucaugaaguauaaaagaggauggcagugaaacacguugguguacaccuguacuuauagcacuccagagauggaaacaggaggaucaggaguucaaggcuaaccucagcuacauaggcaguucagagccagccuggguuacaugagacucagucuuaauaucccuucacccaaauaaaaagagcaauuaggacuaaaugaggacuuuccggcuggguuauuuaaauuaguuauggggaauuuuacaaacaaguuucucaucaugaaauucauuuguauuuaugcuuuuccaucuaaauauauuguagcucgacucaccauuuuuucaugauuauuaaagagauugccaacuguccuaugaguucuguauaacugaccuuugaagccugacaucuuuuacuuagcaccgucaaugccguuuuccuuguugucguugaacaugguaacagucgacuagagguacuacucucaaauaauaugaagcuuuguggucaagaucaaauuuucacgauuuaagacuuaacaucaaacuaauuauaauuuacugacaaguggauuguauugauaaaguuuucuggguuacauugucuggaaccuauagguuuuuguagaaaaaaauugauauguaacuauuauuaugaacacucaggacuaacccaacauagcucaucuuuguguuguuauaucuuccaaaaguagcuucaacuugauuuuaaaaacccucaguuuaucauguaaagucauuguccuucacgugucccuaguaauaaggaucagauaaguucaccuuugugaaagagcauaggccaaugccugguacuaaguugaaggucaauaagcauccauucacuuauucaguacacauucauaauugcauuuguauguuauagaaguucagcaagauguguuguuuccccuccaaaaauaauugggggugggcuguagagaugucuccguaguuaagagcacuugcugagcuugguugguucccagcacccacaaggugacuuaacuguugacaauccuagaucuagaggauccagcacccucuucuaacagugcacauagauacaugcaggcaaaacacucauacacauaaaaaguaaaaauaaauaaauuuuaaaggaguuagcguuguuugaaugugacauaccgagugugacuggagaacucuucuccuugccagcacugcccacuucagcauccauaauaauaacagaaccagcacuagccuugcuagaaagaggagugaugaccacauagcagugaacaccgucauccccucugccucaggaagugcuccaaagcuuucaguguccgugguuauuacagcgccaugagcuuaguguucuuaugucuaacggaacuugaguaggccucggauuccucccagaagucugauccuguauguucagauguggucucuagggucucucgggaguggaugccagccuucugagcaacuguaaggguuggcaucgggaaagacuugaggguuccuuaugagagguuguuaaagguaaaacauaccacuggggggcugacuuucgugacagaagcucuggguuacauaggaaaauccucuuucuuaucucuuggcccacagagaaugagcaaaccugagugagaggaaagagaaccaggagagacagcaggaaggaguguaggcagggugggaucgugugaaauggaggagaggcugaaggagagaagagaucaguucaccuggucucaagcacucaggcaaggagccacucagaagccuucccuccuuagcuguguuuuuaagugauaacacuuaaacuaaaaguacuucuaaauuucauauauauuucccuucagaaauauauagugacacauccauauacauuaaaggcacuaauucauccuguacuauauuuauguauuauauuuuaucacugagauagugaaucaugauuauaaaaauggcauaaaauuaaaauauuuuccuaaguuuaaguggccauaacuuaaauugaguuaucacugacuagaucuaguagccagaugacauuuugguauuuuuauuuuuaaaccuaggaagaguugccuauaaagcauuuaguagcagaacaaagccuuccaaauugugaguuaaaacauauggagauacuaaauauacuuggauggggcauaaauguuuucucacacauaaauuguguucagcaagggaaggcuaucuuagacagcucacugacuauagcaaaaaaggggccacagcaaaauucgugaugauuacuuuguuaaaaauuuaaaaaauucuuauauauauuuuggcuuuuuauuugcguguaugucugugcauucuaugcauugcaaugccuacagaggcuagaagagagugucagguccauuggcugugagcagacauguggguacugagaaucaaacuccacuucucuguaaaaacagccggaacucuuaguaccacugagccauuucuucaguuaccauagucauuuuuuuguguacauugaugaguuaugaauaauuuuauuucacaaauuauaagccaaaagugagccauuguauucuugaagcuaccuucuuagaaaguggacuucuuacccaaggcagacagccccugccuuagauguuuaacauggaaugcuuccgacucucccaccaccugaguccaaucagcauucaauagaagcugugcuaacaaguguggggacagaggagagaugucugcaugagcuggcagcaugacccucucccuugguaugggcauuagagcgcucaguccuccaucagcaauugaucaccaggaagcacccugugcuguguauugcagcguacuguuuuuuuuuuuuuuaaauauuuuuuauuauguauuuuccucaauuacauuuccaaugcuaucccaaaagucccccauacccuccccaccacuccccuacccacccacucccacuuuuuggcccuggcguuccccuguacuggggcauauaaaguuuugcagcauacuguuaaggugugauucggagcaggcuaguuaugcaaacugcacuuuuggcuuaagaguguguguguguguguguguguguguguguguguguggugugcaugugucccucuuuaaguacagacuucagaaacauaaaggagucauuagcaaguguccucaaggacucaaagaaaauuaugauagauuaguugaagccaaugccuuuaagugaacuagaucuaggguucucauguauaaagauuuugcugguuguauggcaguaaacaaguauuuaagagcuuuguuauuguuuuacugauccagggucuuguguagcccuggcuauacagacucacuguguagcugaugguucccuaccaugucugaugggauugagguguuugccgccacaccaaggcuugacuccuuuggaauacuuaguuuuucacacuuguaaacugagacuaauaacaguaguuguuggacuagacaacaugauaauguagaaugcucgugagcacuucuguaugccaaggauauucccuuacauuugcagugaaaugcucuaccccgaaccauaccacauccuucaauguauauugacacggggaauuugaaguaggugaguuugagaaacaguagccuuauuauccccauaacaugcuagucaggagucaggguuuccuuugucccugaaaugcaacaauuucuuccccaugcucaccaccggaggacuguugaaccgaccccuuuggaguuuauguucuacaacaggagaugccggcaucguagucaaguagaggguggagccauuggaagagucguagaacagagucuuccaauggcuccagagugagcacaagacccaugaacacacagcagggcugaggcacggaagaacucagagagauuguggcacacguacagcucccucccucuaaggucucccauaucccuuuccuugcucucuuugaaaugaauggcuuuuuuuuuuuuugcuaauuguguuacaugccuaugcuuauguauuccuguauauaaccugcucagccuguauaauauuucuuguguguuuguuuucagggaugaccuuuugguaauaggauaaccaguuagugucaucucccugggaagacguuucucccacucucagugcucuuuaguugcuuggaguucuuuguguggggcugaggccucaugguuuucccccaucgaccuucauccucacucaugucauguguagacagccauguuaguaaaacuuucaguguguagccuuugacauuccuaggagcuacagucucacagcaaagucccagaucuucugacuuucacugucuuaucccugaaccuugcauguggguuagauauguguucacugggacuggugccacaauuuugagggguuuuguggguuugugauguuuuguauuuguugcaaaaagaagucucuugauggggaugagagcuacacuucucuguggcuauaaggauuaacuauccaaggcauguacaaguccauauaccagugaaacacucucuuccccucccccuccucccucaagaaugaaugcaaucaaggaaaugaaagacucuacaaugaaaacuuguuuuuauugccagugccauuuggaacauaccgugaauauuccuguauugucacucuacuuucuugauaauucuguagauucuuagucuuuuuaucuuccuagauaauucuguagaugucuuacuuuuucugauguguccacuaguccuggcacauagaccauauuguauuuuuuuuuuccuuugagagaaugauggaguuaaaaauaaucacagaaauaauuuuaaaaggccaugcugacauuuagaucugaggacugucccucuaggcuaaaaugucuugagaguagcucacacuuugguuucaacucugaccagauucuugcccucugugucggcuuaccucuugaucuuaaagcagugcucauucuugacuucaguaagcuguaaauuguccuuucaaauuaaaaaaaaaaaaaguguaggggaugagaaaguuaaacaagcaaaugaggcacuuccauugccuuaaaagcaacuggagcuuuccuucagggaaucccagcuagaacuauccgauacuuacaaagcacagagguugacacugacuggaagaagauugacuuauacguaauauccuuaagagucucuuucggauuacuuuuccuggaccagaggacaguggagucugaagaugugugcuaccuacuuaacaugggcuacccuacugagccagcauaacuguucguccaucugcuuccugggauuguagucaugacaagcacacugcuguucaucucuggacugaguugugcucucaguacuucuacugugaucacuaccgcugaccuuugagaaacgugacgucagcucuuucguucacuguguacuuucuuauauguaggauuucucucucauaccauucuagcccauucagucuaggucuagcaaguaugaauaagcauucucugcuaguacuucugauaacuaagcacuuuuuagcagauugauaauggguaccuuauagcaaguauuuauuucaagagcaauuaaguaaguggcuggcucauuucaguuugcgucucagccaccguuuagcgcuggacagccccaggcacccuguauguccuuggucuuucuagcacaauaguuuccuuccaaugguuagcagaguuuauuauuuccuuucuuccucuaucuuucaugucuuuauuuacugaaaauauuaacucaaguuucuuuuuuuauugaaaauauauuuuucauacaauauauuuaauacaguguaguucauaaaauaccagcuucuccaagaucuuccccaccuccccucccaucugaacccacagccucauccucuaguuagaaaacaaauaggcaucuaaauaauaauaauaaaaauaaaaugagauaaaacaaaaaaaauagaauagaacaaaacaagcagaaggaaaaaagccaaauaaaaaggcacaagaaacacaauagagauacagagacauacauauucacagauacagaaaucccguaacaacauaaaaccagaagccauaaaauauauguaaaaaaacuuauagguagucaggcaggcagagacacagauguggguccgguagagaagccugacuaaccauuaugagacauaccugcaaggaugcuguggccuuuguuuucugcugggcaugagaccuuuucuuaagaguaguuuaaguccccaaugagacucuguuggcgucaugugcacgugguuaauaauuguagauagcuucuguguucuccuuucuacucuggguccuucuggugcagaccugcucuggaccucugcguggagcacagucucucugaguucuuaccugccucagccccgauguguguagaagaccuguuuguuucuucaguguccuccacccucacagcccuuacaguuuucccacccucucuucugcaguuuccugagcccugagggucgggauuugaugcaggcaucucauuuagggcugagugcucuaaggucucucacucucugcacauugccuggcugugggucucuguguuucauccacuucagaaggaagcuucucugaugauggcugagcaaggucugugaguagagcagaguguugugaggagcacuuuucuuguuauguuucuuuuacagaacaauaguauuugguuucccuuaggucccuggcauaucuaggcucagguuguuggcucuccgagcagugucaaggauggguucccucucauggagugggccuuaaauucaauugcagaaccucacgaugcucucauuagaugcagaaaagccuugacaacauccaacaccccuucaggauaaagguauugaaggaacuagggauacaaguaucauaucuuaagugauuuacagcaaguccacagcuaaggccaaccuaacuggagagagaaaucaaaguauuucuacuaaaaucaggaauaagacaaaguuguccacucucugccuacguacucuacguagcacuuaaagucuuagcuagagcaguaagacaaccaaagagauuaaggucauagaaauaggaagggaaaaagguaacguaucuuuauuugaagacgcaugauuguaugaauaaguaacccuaaaauuuccacuaggaaacucccacagcugauaaacacuaccaccaaaguagcaggauacaaaaaucaguaacuuuccuacauacaaaugacacagacugagaaaauaauuauuacagaaaauaagaacaauaccuuuuauaguagcacauauauacuaggguuaauucuaaccaaccaagugaaagacuugugugauaaaaacuuuuaagacauuuaagaaaggaauugaagaagauaucagaaaaugcuuacaaaucagaaggauuaauauaauaaaaagcuauccugccaaaagcaaucuauagauucagugccguucucaucaaaaucccaacacaauucuucacagaucuugaaaggaaaaauuugagcuucagagggaaacacaaaaaacccaggauauccagaaagacccugaauaguaaaagaauugcuggaggaaucaccauaccugaucuccaacugcacuacaguucuguggugauuaaaaacagcaugguuuuggcacaaaagcaggcauauugcucaaugggauucaauugaagacccagaaaugagucuacacaccuacaggcaccuuauuuuugauaaauucaccaaguuuugugucuguguauagaacugcaaucucgacuaugaaaauugaaagcacagaaacacauaggcauuucuaugcccauauauuuaaggauuucuacuuuaaauagacuaaaaaagaaugucuccaguauguuauuauauagaugaaguaccagguacacaggacaacccggagauugggaaguauaauuagaaucagaauaagaacccuguuggaaucacaaaagcuagcaguacacagugagcacacauuucauacugauugacaaaguagaaaaagugagaaaguugccuuuguccugcuuauaagaaauagacaggcaggaguaggagguaggacauuggaagaagagcuucagugaaaagagaguagaaaagaaucauucuggaaauauuucuauuuguuuauuaaacugaucuuuuccuuauuacuagauuaguuucaucaaauauuuauuaauagauaaaaugauucaacauccuuaauuaaacuaauauuuacuagacccauugacuucuuaagauuuugauccagguaaaacugaaaguacuucaaaaccgacuuuauuauuuucauuggaaaugguugguuguggugagcacuaacuaccugggaguacagcuuacagauacuuacauacagagaguagagccaaccuugugugcaucagcagaugagcagauaaacugugugcacaugcgcaguggacuuuguuuagcagugagaaggaugagguaaugacuggaugugagcucauucuguuaaguaaaauaagccagacucagaaagacagaugcuggguguuuucugucugugguggugcgugcgugcgugcgugugcauguguguguucauguauauguuugugggucauaaaaccguaaaaggggucuugagaggagaggaaugcaugucaagggaugugguaaauagaguaauggaguauacauaaccagaaaauguaaagacuaacuaggagaagagggggaaccagcuggaggggcaugggaggggcaugggauagacagugagggagggagcaagugagaacaagguaaaguggcacauguauaugugaaaaugucaugacgaaaccuacuacuguaugcuaaccuaacacuuuccuaauugucauguuucaacuuuuauagcuucuuuuggcauuaugggaaauaauaguuugguuucauucuuccuaaagugaagagaaggaguaagaaccaguucccacugggcgugguggcgcacgccuuuaaucccagcacuugggagucagaggcagguggauuucuaaguucaaggacagcuuggucuacagagugaguuccaggacagccagggcuacacaggguuucaagaaaccccuucccagcauuuucaguggaaaggugaagcuuucuuucagugguuguugccuguaagugauuucagagaaaguagugagauaggcaagucuguuuucuauaguguguggccauccugacauuguagacuguaaccacacccacccccugaaagggugcugcccaaacuauaguucucaggaggccugaagucagaguugaugcuugcuuuuuuagguagcuuaaaauaucauaaaagaagagcguagcucuacuucagauaagcugcugguauuugcaacuucacugagcuaugccuccuaguaaaagaaauuuagucacuacuagcauuuauuuauaaaaaguacugccaauuagagaauaaguuuaaugcuggcauugugccugagaacuacaguuugggcagcaccagucaggauccuggccaaauguggcucuacuugguguuuauuucucaguggaguucugcaacuucaguuuucucaguugcccaccagauuuucaggagguacccucuaagcuuuagucuagacuugauuguuaccguuacaagaguugaguuaauagaauuugauuuuugguaauaaugcugauaaugccuuucugaagauucugguguggguaauuuauauauggaaaucuuaaaacaucuuuacuugaaauagucauuuuguauuuaucaauauacauaugcagccugcucaguucauaugucacuuguauguuuauguccaagaauuuuaaaagcacacuaauuuuaaaugucaacacaucuagacuuggauuccuagucaguucagaagccaaaaucuuauguuucugguuuguucguuugucuuuaaaauaaccgcauuaacuggcuugcucuuguacagucucguaagagaaccacagcuucuguguguucauuggaggggcucccgagggcugacacacucucugaagagcgauuggcaguugagggcugcaaggagauggagucuguuuuucuuagaccuguggccauuggaguuuccccaggccucagggaugacuucacauccaugugcauaugggcagccccguuuguguucaguguguuaaaugaagacaggaacuugagaaagacaugcgaugguggauguuggggggauuaaagggagccaggaggaguucccuuggauauggucaagauacauuguauacauguaugaaaauuuaagggaaagaguaaaaaauuuaaaagauagcuacauuaauacugccaccuuccauuagcucuuuuuuuugggggggguaguaaauauuuauucucaauccgggguuucauagaucaucuaguucccagauaaaagacacaaaaccuuuauauuaauaauaagcuauaaagcgcauggcaucuucucuguuuucuaccuucuucuccuuccccuccucagacccaaagcccaggacuggaaaacucaccuaccucuuucuuuaucucuuucuuuaucucuuucuuucuuucuuucuuucuuucuuucuuucuuucuuucuuucuuucuuucuuucucucucucucucucucucucucucucucucucucucucuuucuuucuuucuuucuuucuauuggauauuuucuuuauuuacauuucaaaugguaucaccuuucacucuuucccccuccaggaaaccccaucccauccucccaccccugcuucuuuaagggguugccccacccacccacccacuuccaccucccuacccucucauuccccuacccuggggcaucuaucaagccuucauaggaccaaggaccucuccucccacugaugccauugauaaagccauccucugcuacauaugcagcuaaagucaugggucccuccauguguauucuuugguugguguuuuagucccugggagcuguguguggagguaucuaguugguugguauuguuauucuuccuauggaguugcaaacccuuucagcuccuucaguccuucuaaguccuccauugggguuccugugcuugugaugguuggcuauaagcaucuguauugguaaggcucuagcagagccgcucaggagacauccauaucaggcuccugucagcaagcacuucuuggcaucacaaauagugacuggguuugguggcugcauaugggaugaauccccaggugaggcaaucucuggauggccuuucuuucaaucuuggcuccacucuuugucccuguauuuccuuuagacaugagcaauucuggguuaaaauuuugagacacaugcucuacuauguucauaacagcccuauuuauaauagucagaagcuggaaagaaccaagaugccccucaacagaggaauggauacagaaaauguggugcauuuacacaauggaguacuacucagcuauugaaaagacugaauuuaugaaauuccuuggcaaauggauggaccuggagggcaucauccugagugagguaacccaaucacaaaggaacucacacaauauguacucacugauaaguggauauuagcccagaaacuuaggauacccaagauauaagauacaauuugcuaaacgcgugaaacucuagaagaauaaagaccaaaguguggacacugugcccuucuuagaauugggaacaaaacacccauggaaggaguuacagagacaaaguuuggagcugugacaaaaggauggaccaucuagagacugcgauauccagggauccaucacauaaucagccuccaaacgcugacaccauugcauacacuagcaagauuuugcugaaaggacccagauagagcugucucuugugagacuaugccggggccuagcaaacacagaaguggaugcucacagucagcuauuggauggaucacagggcucccaauggaggagcuagagaaaguacccaaggagcuaaagggaucugcaacccuauagguggagcaacaguaugaacuaaccaguaccccggagcucuugacucuagcugcauauguaucaaaagauggccuagucggccaucacuggaaagagaggcccauuggacuugcaaacuuuauaugccccaguacaggggaaugccagggccaaaaaaaugggaauggguggguaggaaagugggcgggaggguaugggggacuuuugggauagcauuggaaauauaauggaggaaaauacguaauaaauaaauaaauaaaaauaaauaauauucuuaggguucaaugaacacuaaauaguuaugcaaaacuuugagacagcaguauccagaaucaaaacgauacagcacuuuuauaguguacccauacauuucacaaagccaaaguaugguacuauaguuaaagacaguaacuggaagaaggccaugggucagccuagcauaaugaauaagaagcaggagaaagugugagaaaacgucccauucucucugagauugucuuuaguaaaugcuauauauguauacauauacauauauauauacauaauauuuaugaauuuggacaaugaaucuuaucucaauuugaggaugaaguuaauaaauaauagaaaucauuagaagaauuuacaucuaaauuuugagaagcgugggugaccccauuucucaaccuggggucauguuuaaccuguggauauuucucuacagguucucucucaccuuuguuggguauuucagauaaugucauccccuuuggguccugggagccucuugcuuuccuggagucuggaacuuucuguuggcuaucccuguucccccuccccauugcuacauaccucuguucaguuucuugacccucuuuccaucuccucugucuccucacaaaccugccccugcccccuuuuuccucuccccauccucucuuccucccaaguuccuuccacccucuaccucccauaaguauuuuguucugccuucuaaguaggacugaaaccucuauacuuuggucuucuuucuucuuguguuucauauagucuguaaguuguaucauuggguauccaaguuuuuuuuuuuucaaauauccauuuaucaguggauauauaugauguguguucuuuugugauucuauuaccucacucagguugauauuuucuaguuccaugccugugaauuucaugaagucauuauuuuuaaugccugaguaguauuccauuguguaaauguaccuaccucuuuucugucaagcucuaagcugcuggcaccuuuauucaucccagcauuuuaaauuaaggagcaaguucacauagcauuacuugguguaagugcagauucucucaucccugaggaaaccagugacaguauuuaacauuacagcacacagcaacagagcaaaccccaacaguuccuaguagcucuuaguaacuucuauuuuagaaaucacaauuuagcuuagugauauuuauuuauuuauuuauuuauuaauuuauuuauuuauucauucauucauucauucaugucauaguuuuggggaguugaacucagggcuucacacaugagaggaagauacaguugucacuaaggaaagcaucccacucuaauuuucuuccuguaaucucagcacuugggaggcagaggcaggcggauuucugaguucaaggccagccuggucuacagagugaguuccaggacagccaggacugcacagagaaacccugucuugaaaaacaaaaacaaaaacaaguuguugcuguuguuaucugugugcaugugcaagugugggugugcaucacgcaugaggagcucagaggacagcuugugggaguuggugcguguguauuuugaacuuaggucaucaguuuuuguguaaugugcuuuuuuuuuucuuuuucuuuuucuuuuuucuuuuuuuuuuuuuuugcuacuuagucaccugccauauuucuuuuaauucuuacuuuguccauuuauguggaacauguuuuaaaauauucuauaauuuguuaucaucuuauguaguguugggaugugaacuaacucugaauauuucaaaaggauagcucguguucacauucuaaaccaucauaugggagauggaugugugaugggaggaauccauuguauucuuuaucuauggucaaaggcugagggacggggcucugcugucuugaauauguuaagucuaauguuaaaauaauuuaaauaggcaugcaaagcauuuuacuuccaaauuaaagggcagauuacuucaggaugugcaaugaguaccauaaaaauggagaaugugcgugucuugucagcucuguagcuccagccccaagcccuuccugaaaaaucuucauuccaucacuuucagcuuggccaguuuccucccacucuaugccuaaguuccuuaccuaucccucuaccuuuaggaagucacuccaccauaaagagugaugccaucacuuaaaaacccaguaggauuuauuccuguauugacuuaaacuacauaaugaaaauuuugcauuuuaaaauaaaaauuuaugcaccccccccacacacacacucacagagagagagagagagagagagagaggagagagagagagagagcacacaagagaacuucugugaugucagucucuuggcagcucaacugugagaagugucuauaaaauaaaacaucagauuaaccauuuugguaaucuggaauuacuggacaaaacuggaaauuuggaaauuuucuuuggcuuuguauaacacaccacugugggcuggagugcggcuuggggcuagcacacucucuagcauguucacaguccuagguucagugcuguguaccagcuccacuccugugcaccagaauaaccaauccauaaacguaagacaguggaauaccuccuauuuucugcaguuuguuagucaugggauuuuuuugagucaugccuagaauaaauaugccuuuuuuuauuaaaggaaaaaguaaugcaaucuuguuucauuuauaaaaacaaucaugugaagcaauaauuugcuauuauuaguauuauuaucaucaucaucauaccuguuuuuuaauaaaauggugcuugggaaucaaacucaggaguuccucuauacuaggcaagcucaaguuuuaaacauuuauugcuuuuaaauucaauugguuccauuaaacuuuugcuaugggacauuagggccagcaagcugucucaucggguaaggacacuugcuguggagccugacaaccugugcuguguccuuggaauccacaugguggagggaaagagccaacuucugcaggguguccccugaucucaaaagugugcccuugccuguauccuguacuuucccaaaugaguagauuuuucuuuuaacuuuaaaaagacauuaauguacauuuuuaguaggagcauugcguugacucugcaugguguuugaaaugacccuagaaagcaucugagacuuaacacugaguuuucauugguaaggucuuuucaaaaaguauaguuucuugucuaacuuuauaaacgucaaauuagaagggaaaacacuuuaagauguacugugcauuuacauuagaagacagccauguaggaaaagaugucuggacuacaauguacaagagagaagaaagagucaagaucucaaccaauggcuuaggcaaagguacaaaguggagggguggcuguucuaacagaaaaugcauucagguugccagacuagcaaaggguuuaucuaucuuguugauuuucucaaagaaccagcuccuggucuuguugauucuuuguguaguucuuuuuguuucuguuugguugacuucagccccgagugugacuauuuccugccgucuacuccucuuggguguauuugcuucuuucuguucuagagcucucaggugugcugucaagcugcuagugugugcucucuccgguuucucuuuggaggcacucagcuaugaguuuuccucuuaggacugcuuuccuugugucccauaaguuuggguauguugugccuucauuuucguuaaauucuaaaaagucuuuaauuucuuuuuuuuauuuuguccuugaccaaguuaucaucgacuagagcauuguucagcuuccauguguaugugggcuuucuguuguuuuuguuguuauugaagaccaaccucagucauggugaucugauaggaugcaugagauuauaucaaucuucuuguaucuguugaggcuuguuuugugaccgauuauauggucaggcuuggagaagguaccaugaggugcugagaagaagguauauucuuuuguuuuaggaugaaauguucuauagauauuuguuaaauacauuugguccauaacuucucuuaguuucaaugugucucuguuuaguuucuguuucuauuggucagugggguguugaaaucucccacuauuauuguguaaguugugaugugugcuuugagcuuuaguaaaguuucuuuuaugaaugugggugcccuugcauuuggagcauagauguucagaauugagaguucaucuugauagauuuuuccuuugaccaguaugaaguguccuuccuuaucuuuuuugauacccuuugguugaaaguugauuuuuuucgauauuagaaugguuacuccagcuuguuucuugggaccauuugcuuggaaaauuguuuuccagccuuuuacucugaaguaguaucugucuuugacacugagguacguuucuuguaugcagcaaaauguugaguucucuuuauguauccagucuguuagucuaugucuuuuuauuggggaaauugaguccauugaugcuaagagauauuaaagaaaagugauuguagcuuccugcuauuuuuguuguuagagguggaaugauguuuguguggcugucuucuuuuggcauggacuggagugagauugaaauuugagaauuauguacaucaugaauaauugaaaucgccccucugucuuucuguguuuaugugcacauaugugccuccuuguauagcuguguuuguuugugugugcaugugccucauuguauagcucuggcugcccuugaacuugguacagucauccugcuucugcucccgagcugugagauugcacuguacccagcuuccuaccuaaggaagaaaggaaacuggucuuccuaacucccuguacgucauccacccauccuuucuucaucccuuaaacccuuccuugaaacagcaacacuuuuugaacagauguucuuuuauuuuauagggucaaagugcuaaaggaguuaaccagcuguuugccaauagauuuggaagugggaggaggggcccuuuaucucuggauagcuuccucuucugcagauucagaaagccugcugcuaaacauugcuugagaguuagaagcuaagaauagccuacccgaguagacccaggacaagagaguuaucagaauccaaguccccuagcagucaaugcagucgucccaacugccaugucaaagcccuuguaaucugacugcuuaaucuuccugcuuuacauucuaugcucuguguccuacccaaggacuguuucuaaucaugcagugugauucccaccauagaccucugacuugguacuucccucaauuucagcagcuccucccacauuuaugagcagcuacuuuccuucaaggccuaaugagaguggugucugugucuugggaagaagugaugguucuuucuuuaauuucccuaaacauuuuccaucaguguuagguaacagauuacacaucagaauuaaacuggauagauuuaaguuuuuaauuaauugcaucuaauuaacuauacaaccuauuuuuuuucacuugugaaauggggguauaugaauuuaaaauaaaauauuguaaggguucaagcuggaaauguacuuguaagaauaaauauugucuuaugguuacuauuguauauugugauuugauucuccacauuugugugcaguuggucaucuuuguaagguagagugaucaagaaugcuuucauagucccuuggguuucuauucaucuggcauagugccucacucauaggcggauucacugcuuguaugguaguguagcugaguaggcacuuagguguuauagaggagcaacagccacugucuuaucccaaguuuaaagggauaccuuuuaauuguaucuccuuuaagaugacugccugauuucccaggacacccuuucaugacaguugccauggcuuagcacaauuuaauuguguuauauagaguucucaaugcacuuguauaauguguuuauucaagagaugaguuucaacccggagucagucuagaagccagguagaccauagacaggaagccuacucuaguuaauguguuucuguuucggugagucacuuuguuuaaaaaguuaauauggauaaguuucaaaucauccaaauagguuaauguggcuauagauugguauuuauguugaagauuuauguuuagguucaugugucuucauuacugcacaaagcauuauaaccacuguuuuuaaaaggcucauauucauaguagguaccuuuuaaguugaagcucaaguauuuaguccuaauuuucuaggcccagauaauugugaaaagagcucuaauagcaggcuucuaaacaauuacuuauugugucuaaauccucuguucuuucuauuccuugucaaagaaaaaagcauauuggauauauauauauauccaauaugcaugcacacacacauacacacacacauacacacauacauauauauguacauaaguacaauuaaugaaaaaggaggccaugaauuugaacaauagugggaagggguacaugggagggcuugaagggaggaaaggagagggagaaauguugugguuaugcuauaaucucaaaaauuaaagaaaaaagaaagagaucuacuauuaccuuugccuacagugcauuucccccuuuucuguacauaaucacuugugugcagucauugugguuauuugacuaagaauggccccuacaggcucauauacuccagugcuugcucagcagggaguagaaugauuugaaaggauuaaaagauggagccuuguuggaagaagugugucauuggggaaugggcuuggaagauucagaagccagugccuuaccgcucuuugccuauggaucaugaaguagcucugaguuccagcuccagugccugccugccugcugcuuauggacuaaaccucugaaacuguaagcaagccuccagucaaaugauuuguaagagcugacuuggucauaguaucucuucucagccguagaacagugacuaagacacuaaguauucaucagacacugcuuacaggcugccaccuuuguaaaacaaacaagcaaacacucgccccuugagcagaauuaggccccuucuuccuuugcuuacuaggcaguggugugaaccccugguugucaugcaacucccuuguggauucuguaaaauaggugcccucuuuagcccugacuucggaagugcuuagguacuccacauguguguuuauuuggguugaacacaggauaaucauauuuaagaaguuucucuccucucucuccuuuuuauuuuugagaucauuauauaauuguaacauuuuucccuugccuuuacucccuucaacagucuuccauauacccuucccaaguuuacuucaaauuuguggccucuucuuugauugucgcugcaugcauauaugaauauuuauguugguauguauuccugaauauucccugcuccgcccauauguuaccuguauguauguuuccaggaccauuuggugcugagcaacaggcacugcgcucuucccaggggaagaccaccuccacugcucccagauugccacaguugccuauaguucuuuguaagggugaaguguuuuguagauguguccaauugagcuagccggcacaacuaggcauucucauuggcugugguuuucuguaagaaguuuuuaaaacaguugaaaaauauuauuaaaagacuuagaaaaauaauauaaaguuuauuuuuucuuuaaaagcagacauuaggauuuugucuccuucuuaugaaaccaaauaaguucauuucaaaucaauuucuuuuccgaauuuuuuuuuguauuuuacuguaugaguauggguauuuugcuuacauauuauguauaugcuacauguuugccugaugccacagaagccagaaaagggagucaggccuccuggaacgggaguuagccaccaugugggugcuaggaagugaaccuggguucucugcaagaaugcccagugcuuggaacugcugagccaucucuccagauucgcaaaucauuaaaaaaaaaaaaaaaaaaaaaaccagugaaguuagaacugcuuuucagcaaguaaauuaacacaaugcuuagaauaaacaacauauugcuauucuaauuuuuaguucuuauagggacauuuucuuuuuuuauucuauuuauuuauuuuuuauuagauauuuucuuuauauacauuucaaaugcuaucccgaaaguucccuauacuccccucuccgcccugcuccccuacccacccacucccgcuucuuggcccuggcguuccccuguacuggggcauauaaaguuugcaagaccaccucuucccagugauggccaacuaggccaucuucugcuacauaugcagcuagagauaugagcucuggggguacugguuaguucauauuguuguuccaccuauaggguugcagaccucuucagcucuuugggugcuuucucuagcuucuccauugggggcccuguguuccaucuuauagauggcugugagcauccacuucuguauuugccaggcacuggcauagccccaugagacagcuauaacagggucccuucagcaaaaucuuucuggcauaugcaauagugucuggguuugguagcugauuauaggauggauccccaggugggguauucucuggauaguccauccuuucgucuuagcuccaaacuuugucuauguaacuccuuucauggguauuuuguucccuauucuaaggagaaaugaaguauccacccauuggucuucccucuucuugauuuucuuguguuuugcaaauuguaucuuggguguucuguuucugggcuaauauccacuuaccagugagaacauaucauuugaguucuuuugugauuggguuaccucacuaaggaugauagccuccagauacauccauuuguccaagaauuucauaaauucauuguuuuuaauagcugaguaguacuccauuguguaaauguaccauauuuucuguauccauucuucuguugagggacaucuggguucuuuccagcuucuggcuauuauaaauaaggcugcuaugaacauaguggagcauguguccuuauuaccaguuggaacaucuucuggguauauaugcccaggagagguauugcuagaucuucugguaguacuauguccaauuuuaugaggaaccuccagacugacuuccagagugguuguacaggcuugcaaucccaccagcaauggaggaguguucuuucuccacauccucuccagcaugugcugucaccugaauuuuuuaucuuagccauucugacuggugugagguggaaucucaggguuguuuugauuugcauuucccugaugauuaaggaugcugaacauuuuuuucaggugcuucucagccauuugguauuccucaguugagaauucuuuguuuagcucugaaccccauuuuuuaaugggguuauuugaauuucuggaguucagcuucuugagcucuuuguauauauuagauauucgcccccuaucagauuuaggauugguaaaaauccuuucccgaucuguugguggccuuuuugucuuauugauggugucuuuugccuuacagaagcuuugcaguuuuaugaggucccauuugucaauuuuugaucuuauagcacaagccauugcuguucuguuuaggaauuuuuuccccugugcccauaucuucgaggcuuuucccuacucucuccucuauuaauuucagugucucuggucuuauguguaggucuuugauccacuuagacuugagcuuugaacaaggagauaagaauggaucuauucgcauucuucuacaugauaaccgccaguugugccagcaucauuuguugaaaaugcugucuuuuuuccacuggaugguuuuagcucccuugucaaaggucaagugaccauagguguguggauucauuucugggucuucaauucuauuccauugaucuaccugucugucgcuauaccaguaccaugcaguuuuuaucacaauugcucuguaguacagcuuuaggucaggcauggugauuccaccagagguucuuuuaucguugagaagaguuuuugcuauccuagguuuuucauuuuuccagaugcauuugcaauagggacauuuucuauagcaagcuguacauuuaaaaaacgggggguauaacguuuuaauagaaguacuagauugaaauuguauuacacugaucacaucuuugacuuuuggggcaaaauugcucuuuuaauacuuuuaacucuggaacaauuucuagagacaagaaaaagaugauuugacuucuuuuuuuuuuucuuuuuuuucuuuuuauuuuuuaugauuugacuucuacauuauacuuuuaaagcaguacuuauuuuucuguuuuauucugaaacucuauuuuguguguguguguguguguguguguguguguguguguguuucuccugugcucugacuguaagccaaacuugagaaacccuugguuuucagguuaauccuauuccagacuucuaaauacauguuucuuuucauccuccucaucuuggcagccucucuuuuuuuucuuauucagcacacucugucaugaugaauguccauuuccccaagcuuugcuggacucuccugugcaccucauugccgcuggccuuccauugucuguggcaggcuguauuuguuggauccccuuuacaaguuaaccagaguugacuguacccaagccucugacuggauuuuuuuucuuuuuaauuugaugaaaucaauagugcucuauccuuacuucuccagggcucagacucacgcccuccccuggcccacagugggcaucucugacuuauuuccuugcaaucagucucccuucacuccgcuugcuuuucuuaacgacaacaaugugaucuuuuacgauacugauaugaucacauggucugucagcaucacccacagugaaaauccaagcucugugcaaagacaaaugagguccuggaugaugagagcccuacagcuuugucuguuuccacagcacuguggagucccacccacaugcccaaagaacugggcugugucacacaucagaaucuuugauauuuuugaucuucaaguguagcaguauuuucuguacucguauaguuuaauguuucaaagaccaugacuaagcauccuuaucaggcuuagccuggcuuuucuuuccugccuucacaagucagcuccguuauacugcaguggugaaguguccgucaaauguugaucuuacuauagcuugugcagacugcuguuauuuaauguacaguuuauucuaaacuuauuauuugauaugcaguuuauugucaguauuuuuuaaagcuccuuguuaguaaggagccaucuugcccaucuugcuaccugucauaccuggcaugccuuacgaaucuaaggacuacacaaguguuugugcaaugggcgacuuccaccaaauguuguuugguacuccacuuaguggccuuaguauuauagcuuaaaauccaaauaauacguuuuggauuauaugucucuaacagugacaaccugaaagcugguugcuugguucugguuuucagcagggaagauguuguagcuaguaacuuagugagcuagucccucugaauauuuaggucuuuccuucauuuugugguaguguccaggaucagcccauccaugcauuucuuuucuguucaaguuguaauaaauuagagaaagucuucugugaauuuacaaacuuucccaccagcuuuuaaccacugcucucccuuuaaucucuaguuugcagagaccucuaaacugcagaucccucucuuuauuucugugcucauagccuguacguuuuccuucccauucaucuaugguuucagccaucuugauggucuccugucuuuacugaguucagauuuauuuuuuguucuugguuagacuucuuuagagcuuauuuucagcuagcauccauuuugcaccuguaacugauaacacucuucuccgugucuagaacacagucccugaggauaaacaucauuggacacugguguuguuuauguuaaaggagccaaucuuccccaggcaucugcugcacaggcucaaaaaaaguuguuccagcuauuggcugccgggggaacagaggguugucacaaaacaaacagcccccaacauccucaagaggcauugacuucauaccgcuggaaagucagaaucagggaagggcuguacagugcugauuggcugcuggcuugauucccugucuccccauuucgggaguagacuuuuuuuuuuuuuucuguaggaaccagaccagaguuuagaagggcacacuuaagcuuuacuuagugaugguaagcaugcagauuugaaauuucucuggucccuggcagguuguuugguagcguaguuggauugcguucucuuuggaagcguggucuuuugacugacuuugauaagguugacucccaggaaaccccagcauccuccuuucccuggcgccacugggccggccacccgccuucucucuuccuucucccgcccccacuucuccaccaccucacuaucccucacuugaacugacugccagaguucacagacagcugggcagagaguggcuaagucgcccagcugcccgggaagcuuggcggccaggcugagggaaggaagcgucggcucucuuugaaggucggcugccagugaaucucaggcagcuggacuucaaagggggcaccgacgggcuuucccuccugucuaggcaggucauuccauggcacugugcuuccggcguuggcauggcgguuuccaaguuccccuucaauuaaagagcugaaucgggagucacccuuguguucacauuuguaucugugacacucuaaguucccaccccaaacugaagagcuacaggagaaacaauaauauuccacacagugggauuuucuuauugucagccccuguuuucuguucuuugccaaauuuuaaguuacuuuagagacuuuccauaugaucuugaauaaauucuggucacugcuugcuuauguaccaaauuuacauagaccugugagggguacuuuaauugguuucuagaaaggggugcagugcucacugggccacacuuuguucuuauugcaucucucuaccucucaccuaccaauucuccuggguguucugagagagaaagagccuaggaagagaccaguaggaugcugcugagaacaguccagauccacauuagugucaggaggagccgacccaggacagcuaguccuaccuuauuaugcaucccauucucuccuuggcagcuggcaaugagagcaccugcagcacugaugaggaaaugcaaugggugaacaggcuuaauagacacagcguguagcucacaguaaugcuagcugcugauagcuucuauagcuaugucuguguguguuguucuuguuuguuuuauugccccuguuuagacaagagacggguaguaucugccuuagaccaaugaguguguaauaguguaaagugauguauuacauaguuggaggaacaguuacuccguguuaccagucucaagcuacacugcugguccuggggcuguaaggugacuggauucacugagcgcuauuauuauugugcugucccaugcauacucaaagaaggaacaugacaguuuuucaaaaaguagauauuugagugaguagccuuucuccuggagccagaggcaaguauuugacuuuuugcucugacaguuucuugucauguauauauggguaaguuuucuuguuggccaaaugagauaauuauguguaguucagagaggaggaaauuagcgaauauaguguagcugucccaaguagcaacauauuagauaaauguagcuacuguuauuaucaucauccuuuguguuauuauugucaccaccaguauaacaaguuaagaguauuucuaaauuacaagggauaccuuccuuugggcuaacagugaucucguaagcauaggacuuuccuuaaacauuauauauguuuucuaauccacaaaucagcuaguuuggggccgaaucuaguuugccaucuccuuguguggaugcuguuuugugggcuuuuguuuauugacacacauuuguauccauuuguccacguacugugucugucugugguacucagcagaaguaaguccuuguaacaggaucuguaaaguucucaaagucuaaaauaguuacuguuugaucuauccuuuccaggcaaguccaccaagccuugcucaagacgcauguuucccacuuaaggaccagagaguacuaguucaguccaugcugguguauguuaucugaaaaaauaguuccguagucaaacuuaggggaauguuagagagguugauuuauuccaggacgguuacuuaaaagacucuggcuuuuaauauacugaugugcauugugaaucuucaagaugaggccaugguaugcaaauaaacucuaguuucccaggcuugcuuggccauggcccuccaauacgaugauguuacacacagcauucauucucugggaaacccuguucuuggacugucucugggaggauuaaaucauuccucuuagugauuuaagugauagccucauuuggagaccuguacaagauucuggaauucuguauugguuaccccauuuuucuaaucaaaauuguauuugcuuaaaaucagaacaguuaaacauacaugucacauauucaaucuaaucagacauuauccccaacucaaaugauucuuaugauaucucaugauuaugagccagaaucucaaaguccaagacaagcuguuucuucacuucaugccuucuugaaaauguaaaaguacaaacccuuugugaguuuuuuuuacccacccacacuucuaaagcauaaaucuagagcaccuaacugguauaacaacugaucucagcuaggguuuauaagagaggagauuaaugugaagguagcuuuugcccuagccuuaaggggcuuguuuuauagacuaaaguaaacaccuugaauuucaauuugcaagcacgcagggagccagaagauuccagagcacuggcgucauauucugccugugacucacauagcucaguggcugagcguucuccgcagcugcaguuuccagcuggccaccagauagaacccuagguagucauacacugcagucacguggucugagaugaccaaacaggcauaucauugcgacauagccuguuugugaaugaaagcuggacuguccuuuugccaaacccagauagaaaacaaaugcucgaucgcacugguugcuguggggcuguggugguugcagcagugacccugcacuaaguuagagcucugcugggaggugcaguccugcucguaaguauguccuccuucucucugggugaguuccucaccaguagcucaagaucaguacuuaagcauucugucacacuccagaccugauggacuuaaaacuaggaaaugcuucguagaaugguggccaaacauguguucgccuucccaaugguucaucaggucaagaagaucucaugucuuaccuuuaguucuuugcuauauguaugaaggaaucucuguaaauguuauugcauuguaaauguagguccugaauuuuucauugauucauuucacgguuuaaggaaugauaaguggacuguucgguguccuccauuguuggcuacugucauuugauggacagcauguagcacuuauccaugugugcuggaauccaaaguucuguccucaugcuucaaccgcaaucacuuaacccccgugucaucucugcaucaccaugacugucuuuuaucucuaaaucauuucuuuaaaagaaaggaaagaaaaagggagucaugaaugguaggaggaaauguuugaucucuaauguucauucucaauuugauuggauuaagaaauuaauuagugaggcacauuuuggggugucucagagggcaggccuuuccagauaggaugaauugagugacagagacagaauaugagcaucagacugaaugaaagggcuaaaaaggauaaaaccaguuggccugccuuuuauggucaucccaaaugugaggaagcuccuagugccacccguguggcgugccacaucugcgagcuguuccugcugccgugagcuuccuugccaugaugggcuguaaccucaaguuaugagccaaggcaaauccucccuugccuaaguggcuucuuguuaagacauuuugucacagcaauagguaacuaaaagagaaaggaaaauagacaggaaaaacaucaaaaaggaaacgucagaaauaugaggcaaagucuaccuagcaccauaaagaaaagcacuguauggugaauccuucuaugucuucagaugaggugucuccaggcaaucucuucucucacuguuuaaucauccauauuacauuauguuaaccugauauuaggaaauguauaaaagaaaugacuauaaucacuggaaauaaacuacaacaucuagagauaaugguuaucugaagcuaacaauagccagaguuaacaaacauugcuagagugaauucuuacucccauagguaggcacaaaaugggcaaaagacaggugccaugaccauuuuaaguacgaggcacacugaaguacaguuacguugaaccgaagggaaacaggaccaguuuaugaugaauaugguuuggcagaauguugaauucugagaaaauuguauggcaccagacaauacuugucugggccagcacagcugauuucuuccaggcuggguuuuggcucugugguuagcuagauguuaaaucagagcuacggaguuuaggauggcucacucaucuugaccccugacccacaugccucuugauaguaaggcaguuguucucaaccuuccuaaugcugcgccucuuuaauacaguucuucauguuguugugauuccccaaucaugaaacuauuucauugcuacuucauaacuuuaauuuugcuacuguuaugaaucaugauguaaauauuugauaugugggauaucugauauguggccccugugaaaggauccuucaaccccaaaggggucaaaacacacagguugagaaccauugcuuuaagaagcuagcugggagcaugucucugaucagcuaggaagguagcggauguuuucucacccacugacugaguuucaaaagcaguaaggccgugcaugcuuucacuaaccucugcuuggcuugcucccuaaugucuguauguauuaugauucuuugggaagcagaugccagugcaggguuagacaguuaagaaaucuauuuccaaaaugccaaugaaggaaaaugggaaaggagccagacgaggcugauagucuucaaguacagauggugacccaggcccuuaggaaagaaggaaggagcgaaagcgucucugggcucaauauagaggucccaacccaaaccuaaaacaaagagcuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguagaucucccaugcucauggauuggcaggaccaacauuguaaaaauggcuaucuugccaaaagcagucuacagauucaaugcaauccccauuaaaauuccaacucaauucuucaaggaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauuaaaaaaaaaaaaaaaaaagaucuuauuucuaaaaaaaaaaaaaaaaaaaaaaaauaaaacaaagagcuguuuaucuaguccugcaucccagcucccuugacuaagcaucucccaaauccagagucaagauaugccaugaccccugccaguagcugcuagccaacagcucuuuuaguuucucccuuauuagacccaacacuucaccagcugacaaauacugagauuuaauccuaccuauugauuuagcagccaagauaggaggcaggggcagauccuaaucagaaauauuugcugucuuauugggggaugacauuugcagcgucuucuaggacacaaaacauucuugaucuuccuagacaugagucuuuaagcagagagcucccggaguuugggggcaggguaucuauagcuuucuaugagauagcaagccaaauauccaguuaugugucagggucccagacuuucccagcuagagcccugaccagagaacagcagauuaucuggagagcuaaauguguauacugcucagcucgcucugcugcugaaagaggagcccucuuugaaaguugcugaagcaguccugugguuuccucucucacuuugucuuuucagagugucagugaaacugagcacuaaccaaccaauacuguugucuuguagacaggguuucuuccuguugcuuugcauguaugaggacagucauuucaugcaauucacuucuggugacauuucuaccaguuggggcacuacugagcacccuaggagaauggaaguaauuguuugcucacaauuacacuugaaaauagauuccagugagaagagauuugcuacuuacuaagggucuuagaaagagggacaugucaguaagcucgcuucgugagcuaaccuagcgcuugcuuccucuuacucucagaaucuacaucuaggcagcauaauugagcuucaccaucuuuuuaggaaguaguaucugcuuuaguuuucuuaagcuuguggcucugacaccaggaagggagcuagcuaguagauucagagugacuugaucucuuaaugaguuggggugaaugguggaaaggcauagguguguaucugaaaggucaguaaacugguaagguucacacuugaggcuagaaacccugcucuagaaccaguauuugcuaauaauuuuccccauuuucauuuaucuaauuuauuuagauuucucuacuuaaagcauuugauuccauccuccuauuuauuuucagcauuucgagagcuuuuuguccuuugaauuuuugguuuuguuuauucuguuuuguuuuucaaacagggucucacuccacuaaugaggccucagccucccaaauaguggggggagaacccuagaagcuacuggauggaaacucucucauucuugaugccaccaugauugagacguucagacgcugauguguuuaagacucugucagugacacuguagacacaaugccuaggauaugcuaagcaucgugugagacuuacuauccucaccauugcuaccaccaccaccacccaccacccaccauccaccauccaccauccaccaaaugggcacauuagcuaguccaagggccacagcugugugcacugugucuggaauauacuaagaauaaaaugggcauuuuguauuaaauaaguaauaugguuguuugauauuuuauuuaaauaucucucagguaagguggggaaugaucucaauaccuucaaaagcauaauacaaaaaaauuguuauuuccuguugcuuuaaaaaaaaugcuuccugcuaagacuuaucucuguuaaagcaaguaaaauuuguuagagccuuucaguuuuuuuaaaggagcaaaacuauaaucagaugaaauuaguguuuuaucuaauauguauaaaauuuccugaaugauaaaauaaaauguucuuugcacaaaauuagucuugccugaauauaaaaaagauaacacuuugcuuguguuuccucacagguucacccuaaauuccacuacaagcaggcucacgacccuggcacagacacgucuuguguggcuuuuuccuaugaugguaauguccuugccucucguggagguagguaaccagcucuugcuauguguuccuguauauaagaagauaauuuuaacucuuaacaaaugucacacuaaugucccaaggcuuagugggacuguguuuuuguuaauguaccuuugucagucugaugaugaugaugaaaacguguuuucaacuuggcagcauugucugcauccauaguugcuaauuggacuugcaagauggcucagcaauuaaagugcuugcugucaagcuuguuaaccaaggucauucuguucuuagagcuugugugauggaaggugaauacaacuccacauuguuguucuuugacuuucacaugcaagcuuaugcuuguucuuguacauacaugcaauaaauaaagaagugcauauauaaagaaacaauauaaaaaauuaccagucaaaauuuauaaauuauguuuuuucauuuaggguuuuguuuuguuuuguuuuucgagacaggguuucucuguguagcccuagcuguccuggaacucacucuguagaucaggcuggccuugaacucagaaauccgccugccucugccuccugagugcugggauuaagugugccaccaugcccagcucuuuuuuuuuuuuuuuuuuuuuuuuuugcaucaaauuuaauaggacuuuggucuuugugucuggcuuuugcuuuggucuuuggucgucuuuuguaaaugaucauccacauuuguuuuacucucuggguaugcauucuuggcaagcacucuaccacugagucacgucuguaaaccauggugucaguuagcucaggugggaacucaauugacuagccucaaacucucaauuccccuguuuccuucggaugcugguugcuacacaaauguauauccaccugcccagcuaugugcuuuuauuuguucucuccuacucuaucauuccaugccugguauuucaaauccucuguucguuggccauugguaugcgccccacuucugaguuuaaacacuaguacaguuuaguauuguaggcagacuuucuaguaucuaacugcuaugcuuuguucuauauuauuggauuaucagcuuauaucuacucaucugguugcauguugguuguuccugguauuugccauauccaguucacauggguaagacaguguguuagcagaggggaugaagaacaaugggggcagcccaagaacucacuugugacaauacggugacauuccaaaggugaauuuuaggaaguucuuagaguacaaaguugugaauucaacaaguuacagauuagucccugcccaaagccagguuucagaggaagagucccuggggacagaggcguuuauuaacucuccacucucaacuacagcugauccuauuccuuauuggacccaaagggcugaggccagucguaggcuaugggcauugggacaaaggacagcaaagacauugagcuuggcucuuguucuagucagggguuugugaguagcucuauagaaauauaaaaacaguauucuuagaagaauauucauuacucuuuaaguagcaugggaaguuguacuuucccagcaaaaugaagaguaauagccagggcgggauuacucugaggggcaaggaccaccauggccuagaucaguagugucgauggagcauuccacccgcgugcuaauggaaaauaaucugugcugagcugaacuauucucaguccugcuggcucugaaauuaaggccuccgcaggaagcagguuauacacgcauagcaccgggagccgccaucugcuccaaugcagugcauuggugugcauucuccagacuugccggcagaugcuaaucaauccggaaaguaauugcugggaggauaacucaccgucauauaauuuuauacuauuuuuugcaacucccuaaacaauuaaaaggggaaauauacuuaggugcaugggguuuucccuccuucccccucuccauuuuucuuuacuuuuuuccauauucccuucuguauaguuauauacuauugggcaaacuuuaagcuggcccgagaucuuuuguacaaaauucacuuguccuuuuuucucuuuuauucucaauuaggcgaugauacauuaaaauuaugggauguccggcaauuuaauaagccauuauuuucagccucagaccuuccuaccuuguucccaauguaaguuauauuaucuuuucuaaguuguuaaugugucuguguguaaauguuuugucuguucaccacaugugugccugagaccugaggaggccagaggagggcauuagauccccugggacucgaguuacagaugguugugagcuguccuauggguacuaagaauugaacuuggguccucugcaagagcagccagugcuuuuaaacauugaaucaucucuccagccccucaaguagcauauuuguuauuuaguuaacauaagagaauggaaaagcaguugcuuuaguguuaccuugcaucgagcauuuuaaguuuucuagggaagggacuugagaaguguuugguuuuuuuguuuguuuguuuauugguuuuuuuuuaaauuuuguguauuuguuuugggggcaaaugauguugauuuguccaugauguuguguguauauuuguuauguaaacacgagguccuuuugucauucacacugucuugucuggaauggccaaacacauuauguccaggccacuaaguuuggcaacugaagcuuuuggagauuauucuggggcagcugagguaggguuuaacugcuaaguccuggaaucggugucuaggaaacgguuucuauuuuggaagaaguaaaacuuuacaucuguguuaaauaaugaccaacagggaggguaugaagguaauagacacaucaaauaugagacacugugugguagcagccugcccacuccagcagagccaccgccuguggcauugucgccugauaacaaaccucaccgaggaaccucagcuuagaauagacacaagagccuuugagccaucacaccugcuacaacagugccuacuacauaacuucuuugaguaaaaugucaauuauucacaauuaaguggccaaggcuccuaaaaugaagccgugucaucaaagacaccagcuuguuccccacagugcaguuuucuucugucacaaggcuugacuugauaucacugacuucuggaaggugaucguggugauggagcaagugcagauaguucuuaagaguggccagggcuuuaucagaucugucugucugucugucugucugucuguggguacccuggaaugaacauuucucauacucguuuuacauuaaaacauguccuaauguggaaguuaagagcaaagauuccauucaccugccuacauuugagccccagaaguaucauccuggaugccacugugcaaggcguauuuaacuucucugucuccgcuuccucauuaguaugugaggagaacaccaaccucauaacauuauugugaagacccauccaguuacuuaaaacgcugaugucuacauuguuuugggcauuagcucuuuggaggggauguuuguauguuuuaaauucacucauuaaugcugccugcugucuuagagccacgaguuuguacucaucacucuucuguguauaggaccgacugcugcuucagcccugacgacaaacucauaguuaccgguaccucuguccaaaggggguguggcaguggcaaacuugucuucuuggagcgcaggacuuuccaaagggucuaugaaauccacaucacagaugcgguauguagcuucuuuuucuucccuagucuugacaaugaaaugaaguuugcaucugauguuuguaauguuuuguuuccaauagaacauaagcucuggccuuuacagucuagugguaguuucuguuuguuuucucuccauaagacuuguuagggccuuguagacuggcugaucuacaccaucccuucccccaacccagugcuucccaggggcccagccuuuaguuaagaaaggacgagccugguggccaugcaguccauaggaggagcugcucauauccuguguauuucugagcaauugugaaagcuuauccccugcgacagaaggaaguucaccuuuaaaacuuugaaaggauccugugugugaagaccauggcaauaagagaaggccaccauccaguggacuucauagcuuuauguauuuggaugauuaaaacauuuauguuuaacucugacacauuuuugaaaaaagacccagaaccucugguuuucugggcauacuuauaggaacauuaaaauauuagcauucauucauuuauucauucauucacacacgugcauccugagacuggagccacuguggacuggaguagugaugaugguuccaagaagaaccuugcauccuuugaagguguaucuuauuauuuagaugguaaagcaaaccauuguaauuuucugagugugaaagagggcacuuaaugucugugucacuuuccuuuggcuccagccuuaguaacacucggcucccacgggguucuucugucaccuucuccaguuguuucagcucuuuuuagucaguugagacacacacuugagugucucagacagucgaacaacugcucugaaucccagagcuccugucucuaaugucugcuauaacuacagcaccacaguagugugucggcccagucugcagccaugcuggacugugagucacaagcaaggugacagaguguuagcagcagagaagcagauucuagcugugcacucagcucucauggaguccagugccacggcgcuacagaagcugccuggagcucacgauacaguuguagggguacaucugagagccaaccaaaaccacuagagucuaagagaaauaauugacugcaucaacuuuaaucucaaaaagugaaacuucaguacucauguaugaaauucucaaaaaaaccuuaaacauguaaaauuauuauaguugaguauuucugauguacccaacuuaaaugacuguacaacuuuucuuucuuucuuucuuucuuucuuucuuucuuucuuucuuucuuucuuucuuucuuucuuuccuuccuuccuuccuuccuuccuuccuuccuucuuucuuucuuucuuucuuucuuucuuucuucucucucucaaucuuucuuucuuucuuucuuucuuucuuucuuucuuucuuucuuucuuucuuucuuucuuuuuuuuugguuuuuccagacaggguuucucuguguagcccuggcuguccuggaacucacuuuguagacgaggcuggccucgaacucagaaauccaccugccucugccucccuagugcugggauuaaaggugugcgccaccacgcccggcugacuguacauuuucaauaucauucuugguguggcguuuuucaacucuaaggacguuggaauaugaauaacugcaggaagugcagguaggguuggaauacgaguaacugcaggaagugcagguaggguuggaauacgaguaacugcaggaagugcagguaggguuggaauacgaguaacugcaggaagugcagguaggguuggaauacgaguaacugcaggcagugcagguaggguuggaauacgaguaacugcaggaagugcagguaggguuggaauacgaguaacugcagguagggcuggaauagaguaacugcaggaagugcagguaggguuggaauacgaguaacugcaggaagugcagguaggguuggaauacgaguaacugcagguagggcuggaauagaguaacugcaggaagugcagguaggguuggaauaugaguaacugcaggaagugcagguaggguuggaaugcgaguaacugcaggcugcacaguggccggguugggcuucacuugcuuguuggaagaacacaccauccuacaguguucucuccgugggacuuucaucaccucguguuauauacuuacuuguguuucaugucuucgaccagguuaugaaucacaugcauguagaaacauuguuuuccucccugcagaauccuuggggucugcugcauagauaacuuuuaaaaagcacaauaaugcauaauguaaaacaaaguuguaucuuugaggaguaaaaacaggacagaggcauuuacaaucaggaauauugaauugaacucaaauauaaaaaugauuuuauuuugugggcccccccuuuuuaaagaaaaacaaggaaugacacauuuggaucugaguuuuagacuuguuuacucuuguugaaauggaaggguuagauuuguuauuagacgcguucucacgaccggccaggaaagacgcaacaaaccagaaucuucugcggcaaagcuuuauugcuuacaucuucaggagccagagugcaaagaagcaagagagagagaaaacgaaaccccgucccuuuuuuaggagaguuauauuucgccuaggacgugucacucccugauuggcugcagcccaucggccgaguugacgucacggggaaggcagagcacauggaguggagaaccacccucggcauaugcgcagauuauuuguuuaccacuuagaacacagcugucagcgccaucuuguaacggcgaaugugggcgcggcucccaacaucucccccuuuccuuuuaauaagagcaaauaggccacccauauuaaugagaguggagauagaggucaaauccccaguguguagguaaaggagccauguacaggauuagcucuuaggcucacaggcuuuuacccagagcaacccugaccugcucccgugucguuuugccugggggaagggaacuaggacacugaaccuucaugaaagaugacaugucucccuagaauaggcucauauaugccgcagagccuuuccauugcagugcuuagccgugcaacucucucgggcugcugaagcacacucacucuaucccgugcaaugagucuagccucgugagauguaagagcugaguggccagcgaccuauugccuaagcauagauaaccauauaucagggggagcuccauguucuaguccugcaagcgccugggcaauaaccaccuugucucuccuaguuuaggccuuaagcuuacagaccaaucaaagaagcaacacuaauccacagcaaaguguaucuccaaauaauauuaaucccacccauuuuuuaaagaaggaaaaugcugaggagauccaauuggguaauccuuuggucagcgacagguccaagcgcguggaguugaccugaagucucaauucccgaaggaucuguucaaauucagccauccaauucuguaacauauacugaaaaagacuuuuugacaauuuagcugcccuaguaaauuuaacauacugaauggaaauaacacacaaucccggaaacuuuuguucacaucccagcugaguuauaugucauaauacaucuaguuguaucuggacaagaucuaugaguugauuaaccagcaugagaccucucuguaucuugacauuagcugaggccuguuuaucuaugacuguagucacugaggcugacaaaguguuaauggugucagucgucuggaccuguccagacagagccaaggcugucugaauuaaggcuaaacccaguuccuaguuagugguaaaaaagcaggagaauacuugagcauuauacaucaccgucauugggaguggaaaugucgacauuaucccccaacgcugcucucuuuuuauuauugacgcccuggacaucaccaagacgagggacaucaguauucccuuggucagucuggauuuuucgggugagucuuucugguauccaaaauggguugucuucauucugugggaaaacacagauagcuccccuggaucuuaucaaaauaggauccgggccauaccauuuauuaucaaggacauuuuuccauuuaaccaucucauugggccuaucuggcucugaacaaugacguucagccgcaguauggccaugagcaucaauauuuaaaaaauugaguguaaagagugccaaagacacagacacucuuggugcuugggguaaaaucucuucaauuccccucuucuguuuuauaagauagguuuugagggugcgaugcgcacgcucaacaauacccuguccuugaggguuguauggaaguccagucagguggguuacguccaucugacggcagaacugcuggaauuuuugagacguauaagcugguccauuaucagucuuaaggagucuggguuucccccaagcacuccaugccucaagacaauguugaaucacaugugaggcuuuuucuccgguuaacggagaagcaaacaugaugccagaacaugugucaauggacacauggagauauugaaguuuuccaaaggaagaaacauguguaacauccauuugccagaccuguagaggucgaauaccgcguggguuaauucccacaugaggaacuggcaagaacucacagcagcuuugacauugaguaacaaugucacgggcuucuuuucuugucagggagaaacgacugcguaauguuucagccgucacaugaaaauuguuaugaaaauuucuugcagccucuaccggggaugauagggcagcagccaccacuuuaguggccuuaucugccaaaucauuucccagagccauggggccagguaggccugaaugggcucuaacaugaguaauauaaacaggaaaucuucuagauaacaaaacuaauuguaucugcugaaaaauauuggcaacucuacuggaaggcuuaaucacuccagccacuucuaaaagauuuacugcauuaaccacauaacaggaaucugacacaauauuaagggguucuaaaaagguuuuuaaaacuucuaaaaccacuaaacauucuaccacuugaggugaaauuucauuauacuguuuggauaccacuuuaccauuagccacauaggcaccuaugccaguuuuugauccaucaguauauaccacaauccccuuuuuaaguggguuucuuacuguuauuuguggaaacacaacagauugauuuugggcaaacuguaagauuggaugcuuuggauaaugguuaucuauuuuuccugaaaaggagguaacuaaaacugcccaaucauuagaugcggcugccaagguuugaaccugugcagcgguauaagguacaauuaaaagauauggacuuugcccaaagugggugauugcugcuuuuaggccuuuaagggcaagcugugcaauugcaucaggauaccaaucuauuauuuuagcuggggauacguuuggauggauccacaacaauggcccauucugccacaaaacugcaguuggcaauugugcugucuuaaagacacacaaacugaaaggcugcgaauccucaauacguuguaauugugcauucuguaaggcuuuuuccaccuuuuguaaggccugguuagcagcuagaguaagagcccuaggggaggagauaugaggaucuccuucuaaaauacuaaacaaaggccuuaacucagcagaaggaaucuuuaaaaaaggucugagccaauuaauaucucccaacagcuuuugaaaaucauuuaagguauggaggugaucucuucuuaucucuaccuuuuggggcacaaucuuaucuggggacaccacagagcccaagaauuguccuguaucagaaauuuggaccuuuucuguggcuaucuguaaaccccacugacuuaaaguuuuaaguagaaaaggauaugccuuuuguagcaugguaaggucuuuauggcacaggaggaugucauccauguaaaggagcaaaauuaaagaggggaauuguucccucacuggcaaaagagcuucuugcacauaaaguugacacauaguaggacuauuggacauucccugugguaagaccuuccauugauaccucuuaucagguuccaugugauuaauagaggggaugguaaaggcaaaucugggccuaucccuuggacacaaagguauagaaaagaaacaaucuuuaauaucuauaauaauuaaauuccagccacgugguaaggcggaaaguacagggagaccccucuguacugggccaaauaaguucauuugcucauuaauggcucugaggucauggagcagucuccacuuuccugacuuuuucuuaauuacaaaaauuggaguauuccaaggugagguagauggcucaauauggccuaguuuuaauuguuccucuaccaguugaaucacagcuuccaguuuuucagaggauaggggccauugaggaacccacacuggauuccccguuuuccaugguaugggccgugcugccccaauggccgcuauggaaaacccagacccugucugucuugguuuccauuagguaagauaggcucuauccuucccuguucuugauguccuaacccuuuuccuucuuuauaacccaucuuugccaugauauuuuuugcuuuaguugaauacccucccgauggggcguuuucauuggacaaaauaaggcccaaaugcugcauaauaucccuuccccagagguuaaccgggagugggagcacauaagguaugaauuucccuugcuguccuucagaggauucccacgucaaggcaacggagcuuauagugggacaugauugauauccuaggcccuguaaugaaugagaugacucuguggugggccaugcuuugggccaccaauguguagaaauuauacuuuuaucugcuccgguaucaaggaugccuucaaacucuuuuccguugaucuuaaggcagagcuuaggucuauuauucaaagauacaaccaaauaggcagaaucauuuccugaggagcccauuuucuuuaucucagguccugcagauuucucccugguauuaucagggaggagcagcagcugagcuauccuaucuccuuuacuaauagaaaaaacgccuuuagggcuugagcacaggaccuguauuucaggggaauguugacaauccauaacuccaggguggacuacuaagcccugcaaggugagugaaccccggccgagaauaaggcccaugguucccaggggcaaggaugguauaggcuccacuggcaccggcugaauacucauuugaggcauuaauaggaagucggaggcggcacgcagguccacccuugugggucuuccugggucgccucucugacugcuuccuggguccugacaaaccgguucccauaucuuugagggcccugggaccgagggcccgaugacccguuuuuuggcacaucaguugauugacuaucaggugggggaaggacucugcccuuuauaucccucacagagcgacacuggucagcucuaugauaacccuugccacacuuagagcaaagagugagagucccucccuguuuaucuggagcucugcaaucuuucuuaaaaugcccaggcuuuccgcaauuaaaacauguccucugaucauuucugcucauggagcgguucugagauuggaggauggcggccgcuaagccugcauuggugagaggucccccaagcucucgacagacccugagccagucuuguaagccuuuguucuuucuuggggcuauggccgcucggcacuccuuuguggcuugcucauagauuagcuguucuaucagaggcgcagcuugcucugacucuccaaaaauacgcucugcugccucugucauucuggccacaaaaucugagaaggauuccugaggucccuggacaacuuuuguuaauugaccagugguuucaccugcucgggagagcgccuuccaggcccuaauagccguggaagagaucugggcauaagcuccccaaugguaguuuguuugaucagcagaauaagcucccugacccguuaacaagucaaaaguccaaucucucugcucuggagucaaagcagcugcguuugcucgggccugcgcuugugcaguuucaugccaaagcgcucuccauuccauauauuugcccauacuagggagagcggcuuuuacaaccguuugccagucggcaggaguuagugccaugccggcaagccugucuaacugcaccaagguaaaauuagcauugguuccguauuuacggaccgacucggcaauuucuuuaauuuguaaguauucuaccggagcguggacacgcccacccucggcuccuucaaagaccggaaaugccuguuguauuuuccuuuguuccucucugggaaugaaugagucugcgcacugccucucugcgcauugccucucugcgcauugccucucugcgcauugccucucugcgcauugccucucugcgcauugcugacgcacuacgcagggcggggacuccgcauagggcggaccuugaagccgacugcccugaggccaaucagcaaacuggccuucgccagccgcuuuuggcuuccuuaacugauuagcuagcacuuuaccuggcugguacccuuuuuucucauaaugagcugcuucuuccucccagucuguuucuucagaggagaauucuucaucugcuucagagcuacuaagagcuggcuccccgagcccauccagcgaugagcacaggcuccuuuuccuagagaccuccgcuaauugaucuuucuucuuuucccuuuuuccucuuuuucuucuaaucucucuccagguauuccuaccuaaccuuaacuuuuccucggguucaagacccuuggaaaggccuguauacuuauuuuguguaccauauuuccucuuugcuccuacucucucuccccgcuuuacuucugauagcuuguccugaauuuccucuagaauccucccugccuuaaccacuugauaacaugugaaaaggaacaaaagggcuucuaacacuagaaaaaauucaaggccaaacauuuuccacuuuacuucugauagacugucuugaauuuccuuagaaaguucaaggccaggcuuaccucguaaagcuauacucacugguacucucguuccccagcugaaaaguucugaauucauacaguugaauccuucuuaacagucugcuuuacgggaaccuuuauuaccgcgacccacaguucugguucuggaaugagggaucuuccuugcgccagucccgaguuuuuucucgucccggaauucggcaccaauuguuauuagacgcguucucacgaccggccaggaaagacgcaacaaaccagaaucuucugcggcaaagcuuuauugcuuacaucuucaggagccagagugcaaagaagcaagagagagagaaaacgaaaccccgucccuuuuuuaggagaguuauauuucgccuaggacgugucacucccugauuggcugcagcccaucggccgaguugacgucacggggaaggcagagcacauggaguggagaaccacccucggcauaugcgcagauuauuuguuuaccacuuagaacacagcugucagcgccaucuuguaacggcgaaugugggcgcggcucccaacauagauuuauaaugguuggugaacauuaguauaugaaaugguuuucuucauaauuuaauuuuucuuuuagugcauuggugugaggguaucagauucccuggaacuggaauuagacaauugugagcugcuguauuggugcugggaauugaaacgggguccucuggaagaguagccggugcuguuaaccaccaagccaucuccccaaccccugaaaugagguuucuuacuuggaaccuuagugaauguucuuugagauaauaacuuaucuugaagcuagggauauggcacaguuagugguaugccuguauagauguaugaauccuuagguucaguacccagaacugaaugguauaaacuggauaugcuagugaaugccugggauuccagcaguuaauuuugaggugaagguaggaaggccaggaguucaaggauauucucagcuguacauagacuuugaggcuaaucuggacuacaugaaacccuacugccaaaacaaauuuauguauuaccuauaucuguauuucuaggaaagacacugaguacuaauuguugauucaaaaauauuuaaguuuuuuuuaucauauuuuguguauagguucuuacuacagauaaacagauuagggcauaagaaaauguacauacaguuuugggagaaucauuuauaacucauacggaaaugcugguuccugauggauuuaaugggaaaggcugauugauuugauagaggauugaaaugauuacccuuaaauaauagcauacaagaggaaugagcaaaccaagagacauuaacaaggaaaagguucccuaagugaaguauacaugaugauguuggacgagcuaagaaacagguuuucagaacuguuugaauagacagauggagagagacauagagaccugccuggacaaauccacacagcuuggaaagaaaggucuguuaaaaucauugauugagugguagugguugugggcgguaucguuaacaccaaacagcuuaguugucuguuuauauaguagaauauuaggcuaaaggggcucuaaacugcccugugaccuguugcuucaaguuuugucuccuuggaauguaagaaaauaaacacauccuuggaauagagacuagagugggcacugggcuaaagacccaaguuuuauuuauuuauuuuauguauaugaguacacuguagcuauacagaugguugugagccaucaugugguuacugggauuugaacucaggaccuucggaagagcagucagugcucuuaacugcugagccaucucgccagucccuuggggaccacuucuuuuauugcaugauuguuuugucauuaaaacccccagcaggggaggaaguaugggauguagaacagucagaguguggacagggaggggaauaaaaucuggaguguaauaaaugagugagugaaugaaugaaugaaaaauuaaguugacaaagucuccaauuacuaauaugaauaaaucuuguaaggcauuaaaaacacccagcacucacuauucguuuccuaauuccucguucaguauagugaggagcuucuuguugaguuuugcuuuucauaaaaggcagcaucugaugcucuguaucucccacccgccugagauuacugauaguuucuagaaguuuucugguagaauuuuugguaucuaugauguauaauaugucaucuucaaauaaauguacucugacuuccuuucaugcuugcauuccucuacuucccuucucuugcuuuguggcuccagccagagcuucaagcucuguacugaaaaggaguaguggggccaguggacauuccugauuucaguggcuuacuucaagucugcccuuguuucagaugagguuggccgucagauucccauauauaaccuuuaucgcguugaagucuguucccucuaguucuacuuucucuagaacuuguaucaugaaggaauauuggauuuugcgaaagccuuugagaugaucauaugguuuuugucuuuaauuccguuuauaucauuuguuucauuuucugacuuauguaugcugaacugucacugcaccucugaaauagcgucuucuuggucgugauguauauaaucuuuuugaugcaugucuauauucaguuugcaaauauuuuauugacgguguuugaaucuguguucauuagggauauuggucuggagugcuagaagcugcauccuuaccugccguauagcagaguaguguuugcauucuuuucuaaauuauucagaaaguuuucucccccucuccccuugcuuuuucccuuccuccacuuaccgcccccacccccacccugucucuccuuggcuccuucccuuccuuuucuuucuuucugaauaguuuaagaaggauuggcuucauugaaagucuagucuaauucucuuaucaauccgucugggccuagaccuuuuuuuuuuuuuaacuuagaaggcucuuuuuuuaaaaaacaaaaaacaaaaaaaaaaaaaacccaaaaaacaaaacaaaaaaccccuacuauuucagacuccuuguuuguuaccaaucuguuuaagucauuaaucuuuucuugguuuaauuucuugguuugaaagaaucuagagauguguccauuucuuuuauauuuuucaauggaguacagguuuguaaaauauuugaagggauguuuucuggccacuagagagaauggcuaacaaaggccaaggcuuacccuagguguccauuuccuucucgucugccauucuccacaacgucccgaaugaacugaaguguagacccucuaugugcaguuccauaugcccaggguacgugaguauggaguacuugggauggaucugaagcuccagggugguuuuuaccuggaaugagcgacaucuggggucugaggaaggagaugcccugaaccugccuuccugcagcuuaucauuucaccucagcuacugggggcaggugcaguaagggggaccgggaggcuuuuccacaagaaggguuuuauuuaucgacucgccucacugucucacuuucacgaauauuggcuggauuauuuauaacuuucacuaucauuguugugucagaguucaucugauuaaccaaaggaaaaagacagaguucuuccuuaggguccauuaaucugauauuggaaauuguccucuacaucuacugagaagaaaguuacagaauucucuuuaauaaaacaaaaagagagacgggcauaguggcucauagcucuggggcggcuaaggcaggaggaucacagugaguugaggccagccugggcuguauggauccaggaaagccuggcugcagaguuagcccugucuuaaaaacuaauguuuucaacaagaauacuggcugacucuuucuuaauugugugaauuccugaagggaacuugggcuugcaucuucccuuacccuacaagaucuaauccuucagacacaucccaacuggaauaagaucacuuuuuauauauuaauuccccuuucuuauugaaaguaguauauacaaaaucuuagaaaagacagaagauuaugaagaaaguacucccacuaccauagguuauuccagaugugaaauuaaaauuaauaacauugauguuuaagaaaauugcuguauguauuaccuaagcauauaaaaugccaauauccuguaaaaguauuacauacaauauauuuaauaucauauuauauauaacauguauguaacaguuuuguuucauguguguucuuguuaggggagaacacuuauaugucaaguuugaagagguugaagaggaagaaaagauaaauaugaaagggccauaaaauaaaagacccuuccugaagcuaguuauuugccuuaauuuauaagugaugaccacucagacuguagucagcuucuguuauuuaugccuguggaggagagcaggaaggugauucaacucaauggauauuccagaagugcacagaguuggcuucggaaugugucuuuguucuuacauuugaauauagauauaugugaucugggaguucacuucaaacaaauuauugaagcccauacaugugagagcuagucucaggaggagcaaggggcuccaucuguucuuccuuugcuacugggaauaaacuaauccugucuuacagacacagacucccaguucaggcagaauugcuccacccugaaagcuucuacgagcucaggauuggagaagcguuuuuugccaggucaggaucaugugaggaguaauacacagagcuuccugcagugcagaugccaccagaagugaaacccuaaugacugcauuuggcauuuaucugccuucucgaauauagugaaaccuucuuagugugaaacacaaagacauggggaaacgugggcuuugaauuaacuagcuuuccauuaucugauuucuauuauagagcaaucaggcugcugguugccuagagaauagcaguugcuuugaauuauguauuauuuuugaauaaaaugauaucagcuuaauggcauuucacuuugauucauuuuuugaagaauuaaagaauacaaacccuugaaggaaccugaccaacauguuuguauauaauagagucuguaauauuugcccacagccuagggauggggcaguuuacccugcagaaagccagguuuuacaagguuguuuucugaucuuucaggaugugugauaaagaaccugggaguggauagaagaugcugauauuuagcauaaaucuguugauguaguacuggcaugcuuucuuuagcguuauuuuuucuuggucaaccaaugugggaagccguugcagaguggcaguugcagaguggcaguuggcuacugcuggccacuacacuuacauaggcagugaagguucuuuugccaagacaaguuaaccaaucagaugugagacacgccucuccuaggccuauguaagcagcgccaguucugggcucagggucuuuucgccucuacaaucaagcucucccaauaaacgugugcagaaggauccuguugcagcgucguucuuccuggccagucgagcgcgcgcaagaaaccaauaacaucuagcaugucucuuaggacaguguuucacugucuauggccacagugaucagucaguacaauuuuaucuaggaguagguguuaaucgccaaagcagaaagauacuaucagaucuauagugaaagacaguguucugguuuuuaucugccuucagaauaugaacgauguggccaugagacaggcaccaaaugccuucuugggguuuccuggaggaacaugcuuacacauauuuguauggagcuagaacuuagcuugaauugccugcuuagguagcuucuuguacuggcuaguuuugugucaacuugacgcaggcuggaguuaucacagagaaaggagcuucaguuggggaaaugcuuccacgagauccagcuguaagacauuuucucaauuagugaucaaguggggagguccccuuguggguggugccuucccugggcugguagucuugguucuauaagagagcaggcugagcaagccaggggaagcaagccaguaaagaacaucccuccauggcuucugcaucagcuccugcuuucugaccugcuugaguuccaguccugacuuccuuuggugaugaacagcaauguggaaauguaagcugaauaaacacuuuccuccccaacuugcuucuuggucaugauguuugugcaggaauagaaacccugacuaagacaaauugguaccagcauagugagguauuccugugacaaccugaccauguuuuggggaggacuguggaaggacuuuggaacuuugggcuagaagauccauuuguuguuaagagcucugucggauguuguguaggagcuuggaagauaauguugagaacaguguagaagauggaggccuggcuuguaaaauuuccagagggaagauuaaaaacucuuaucagggccauugcuauuuugauuguuaagauucugugguucugguuagcuggggcugaagaaucagcugggauuaacaagauaccagaacuacuaaagugaaacguuugcauuacugggacuauugaugcugguuagcuggagcuaagaaauuagcagugauuaagaagagaccagcaucguugaggugacaucuucugggaaguguuuccugagagcacaagaggcuguauuuuaaagauagccaagguuguaccucgugcugcagugggauuugguaauguguaagagucaccaaggagguacugguuuugaaggcaugaaggggucacacaaagcagcugaggcucggcacugugagaggccauggaaggcuauuggugaaggugcagccucaguugcaauugauggcccaggucugaaggggucaugcaaaggaguugaggcuugacaccauggagagagccuaugagaggcuauuguugaaaccaaguuacaguggaagacagcagcauuuuggagauaccaguaccaugagaugaccaccaagaacagcagcagcaguagaguacaggugguuggauccuagaagagaacgugugugcuacagagggcauggcuugaggagugacccaagcccuuggaggaauccagaagauugugaguuggaucccagacauuggacaguuggagauugauuuuugcuuuugauugugacugugccgugauauuuuucccucuugaaggaaguuuuuuagugaagcccacaguuaagagacuuugaauuuuaaaguacuuugaauuuuaaaaaauacuggauauuuuuaaaguauugaacuuuuaguauguaaagacugugggacuuuuaaaguuguuuaggucuuguggaugaauaagaaacuaaggguugaggauuacuacugauguguuuguguaugaaguugacaaggggucaauuguacuagcuaguuuugugucaacuugacacaagcuggaguuaucacagagacaggagcuucaguugaggaaaugccuccaugagauccagcuguaaggcauuuucucaauuagugaucaagggggaaaggccccuugugggugggaccaucucugggcuuagguucuauaagagagcaggcugagcaagccaagggaagcaagccaguaaggaacaucccuccauggccucugcaucagcuccugcuuccugaccugcuugaguuccaguccugacuuccuuuggugaugaacagcaguauggaaguguaagcugaauaaacccuuuccuccucaaccugcuucuuggucaugauguuugugcaggaauagaaacccugacuaagacacuuccuaauauccaaaaaggacaagcaucacuaagacuugauaaaaugaccucucugcucucacagaaucugaggguaucauucugcgaguguucugcagcggcaguacauaggguguaaagaucugaggguaucauucugcgaguguucugcagcggcaguacacaggguguaaagaucugaggguaucacucugcggguguucugcagcggcaguacacaggguguaaagaucugaggguaucauucugcgaguguucugcaguggcaguacacaggguguaaagaucugaggguaucauucugcgaguguucugcagcggcaguacacaggguguaaagaucugaggguaucauucugcuaguguucugcagcggcaguacacaggguguaaagaucugaggguaucauucugcggguguucuggagcggcaguacacaggguguaaagaucugaggguaucauucugcggguguucugcagcggcaguacacaggguguaaaguucuggucuguugcugucugccuuagcaagucuugaaguguuuuacaaaaggaagaugauaggaaccagggcugauucuguuauacugauuuaaaaauuacuguacaaugaaugcaccuuguuuuucuaaggaggacagauaguugagugauuguaagacauacuguauacgagccuaagagccaacgucuucaucauacaucuauggccacuugcaagacaccccugagaauggacgcauugcuuguuguaguuccuuuauaagcugugaagcauuaacugggguggcgcucccauuuaugugucuauggagaagucaucacccgucgggggugagacuucagugguauggcuguuccagacucacucacauuucuuuaaauaaccccccuuaugaugcuuguuaaguaguucuauuugcgaaguuggacauugauggagucauacuuaggauugucauuuggugcuguguaaggaggggaagagguuucuaucuccccagggagggaaucccugcaacacguguggguuuaugugcucagcaggacacaaucagcacacgggacaguuccaucagcuccccagaacccgguuccuuaugcuccauccccgucugugucccucucccguccccauccuaacgguugacauucacuauuuuuucuaucuuaguauuguguugucuucuuaauuucauaaagggugugaccuuuugaagcuggcuuuucuucaacagaaugucuuuacaauuaguccagaugguuaugaguaucaauaguguguuccauauucagcauaauuaacugaucuuuaucauuucaguguuuuagaaauuguagauaaaauuucuauaagcauuucuuuuuuuugguuuuuguuuugguuuugguuuuuguuuuuguuuuucgagacaguguuucucuguauagcccuggcuguacucacucuguagaccaggcuggccuugaacucagaaauccgccugccucugucucccgagugcugggauuaaaggcgugcaccaccaugcccggcuuauauaagcauuuguaaugcagguuuuugaauuaauguaaagauucauuucuuugagauuaggauugucuuuuuauauuguagauaccagacuuuuugugggauaugugauuuaaagacauuuucuccuagucucucucuccuucaacaucucccucugucaaccccccuagugcgccccccccaccccggucugugugugugugugugugugugugugugugugugcgcgugcguagacaacuuuguagagccaguucucugcuccaccuccuccuaggucucaggcaucaagcucaggucuucagagucgcaucguuggaagucaaggacuuucaacugccaggucuuaacugucucuaagaaagcagaagucuaaaauuuuguugaaaccaagucaauguauuaauuuuuagaaauagauucuacuuuuggugacacuuccaaggacuucuugucuaacucuagaucucccagauguucucuuacaagguguauaguuuucuguuuuacauuuagguuuacaucccauagcaugauugguucuauuuuuaaaaauagaauaguuuuaaaauagaauaguuuuaaauuuuucaguauuuuauacauuguguauuucuuauauucaguugggcuuuuguuuucuuuuuacuuugagauggaauuuucauguggccugggcugaccccaaaauuucuaugcagcuaagaaaggccuugaaccccugacccuccugcuuuccuuuccuaagugcuaggauuacuaaugaacacccacaggcauggugcugugcuggcaacugagacccaggcuguaugcaagcguauuaccaacugagccaagcugugaauuaaaaaaaagguugcauggagguacuuaucuugauuauguauauuucagggcugaacuuagcacauaggaggcugugggugugguuccuaucaaagugaaacacaagaaaacaaaacaaaacaaaacaugcugcuagaguuagaaccugaggugaagaagagcucagcuggacugcuucucaccucaucgaaaaaauugauacuagcugaucacaggcauuaguuauuuauuaguuauuuacuaacuuuuugguggagggccacuuuugccuuaguaauuauuuugaacucugaauuuuaucccaggucuaccuacugaucuuacuucccugaguccugcugucuaucugucugucugugaccacacucagagggagaggcugagcaguaugcguguguuuccucuguccuauccaaaaccaaacaggagcucuuuaaauucacagucaguucacuggugauggaaagaaagcacagugugacacaguacagaccucgcagaugugcccagggcaggcuaggagaugaugugccuugguaggagacgaugucacugaucucacugcgacuuacucucugacgcuggcgggaucucucuugacgcagcaguaccaccccagagcugucuggaaucaagcauguuccugcagauuuuccauaguaccccaugucucugccugaggacuaugaucuagcugcccuguguaaaaguuagagcugcacuuccagaauauguuugcagccucccugcuacagccuccccgcagaguuccuuuccccucucguuagccucucguucucauguuccgagccuccauccuuuacuguaguccucguggaccuggagaacagcuggucaguauccucugcuuucuugaugauuauaaggucgaugcucugucuuuucuuguguaagugaaccaaacauuaaaaaaaaagaagaagaagaagaaaagaaaccuuuuccuuguggaucaguuuuucucggugcuuccauuaucuuugauauuuuuuucucagacauucuaaguuuucagugaccacauugggcugggaaggccccuggggcugcaggugcuaugagugugggaagugcacaccauuuauugcuuagcacagcacauggcauaugguagguguuugcuaaauaacuugcuuuacuuuuuauccuacuugauucuagaauguucuuaccaaguuuugcauuaaauguucuaaucccucucacuuucuuuugcuuuuauuuuuuaauaguuucaaaaauacuuuggaaugucacaacauaaguauauuuacuuauagauuugauuaaagaagugcacauuugguuuugucugcuuauuuaaaauuugacagugauuaucgguuuuuacacguagcuaaaauagcuguguuugaguucaguggaagaaacuuaaauuuucuccagaugcuaaaaaucuugguaaucuaaacucuguuuaacauaauuugcucugguuguuaaacuauuaaugagugugagcuauuguacaauccgcugugguuugaaaaggggggaaaucauauauagcucuugcugcguucacauucaugauucuucugagugucgggacuguaugcacgcaccgccaugcugagcuugaaguaaauauuguuagcauuugacaucuuacagugucuagucaaggagcugggaagguggcucguugguugaaaccacuagcugcaggucugaaggaccaggccugauucccagccuccacugcugcucacaacaaugcacaauuguaguccccggggaucuacugcccucuucuggccucuguaggaacugcauaugcauggugcacagacauacuuuuaaaaagacccauuaaauuagauuuuuuaaauuaaaauaucuaaucaauuuauuucuuagacuaggagacaaaucccugauuguccccucaccauuuccucagucuccuuuaaaaggacaauguuuagugucuuuuaacaagugaauucuuaauucacgugcacuuauuagaaccucaacauuuuccuuugcaauaguguuuccuguagaauccagauuuaauccuguagcugagugacuucaggguccucggauugacaguaacguccuuguagaaggccccggugagaugagccgauggcagccugcaaggaaugagaggagaaagaggccccgccccuauugucagucuucuggggccuuugaccgcugacuggauggaugguagagcugcucgccagaguucccguccaguacucacaaggaaaugcuuucugcuucuguuucuaggccuccaaaaccugcaagcauuauuucuuuuucauuaaguagaaacuuuuauuuuguccuuuccacaaaagcuucuguuuuacuuagcagcuauguauuuaaacuggcgacauuucauuguguagacaugcugaccaugaauggcaaagccagauaaagaaccagacaccauagggacaaacguccuuaauuacucuguaaaaccagacaaagagguccuggagaaguggcuaagcaguuaagagcccuggcuuuucuuauaaaggcccuggguuugauucccagcacccacacaguagcugcugugagccacugugagcugugagcacgugugugcagguagccacugugagcugugagcacgugugugcagguagccacuguguggcugugagcacgugugugcagguagccacugugagcugugagcacaugugugcagguagccacugugagcugugagcacgugugugcagguagccacugugagcugugagcacgugugugcagguagccacuguguggcugugagcacgugugugcagguagccacugugagcugugagcacaugugugcagguagccacugugagcacgugugugcagguagccacugugagcugugagcacgugugugcagguagccacuguguggcugugagcacgugugugcagguagccacugugagcugugagcacaugugugcagguagccacugugagcacgugugugcagguagccacugugagcugugagcacgugugugcagguagccacuguguggcugugagcacgugugugcagguagccacugugagcugugagcacaugugugcagguagccacugugagcacgugugugcagguagccacugugagcugugagcacgugugugcagguagccacuguguggcugugagcacgugugugcagguagccacugugagcugugagcacaugugugcagguagccacugugagcacgugugugcagguagccacugugagcugugagcacgugugugcagguagccacuguguggcugugagcacgugugugcagguagcaugcaucagugcaucuccguucacagaugcucaggggugagcaaggugcuggccuguaaauaaugcacagguguauaugauagccuguucagucagcugccgccauacuguauguucacugugggccagcgaggggcucgcuguccuguagggauucuugagguuuucuucuccaccccgaugaagggucugucuaaugugcuaacccauuuucuagcuguucuaucagaccucuggccaaacguucacuuaauauagaagaugucuauaguuagcacauaucucaugcauguuuuccuuuucugcaaucauagauaauagucucauugaaaggguuuccaagaucccgaaggcuaaauaaaacaaucugauaucuagaacaccuuuacuuguacuacuggauaagugcuguucuuuuaauaccuugucuaacucaccuauucagcaaaagucugcucucuuuucauuucuugaaaguuuuucuugcucaauuauuuccaggcuuugaucacacauauauuuuuauuuaguggcuagagauuuaguaugcuuuauacauuuguguuuuauucagauaaacaaaggccugaggguuguuguuguuguuguuguguuuaucucuaaauaguggcaaaugagagauaaagggcuugggucugugaagauuggguuggaacaauuuugaucagguuguaaacacuuggaaaguuuugauuacaagaagaaccauacuccaggauaaggaagugcugcaaaaccagccacaggaccaguucuuacugcacauagcucuuuaugucguaucgucgguuuuggagcuggcuaauuugggugugugauguuuuuguuuacuuccaaauuuucauaauaaagugaaaacacauuuuaaaaacauaauucacaaagaaagauuuaaaaaaaauagugaaagauuagauuugguucacuucaacuagaagaguaugaacaucagcuuuguagccuucagggaaacagaggguaucgacuguccccuuugcaaccugguccucaugaauggugacauguacuacccagagaugugaccauuccuugcuagaggugaguacccugagguuccaguaccucaaaugccauucaggucugagaggccuccacauccuggaauaucaguagcccaugccaugcccacuguggagaugugugaggucggucccccccaaccccccgucagggccucuggucuccgaaccgaucaggcagaccacccaucugugcccccguggguugcagcuuuaggguccucuuguuucuugcuccccagcucucaucaauaaaagcaauuaccagacuuccuccaauaauucuuuuccuccucugucgucacacuuucuucucaaguucugcaguuggagcaaaccagcauugguuguuuugaauuagaugagggaaguuuuauuuaauuuguuuuacccaagagacauucuauuuucucugagaacuuuuucuugugaugaaauucuucaagcaagcuuauuaucagauacagaugugguucauuuaguaucaaggacaacuaccagguuccagauuuuugcugcuuuagugguuaccucaacuuuauagcacaaucuaaaguaagucgaucauaauagauauguuuuccaugggugugauggaaauuaguguaugauuauugaaaaauugaaaguauaguaucuauagcaguuucaaccuaugggucaugacccccuggguggguuuucaacaacccuuuuucaggggucacccaaggccaucagaaaacacagugugauaauuacauuaugauucacaacaguagcaacauuaucacuauaaagugacaaugaaaauaaguuuaugguuggggguggggggucaccacacuaugaggaacuguauugaagugucgcagcacugggaaugcugggaaccucugcacuaucugguguuacagcagaugcagaacaacaccaucccacuccuuucucuugccacgugagagcugcuccagcccuuuuucuugucaccaucaggcuucucucugguuuaucaaagaaaaaacuuacuuggaacagagaaaggaaaagauugccaaggaaaaugacaagucuggcuuaugguaggacugucuugacaucgggguguacguuaauaaaaggauagaagccgguuguggcggccucaccucugguugcagaaccugagagguggaaacaggaagaucacaguaagugugagagcugccugggauaugcagcaaauuccaggccagggccgcaccgcgagacccugucucaaaagaccaaaagcaacaacugaguugucuggagaucucuggagagugaacucaggucguuuaggauuuuucauagcucuuuagauuuuuuccagcagguuuccgaauuacuuagagagcggacacagcuguuuuagaguguuuccuagcagcuagccagagaagcuucucugaagagcgaacauaacaguuuuagaauuuuuuuucuggccuucugauuuugauaggaaaaccuaagaauuacuuuuagaaauuuucuaacaggcuuucugacuuggucuaaaaaaaaaaaaaauccaagaauuuuuuuuauaguagcuuuucugacuuugguuggaaagcccaugaacuaucuagagagcuuuagaauuuuuacuagcagagagagcugucucaaucagucuuuuagaauagcaagaaaggguuguccagagcagagcagagcagaacacgcgcacacacacacguacacgcgugccgugcgcgcgcgcgcgcacacacacacacacacacacacacacacaugagagagagagagagagagagagagagagagagacagagagacagagagagacagagagagcgcaaucucaaaggcugucuggagcagacuucagagccaagagcuaucuacagagaguuaucuaaggagccaucuugagcagaacauaggccgcuagcuugggcccauuuguuuucgcugcucccagacacucuuucucucagaaccugucuccaaggcugguccuuggcauugugggagaugaauagccuggaagagcugaagcaguucccacuuucuuccucugccuccccugcccaguauucuaauacagaagaccauuuccuuucucugugaaaugagucaugggcgugugugaaucugaagugcuuuuccucugguaccuuccuguuugcaucugucaucuuucauuuguuuggggcugacagcgugaucaggacacaugguuaaguguagugguuaguccuggggauggccacccacagugcuaaggcuuuuuuuuuuuuuuuuuuuuagacuaggcaaagauuuuuauuaaccuuuuccaaacuuuauucccaggcuucuucagcuuaaguugccgcuaagaaugaaucagguaugagcaaaaaccaaaaagagguacaguguccagggggcuugggcuucacaauauuagagauuuagauuuuugucagauccauaagcaaauaaauaaauaaauaaauaaauaagcagccauguuauaaaacaggagcuccuguaacuucuucagaaguugcuucaauucaguuugccacguucuuagaagcaucuucaaaauucuccaccagaucuggaaccucaccaucauucuucucuccaaggagcaaguggugcuuucccguccacagaguguuugguagagcaccagccacuguccuuagacuggucagaccaucugcaccaagcugcuuuaggaugcugggagguagcucugugaggugcucugucucagcauggccuguaaugguggagauguuugcagaacuguaggguugacaaaauggaucccugguccuugguuuguuaccauguucaccucuucaacaccagagauacuguuuaccccuaacuucuuuaaggagaaaugcagguuguuuguuuguuuuuguuguuguuuuuuuaucgucugcuauggcuguugugugaaccacuuucuucuuucuccgagggguuccuuucccaccaaugcacacuugguggguuuuuccugguucaugaucguuucuuucaucuugucagaguggaaauggggcugcucggggggacuaagguucaggcgcacacacucagggaugcagacucacuagggcuucuuauacacagggcugcacaacugugcacaucuauuuuccaaauagguaccagguggguuaugggaagucacugaacuugcugcuucuuccaaggaaucagguuugcuucuuuguccuucuuccacgagacagaaaccaaaggugaaaaucacagauggugugugguguucagugagggucagcagcuaggaaggaccaggaagugguguuugaacauaaucccguuuaagguauaaaauuauaaggaugcugggcuugucuucuguuuagauauaugcaucacacacauguaagguguugcucaggcauugaguucguuuauagcaacguuugugaacccugauuuacugguaccaucugcuccccgucuccuggcguugcugggguucaguggaaggcacuugaauucugggccagcauucuuccaccgagccacggucucagccuccuuuuuccuuucaaaaaucaacuugauaagauucuaguucuacguugcaaagguuugggaacgauuuaaaaccucccaguuuuguucacuguucaauacaaggcuccacugcauaguacauagcauaaggaaauaaacgagagagucgggguacccguucccuccccucuguaaguuacgcaagcacugcccucucccggucucaguuuacuuuguuuguuugcuugguguuuuuuaucuaugagaugaaugagguuacuacuuuuguaaagaccuccagggcucagugggaagacacuugccgccaaaccugauggcccgagugcaguaccccagcugcgcacgguggacagagaagacugucuuccaaaacuuauccucugacuuucuuauuuuugucauagcacaugcgccccccauacauaaacaaguaaauguaauaaaaauaaaugaauaauaauauaaaauuccagguaccuacaguuccuuucucacauguccuaaaauucacguucacucccugcucuucuuuccuccccugcucgucuccaugguuucaguuaaaguaaaccagaaaaccauagaaauaauuacuuggaauuuuuguggccaucucacuuuugcuaaggcguaguuccagaaucgcugccuuggaauccugacacuguugguaguguacgccacucucuucaucuccccucuuccuuuugguaucugcagggauagaagaucucuguguugaggacaucuguguauuguaacugagcauggccaucuugcuuaugagugccaucauuacuugcuagcucuuggugccagcugcuagagcuaaguccuuccagugcaguuugugguaaaggcugucucuuugguauuguaggucugguguuccugggacugucucucgucccuugauuugggaaugucuuucccuugcuuugcagcacuguucagaacaugucaaagguccaggcauguuaaccaaagaggcaucucuuaaagagaggaugaaggagcuugggcuguuuggcuaaaugagugauugcacucucuuucuuuguauuuauaacucaucugucuucugaugguucugggcuccuagcaggcacguguccauuguuguugagcaaagcccaguguauaugucugacaaauuagcaguguggcaacucugcuugcugccgccggacucagggauuguuugguuuggcaaauggccagcucucugcuauaagaugcauuuccuugacaggacaaaguauggaggcacauuagcugcaaaguuugcaaaggucagcuaaacacauacaauaaauauuaauaaacaaaaaaggcccacccaccuuugacuuugaacucuuguuucuucacucuguguuuuggaaucccuguaggauuugauuaauaaccagucuuaagguaauugagccucaaguguccugugccuaagcugaucuucucgccggccucccauuggcugccugggugacucauugccacaguggaguggucucuggacuaacuguuuaggucaagggcucuuacuugcaauccccugcuugugcgugagaagcggguaaaugugauugucugccagcgacugcugggcaguccugugggcugugucuuggagcucuggagauaaagaauuggagcaggaauagaggugaaaugccuucagacucccuggaaagcaaccagacguuggucuguuggccugagcagucgccucucuaacauuuacacccucuguggaaagggagagaguaacaguaaccugcugccccuggaaacugccuguuuggcugggugucuuggaauuuaucaggccuacauuguggaucuuuuccaauucugcacccugcucacuugagaaccaguaacugcuuagccagaccuguagagaaccaaggaagagaaagaacucuaaagccaugucgcuagcauuguccugggaccauucguggguggcugggguuucugaaggcacuugaaagccccuuggccccuuuucuugcucucugguucauaggugucuauucucuccaggacuacagaaagaaucaacccugcuggauuuguaugaugguugguuauaauacacagacaucaaauucuuccugauggaaaaggauaguuuuuaaauugaaaauugucuccaacucugcuuaacaaaguaacccauucaggaauagcuuuuaacuuacuugaagaguaccagacauuaaucuaaggacccggaauauacugcugaacaaagcuaauccagaucucuggccauggaacaugaauucuaguugagaaaggcauagcaaaauuaauuuaaaaaaucaaauucuguauuaaagauauaugcuauggcgaaagggaagcagagugaauggaguuaaagggccauggcuuuaaauaaagugggcuuaaaggguaacaucauuagggccugaguaggggagaauggacuccugugcccucugcccucugcccucugcccucugcccucugcacaugcacuguggugcacacauccucccuccucauaacuaaccaaaugcauguagaggagagaacauuaggaaggaaaacugagccaucaaguguaaaggacuccagugguucaaauggggcaagugugucuacugucacuguuguuugauuugcuuuuuaacacuugcuugcuagccgacauuggagagcagcgccccagauuugaggaaagcuaaggaaauguggagaccuguucuuucagcccgccccacccccaccuucaccuccacggggcggggcaggaggaugccaacacugacucuggaaugacucagcccacuucaguggcacacagcuuacaaaccaccuuggaguauuguuggaugugaauuagcaacuugcaggcucuuuguagcuuucuccauaguucuggaguaucagaaaaggguuugcagccauuuaagcaucaccagucaggugagaguagaguuucuaccaaagggauuucagaguuugcaggucuuccuucuuaauggaagagcgggauguuagaggcaagggcuaaagaaggccagccugcggagacagggcugcagugcaggagacagggcugcggugcagcagacagggcugcagugcuuugaucuucucucgaggaccucagaugucaguugucccucuuucccuuuaguccgugugcaugcgugcaggaagugggcuguuagucaacgaugaauucauguuuccccuccucuugcuccaaaugagguuuguagaauguaguguguggcauuugugcuucccagugucagcuucaugguccccuccccccuugauucgcuuuaugcugucccucccaucuuuccuccuaaccccaagaaaauugaaaacagcuugugagaacucaggacucagguucuuugggaccccagaguaccaguuauucaucaccagacaugaauucagaccauagcuuccagugaggcaccucuuuaaauagcuucccaucagguuaauaucaaggcucugcaauugauaucugcuuuauuucugucauggcguugcuguuuugucucauaggugggagagauuauuaauugucuaccaauaugugcucuuuguaaaaaaaaaaaaaaaaaaagaucuuaaugagacuuggaucucugugaacuaaaaacaauaagcaccuggccucagucugaggccaguggaacauauugugugugucaaagcaugaacagcagaucuaagguugccgcgguggggagcgucacaggaagccagcgcuccauagugccagccucacaucggaacuggacugcccagcccugguuccaaggcucucaggaacagggucagguccagaaaugaacaucuuguauuucugugggacuuugagugggugguaagaggcgguauggauuucacucacagagaacacaaugcuaugauuuagaucuggaaaguuauggguuucucucccaccaguacuugacucccuaguaaacugaccaucaaagccccagcaggacucuucccucccccucaguuuuuuauuuggucaccugacuugacuuguauggcuguucuuucuagagugugguccgcugccuguggcauccaaagcugaaccagaucaugguuggaacuggaaauggacuggcaaaaguguacuacgaccccaacaagagucagagguauuucuuggaaaagccuguuugagauggaugacaacuggggagggcuuggguucacccuggcuucuauucaucccccuuugauggggauccgcccuuuuagaaaaggcagcugguacccaguaaagccuuagacuccuagcauugugcuuuaaaugggauuuagaucucacccuugauccgcaucaaauucaaagggaaaguugcccagggauuugcaguccuuuggcugaaauguugagugcaggguggggggaguccugcuugcuccguguacuccccggacaguggcaucagcagagaugcaugugagguauuagcaaacaggaguggccacucacaagacacagcagcagcuugccuguuuuaccuuuuguggggagcuuuuaguaguuacuaguuuguguauuugaugaggcuaugcuguaucgacugaaagggauagccugugaauggacuuuuccgggcccuuagcucgccccaggucagacauaagcauaccaguuuaaucccaaggucuggaaacugggagaggcucaccuagcuccucagguauuaacacuuucuuuuccaugagauggacaugggcuaccaccccaaggagcaugguccuuccuguucugguuuguauacagagucacaugccgagccugugcccuucucuuuugagcuccuacaugcuuucuaaggacaguaaagcuaaucuuuaugaaugaacuuucauugaccauaauuuugcucuaguaagaaguggaccauccugucuucagagguuccugagcccguguugaaaccuuuguccuauaaaauaacauuauaaaaugauaucuaagaagaaguaggauuuuguuuguuaauaaaguaaaaaugcuaguuagugugaauggaauccacucaaaaagaaugccagccuuauauuaugacacccauuuggaaagugcuaucuuuacuugggaucuauaagauuugcuuauguauauuuucuucagagcucuguaccacuaaggugagguaagaucuuaaauagaccuuccauuaaucagguuguagcuccugagcaaugccacaaagcauacuccagcuuagacacucaaaacggcguauuugagauauggacauacaccaugcuaggucccgcugaguggaggaccuugguugcuuucaucuggaacauaggcuaaacauggaauccugugaccuugcuuaacuugcaaaaucucuuuaacauccuuauguucuuaaauuacuuuuguggauuucucuuuaguguccugaaugccuugguaccucucccaaucuuucacuuggugggugacacugguagaugugaauuucuggaaaguucauugucacuaagaccccaucucagaaaggcagggucuugcacagauuaaaaaaaucucucgauuaaugaaaauacuacagccguguuuugcauggguuaaaaaaauuuuuuuaaaugaauuggccaagaucuuccaguguuuccugcaucuaucauagaguaauuucugcuggggucuacuacauacagggagagggagggggagggggagggggagaggagggagcuuugagacucucugaugggaccagaaauuuaguguuucaccucuaccuauuccuaaaaugcacuaaagaaaauaauuuguuccaacucaucguaggggagcaaaacuaugugugguuaaaacccagaggaaggcaaaacaagcugagacacuaacccaggacuacaucaucacccguaaguuguugucagcaucccucugucuuccggugcucuucucuguggucuuguucauuacuugguuugaaaucagaaaggguggcaucuauuacauuauguccugucauguggacacagguacaagucacaugacagcaucacuuuagcuucuuggucguuuacaaaaaugaggcuugccucauguaacuccucgccuaaaugggaagugccuuccugagcugaacacacuauucuauuacaguguucuagguuaacauguuauucugugaaucaacaagauucaggaggccugcagugugauucugaacaucagggagauuagacaaggaaucuaugaccauguacuaacauacuuggaggaauuucuguaucaaacgaacugucuggggcagaaugguuuuucucagaugggucauacaacccuauucauccgacaggucuauguucugaaaaccacagccucagaccuguaagaggccaggaaggaaaucucggaugccacagagaugaguaauagaguggcccagggugcucugcugcuggccuucuucccggugaugggucucuugugagaccaaguuccacggggcuuguggucggucaagagaucccaagacacucuuugcaagaguagaaguguuaaaguuggggucauagccaguccagcucaugugauuacaugcggccuucuuaacacacaccccccacacacacaccgcccccagucaugggaaguaaaaggcaauuuucccaccuaaaaggacugcgugucucacggccugacaagaguaaggggaguaaugugcuuagcuucccuaucauggcaggcacgguuuaaggugagugguacugccuggcugcaaucagaaguagggccagaggaucugauggggacuggaaggguuuuggagauguuuccuuuagauuauaaccugucuuuuccaguucucugaaaguguuuucucuuuuaaaacauguuuaaauuuauaucuaauggcuggaagaaauucuaggucaagaagaagauagcuauuuaauacucuacaauaacccuauccucccaaauguuaaauguuuccccuuaaguccauauucuuuuuaucugaacgcuugacaguagcugaguacaugugccugugucacccccuuguucuaugggccagccgaguggaagcagggcuaagugcucuccucugugguuacuccucuguguuuucacgccucugccgagagggggccacaccucagacacaugugacgugauuccggcauuuauuagguuucugaagaaccucaaggacugaccggcacguucuugggguuacucauauuugggcccucuaagcaaaaauaagaaagugauucuaugaaguguuucuccguggcuagggagaugagccuucccaguguuuccaagacaguguuugauggcgcuuccugagugucauucgcugccagccgaggugaacaaggagucugguaucaaacagaauuggcuaauugguuacaguaagccugucuuuuauuauuaaaugaaggcugucauuaugauuuccauuucauguuucaguuagucaugcauuagcuauguuuuuggaugaaggguuauuauuauaaugaaaauuuucaaaugugacuccucacagcucaugccuugcccauguuccgugagccccgccagcgaaguacgaggaaacagcuggagaaggacagacuggacccccugaagucccacaaaccagagccuccuguagcaggcccaggugacugaagcagccgguuugucugcaggggaaggaggggucaggguagugucauugauacggagguggagagagcuucagggccugagaucuucuugaucuucagggacacuaguggcuuucagaugucuucucggcuagcaccggagucacaauguguagagcuuccagggauguagugcugaaacagagagauacguggggcuuuacccucccuagcucgagccuucggugaccucacuugaacucuggggcuccuuggaagccagggcuaaaacugcugcucucaguaguggcuuaagcuggauuagguuucacccgaggcagagaguagccauggcuuagcuccgugugguaagauggaggagcugcccaugucacuggaagguagaaggaagaccguaaguaggagauguugcagggccggcuccucccuucugagagcccugguaguuauuggcacagaaagccgguagcaauuggucuuuuaaaaaacgguuucuuccuaauuaaggaaauuuaucuucuaguguuauuuguuuagucauguguuuaucuuucuaaacaucauuucugaaaagaauuuucuaaaaugccagcccauuuuuuuuguuaugagagacccagcaggacacagaucuucgccccuaagcuuguugucugccaaggcagucguagcaaaaaaguaaggagaguccgugcauucgcauggcuuguuuucccucaggacagagagcaaaguaccuauaauauacaaggaguaacccucuaaaauauauuuguuuacagcuaaaauagcagcuaaugauuagaaguuaccuuuuguauugaauaucaguaaguccaugccagggcaguuuuuaguacaguccuuaagaaaauguuuuggguuuuuccccaccuuuuaaaaaccaguaucauuuuguaaauuaagcagccagagcauuuuuuuuuaaugucucuuccuguuauuaaauguuaaagggauguuaaaggcagauggcucuuagcuuugacaacacaagcugaugauaaagcacuguugagaucugagcucaggacacagcagacacagauuuguucauguucucucuaaucggggcuuuuucucugaaacaggucgugguggccgaguuggaacccacgggggcacccuguccuccuacauugugaagaacaucgcuuuggacaagaccgacgacagcaauccccgggaagccauuuugcgccaugccaaagcagcagaagauaacccauauuggguuucgccagcauauuccaaguaaggaaaaggcuguuuaaaacagaagaguggggucuugugagauggcuuagucaucaaggcacuggucuacaggccuggcguccuuaguucaaucccuggaacccacgaaaaggugcaaugagaacugagucuauaguuuucuucugagcucuauauacaggccauggcauauucguguaugcacgcaugcacaccucucccacaugauaguaauaauaaauuaaaaauaaauagaaaaaugggacuggcaguguagcucagugguagaguauugcuuagugucuacaaagcuauaaauuuaagccaaaaaagguaaauaaaaaaauagagaaauuauuauucccaaugaauugagaagaacauagcaauaguauuuugaggguuuaacuucuuuucuauuugagcacaaagaaugggccaagaucuguaggucugauaccaagaauuguuauguaugauuagcagugccugcaauccaagcaucuaacaggugauugcacaugggugaauuggaggccagccugagcuauagcugaagauauggaauaaguucaaggcuagccugagcuaugagaggcccugcucuuguuuaaacaacaguggaauugggaauucaaacucucccccccccccuugguucuuugguuuuucaagacaggguuucucuguguaguccugacuguccuggaacucacucuguagaccaggcuggccucgaacucagaaauccaccugccucugccucccaagugcugggauuaaaggcuuccaccaccacuacccagcuggaauucauuugcuuauauuguuaagacucuaaaaacagugaaauuuuuaaaacuguaauaguuuguugucauaguuaaagccaagaguaagccuugugugcuucucuuuccagagacuuuaaaagugauugucuuucucaguggaggggaguuaaaagcaagcaaagaggcgugaccugccugucucuuaagaagaacugggggcgggguguuguguguuggugucuuuuugcuuuuucauagucucgauaugaagucccagcuggcugagagcucacuguguaacaaggcuggcuuugaacuugcagcaauccuccugcuccugacuaggcuaguucucagguaggggauauauauauacauauguguguguauguguguauacauacauacauacauacauacauacauacauacauauauccauguacaaugaauccagccuuuuagaaaguuccucaaacagucuuaccugagugaguauguagcagcuuucagugcuaccacaccacccacauuuacaccaaggaaaguacucuuauugaauuuuuaauuacugaguuuugaaauuuuuuacuacaacuaguuuuagacuuuggcacauucuaauaccuuacaugaccguaauguaguuuaauauucucuguaguagccaccccuggccaacuguuaaaccugacaaugucuuuaugaguaggauuucuuuucaaauaucccccuuggaguuagugagcuuuaucuaaacugcguuugcaucaucugaccucuggaacccccucuccauucaguguucugucuaccuguguuaaggaaucauucggugggugaaauguuaaugaacagugccuccuauuuuguuaacaaauuuuguuuauaaccuuuaggacuuuauuacucuugguaucauuuccauuuauucuaccucugauaucccuuauaaaaaccauauugcuuuauuuucugucaaaagauaaagaaaagauaaaaaaguguccagcugcuuauuguauuuuuauuauuuuaaauaauuuguauacaaaauucugggaucucuagguguaaaauuauauguaagugguguuggccuccuccugucuaauguuuauaccugucuuucuuuuucucauggaauugccuugguauuuccaagcaguaguaaauugugucauugggagugagcagaccuuucucccuuugaacuuuagcaggaaagaguccuguaaacugugaaguuuuccuucuuguacuugaggaaauccaaccagcagcuuccuauuguuuaaucucaucuucuuucccguaaaauauaaaauagacuucugagaguacgcccguaagaguuuaaggaagagcccaucgcucucuuucauucauucacuuaaugacaguuaaugagagccuccuccgugugagauagugcuguaggauguggggccauagccgucuucacggacccaugcugugauacucaguggcaggcaaugcaggacucugucaaugucagaugauaugcuacaaaggaaacucaggaaguaaaggggaccagagugaucaggugugugugugagugugugugugugugugugugucugucugucugucugucugucuauggcaccaugugugugcacuacccacagaguccagaagagggcuucagacccucugggacuauaguuaccuaugguaggcagcugccaugugggugcuaggagucaacccauguccucuggaagagcagccagugcuccucacugcugagccaucgcugcaagccccaggugcuauuuuaaauauggcugucagagucaugaccugacugaaguagagggguggaaccugcagauacccugggaaugaguaucccauagagagaaagcagccugcagaggccagaggcaagcaugucuguguacugacuccuguucauuccuucagccacuuuuaaauuauuuuaaaaauuauuucuucaucaucaucaucaugaugugugacugugagcacucaugucuuagcucauguguggaagucagaggacagcuuuugggaguagauuuuccucuuccacccuggagucuggcauuuggacucaggucaucaugcuuaaauggugacugcuucuaccuaucucacuggccccuuaaauuuuuuuuuaauuccuuuaucucuauugaaguggugacaugaucucccuucuuaaaccuacacgugaggaccucugacaccgacuuccuguagugcauugccuacuuguuagcccggcuuccugacaaaauaacuuuaaacagcuuaccuguuuuguaaauguuuaauaaaccuuauaaaacugccaaagugugguuguucgguggagggcagagcagagaguaaugucuuuauccaccauccccguccagccugucccauuuucuccuguugcagcacaagccugcuucauaauuaauauaugucuuggucagucauccauccuggcuuucaaguuuauuuaaauagaggucauugaagcugacgguguucgcucagcuaccuagagacugcuuuuuuucacuguaaguggauuauuuuuauuuuauguacgugcugggugugaaggagcugcugccaugcugcccaucucgugagaagacugcugcuuggagcuugcagccccagggccugaggcuagcccucagcucagugccuuggccccagcacggugcucuuucggguguccgccuuucugcugcguuuucuucccauucaucccucccacccguucuuguugccuuagauuuguugccugcuaacucaguugaaggcauugcccaucuguggccuguaguguguuagcugggauccuauguucaccugcugcaggauacugcuuacugccaaguggcaaagcaugugaagggaagcuaauauuuaaaaggaucuuuuccuaaaggucacgguaacugagaacgugugucugguuguuuuucuccacugcaauugacuucugucagugaugaagugaagguguauuuacugugucucgcuugaacagggaaaagcaggucgucagaaagacauuccguaaguguucgugcuacgcacagcauauacucaccuauauucuccagagugccgaugaugccuggaugcuuuacaggagucacuugaggaucgaaaccccagugugacacuggcaguguaauagccaugaaaguguucaaacacagcaggauuacagaggacucuuguucagccgcacacgggcagauucaguuacaguuucuuguucagagaugcugcuggggggagggagagagcuggcuggggagggggcaggaugcagauccagaaugcuauuagcuuacacaucagacaggauagaugugugugugagcucggagcccggccagcagccugccaggaugacagcucugucaaccauggcugccauuauugccgguucagucacuuuagcuucacugugcauaucuuuugaaauacaagaugugaggaugugucuaagauguguuguguguguauguauaucguccccaccuauaaagagccuauuaaaagucauauugaguucauaagccaaauuaaaagcagucauuguagacgaggaaagagagaaaaauaucuucccccucccccacgcacuaaguaucuucaaauauuagcuaauauuuaauauuagcugaucgucacuaucugccauguugcuuuguggaggacaguuucauagacuaguuuugugaacugccugucguguaggcagcugggggguggguacuggggagaggacugaaaugugaaugaauuucuagguccacuccagacuaauagacccugagagauuucgucugagaaucuacauucuaagaagugccuaaagugaugauuuugcacacaaaugcuuggaaauaacauaauuacucagaaucagaaacuauuucucauuaagaaacuucaugcuuaaaggccagacagcuucauuuauaaaagacucauagcaaaucauuuccauagaaaaagaaucuccccaggauuugagaacauagcauguugcaauguuguacuuaacacaugaauucuuaugcucaguauguuauaccuaggacuuuagaaaaggugucaaucaucugaggcgaggaacccuguuaucuaacguguuauguaaacagucguggcacuucuucuguacuaacaccgugauggacuugcuagaaagcuuaguauguguuagcauaacaauccucaucacccacgagguagacaguauuccuguccccaccuuguagaugacggaacggaaauguguaauuugaccagugccccacagguagcagguggccgacuuaggacuguguacagagaggcugccuucuaugcccugugcuuguuucuccucaugggcagcuaauaguagcuacugggaugcugagaugucugugugagccagcauggcuuagcagagggaacccuagacuaagagucagaaguccugaguguacuuccaguucugcuacagccugcuaagggcagggcuugccuuacugagccgguucacgguucaccguauccacacgguaggaggguaggauccagccacacccgaguaccgguccuuagaaauguguaccugagacaucagaaagaucucggggaaccuggcccgccuccgcuuacuguuuucaagucucagucuucuuuccuguguaccacuuaauaguaaaagagcuaguggagacauuacaggacucuucuggguccuucauucuuguguuccauaccacauuucacauuuguucacccacaucucacacuuguucuuuuuucuaguugcugaauucucaaacauagcgugcugcacucuaugacuucaagaaguguuuauuucucaaaugcuaugucugcacucucugaagaagauucuuuaucuaaggcaucuacugcuuuaucuggaagcuucuuacacaugcccaguguuuuaaauuuuuuauuuuauuuuuugguuagguacucacagauagaagcagccauuucaagcugaaucuuuuuggucaauccuuuuguuuaaucacaauaauucugcaauugugaugauugggucagaguucagccaggcuggauucauguuaacgggguuaacaagugugucagauugucgagucauggcuauuauuggcuuuggcuuugagguuuucguucauaauaaacaacgggccccgagccaagagaccucguggucugugcucacauccucaugauuaaauauugcaagugauuuccccucauauucuucccaucacccacgagcuugcuuucugcaucuuaggugaaucacagcagaagcacacccguaauuagagagacugugacccgugcgcggacuuugcaucgcagccgaaaacacugaugacuucacucugcuuugaguguuagaaggaguugcagaggcauagauuagggcuuagucagaagaaaauagaaguccccuugacacuuugagucucugacacagacagugcacucuaaauacccuuuagaagacugcgguggguggggauggguuugcucucacuggcugcucuggcuggaaacccugaagggcacucacuuuccuuggauuccugucauugugcuggagcgcgcacuugccaugacucacauuguacaaauaaucuggagaauuucuuuuaaaguaccaaagggagugauagagucagcgagccacgaaagcagggaggaaggcuacucugggggaaagagagaagggagccgggucacagggcaggagacgacuaagaauugaguguagugaugcguaccauguagaugcuucggggaaagccuuuguauacuaacucccaaaaagaacuucagccaacucaggaaugcugagagcaggagaaaugucuuccccagagaagagcacaccacuggcuauccagaaauggcuauccaauaccuaguggucagcccugaaaacauagaagaguaaccugagcagaugauauauagaagcauauacauguacauauaugcauauaauaagaacuaaugaaaaaggagaccguaaauguaaaagagaacaaggaagaguauauugaagggcauuaugggaggaaaugggaaggguacaugauguaauuauauuauaauuucaaaaauaagugauagaaaaguuuuagacuaauuuuuuuugaaaaauuagcacaaagcaucaccaaauuacaccuuguagauuugguagacauuugcauaagcuccuguauuagcuucaugaaaucauauuuacauguaagaaaugcaggauauacuggaaacaugacagagcaagacaaagcccaaaaaagcauuccuuugaauagucuauuuagagguugacaacagucauuauacuaaaacuuaacuguccuuaauaauccagugagcuguuaccaaauuuaaucagaugaaaaauucuuacucaaaagaguucauuaaacuggaagauguaaguuccacaucagccucuguaugguuaacacauaaaaauggccacuauuaggcaguggcagaacugggugaaguugcuuugaguaaaguacucaccaaacagguucuccuuugaaacugcggcaucccuaugaaucugcuggauuacagagucaucucccuuucuuuuaagccauugccuuuaucuguucucaguuagggcaagggagaugaagcugucuugaggcuguaaguucaaggaacugccuacuaauaauuagagaauaagggaccacaaagauggcucagagguuaagagcauugguugcucuuccagaggacccaggaucaauuccuacaggucauaugguagcuuacaacuacuuagaacccuaguuccagagcauucaauguccucuccuggcaucuacagccaccacgcaugcacauaguguacagauacgcauacagggaaaacacacacacacaucuuuuuaaaauaagcaaguguaagauaaggaaugaugguaaaugcuuucuugaagaaugucucucuugcacucugugucauguacguauguagcucagaauugcugcuggguuuucauuguccaugugguuuggcucgccacacugucucucguggacauacaggauggagacugugcuaagagcaguguacugauuccauuuguguaagcagcucagaaaagaauccacacuuaacaggccuaaaggagguauuguugcuguucguccccuccuggcuccaaagugggguuucuagaccagcuuuaaguuguuuucaaaugcaucaacacuuugucugucugcauguucacaucacucuucuuugucauuguugauuuauuuuuauagugcuuucgugugcuaagggaaaauuaggccauucccuagagaagaacucugcucguucuauucuuaacugugugauugcacaaucgccccuguucuucauugucuuggucaagcggugacuggaaaaaaaaaacuguuuaaaaugccccaagauagaccugaauugaauuguuaagaucauucucauguguggaguuacaaaguuuuuaaaaagaauaacuguggaaacggauucaggcaacaguugcuuggaagaaagcugcgagguugaaagccagguugucuugcuguguuuguccuugcaaagcacauucauuaggagauagauauuccgagagcuaccuggggaaaaaagauuuuaaaggaccucgucuuuauauagcaaaaaaacaaagagcucuuucuuauuaaagguucuaaacuauucuuuuagaguuuugguuuggggcagaaugggcuguuucugugagcugggccuuccacuucccagcacucucuauggugcacucuccagaagaaagggcacuccuuaaagauggcccgagagcaaagcccgggcugccuugucauaguaguuuccuacagcuucuccagaggagaaauaccuccuccuagcuggagcuagucacgccuccaguuaaggagccguggucuuaugcaucuaccucauugcagaguccugcuguuuucucugcuucccacucuaugaacaggguggaggguuuggaugugaccacuggguccacuguccagugaggaaacuggagggcuucagaguaagcacuuaggauauuuucuagcauuuugauacauuugaugaaucuaacaaaauauuuaaaaaauauuuuaguuuauuauuugauaacaucuuaugcguauauacuguauuuugguuaucuucaucccugucaccucucuucuccccuaguucucucugaacccuucuuaccaacaaauucccuuccuacuucuauguuuugugagugugugaguguguauguauguauguauguauguaugugcaugcacaggcauguucauuugugcaggugugcagguauauguuuggaggcuagaaacugucagguguccuguuauaccauucucugccuuguuaccuugacacugagucuggcacugaaccuagaacuugacuaacagucagcaaucccagccacccuccuguaucugcaccccaucccucuacuugccaggcacuugaguuguagcaucugcauacuuguguccagcucguacauggugcugaggauuugaacuuagaccucauguuuuugcaguaagcaguuuuacccauagagcugucuucucagcuuccagugccaaguuucauguuguuguacaucccaucauccuuuggugcugagccgccuuaugcuuugcucuguuuugauuauguucacucaucaacuuuauugagacagaguuuacauacaguaaaguguaaagugcagccgucucaaguuuuggcagaaauacacacguguguaacccauacuucaaucucuguccacaagagcauugacuccugcuucuuuacagcaugacucucugccugcuguuuuucugugcccugccagguuagccaccagccuuccuucuucaaguacuuuugggagugguggacuaugucaaagcaagcccugcagugaagcagcucuagguguucugucugggguccgccauagcaguuucauuuaauaauauaucuccaggggcucacugcugcaucucaguacuuaugucucguuacaguugacuugugaaauauagccagauagccuuagaucucucucucucucucucucucucucacacacacacacacacacacacacacacacacccuuagaaguuaaauauuuauuucaaaggcucuuuuaagcuuacacauuuguuucucuguggauuuguucagggaccagcaucuuugcuggaagguaaaagagcaaacaccaaauugcuugcuuggcuguggcacauuugaaagcccauggcccugcuuucuaguaacuggggucuaugaaaguccguagcuguuuuuugaaauguuagaccuguguguagaugccauaaaguaauuaguagugccuugaaguaauuaggaggugaaccgauuggauugguaaggggcaagccuuggcuccagagaguuguaggggcggagggagcuugagcuaaggggagcuacacuaugaccguuugccauucuccuggguuuuuuuuuuuuuuuuugaauggagaaaugggaaugucauggagccugcagagcacuggagauccugccagaggcuggcuugauggcugcugugguguuuagcagugacacuguauggcaugauauguccuaagugcuuggcauuuccauacauugaucugggcagaagaaucaauuggugcccauuuguuucacuuuuuacuaguaugagccacugcauguuuguuauuauuugaaacuugccagauaagaaaacugugauuucaaauucuccuauuugcaccacagucacgugcacuacugaagucuaaaagccuggguaggugcagguaagugccauguagggucuuguguggugaccauauggcguauccuuccaaauggucacacuugggcucaguguggcagagaugcacgaggguccacuggggaaagacaaacauaaagugucugccacugagggaaaaccuucaaaaaauauuuggcucuuuuccugaacauaauuaaauuuucacuaugcuuuucuuuugccagaaguuuaaugauuuauauuuaauaauugaaaugcaaucagugccccagacuugcuccugcuugaucaaagagacaauaucuaauacaagaaccaacucacguuuuccucuucuuuuuaacuuuuguuuuagaacucagccaaaaaccauguuugcccaaguggagucugaugaugaagagucaaagaaugaaccagaauggaaaaaacguaaaauuugaagaaucucguugaagagcuauuugcauggagcaacaggauaggauacaguguuuuuuuuuucaacccccuccccaaugcuuaugaaauaaaaauacauuuuuacaaacagau

SEQ ID NO: 7675 - RNA, 750 nt, Mus musculus
guggcaacucuuuuuuuuuuuuuuuuuuuuuuuuuuaaacagacaaaggcuuguuuucuuuuaaagacugauccaugugaggccacagccaggccgcuauguacagacaggagggaagcuuuauuucuuggucucuuccuccuuggacagagucuagaugagcucuuccuucuuggccuggaggcgcuccucccggcgcuuucgugcuuccuuggucuuagaccugcgagccucagccuggucagccaggagcuucuugcgggccuuguaugccuucagcuuguggaugugcuccaugaggaugcgcuuguuuuugaacacauuccccuugaccuucagguacaggcugugauacauauggcggucaaucuucuuggauucccgguaucuccugagaagccggcgcaggauccucauccuucucauccaggucaccuucucaggcauccgagcauuggcaguacccuuccucuucccuaugcccauaugccugcccuuccgucgggccaggguguuuuuccggcaaugagcccgggaauggacagucacaggcuugcagaugaucagcccaucuuugaucagcuuccugaucugcugacgggaguuggcauuggcgauuucauuggucucauugggauccaaccagaccuucuuuuucccccgcagcggaggacacuagaggcaagccucuucuguagccugagcauacucauggcugcggccgcagcagcgaaaggcguggcaacucuu

SEQ ID NO: 7676 - RNA, 52305 nt, Mus musculus
cagagcagguuggguuauaggagaggaacagagacaaagacaugguugcaagaugggcaugacaaggcgguuauaacaagguaggcauagaacauucuuguuucuuuguuuggguuuuucgagacaggguuucucugcaugacagcucugacuguccuggaacuugcuuuguagacgggggcuggcauugaacucacauucggccuacgucugccugcuaagugcugcgauuaaaagcaugcaccaucagcuccuggccauguaaccuuuugaaucaaaguaggguugcaagaugauuauaaacgacuuuuugaaacaaagacaugauugccauuccuggaacacuugguacagaaccauuuguaguuaaggcuguggggagcggggcauaggcuaaucccugagaaacagagguuugauuauaaacaggcaugaaccuaguuuguuuuuuauuguaagcugucuuuuaaacguaagauggaggcaggcugauucuucgaaaggucucaguacauagcccagucuggcuuccaacuacaggugccugccucuaugccuggaccuugagaggcauuuacuuugucucuguaaaaguguaguaauuugguauucccaacagcaggcacgauuccugacacaguacauacucgguuuccuagaaucagaccaucuguugaaugcauccauuauuuaauauccuugugcucugagaugagaacagauggaucagaugaguguucucccaaggcaacaagggagaaagguauacagcaagaacaaacacuuuuuucuucuuuuucuugagacagacucucaaguuuacuacaaacuugccacacagccgaggaugaacuuauccuccugccuccacuuccuaaauccgcuggcaggacccaucacacaguaucucccuucccgccucuguuuguuuugaguuaggaacacauuccguagcacgcuaucuggaacucaccaaaugacacaguaauccuuuugccgaaaccauaggacgcguauuaacaggcaugagacaccguccaacgcugaccuccaaccaaaaaauuucgcaaagccacaaagccaaugacccagacacgcacaugggaaaauucaauaaauucuuucuugggggccggggggggggguggugguugagacaguguuucucuguguagcccugucuguccuggaacucacucuguagaccaggcuggccucgaacucagaaauccgccugccucugccucccaagugcugggauuaaaggcgugcaccaccaccgcccagcaauccaaugaauucuuaauucacccccauuauuugaaacgcugugaguuucuggcucacagguaaacuuucuggaacuagcgaucaauuucuaacuacuguuagaaguuaucagggaaccacgguaauggaugugugccacucuucagccgucgccacauuccaaacuggggguggggcucaaagcaaagaaucagcacgcgcgaugucaccaccgcacaggcgaccgcaaggggacaucaaccccacuccagcacccgaaguuccucuucccucucccccccgccccgcccccaguccccuccccucucccguauccucuucccuucuccuccucccuucccuaggccaucuccaaauucaacucuagucuccucccucacgccuucgccaauguccgacacucaacugcuuccucuucccgucccagaagcggcgucuuccagugccggggaggacgaaccggaagugcgucaugaccuggcgcccaguuauucguuuuccgcgcgcguuccgaggagcgguuuugggcucucuucguuuuucucacgguucuccacggguuuggaguguuucuauaaggcgguggccacgauugccgacaugccaucggugcugggcucuaugaugguggccucuacgucggccgccgccucccugcaggaagcuuuggaaaacgcggggaggcuuaucgaucgacaguugcaagaagaccgcauguacccggaccuuucugagcugcucauggugucggccccaagugagugaucgguccacuggacgcucuguuuccccaccauaggauucuaguccgauuccccugucuucuucucuguacguuggugcccucgugaacauucagagauuagggcuugguuucuugaaaacacgacaaacagcaaccgacuuuuagcuuuuauugcuuauuucuucuugucuacacuuuauuuacuguagauacucgaggagguaagagcaaacucauuaaguccaaaugagaagaauccucugauccagauuccauuucugugcauuuuuugcuucgauaaugcucgcucagaaaagcaagcgaguuaauuuggaaaucugccgcguucucucagagucaugucauacguguagaguuaguauauuugugagugccgggacuaacuaggaaagaaauauaggggucagaaggcuaacugacagggagagcagaacuaaguuuaucugccaacagaggagauaauuuggaagaauuugccuuaacuuuuaaaacuuguuaccagcuaaagguuuguggaguugcauuaguugcuacaaaauguuucuugugaaaugaaaguuggagaaaaacagaaauguaacaugcaggugagacuuggugagaaaaaaaaaugggugggaguaacuuaaacagaauaaucaaucaaaaguagcccaaagcacaugagcaaugacuuguaaaaaucuauuaagagauuuuuauuuuuuuaaccagaaauacugacagcagccagauagugguuguccauuccuuuaaucucagcauuugggaggcugaggcaggcggaucucuguggguuccaggcuaggcuggucuauagagggugcuccacagcugccaaagcuacacagaaaaaccuuuaaucccagcacuugggaggcagagggagacggauuucugaguucgaggacagccagggcuauacagagaaacccuggggggggguggggucguugaaaaacccugucguggaaaacugaaaagaaaaauaccagaagcaaagauagucuuuguacuugacaaguauuagcaaaugagcuugccuuuuuuggagcaggguccaaaauuuuauaaaaacuugcuugaccuauuagcugcuauugucuucauauguccaacccccucccacccccgcuuugcuuucugauccucucaaauguguaaucucuuuaauauacuuuccuccucauacuaaucccuuucccuucuagcauuuuccccccucugccuaacaggcuccucccagacaaguuuucucugauagcccuggcuguccuggaacuccguccgagaucugccuuccucugccccugaagugcuggguuaaaggcauggacauggaagccugguuccauccaguucuuaguaaaagacccuaguucuaagucaggcauggugcuacaugcuuuuaauuucaugcucuuggagacagaggcagcgagaucucuuugaguuugaggucaguccgaauacauagugaguucugaccagaacaauaaagugagacccugcuccaaaaaagggaagucuuuaguuucuuugaaaauuuucuugaccacucacauugucauugucaaagaaguuauucuucccuuuuguauuuccacuucauuuccuaugugcauuguucuauugaaauuguauuuuagggcuaagauuuauuuuuagaaagaacccaguggagaggugaacaggaaugguuaugugaaugaaccaugcuggggccaacauaucuaugauuguucagccaugguaaucaguauuuuuuuuuaaagauuuuauucauuuuauguacgcuuguagcucucuucagacauaacagaagagaguauuggaucccauuauagaugguuaugagccaccgucuaguuccuaggaauuaaacucaugaccucuggaagagcagucaguccucuuaacugcugagcaaucucucuagugcaguaaucaguauuuaaugucaguucuccaaacauccuuguauucugaacuagacccugauaagguaccuggaauacuuagguuguaggucagggcuaguguuaaguguccugaaggacaggucaaguagaccagcccacucgugccccucggcucugagucagagagcaagagauaggaagcacaagaagaauucuuuauugagagcagucuggauccccaccaacuuccagugauguuuugcauuauugguauuuauguaugauguauuggucugggagagaaauccaaagaggacaaauagauuguuuggugugaaccuuguuccguuguuuuuaggaaaggaucuaauguaacuggggcuagucucuaacgguugucaggagugaccuugaauuucuaauccuccuaagagcuacagauagagguuccugcuacuccagucuguuugaugcugagccaggagucacggccagggauucaugucugcugcacaaaaccugcugagcuccaucccacucuugauuacuuccucucguuuuugaaaccaguaccugucccacccuguaguggugagcuuucuuagguucaguuugugacagguuagaacuccuucauuucagagaugucauaggcacuggggugacuugacuggcuuaucuauuccuaguugaugagugguacuuuauuguuguaaauaaacgcuuucuuuuaucuuuuuuuuguguagacaguccuacuguuucuggaauguccgacauggauuacccucugcaaggaccagguuugcugucaguacccagccuuccagagaucagcacuauccggagaguuccccucccgccugagcugguugaacaguuuggacguauccuauugcuuuguauuuagcuauuugauaaauauuagauuacucaguuucguuauuauaaaucuuuugggggggggcuugucaagacaggguuucucuguauagcccuggcuguccuggaacucacucuguagaccaggcuggccuugaacucagaaaucugccugccucugccucccaagugcugggauuaaaggugugagcuaccacugccuggcuuuuuuuuuuuuuuuuuuuuuugcauuauuauaauucuuguuccauuuacauaauguuuguaaguuauuucagaguucucuuuuuagagccacauguauagcucauuugucuggcaugccugaggcccagcuguucagaccuuucauucucagccaugcauggugguauauaccuaugaugccuccagagguugaaacaggaggauuuggcacucuuguggccuaccugggcuguuuagugagaccuuucuugaaaauaagagugacuagguaguuugcuuucuuucuguuagauaagcaugggcauggugguccacaccuuugauucuaccacuuaggaggcagaggcagguggaucuuuaugaggucaagcccagccuggucuauaauagugaauccaggacagauaggcagagcuacauagugagacugugucucaaaaaaaagaagaaagaagggggaaaaaagagggagggagggagggauggauggauggaguaguuggcguggguaaaugugguauaagccugucaccucaagauuuaugaagaugaggcucgaggauuacagcuuccaggcuagccugagcuaacagugagacugccucaagaaaaaagaaaaguguuugcaacuggagaagauucagcaguuaagagcauggccuguucuuguagaggacccagauuauaggcccagcaccuacuugauggcucacaccugucgguaacuccagucccaggggcuccaaugcccuugucuggcauccaugggugcaggaacacagaugguaugcagauagguaugagguguguguguuuaaagaaaaagggagagggaaggaaagagaaaagaaggaagccucauggguacuaggcaagcucuguaucacugagugguaaaccuaaaaggucacuuuaaauggcaacuuuuaagucuaaagcuauggaacggauugagaaagcuaauugcccucugcaccuuacaucguccgugcguccucagacaugcagugcaacugcaugaugggcguuuuccccccgaucagcagagccuggcuuacgauugacagugacauauucauguggaacuaugaagauggguacguaugggaggcugcucugggauucugcuaaccucgacugcuuguugcaucucguguucuagucaauguuugcccguguauaccagucaucuugggggcauugaagucuggguuugggggcuagggagauggcucaguggcuaaagugcuugcucuauaagcaagagccugcacucagaugcuggggucuugcugagcagcugguuuagcugaaacagugagcuccagguucagugagagaaauugucucaaaaguaaagaagacacucaacauugacuaaccucuggccucauuacaugcacacacucuagcucacccaugcacacucauucacacaugcggauucuguuguagcaauuugucacuaauguucuugguuuuaguacugcuggagccuacucauggcaagcacuccauggagcuacguccccuacaaaagacugcucuuguuuguuuguuuguuuguuugguuuguuauuguugacugguuugcauguuugucguccuggggguuaaaccugguguccaugaaugcuaggcaaguguucucucauugagugauauccccagccuccagaguacuucucuuaagaagcaagcacuaguucuaacuucauagucuguaaaagaaauuauacauugguacuuuugagcuaauauuugacauuuuaauauuuuguacauauggggggagguggguuuaggugugugaauauauauauauauaccacaguauauguauagaaaucugaaauucuuucuaccauguggauccuggugguggucccuuauugacauuuuaaagacuuuccuugcauuucuauggacuaggaaucugauaauucaggaaaugauuauuugguuauuucauggcuuugacuuucuguguaaauuaaauaaauagaauguauaaaagccagaaguuccuuaaguagaguagugucuugaucuggcugcucaccuggcuggagaggugaguuuuguuuuacuuguacuuuauauuucaguuauucaguucccuauuuugaguaaucuaauuauccuuauugagauagcagaugccgcccauguaacuacaagaguaagcuguuacucuuacauugaauaaccagugcuccuuuuagaaucaugcaugugcaugcaaacacauucaaaauauuuaacuacaucaaaacugauaccauaugaccacuuacauucugcagaaaagauacuguuuuuacuuuccaaaccuaacaugcauauuuaggaccuaaaugaauauuuagcaaauauuuauccugagacguggcuaugccuugccuccccuuaggcuaggauacaauggguaagccuuuauuacagcaaggguuggcuuuuggauuuguuuguugcuguagucaucucaguagcuuggguuucugaauuucuuuaaaauuucccugugucaggguggagaauuaacaguaaacucugcgcuccuucccagagucuagcccccgucuuagcaggccauugguguucacuugauagccauugcuugcagcccugaugggcgguuguuuagaagguaguccaccuuuaccuguuucucuagcuuagccuuacacagcucuauagccugacuauuaauuuuucccuaguuuuguuugcuguuuuagguuuuuaguauauaucuaaauuuuuuucaacuaauaaagagcauuguaaauaugauuuaauauauguaaacauguuuucuuuacuuuugggcagaggugaccuugccuauuuugauggacucagugagacaauucuugcuguggggcuugugaaaccaaaagcugguaagaaguaaaacucucaggaugagauuguaacuguucagucucccaguguuuucgagcugaaucaggaaaguucuaacucuucuagugccuggcagcgaccacucuacuuuucucuauaugaauagguuuucuccgguaguaguugucguuuuguguccggcucgcucuucacagauaacauuuguugggugugucugaauuugccuuuccagcgaggugugguggcgcaugccuuugaucucagcacuggggaaaagcagcucaaugucuucuucagcuaaaacacaauguugaggcuaccuuggcuaccucacgcgcugucccccaaaacuuccuccucuguauagcaugcauaugcuacauuuugcugguucaucugcugaaagacacuuagauuacuuuaaucuuuuagacuuuuggauaguuuuucuuuuacuauaaguauacaaaugcaaauguuuauaguucaguaaaccaaaaucuauuaagacacuuuuuuuuuucuuuuuuugguuuuguuucucuguguagcccuggcuuccugggacucacuuuguagaccagacuggccucgaaaucagaaauccgccugccucugccucccgagugcugggauuaaaggcaugcgccaccaugcccggcaagacacucuuuuuaaaugacaguaauuguugagccaguuauuuccuaaguuaguuuuuccuacuguuuauguacuuuaauacuuuaacauaguaauauuuaagcaucagaauuugcuggccuggauucagaccuuuacuguuugguuaggaguucacuucaauggugaaaccguauuuuauucaugcuuaaauuuaggugagguguuuuucagccuuugucugcuuugccauaggcaucuuucaaccucauguaagacacuugcugguuuuggcaaccccuguggauauaguaauucuuggacucagcuaugcuaauguacaaacagguaugguaauccacucauauccuaaauuucuaaaaauagcacugucuugaagauuaguauuauaaugcuuacaauaccagauccuuacacugguuugaguuuguuuuuuuuucuuggauauuuuauugugugauauauaugugugcuauaggugcaguuuaagaggaauuaccaaauucuuuugagugaagcucugcaugcgugcauuguuagaaauugaguucguucggccuuacauuuagaauguaagcacuuuacugcuaaacaacauccuggccagaguguuaaacucuuuuauaucuauuuguauuuuauguguaugaguguuuuugaguauacaugcauucuauuuguauuuuauguguaugaguguuuuugaguauacaugcauucucugugugccuggagccugaggaggccagagaauggauggaguuagaucccuuagaccucaagugacagguguuugugagcauccauguggcugcugagaacugaaccugugccuucuacagcagcaucaagggcuccuuaaccacugagucugagucaucuccagccccucaagcuuuuauggaaacuuuauaaaauauguaauuugggauauuuuaguaagaauuuaguaaaaguaccaguuuuuaagauaaugugaaaaucauuuuagccuuucaaaaagcuaagaaacugguuuuuccuguugcaaacauacagguucuggcauucucaaugacagcauguguggcggcaugcagcugcuuccagaucccuuauauucucuucccacggacaacacguaccuuuuaacaaucacguccacggauaauggcagaaucuuucuggcuggaaaggauggcuguuuguacgaaguagcauaccaaguaagcuuuaacauuuacaaacuuuuuuuuuuuuuugucuuuuacucagucgcaaagaaaaagcaaagcuuuucuuugaauuuucuaauugcauagcauauauuauuagggagaauauugaaacauaaaugucagugucuuggagcucagcucagaacguuccaacuguuagacacgcaccgugucucugagcugcagcgucagcucuguacauggcagcccgacugucagcccgacuggugggugucuguaaaggguuccucauugcuauaugugcauuuacaccuguguacacguguuuguggauggacaagcagacaguacucuuuguaaauguacgucuuuacuuagguugccguuaucuucacaauuggccucucauugaauuuuguguguuggaaggcauuuguuguauuuaguaguuuuaauuauaaaagaaaacucuguaggucauuuugaaaaguauguuucaguguguucaccgucacugcggaagccuggaggcuggcaggcuuuacuaggccugaauacaguugucuucuuacguggcauuucaaguguuguguuguuuuuccuccaaggcagaagcaggcugguucagucaaagauguaggaagaucaaucacuccaagagcucgcucuccuuccuggugccuuccuugcugcaguucacguucucagaagauggugaguagcaaacacauuugacaaggaaaacaagauuuucaugcuucaagaccuaacguuuucuucagaacuuuucauccuuaguuaaaagcuugucauauuaaauugcauuuuuuagaugccuaugaauucacuuaaagacuagaggcauuauaaaauggaaaaaacauggauuuuauucucaaguugucuccuaaaaacuuugguuguuccuggaucauauguucaaaacagcuuuccuaccuuaaccaaaaagugugugucugucucuaugugugucuuucugucuucaugcauacaaaaguaaaagagacuaauuugcauaugugauaaagggucaaggacaaauucccugcuaagcuuuuuaucccuaaguuuuaguguuuauagaaacauaaauuuguaggauuaaggcgugggucaccacagucuggcuagaaugugcuccauaucacagaguucuucuacccagaugucaugcuuuguucuuauuggaaaacuagaaguguuucuagaauagaguaaaugauuuguuaaguauuacugaacuaagcaauagucuaaacugggcauaguggcacauaccucuaauuucaguucuugacaggcagagacaugauaguuuuuguacauucaagacuagccugggcugcauagcaaguuuaaggcaagccagaagugcauagugagacucugucuccaaaaccaaauuuuaaagaguuaaaaauucacuuagaagacagaauaaguugcuuuuguuuucagacagaguuuuguucuauagcccugucuggcuuuguaaugcugauguauuucucagacugcaugcuagggugacuggagagcagcgugcagcacugugccugacagugugaguuguuuaugacacccuacuuguguaaccuaauguuccugguugguccuuauugcagacacuguguacgauauugaguaucacaggcaagcaggagagcaggaagccccgaaugcagauccgaaugcagcaguuuucauuugcugugaaugggcccuguguucaguugagaauccucagaguuaguuguguuuuucucucuuguuuuuuuuuuuagauccuauuguucaaauugaaauugauaauuccagaaauauuuuguauacacgaucggagaaaggaguuauacagguaaauaugcauguuugcuaugauuuaagauuagaaaagcauuccuguuuuguuuccuauuuuuuauugguuauuuuauuuauuuacuuaucaaauguuaucuuccuuccugguuuccacuccacaaccccccucccccuguuucuaugagggugcucccccccacaacucccauuauuuucucucuuuuuuuuaaaagauuuuauuuauuauuauauguaaguacacuguagcugucuuuagacacaacagaagagggcgccagaucucauuauggaugguugugagccaccaugugguugcugggauuugaauucaggaccuucagaagagcagucagugcucuuaaccgcugagccaucucucuagccccucccauuaguuucuaacuuugaaaaaaaauauuguuuuugugcggacaaauguguguaugcacaccucugugacacagcccauguguggagggagaggauaacuuagaguuaggucuuucucugcugugagauccagagaugggaguuaaggcgugaggcuagaaguggcccgugccuguagccagugaauuaucuuaccugcuuacaccgcugucuuauaaggaagacuugaguauucaaaccuccugugaacugugaacuuuguuguuguuugagacaaguuuuccugucacucagacuggccgugagcugcuucuguagccaagauugacuuugaacucuucugcuucugccucccaauugucugccauugcuccugugugucaccaugccugccuucaucugugugcuuuugcaaguaaacaccucaaaccauuucuuaggccauuucuuguuguuuguuugucuuagugagauuucaaacauuuuaauguucaguaaaugccaaauuaacuaaucugaaagagagcacucgaacuucaguauacuguguaugcugugcauuugugucuaagggagaauccuuauauaauccaauaugcugugugugcuguguaauugugucuaaggagaauccuuauauaauccaauguacugugugugcuguguaauugugucuaaggagaauccuuauauaauccaauguacugugugugcuguguaauugugucuaaggagaauccuuauauaauccaauauacugugugugcuguguaauugugucuaaggagaauccuuuauucccagguuuaugauuugggccaugauggacaggggaugaguagaguugcuucaguuucacagaaugccauugucucugcugcuggaaacauugcuagguaaugugugcuuuacugucaggaauucauuugcagacauauuuaugcuguuuguguauaguaccuauaauauguuauauguucauuguauaacauauaauguguaauauauacuauacuaagauuaaauuacuccuucaaauaucucuaauagauuauugaaaucuugucacuucagacuucucauguugguugaaaucauaagguuucuuacugagugaaaacuuguguuuuacccucuuggacuuuuucaaaggcacugagaaucaaauccaaagucuccuucauacuaggcaagcauucuaccacuuagcuagaccucuagccuuuuucauagugcuaaacucagguucuuugcagcaaauauuguagagguuauaacacaggcccccuacucuccccuuacagcaagccuacaugguacaaauuagaaagaauuucauagcuguaauauccucauauaauucaugauaaaacugaaacuaaaggauauaauggauuccuuuggccucuuacagagcuagaauccaauguggagucugaggaauuauguguuggaugcugagcuaauuggugcaaacuuccuaaauuccuuagugaucugcagacauucuccucacuggaggucucacguuugcuaauggucuuuguagugguuuguaaagagggcuagucuuaaaaccauacaucuacuguaguugugcuucuccugcugcuacuauguugcuuccuaagggauuaaucuuauuauuuauugagaugaugccuaucuauuuggccauccuggaacucacuacauaaaucaggcuggccucaaacucagagauccaccugccucugacucuaugugcaagggcuaaaggcaugaacuacuacaccugccucagacuugacuuuuuauaaauuaggaauaaacuucaguuuuuguuucuuaaaggacuauugaucguuccgucuuuaagccaauuguucagauagcugugauugagaguucugaaucccuggacugucaguuacuggcugucacucacgcagguacgcuugcuucucuaucugcuguccuaccaguuuucaugauccucggguuggagguguaugguuagaaaugcuucacucucucauuaguuacuaagaggauguugagaauucuuuauuagugggggguaacucuuuucucuccuccuauugugaggcauagccagaccaggaaagugaaguggcuuauguuuagugacagaaccuuaacugagacacggcuugccuugacuugucacaaguucuugcuacagaaauauaccgagucacugcucaagucuggacaucuucuagaacgugguuuaauuggcuauucuaucauuuuaagccaaugaggaaauuggugugugcuuuugcagaagucucugugucugugugucugugugugucugugugucugugugugugugugugugugugugugugugugagauucuucagcacacauguacuacuucauguccucccuaaugcauauguuuaccuccucaucagguguaaggcuguauuucagcacuuguccguuuagacagccauuagcucggccgaauacacugacacugguccacguccgguuaccuccuggauuuucagcaucaucaacaguggaaaagccuucaaaagugcacaaagcacuuuacaguaaagguaagcccugagaugcuguaagguuuaagguucucaaugucucagaaggauguaccagaucugggacuguagugcuuacagcugccuuugagcugucacaugacgugggagcugggaauugaacacagguucccugcaagagcagcaagugcuccuaacugcugagccaccuuucugagcaccacgaccaccaacauuuuuugagacagucacacucuauagcccuggcaggccugggccucucuguagaccaggcuaugcuugaacuuuuagaaaccuaccugucucuaccucccaagugcuaggauuaaagaugugcaccaccacaccaggaucuuccuacgugauuggucuaaacuuuuccuuugcaagaaguuuuuucaaauaacuaauaccauguaucaucacaaacucuuuaaauuauaacguuauugacauuacucaaauuuaaccuucuaaaguaugaaaaucaguguguguuaguuuauucagacuuguacagugaucaccacuguccaacuuaaaaauauucuaacaauuguucuagcccugggaaacuuuaacgucccuuuccuaauaauuuguccacuugggauauuuuauauaaauagaauacaugauuggcacugaguugcacuaaacacgauguuuuaaagaucgaugaugguauaauggguauuagcacugugucaccaauuuuaaaaaauuaucauguguguagagguggggauaguuguuuguggaaacaagaggaccucuggggguggguucucuuguucaaccugguagguuccaggaaucaagucagguuaucaggcuugauagcuggcaccuuugcuuguugggcucucacucccagaugcugggacuacaggcuagagcuaacaugcccugugcucccuuuuucuuguugaauaauguuuauuuguggaaacuguacguucacgucaucucuacuuuguacugugaauuacccuguuccuguaaguguuuguguucaagcuuuuauaagaacaucuguucauuucuaugggauugaaauuguuggaucaugucgucacuuugcuuuuucugugauggacucucaggcugucuuucuaguaacuaggccagcuaacauuuuugcccauuguagaaggcauacccacuuuggcuacauucuugccaauacuuguuucugguuuauucccaucuuacuagaagagaaguuguuuuuuaucugauggcuaaaguuguuggguggcuuuccagguacuuacuagccaguuaccuuucuccuuugcaagacaaagcaaaccauuucuaagccuuuauuuacauuuauuucucuuaauugaguugagaauuuguuguauuuucuagauaaaggucccucauccaaagacgugaucugcugauauuuuugacacugguugacugucauugcaucugagcauccucugugugcuuuaucacuucacuguuagauuuaguaggguuucccuuuaauaugaaaaguguauuuuaugcuggucucagggauagcaugaaggaguucacuccucccuccccugagcagggucuggggucaaacucaggucaucugucucugugacaagagcuguauuugaucaagcagaggaaagcaugcacugguaucuaugucuauuuuauucacgaugcauuuaaauucacuguuacauagacuauuucgccaacugaaaaguuauugacuuaaaaaagauuauacugaguaagcauuuauaaguuaaugaaauugauaagccaaucaauuacaaaauauguuuuaacccagacacucuaaaaauaaauguucaguuuauuuacaaacaguuuuagaaagcuagcugauuuucuccaugcaccguuuauuuaaaaacaacauccuuuucuuuccccauuagacuuuuucugccauuguauagauuguaaauguugcugauaauugcugaggcuauugcgagggcagauuauuuaacaucauauaagaguauucuguuuguuuaccuuuuaggaauuuuacugaugacagccucagaaaaugaagauaaugacauuuuauggugugucaaccaugauacauuuccuuuucaaaagccaaugauggaaacucaggucaguagcuuugagacuuuucguaaaaguucugugagguguuggggaucagacccagagucugugcaugcuaguccggcuuucaacuguguagaaacauccauacuccauaagcauuauaaaggagagauguaaugguugguaacucuaucuuccccauuauggcuucuuccauaguaauauguagauagaacucuuagaguggcucucaugacauggccccuagcuugaggcacuugaugcucaaucaggaagacuggaauucugaucccagcguucucaucagguggcuuacaaacaucugcagcuuuagcuguaagaggucugaugcccucuucuugcuuccuugcauacuuacacacuaaugugcgcauacaccuaacagacacagaccugagcacucgugcacaaaaaaaaauuuuuuuuuuggguuuucagauuuaauauguauuaguacuuuuccugcauguaugaaugugugugugucuguguguauagguauguauguguauguaugugugcucugcgcaugccuaguacccacugagguuagaagagagugaagggcucucugcaacuggaauugcaccaacacauauaaaugcuggggaucaaaacuggguccuccccaagaagagcaaguggggguuuuggagagguugguuuuuuuuguuuguuuguuugggguuuuuuuuuugguuuuuuuugcaaguguucuuaacucagccaucucuccagccccaaagaaagcaaucuuuuuuguuuguuuguuuguuuguuuuuuuguuauuuaaaacaaguuauaugucucuuuuuuuaacucuuucuuuuuuuuuauuuaauuagguauuuucuucauuuacauuucaaaugcuaucccaaaagucccccauacccucuccccccacacacacuccccuacccacucacucccacuucuuggcccuggcguuccucuguacuggggcauauaaaguuugcaagaccaaggggccucucuucccaaugauggccgacuaggccaucuucugcuacauaugcagcuagagacacgagcuccggggguacugguugguucauauuguuguuccaccuauaggguugcagaccucuuuagcuccuugauuacuuucucuagcuccuccauugggggcccuguguuccauccaauagcugacugugagcauccacuucuguauuugccagguaccggcauagccucacaagagacagcuauaucaagguccuuucagcaaaaucuugcugguguaugcaauggugucagcguuuggaggcugauuaugggauggaucaccggguguggcagucucuagaugguccauccuuucaucucagcuccaaacuuugucucuguaacuccuuccauggguguuuuguucccaauucuaagaaggggcaaagcauccacacuucggucuucauucuucuugagucucauguguuuugcaaauuguaucuuguaucuuggguauccuauguuucugggcuaauauccacuuaucagugaguacauaucaugugaguucuuuuguaauuggguuaccucacucaggaaaagaaagcaaucuuagaguaaagaaauauaucuuguaauucuuuuuuuuuuuucgagacaggguuucucuguguagccuuggcuguccuggaacucacuuuguagaccaggcugaccuagaacucagagauccgcuugccucugucucccaagugcugggauuaaaggcgugcaccaccacgcccgccaucuugguaauucuuuuuuuuuuuuuuaagauuuauuuauuuauuuauuauauguaaguacacuguagcugucuucagacacuccagaagagggagucagaucucgugauuggaugguugugagccaccaugugguugcugggauuugaacuccugaccuucagaagagcagucgggugcucuuacccacugagccaucucaccagccccgguaauucuuauuuuuaacucugucagaucagaggugauuauaguaaucacugaacaaucagaaaucuuucuuuuuggcaguucucauuagauaacccuagaugucuagacuagacuaaccuugaacucacagagacccggcagucugcaucugaagcgcugggauuauaggcauaccaugcuuguuucuaaaaauguguauauguuuguguguguggcggugguggugguaccauguuucucugugaaagagagccauugcuguccuggacuuguuuugucgaccaggcugcccuugaacacacagaguuccaccuaccucugccucccacacacugggauuaaagaugugcgccaucacaccuggcgagaguuaguuuuaauacauuaaaauaacucuuugggcggcacuacugugaacccagccaugcuguccugagaucaguucuuggucugugaugagcucuucuuuuucccuccuguguccucugcuuacucuguccuaguuacccucugaagcuuucagaagugcuaaccaggucuagcuaaaccugucgucuccuuuaacguguucuguucucucugcuuuugggggguuugggucuuuauuuguuuggauuuuuuuauuugcuuguuuguuggcucucuauaauuggcuuagaacuagauguuuucgcccagguuggccuggaguuuaugguaauccuccugucagucuugggaauucuggaaucagaagcuucaccaucacaccuagcugaagacuuacuuuuaaguaaaucauuguuuucgacccucaguuuguuacuuuguagaagugaagacacuaguuacaguaguaacccagaaggugguugugagaaucaggacucuugccagguagagaccuaaagaccacucaguacaaccaaauuccaaauugaggaccugauuugaaccagccaucaauuguguagagagacgcuucucacagaaagcguuuuacagggggcacaggcaaggaaccgaaaaacuacauccuggcuggcgguugcagggguuuuauaagcaagcaggcaguuuaucagaagacaaaagcauucaguuagcuggggcauuuuaacccccagaacuucugguguaggguucuucuccacaggacagaaaagcaaugcccaguuucaccucucccagaggaccuggguucaauucccagcacacauacggcagcucucaucuuucuuuuuuuguuguuguuguuuuuuguuuuguuuuguuuuuuugagacaggguuucucuguaucuuccuggcuguccuggaacucauuucucuguguagaccaggcuguccucgaacucagaaaucugccugccccugccgcggcccccccccccagugcugggauuacaggugugcaccacaaugcccgguuccucucaugucccgagcuaucgcucucgcaggcaagaacacacucggacaacgcaagcuuuauugcuucuuaaggagggaagacccagacccuggaaaauggugcugcuuauauagcccucagcguggcguuuuagcaccugauguggcaugucagcuugcccaucaccucauuacuacgcccugagaugggcagugacuagguuugaguucacucucacacuugcgcacaaggcuuguuuacuaguuaggcacagcggaagccagcgccaucuuauaauggcgauugcucgcggcacagcucuccacacucucaucuuucuguuaauccagcuccaggagaucugacagucacacaaugcaggcaaaacaccaaugcucauaaaaugaaaaugagcaaucucccaggcagcaguggcgcacgcuuuaaucccagcacugggugggugggcuggcaggcagaucucugaguuugaggccagccugaucuaaaaggcaagaucaaggacagccaggccuacacagagaaacccugucucaaaaaaacaaaggguaaaaaaacuauauacugaguaauucauguugcuggaacuagggaaguuugguuguuuuaauuuuguguuuugauuuuuguuuccuaaaagcuuuggcaugugugacuucaacaaaauaugaaaacaguauauuucuuuuuuauagaugacaacccguguugauggucauuccugggcucucucugcaauagaugaauuaaaaguagauaaaauaauuacaccguuaaauaaagaucauauuccaauaacugauucgccaguuguuguacaacagcacauguugccuccaaagaaauucguucuccucucagcacagguaugugcauagcugcuugccguagugaaaagaagccauaguaaauaugcuggagccggcgugaauucagggacugcugcaugcugagccagcacuacugcugagccaacacuagccagucccugcucugcuuacuucaugcuuuugucaaauacucucagcugccacuucauggaaguauuuuuaagagcuuuauaaaugucuacucuuaauuuucuuuaacaguaaugaauuguccuagaaaguauauaaaauaaagucucccauccagauaucuguguuuaucacuaucuguagauuuacagauacauuaagagaauagaauguaaauauuucuaaguaaaugcuaacauucuauauccugcaucuuuaaauuucaaaaaauauucuuuguagauuuuucgaccuaugcuucuauuuugcauuuggcagugauuuuuuuguguaagugugcccuguuuaacuauuuuuccuuauuuccugagcaucccuaaagcuguggugcugauucugcuuauaccaagcauaugugugucuauauuuuagauggaugcugccaacuuucuguguauauucgcuagucguuucuaggauuauguuucauuguaaccuucccuaauacauuuuacuauccaggaagagugagguuaacuaccuuuucaaauguuuauauuuauugccguauacgucagguccuguucuauauauugaugcuuccuuuucuaugguuuugcuuuccagaguuuuaguuucuucucuuuccccaucaaauguagucugaaaaugaagggaagcauuuguaugcccuaaacuguaagacucugagugcacagugcauucacugcugcugggccccuccuacagccucaugugauguguggugcuucuuucuagucaccuaguggcagucuugguuguuacaccgucuuuuguccugguaugguuguuuauaggauguggaaaaugcaaugcaguuuugagcaucuaaagguggaggagguacuuggaucugugccauggguguaagaguagaccacuguaucaccauuucuuuagaguugucauuuaccaugucaagguuuguuaagauuuuuguaucauagauacuaaguuuuuguauuuuagucauaauuuaacuuugcccucuaaaccuugcaucuguguggaguauauccugguauacugugugacuaaggauccggcuuuauuucuguacaaauagacacacgugauaauaugaccagugaggggcagcgugaggaggacaagguuaguuucugcagacauggaaauugaguguaggucgacuguugacauaagauggucuuguccaccucauuuuguguucucggaguugcuuguuauuaacuuguuguuguuagucaguugguuauuaccagccaggugucuuguguguguuagugaggagagaacucaugggcugugcgugccaggcuaggacucuauccuuaccuacguucccacccuuuaccagucaggcuugguaauugcuuucucaugugaucucuccuuuuuuauuucuuaggguagucuuauguuucacaagcuuagaccuguagaucagcugagacaucugcuugugaguaacgugggaggggauggagaagagauugagagauucuucaaauuacaucagguaacuaugcacugcauuuauuuuaauuaaagaagcuguauaauauuaaaauaguuuguaaacuagaaguaaaauacuguaauacacagauuaucuguucuuuuguacucaaaucagcacauauugacuaugaaaauaguuauguuacaggacucuuccacauuuauucucugauuuugacacauucuuuuuuugguggggggggggaggguuuggguuuuuucgagacaggguuucucuguguaguccuggcuauccuggaacucacucuguagaccaggcaggccucaaacucagaaauucgccugccucugccucccaagugcugggauuacaggcgugcacuaccacgcccagcuuugacacauucuuauuaagguauaaaaauaagaauaugauauugaaguuguaugauaaauaugcuuuuuauuaagagcaccagucauuccguuaugagcaugcacauguguguacauucccaaucccauggaauaaauugagguagugacuggaggcauaauauggggacauuaguaguuaauagucauaucagaauugacagauuuaaaacuggggagucuuauuuaaaauuacuauuuucucauuaaagcuaagcuuuuagauucaggauucagacuaucugcuaaaaaaacuuuuuccaguggagugagauacuuguauucacuuuaguuguauguaaacugcaucauacugcagcacugugugcuauaagaacuaauaaauacugcauuuaguuuguuuguuugacacgggauucucuauguaucccuggucguccaggaacucuguauguagaccaggcuggccuccaacucggagauccuccugccucugcuucuugagugcugggauuaaaggcgugcgccaccacugccuuggcgacacuggauuauuaaaauagugccuagcacauaauagguacucaauaaauguuggguuuuacugauaauuucuaaaagauagaaagauagaaauauacaauaauauagaaaauauagaaagauacaagaauaaaauagaaugacagcugaucagaaucuuacuaaagagaaaguaucuuuaauacugaugccugaguuaaacuuuacuucugggcuguuugcuuucuucauguccguugaauucauuccagaguaaguauuuauugagcacuugcugugagcgcuggauuugucuuuaaugcacugacuuuugcccccuuucaggaagaccaagcuugugcaacuugccuuauucuugcuuguuccacugcugccugugacagagaagugucugcuugggcaacacgggcauucuuuagguaugucaggguggagagagagaguguguguuuauguacugggccaccuuuuaguugcagggggcauucugagaguugaauguagauuuguuuuuguuuucccucaugcuauguaaauacuaagcauucuaccaaugagcuacauccuuaguucaaaaguguucaucaaauacuuuuaaaguauugugaaauauuuguauauaaaagcccugcucuuuuugguuuuuuguuuguuaguugguugguuuauugguacuagaaauuaaagcuagggucuuacacaugcuaaguucaaccucagggccacuaaaaaaauuauuuugugugucuaaauguuuucccugcaugugucuaugcagcucaugcaugcaauuccauugggaaccagaagagugcaguggaugccccaugacuccaguuuuaggcaguugugagcucccaugugggugcugaguauagaacccaaguccucugcaagucagaccugugcugaagucucucugcagccugguguuuucuguugguguuggugguuggcaguguuuguuuaaagacagggauucaccauucaauucagccuguauuggcugagugcugggauuaaagagacaccacuuccaggccacuuuuaaagacuuauuuauuucauguaugugaguacacugucacugucuucagacacaccagaagagggcaucagauccucaucaaagaugauugugggccaccaugugcuugcugggaauugaacucaggaccucuggaagagcagucagugcucuuaaccacugagccaccucuccagcccaaagccucgugacaucccugggugggcuagaaccacuaaccucuccauuaacagcugaacaugcuaacuaauugcgccacagagacacuugggccacuuuuuagaugauaccagugugauaguuuaaggcuuugccaaaugggggaaguaggcaaauuuuuaaccuucauuaggaagagucuaaucuagaaauagaaagauagcagugcccguggaacaagcugaggagcauggugcgcacaucacugcuuucuggguaccuuuccuucuuuguccuuuuguuuuacacuuuuuaccaucgucaguccuccuuccuuacugccuccaacagccgcuuccagagcaugggcaucaguggugcugagggacugagucacacacaggaaggaaacuuggggucagagaugguuuuuuaaauucuggguuuuuuguuuuuuuguuuuuuuuaauguguuugcuuguuuuguuuuugcuguauugggaauaaaccaggacugacuagugaagcauucugccauuaaccuaugcccuagccuucagaggcuuucuuucuauaguauauuuagccagaaguuugaagaauacuuguacuguguaaucguuaaauugggggguagggggaugcuggagagauagcugaggaguuaaaaacacuggccgcccuuuuagaggacccagguugaauuugcugcauccacauugcagcugagagcugucacuuuacuuccaagggaucugacacccugcuguggccucuugagugcaauugcacagacauacauucaggcaagacaccauacacaaaaagauaaacaaauguuuaacacuguuuuuaaaauuugacuaauucuauuagaaagaaagacucugucauuucugcguuaaguaaacuauucauuacaugucuuuuuuuuuuuuuagacauuaguggcaauuuuggaaguuugguuuccuuuuuuucuuuuuuuuuuuuuuucuuuuuuuuuuuuccgagacaggguuucucuguauagcccuggcuguccuggaacucacuuuguagaccagguuggccucaaacucagaaauccgccugccuccgccucccaaguucugggauuaaaggcgugcgccaccacgccccgcuugguuuccuuuuauaaaaaauguauuuucauuuuaaucccaagugugggauaugaugcugcuucagacuguccgaagcagcugacuuuugccucaugcucugagguguggucuuaccaacaguagauaguuucuccgauugugcaacauuugggauuugggaacuuuucaggggguauuaaaugccagggccuugagcggugggguggguuguugguuguugagggggcugaucacauuguuaguacuuaugcucaaagaagaaacaagaagaacaaauuagauucaggggucucaucccuuuccuugcuucaauuccauggaauugaaaggguggaaaaaggguggaagaugaaagaaagaagaacccacaaaaccagcuacacuuaguagaguuccuucuaguuuccugguagcaauugagaucaacauuugaaggauuauccuagauacauauuugcuucacuaugagcaccauacauuaaaguuucuaccaagugcaugaaagcuaagcaagaacagggauugucccagguguacaagauugacaguucaauugaacccauacucuugucacacaaacagguaugguggugaggcacagaugagauuuccagcuacucuuccuacuccaagcaacguuggucccauccuuggcucuccuauguauucuagugaguacaaaaugauuuuuuauuaggacuucuguguuacuagugaauagucucuagauagugacucuugacucuuuggggguuuuuuagggggugggguguuguuugguuuuuguuugguuugagauaaaguuuuccuaugcagcguugguuggccuggaacuugcuauaugcaccagguugucuuugaacucagagauuccccucugcacugucaccaccccugacaguauggaaucuuuaaugcauacuaagaagcaaaauaauauguaaccaauauuauuuagagaccucauuuaguaaucaaagggaaaagagauuuuaaaaagaaaagaaggaaaugaguauuugaaaaucugugugccugguucuugacucuaguagguagcaucugucauuccucggucacacugauauguagcuucuuauauagucaucuugaucacauucaaagcauugugaagguauuuuacaugucucugguuuuuuucuuuugcagguucuccugucccuagugggagucccuauccaaauccauccuccuuggggacaccaucccaugguaccuuuuuucucuucauuuugaaaaacuaacauuauaauuccuaauauuuaauguugaaaggacuaauuugcaugaucccccuuuuuaaaaaaacaaaagaaaacaaaacaaagguugaggaaauaaugcaggugguaaaaugcuucacaccgcgaagacccgaguuugaaccucacagucaauguaaaacagcugagaaaacccauccaugucuauacuucuuaacaaaaccaaauggcuaucuauucauugucuuuacauauuuuccuuuugugucaggauauaccaagugggcuauugaaauuucuaaacacuugcaauuucuuuuuaaacuauuuuuauuaauuugagaauuucauacauuuauacaauguguuugaucacauuuacccacaauuccuuccagaaccacuguccccaacuccuagcccuucucaacguauguccuguuuguuuguuugucuaauagccuauucagucugauuuguaccguccaccuuccacuggagcacgcaaaggccauaauuacccuuagaucccagaagccaugaacuguuaauagggccucagcuagaggcaggggcuugugagcccuucucucuucaugcuggaauauugacugagguugagagugcagcagcccuggaaugugcucucucucucuuuccccugggucuuucugaccucugguucuuguaggcuuuucacaccguuuuccacagucucugugccuucuggugguggguugggguuagacuguguuauagauaugccguuugugacuagagucucuacagauacgcauucucuacauuucaaccucugcuuuguuagccaccaucucuggcacaaagaagcuugucuggugaggccgagagcugcacuggacccugugcaugaagacgugaauauacaaggcugucugauaacugugucuacuuagcaaaguagcaguaggagguuggauuucuuggccuuagagaugagccuaggauacacguguaaggacuuuuucugaugugugcacaggugcucagccgccuaccaugucaaccccaaugugugcuguuggaagcccagccaugcaggcugcaagcaugagugguuugacugggccagagauuguguacucaggaaaacacaacgguauuugcauuuacuuuucucgaaucaugggguaaguaccuuguaaacuaccuaauacuauuuacuuuguccuguuugcaguagugaaguauuccuaaauauguauuugggacauuacuuacugaauuuuacuuguaguuuuuuguguuugguugguuuuggauuuuaauuuauucucuuuacauuccucucaaagccuuccccacuccugaucccccuaucacucaaucccuccccuauucccuccuucccuucuccucugagaagggaaagcccucaguguaccaccccacccugauacaugaagucacugcaagacuuguacugaggccagacagguuagcucaguuaagggagugggacccacaggcaggcaacagauuagggacagccccuguuccaguucuucagggacggacauggaaccaugugcuccauaugccgcgucggggcuaagcccagcccgucuaugcucuuucauggugguucugucucugggaggacacuugugaaaucaguucuucacuuccacucugaugugaguucuagggugccauuuaggucaccggacuucuacaggugucuugcugaaccaucucucuaaccuccucauugucugggaaacuuaaaaauguuaaauuaaguucuuacuguguuugaaaaaacugaauaaagccuucauguuccuacagacaaguaacugcauguuaugaaagguauucauuuacagugcaauaaucaaaacauuuuuguuccagaaauauuugggaugcgagcuuaguuguugaaagaguauucaagaguuccaacagggagaucacugcaguaaguguguaucauguuaccuccuuguuuguauauaaccaguuggugguguuagucaguaggcauuguuucucgugucuuaauugcuuuaugaacauguauuguguccucagccaguaaacuguccuucucuaguuuccagucacuuaacugaguaacguuuaacauuucauagccuaguacuccagugcaaaauaaaaaggauagccuggcuccuucugaagcuugcugugaggucagagagccggcuaaccugacugccacaucugcucucauuuguaccuggcuuuuacagaagugugauacucucauaaucucagcagaaucaguucgagcucacaugcacuucacauugcuuuaaagaaacaucccagggcuuugccuuuacaggucaaguggcuugcucaagcucucaggauuugguuugcuuugguuuuucuuucccuuacuguuccuuguuuucuuugcuauucuguuuuucugucuaucuuuuuguuggguuuuuuguuuuccacaagauggucuugcuauguauuuugagcuaccuuugauccugugaccuaccuuccaaacccuccaaguacugggauuuuacacacacugacacacacacacacacacacacacacacacacacacacacacugacgugcauaugcauugacaugcacauacccugacaugcacugaugcauacacacagcccaacccaaauuuugaugcucucugagaguucacauuucuaauaggaugcauuuuaucugacauaguauuaauccacagugauagcaguaaagaaaaguucccuugagcugauugauuaguuggcaguaaggacaugaggacauggcuguuaaccaugcugaacuaucugagugaugaccauggaacuagggaaaguaagguguucacuugguauuuguguucuauauuaaucguaaaagaggaggggaaaggaaggacgugugaaacuuucaguguucuuuauuuugacuaacuggauauugaauggauaugaaaaaagaacuuuauauauuaaugauaaagauagcauagcucaaaacuaaaauuguauguauuuacugcugacacgaaagaguacuuuuucuaugucuuuaagaaauguuugcaaacugucauuuccaaccuuacagauugagagcagugugcccguccagcugcuggagucagugcugcaggagcugaagggcuugcaggaguuucuagacagaaacucccaguuuucagguggaccccugggaaauccaaagugaggaccacaucuacuuacuuacuuacuuacuuuuuuaucuguguaugaaggaugguuuuucuuauuccuuugagguacuggaauaaaaccuaggaccucacacauugugggcagguacucuaccacugaacugcaggccuagcuauucaguuuuucuauccauuguauucuguuagaacuuuagagcuauaccauacagucuuuuuuuuuuuuuaaauguucauugguguuuagccugcauguguaucuauugaaaggugucacaaacgcugaaaccggaguuacagaccgguaugaccugccgugugguugcugggaauugaacugaggucuucuggaagagcagccaguguucauaacugcuaagccgucucuucagccccuaguuuuuuuuuaaugcaguaucucgauauguagccuuggcuguccugaguagaccaggcuagccucaacaucacagauuuucugcuuccaucuccugugugcuggggaguaaaagcuugugccaccacacccaguccaggagcugcccuuguaagcaguccuuuccuggagauguagugcuucauaagguugucaccaucacuuuagcuaagccuggaguagucuccuugugccagaagggaccucugagcuuauuucagucccucuccauugacucucucccuguuccuguaccccugguggauuuucuaccacagugaaucugccuguuauuuuaccuaaguaaagauaugcaguauuauguuuuuguccauacauuuauuucuccuuaaaauguuaggaaagaaccuauaacauuaaaguuuuuuucuacuuuuuccaaaauugcauuucuuugggguugugcgggugggaggcgugugugcucuggcgucuguauggaggucaguguguaagcugccugcacugguucauucuuccaccguguggguucuggaguccagcucuggucaucagacucagcaacaggcacuguuaccuaggcuacuaagcuaccauaccugcucgagcgugguauuuuuaaaaaacaucuauucagucuuauuauaaauccccacacuuuuuucuccuuuuucacucugaccaucacuugugauacggccucacaguccuaugaguaagcucuugaguuaauuaagcucuugaguuaauuaagcaggcccagugcugacguaguauucauaacagugugaugguugugaagucgaaaugacaaccugacaguaaauugugccacaguauugacaaguuugucuuaagauaugaaugaaauccuucaaaagacugcugugaagggcucagguucuuaguguuugaggugacucuugcuuacuuguauuuguuauuuucagugaauuucugguacauuucaaucuucaaagaggcgcuuaucucuguuuuauugguauauuugauaaccugugcauccagccacagcauuuaagaaaguuuugucagcaagcaauauuuuuagguucuuuuuuuuuugguuuuucaagacaggguuugucuggguagcccugucuguccuggaacucacuuuguagaccaggcuggccucgaacucagaaauccaccugccucugccucccaagugcugggauuaaaggcguguaccaccacuguccaacucaguuaauguauuaaaaauaagaauauguuuaaacuugcugaauguauagguugaccuucaagucacucuaacauuguaauugcugauauuuuaaaguauuagugcaugggcuaugcacauucuugucuuacuaaaauaagaaauuuaacugaaaaaaaaaaaaaguacuguacacaccuguauuuucuaaagucugauccaugccccaguaaaacucacacucacuguaauuucgguuucaguacuacugccagagugcagcagcggcugguuggguucaugcgucccgagaauggaaacacccagcaaaugcaacaggagcugcagaggaaguuucaggguaacugacuucugugaccccaccagugcaguguccuaaaaacacaagauuuuuuuuucuuuuucuuuugaauuaaagugccaucuuuaugguugagaaaauagagcagcauggaaauuauuuuuuuuucauccccucugauuuuugcuccucuguccucagaaagcaugauacauucuuuuugauuaauuauuuucuucaucgugguaacauaucuauaccuuaaaguugacaguuuuaguguuugacauuuuuagucauuucuauacauucugguugcucccuccauccauugucccucacuuccacuacaaucaaaucccccacccccacccccccaccccaggccucuucaggcuucgugacugcguuuucuuguguaaucuuuugggccgucugggucaugguuggacuagguccguccauugaacuuggugggaucgccagugggugcacagguaaagaacugaucccccuggcucugaauccaucacuagggagcacucggguuugagccccugagcgccuaaaguauauacaauucagcauacucaguaucuucacguuauugugacuauugccaacaucuguuuguugaacuuccuuauaccguaguuaagcuucguauaacaacagcucagaaacucaaauuuucccugucaucagcucauggcacccaccggccuccuuucauuuucugucuguuugacucuggguauuugguguagcacuuguugucauugcguuacuggcuuacuucacuuagcauacaguucuucacguccaaccaugcugcagcauauguuagaauuuccagucuaagacugaauaacagucuuuuguacuauacauauauaauguuuauccauuuuugucccuuuugauguauucuacuuacuuauaagauaaggcaaguuaucaugacugaccaaauugauuuaauguacuaggguauguuauacaaggcuugagaaacucaguccugggaaacuugaugaugccuucuagaagguccucuaggcuguugguuuaguggcacuuaagaaacgagagaaggcacuacaguguuuuuauuuuucacguaggccuuugcaaguguuuccagaguguauucaugccaguguauuucauggggaugagcacaugauugccccaguuggcggugguuggaggcaggggaggaaugggggugucacucuuagcuaugcuguauuugacaugaggaagcaguucgcccugugucauuuggugaaaugucauuaguuguauuuugucauuagaggcucaacugagugaaaagauuucacuucaggcgauccagcagcugguuagaaaaucguaccaagcucuggcucucuggaaacuccuuugugaacaucaguuuucugucauugucggagaacuucaaaaggugagguggguuuuguccucugggguuauuuaauacccaaaaugcuucuuucuuuuuuaaguuuauguguucugugugugguggcacauaucuucgaggcagguggaucuuucuaaguuguaggccagcuugguacacauagugaauuaauucugggacagccagggcuguguagggaaaugcaugcacauguucugccuauacguauguaagagcaugaaaugcuugccuggugguguuccaaggaagccaucagauacccuuagaauuggaguuacugaugguuguggucuuccaugugggugcugggaacugagccuguguccucuuuaggagcagccagugcuccugacugcugagcugccucuccuguccccuacagauuuagcuucaagcaacguuucacagugauccccaguucuuuuccugguggccagagaguggcugugguuguuguugcagucuuucuugauuuuuaaacuuacauaaacuuuuguuuuccccuuuuagaaaucugaaacucuccuauuuaguugauggaaaccauuucauuuucccuggcagguagcugguggcauguuuuuggauuucauuggauuuuaaauguagauuuuaaacuucuuaggcuccaagucauuugugaucugccuucaaccuuccugucuuccacuacuauauauauauacacucaaggaaugcaaauaaguauuugccccaaaaauuacaguacuuuguaaauauuuuuguugaaauuuaagaaaaaaaaugcaucacuauaaaaauacuuucuggacuauaaauuauaaaugaccuuauccuuugagcuagcuuagcaagaaacuuuguucaaaaugcaggucaaauucaugcaucuaauuuuguaaucacagcauuaucuagggaaaacaaaacgaaagcacaagauucuuuuuuguuugaucuuuugagacaggaccucacuauguagcucuggcugucuuggaacuuacuguguucuccagacuggccuccaucuuacaaaggucucccugccuguacuuccacaugcugacacaccacaccucguuccagccauauuuuuuuacgugcagcuuagugguuuguuuuuuuuguuguuguuguuguuuuuguuuguuuguuuuugccaauggccaaaagcaaaguggccugauacuagugcuggcucugccuugagucgacuuuucuuauauguaaagucagaugguugaauuaaaccaacuaugggcucugacuuuaugugauuuuauugcauuuuuccccccugcaaagcugugucaguguauuugguuugucagugcugggaaucgaaccucagccccauucuuacuuaaauuagagucuauugguagagucuuuuauuacuaaugaaauuucugcaugguggcucauacauuuaguccuaacauuugggaggcugaggcagguaguucuguguuuaaggccagccaggucuucauaguaaauucuaggucagcaagugcuaacuaguaagacccugucucaaaaaacaaacaaacaaacaaauucuucuuugugagcaaauaaaguuuucuuugauuuugaugaaggguuuucuucccuuccuaggaauuucaagagcagcugaagaucaccaccuuuaaggaucuggugaucagggacaaagaggucacuggagcauuaauugcuucucuuaucaacugcuacaucagagacaacgccgccguagacggcauuagcuuacaucugcaggacaccuguccgcuucuguauagcacagacgaugcaguuuguucuaagguaugauguaucacugcuucuaaauuaguaguuuauaugugaggcuucauagugaugagugggaguggagaaucaggguuuucccguacauuaauaugguccagugucagaauccucaacuaagagauggguugaaauacaugguuucuuaaaaauauauguauacucuuuuaaguguuacauauacaguaucuucggcaguauuuuuaggcuauggcuuaaaugacaaagccuauaggacuagacagugguguuuuuggcucagguguuuaagagcacuggccuuuucuggcggacccagguucaacucugagcacccauaaggcagcucuacugucuauaaaaccagucccaaggguucugcugccuugcccugacauccaugggcaucaggaacaugcugcacagacauacaugcaagcaaaacauccccauacguacauuuuagaaagguagaaguuagcaauuaagaaaaaaaauauaucacuuaauuuaguaauugagaucauugaaguuuguuuccuuccuuagaaaguaaggaagaucacuaaaacuuuaaguaaauuuggagugacucaaaguuaaugaggcaauucuuauugauccuuuccuacaggagaaaaaaaauuaagugucaccugcugagcugccugcugaccaauaauguauugacuaggcaagagcauucccagacaaggcuaucugggaaagacuagcuaggauuauuuuggucaaaaacuuuucugccuaaaaguaagaaguaaguuuguagaauuuuuauuuauaaugauaauaagccacauguaaauuuaguagacagacuaaaacauauggacagcaucgucugccugcuugacuuugccucuguuuaaacuguuguccucucuuuaggcaaaugagcuccuucagcguucccgacaaguucagaguaagacugagagagagaggauguuacgggagucacugaaggaguaucagaagaucagcaaccaaguggaccuucccagugucugugcucaguauaggcaaggucggaaccaagugcuucuuugugucucuuucuuaccuggggacacaggccaugugugaaugcagcagugaucuagagucucuucucuggcaaaucuucuagcaucuuugccaaagugagacuuugaauuguguaguugcuuuuauuuauuuauuuuguuucccuuuuuccuuuucauacuggagaacaaacuagcaccuauacauaugaggcaagugcuuauuuacuuuuuagacaacuggccaugaacugaacucucucuguagucaagagacuauggccaugagcuucugauccuacagccuccuccuccacagccugagauucuacacaugccucucacacaugccucucuuucuggcuaauauacuuuugacauuucaguuuuuugguuuuuuuguuuguguuuguuuuuauuuuugucuuuuucgagacaggguuucucuguguagcccuggcucuccuggaacucacuucuguacccagaaaucugcugggcagugguggcgcaugccuuuaaucccagcacuugggaggcagaggcaggcagauuucugagugcaaggccagccuggucuacagagugaguuccaggacagccagggcuauacagagaaacccuaucucaaaaaaaaaaaaaaaaaccaacaaccaacaauagaacucagaaaucugccugccucugccuccgccucccaagugccgggauuaaaggcgugcgccaccacugcccggcaguucuuuuuaagcuacacuacuacaacugaauuauacuuaauuuuaaaaugccuagggcuggugagauggcucaguggguaagagcaccugacugcucuucugaagguccagaguucaaaucccagcaaccacaugguggcucacaaccaucccuaacgagaucugacucccucuucuggagugucugaagacagauacaguguacuuacauauaaucaauaaauaaaaucuuaaaaaaaaaaugccuaaaauuuuugacuaauuuuaaaaguaaaaacuguaacucagcacagauuugaauugcaaguuuuuuccucuaaaacguguuuguuaucuuauauaugaagguucuuuucuaagagagcauccauuaauaugccuuguagccauauuagaccuucuucuucauaaguaaacacaucagaacuauuuugccaugccauuacuagaauaauaaguguguaauagaaacacagcauuccauucuugguuccuuuaugucugccuaggaaagccuuuguagugagcucuaagcccuuggccuuugucuuccccauuagugcguuuuuaugagggugugguggaacuuucucuuacugcugccgagaaaaaagauccucagggucuuggacuccauuucuauaaacauggggaaccagaagaggaugugguuggucuucagacuuuccaagagaggugagcgcucaacccuuagcugauuguugggcuuuuagagacagaccuuucuuuguauaagaauuuuauugaugguauaggaaaagaacauuucaaauacaacccuuauaaaauuuaaauauguucucaguuagaaagaccugaguuuuuaucaaguccugaaucuguaagauuuuagucuuaggaaaauugagacagcacuuagaaguguuuugugugucugugcaagugauauaugcacguguguacauggacacuuggaagucaggggaagacaucaggugaccuguuuucugucccuuuccaaucugcucuuuuaaggggcuucucccugaagcugcaguuaggcugccagucaguaaguccaagcaguccuugguccucacagugcuggagguaguagcauggagagauagccaccccugccuuuuugcaugggaccuagagaauuggacccagguccucauguuugcuuagcaagcaacuuuaaucugcugagcugccaucucagccuuaagaagguuuuuguuaauuuuuauuuauuuguuuguuuauuuauuugaaauauguauccacagucagugcagaaaucuuuguaaaccaaucuggucucaaacucagugaucaguuucucccuuccucccuaguccugagauuaaaggccuguaucaccgcaccugucauuuauaaaugguuuugguccagaaccugugggacuaucuuccuuuucucuauuuauuuauuuuuuuaacuuacuguaguuuuugagaucucugauuugagaacaaaacuggcuccccccacaccuguuccaggugaaaauaaguuguuuuuuuuugguuuuuuuuuguuuuuuuuuucaaaaggaaaaguuuuuuaaauggccacaaaucuguagagauuuaaagaaauauacugggcuggagagauaacuuagugguuaagagcacugacugcucuuucagagguccugaguucaauucccagaaagcacaugguggcucacaaccaucugaugcccaauucuggugugucugaagacagccacaguguacucauccauacucauacauaaaauaaacaaaucuuuaaaaauaaaagaaauauacuaauuuuauaaauucuuguuuguuuaaccaaauaguuuucagaucuuuugaaaaaaaauauguuggauuuuuuugagggagggauagaggauauagggcgcuuggguguaaauuuuaucaucaucauuauuuuauguguauagguguaucauuuugugugccugguaucucuuagacugccuuggagguacuguaaacugaagccuaugggagguacuguaaacugaaccugugggugcggcgaguucuuaaccacugagccaucucuccaaacaagcuucaaacucaaaucugucuuagcccaugaguguuagauuuagaggcacauauugugucugucuguuugcuugauuguuuaaauauuuucugguuaaacaaugugauggaucaccccacccccccuuuuucagauuaaacaguuacaagugcauuacggauacucugcaagagcugguaaaucaaaguaaggcagcuccccagucucccaguguacccaaaaagccugggccuccagugcugucaucugaucccaacaugcugagcaaugaagaagcaggacaucacguaagggcaggcaugcuuccccucuggaagagggugggguuugaacugcuguaggguaguggaggcauaaucccugggaauggugguugcccuucuacugcuaagcuuguuuccuucccagaggucggaggaggugggaugggguaugucaagcaaguuagccuuuagccaugcuaaucuucacuguuuucuucauuuuaguuugaacaaaugcuuaaauuggcacagcgguccaaggaugagcucuucagcauugcucuuuauaacuggcuaauacaagcugaccuugcagauaaacugcuacagguaacaauacuguuugugcaauauaguuuaugucaauuuauacuucuaaguuguauaacaauagcuuuuguagauauaggaaauuaauauuuuuuccuguguauaauauuagguguuagcauauggcuaaguauuuuuauuuuucuaagaagcaaaaugcacaguuuugaugucuagaggcugauuugaauaguagcauuguugaguaguacaagucuuuggauuaguaaugaggcucugucuuuaagucauugggugccuggaacucaaucuauagaccaggcugcacucaaacucacauagaucagccugccucugccucgugagugcugggacaugugucaaagauuuuuuuucuaaguaccauuguucauugauguauaaacuugaaacuugggauuuguuaaugccaagucagcaacucuuuuaugaaagcucauuaaaagaauuagaauuuuacagcaaauuuauuuuuuaauuaguguguuacaaaaaguucuucauuaguuaguaaaaucacuuguacugaguaaauuuucuccuucaccuacugguguuagauucaguuuuccauauuuucagaauacaaggcacaugcgcacaugcgugcgcgugcacacacacacaccacugguuucuacuuuaaaagcaccuaggugauuacaaacauuuucuguguggcugcaauuuccagauugcgucaccauuucuggagccacaucuugugcgaauggccagaguggaucagaacagaguccgcuauauggauuuacucuggagguauuacgagaagaacaggagcuucagcagcgccgcucggguccuauccaaguuggcggacaugcacagguaaggacgacauccgagaggcugguugacggaguaggacagagcucuguggguguggguguuuucaucuacccaggggcuguagaggcaucagaucaucuagagcucuggacucuugggagccacugacuuggaugcugagacaucucuuuaggccuuuaguuaguuacuuugaaaguaucuaguuuaggggaagggagagauggcucggcaguuaagagcacuggcugcucuuccagaggcccugaguucaguucccagcaaccacauuguggcucacaaccaucuguaaugggagcugaugcccuuuucugguauaucggugacagcgugcucauauacauaaacaauugguuuuaaauuuuaaaaaauguugaguuuaauuggguuagauaguguuuuuaaaaaugucgaguuuaauuggguuagauagugacuacagggagagaaaaggaacagaguuccuaagugcacagagaacuugauguguaacuccaguuaaagggggagcaguuaaaggaauggagcaccccuagcucgugaggccuugaaaagaagagaacgcagauuagaccuggauuuguggucuauuuucucuucacuugugugucaguauggaugcauaggugccacacuucaugugaaggugagacgacaaccugagguagucagucucucuuuuccacccugagucaaacuugagucgaggguagguggaaauugccuaugucugcugaguuaccuuguucgcacccugcaaaggguauuuucagacugguugaucugagaaguucccagugagugaaucgaaucggcuuguuuguuucuuuacugagacaguuucgugcaucugcaauuucauccuaucucuuaaaugauucuaggaucucagcuguucaggggggugcuaaaauagucuugggagaccauugaagaaggauaucaggacucuguugagucccauuaagggaaaguuguguuuguuuguuuguuuguuuuaagauguacuuauuuuauauaugugaauacacugucauugucuucagacacaccagaagaaggcaccaaacaccauguggcagcugcaaauugaacucaggaccucuggaagagcacucagugcucuuaaccucugagccaucuccagcccccaaguuguuucuuacucuggccaagaaagucaugacauucugaucugcuccuaagauuuaaugcuacaugcuauuaugugacaguaaaugucuuaauccaguuguccugugaguugucuguccgugagugaggaaaucuaauucaccugaagacaugcuaggaacagggaggaggaauugucccuuaaugagacaaugcgcuucuugaagaagccacugccuugcuauggucauuuuucuugguuacaguuuuucuuuuuugucugccucuuauuuucccaaagccuugaauccccaauuccuuggccuuuaucacugucugugccuagccucugcaucacagagaucuaccugccuuugccucugacucuccuagcugcucacacaaccacuucuaaguaauacugguuguuuuccucugauuuccuucauccuccuccccagcagcuccgggguuggcagcuuaccugcucuguugucuuucuuuuaaaccgugauaaaauuguccuuaaggcuucuuccuaauccauuuucuaaguucuuuuauuaaugaaaucagaaacacaaaaaagggaaccccaguaacaugcuucccaauguaggauacccagugauuccaguaacagcagaauuucauguuuuucacauaaucaugaguauuuguuacccaaaguuaggaucuuaucgcuagaaaauaaaguauuggccaagcaugacagugaacaucuguaauuccggaacuuagguggaggcagggcgacuccaguccagucagggggucugcacagugagacccggugucaaaaagaauuuauauuauuauuauuauuauuugcauuucuucaaaagccuuuuauguucuggucuuaaaauagugugucuuacuugauauauuugacucuuaagaaacuguagccaacggccaucacuggaaagagaggcccauuggacuugcaaacuuuauaugccccaguacaggggaaugccagggccaaaaagugggagugggugguuaggggaguaggggggaggguaugagggacuuuugggauagcacuggaaauguaaaugaggaaaauaccuaauuuaaaaaaaaaaaaaaaauauauauauauaaaagaaacuguagcuaaaauuacagauuuuucuuccuagcacagaaauuucacuucagcagcgacuagaauacauugcucgagccauccuuagugcgaaaaguuccacugccaucucauccauagcugcagauggugaauuccugcaugaguuagaagagaaaauggaaguaaguacuaaauacuuaggcuucgccgaagaguggcugccacgguuacaccacugucuacucuuaaccauggcuuaaguucagcugaagucauuauuaauuguaagugugucugccugugaauguuggacucacgucacguuuggaugcagauguuaaggagucaauguuugggacagaaaggcuuaauuugguagauucucccuuaacuuaucaauaauuuuuauuuuucauuuucucaacugaauagcagcaguuggaucacggggcauuuuucacguauucugggucuaauaaguaaauguaaggaauagacugagcugcuuaaacugagauucaaauaucuucugguugucugaggaaaagaaguuauuucuuacaaaaaugaggucaguguccugcuggcuucccuuuuuucugaugcuacaguucccaaggaggaagaaaagauaaaccuuacaagaugcacauuuacucuuugaaaaccauagcccugacauaaaaugguuggcuuccuuucucauuucuggagugacuuuggugcaauggcauuggcaacuagagauccagccuagaaauuugucugucagugaucauugaauuacugauggcagugacuuuggggagcaauauuccuugucacagcucauuuccugugacaucaguuaccuugagaggauagucucuuacaauaaaauauguaguauuaauacacucucuucacuuuugcaaacuuaaacuuuuagaugagagauuauuucuuuaaguaccuauugaguauuauaaagauauuaauacaucauauuuauuuucuguugaaacuagguugcuagaauccaacuucagauacaagagacacuacaaaggcaguacucccaucauucuucagugcaggaugcaauuucucagcuggauucugagcucauggacauuacuaagguaauagagaucccgagaggggggaggagagggagaggggggagagggagaggggggagagggagagggagaggagagacugagacucacucuucaugggaaaguaacuaaaguucucuuugacagcuugucacuggccagacaacacaugacuuuagucugacuccuauaaaaggcagaccagucccaauagcaaccuuguuagccucaugugaacccuguucaaacgaacaugcuugguugcuauugcuguugguuuuguaguuaaaguuuugauuugguauuuugagacaaagucucagugugugacccugcugguguugaacuuguggcauuccugccucugcuggcauuucaggcaugugccgucacaccagcuuaaagccacaucacugaagccuuccuuccauccuacgugguuuugcuuaucugguugagugucuuuugcucuccguguuucuuacagagucuucuggagacacucuuuauuuuguuuguuuguuuguuuguuuguuuguuuguuuguuuguuuguuuuuugagacaggguuucucuguguagcccuggcuguccuggaacucacucuguagaccaggcuggccucgaacucagaaauaugccugccucugccucugucucccaagugcugggauuaaagacgugcgccaccacgccuggccuguagacacucuuaugugugucuacacauaagugcuuuuuguacaugguuucucuguguaguguugguuguucuggaacuugcucuauagaucccgaauucccagaucugcgccacugucacauccuuugccaugguucuuaaccugguuuagaggacacuaauucuaggaccucagcagcacccuccuccuaaaauagcacaugcgugcugaaaccuguuugagggugccaauggagacccugcucaaaagacaaguuccaaagcugaaacuuugagcacugcaaguggaaaauuccacacaugaucuuaugugaugagucaccaucaaaacacuugguguuauuagaauuuuguauacaguuucccuuggacuaaguguauuucacauuuaaacuggggucccauucccauugcaucuuuuguguaugcacauauuuuuaaauacuuguuucuaaauauauuguauaauggcuacucaacuuguaauguauuuuauauacuuuagauaaaauauuucauuguuuuucauugaaagguauacuucacuuaauaucucuaaacagugagcugaaguugcauguuuaauuuuggaauuucuuugccacagcucuauggggaauuugcugacccguuuaaacuugcagaguguaaacuugcagucauucauugcgcugguuacucagaucccauauuggugcacacacucuggcaagauaucauagagaaaggugaguguugaguugcagauacauugcuauauaguacucacguauccaaaugaacacaagcugcuagcaguauggaaaugggcuauguauaccuacuagaaaggauauggaggacaugugcauacaagggcagcugauuguacagugugacgcuggggaauauuugugguaggguauauaguuuauuugauguauaccaucucauaaugaacuauuuacuucacucagaaucuuguaaccaguaccauuaaccgacaccagugacacguccguguucucacucagaagcacagaaucuguuaguuaagucaaugcagauaucgguccugaaguauuuuguaucuuuaagcaauuaaguaaccaauguaaacaucucacauuucuccugaccugucuuuuccagaauugaacgacagcguagcauugagcucgucagaucgaaugcaugcucucagccucaagcuuguccuccucggcaaaaucuaugcugggacgccucgguuuuucccucuggguaagcagugacuuugcuaucuuaucuucuguuuaauaguuuuucuccauugggaaacuucacuggcccauagagauucuuuuugcuaugcaucuguuuacuguuuaguucagcaguguuaauucugauucuccagggggaaaaaaaaucccugaaggguaacacauuuguuaaugaauagcugacuaugaaauuuuuuucuugaauagauuuuuaaguuucuauaucauuuuuggaauuauguuuacugacaaacuauauaguuuaagugauuauacaguuggaaaacugguacaaguaucaagaaacaaaaauggccuaugauuuuguguauuaauaguaauuugagauucagcuguucucuauugcauuaaagugacaguggguggguugugugucucuguguuucugugugacagcauuuugcccagauugaccucaaacccaggauguucuugccccagccuccugaguacaggaauuacagguguaggugugcaccauaccugaucuuucucugcaucucacccucuuucucaggcuuuccucacgucuuuccucuuccaugcgugcgagcgugagagagugagagacagagacagagacaggcaggcagggagagugggagagcagauagccugaaguguuccugguucuugauuggucagcaaggccauaggaacccaccuaucuaucucugccucagugauaaaauuacaagcuuauaccaccauaucuagaauuuuuuuccauggugucaaaaucauguuuugaugcuuuaaagagaaacauuuucccaaaugaccuacuucacuggcccucaaauauguuugaaauucauuuucagauagacacuugaaacuacucuuauuuauaaaacaauuagauaauuugcuguaucaagaguuaaaaguccaaauuucugggaagugauggcuggcuuagcaaugagaacgcuuguuccugcugaggaccuggguucaguugccaucguccacaugggugcucacagaagugugugacugcaauccuaggcucauuucuggcucauuucuacaccaaguauacaugugguauauaugcguacaugcaggcaaagcacucauaucguuaagcaauaaaaaugaaucauguaguaauucuuauuuuugacuuuuccccccagauuuuaucgugcaguucuuggagcagcaaguuuguaccuuaaacugggaugugggguuugugauacagaccaugaaugaaaucggcgugccuuuaccuaggcugcuagaaguuuaugaucagcucuucaaaucacggguaaggcaaacaaaaugaucuccccagauacaggugagauuuuugacuccagguauagguagguuaucauuuagguuggauguguugagugcagauaugcuucauaugcaaggggagugaacuagggacucuuaucugagagugucuuugcuguguaucauaacuaaaaugaagugcuaauacuuuauaucggugagcauaauuauuuguauuuacucuugucuucauggguaauccaaaguggggacuauuucuggggucacaucccacggccuugcacacuugacaugugcuguaccaucagacuaugauucucagcugcucgcuuuaagcacacaaaauaacaguacauuuagacaugugacuucauuuuagaaaaucuuuuguaagggauagggagauacucagccaauaacgugcuucucauuccaagauugcuucccugagcccuauaaaaacuaaaugcaauguuguauguuuauaaucccagcacuggaaaggcugagaugguaaaaggcauccuggggcuuucuagcugugcauucaaugagacacugucucgugugugugugugugugugugugugugugugugugugugugugcgugugcgugugcgugugcgugcgcgugcacaugcaugugugcaggugcaauaguguuaucuaucagugcuguuuguuuuccugagacagggucuugccauauauaguccaugcuggccuugaacuugggauccucuaccuaagcuuccuaagugaacuaggugacacagcaucugccuuguaaccaugucuuccaaggcaucuuuugcuuguucaguaauaacucaacuuucccucauaaugaaaauaguacuucaacuuacaaugagucagcguguucuagucguaaaguucuguaacucuuacucuguguucagagugcauaaauucaaagggaaguaggcuacagcccauagaaauaguaguuuuuccuuaauuuuauauuauauugucuaaugauaauucaauuuuuuguaaaaaaaaaaaaguuaucaaaauauauugggguuuuuaaaaaauuuuuuuaacuuuuguuuuuguuuucucaauacagggucucacuauguagcccuagcuuagcccuagcugucuuagaacucacuauauagaccaggcuggccucgaucugccugccucugucucccaaguccuggauugcaggugugcaccgccaagcccaccucacaaauaugguguucauuucaaauauugaucuuaaucuuauauauaauuuagaaaguacauucaauauaucugggagguuuuuuuggguuuuugaaacagggucucaguauguagcuuuggcugaucuagaagcugaggugaucucaaacucccagagaucugcuugucucugccuccaggguguagggauuaaggacaugcacuaccacguccagcuucuaaugcuuuuuaauagaaauuuugagugggcucgaaagacuuuaauuaacauaaauaauuaggauaauacauacauacacauuugauaaguuauaagaaaaacuguguauauaugcauacauacauauacauacaugcauacauacauauacauacaugcagucaugcuuuuuuuucucuuccuaggauccauucuggaacagagugaaaagcccacugcaccuucuggauuguauccauguacuguugacaagauauguugagaauccuagccuaguuuuaaauugugagagguaacuauaaauuaaauauuauauugugaaaaaguuuuaauuauugcuacuaaguaccugggagaaggguugggaauggauguggaaugcuccagacauuacagaggagcauuggggaauaucuuaaguaaauuagcaauaacuauuugagugauaaccuaaucguuagcauucaugaaaaaaaguuucaugaaaguuucaacuguggggcuagauuuucuaaaguaaaaguaauuucugaaguacuguauguuccuucguugugguguuaugacguaggaccucaggucuacguuugugguaaagccuccucaggaacccgagagaguguaacucuguaaccgcagucgucccugacugccccuggccggcaggcuuccgguugacaauggugcuuaggguagaugaccuugccaaguccccuuucuguuuggaagcacuuaccgcuuacugaguaaucuaacccuugcuuuucaucgggacucugagaaaguuaaucgaaucuuggucugaaacgacucuuugaaggaaauggguuucaguauagcugguugagggccugaagcaagccagggcuccgugauucugaacgcuuucugcuuuugcagagguucugaguucacuucccagcccccacauagcagcucagggccauucauagcaacaguugcagggugucuggugcccucuuguagcugugggggguccuggacaggugcauggugugcacacacacacauacacacaugcagguaaagcacucagacacauaaaaauaaaggaauaauaauaaacaaaagucaaugagugaccugaagucuuucuccuuacaggagaagguuuacaaaucucugccuggaugccgucuguggauaucugguggaacuucagucaaugaguucuucaguagcaguacaagccaucacugggaauuuuaaaucgcuccaagcaaagcuggaacggcuccauugauuacuguaguauauuuucuuguuugcauuuuggucuguaaaauaaaagcucagcuggguccagaaaucagguguuguauaucuaagaauuuugguagaacauuuuuuuaaugaaugauaguuaucuacaaauaguacauuugccaaaugauuuaguuuuuuuuuuuaugauuaguauuuuuuuuaauugauaaguugggcccagauauguagcucagugguaaaauguuuguauaguguguaaaaaguuaguaguaccacacacagacacagcagucuaugaacagcuggaauaagacuguguaugauuaugacacacaaagauuuugaauuucacuagugguaacaauuuugacuuuguauuauuuaucuacagguuuauguaggauguuaguauuaaaacuuauaggcuaugccagguuugguagcacaugccuuuaaguccagcacuuggggaagcaguggcaggcggcucuuuagaacucacugagauuuccaggccaggggcuacacagugagaccuuaucuucaaacaaacaaacaaacaaacaaacaccuuauaggcugggucuguucccuuagugcuagauucuguaacagucuuaauuagucauuuuuagguuaauauuuuaucaauuacagcccuuuauguucucucuuccucuuuuuuucucucucccucucaccauaaguacauacauuagauuuuauguauacauuuauauaugugugugcaggcuauauauguauguuguauguauauacaggauuguuugagcaugugauuguaacacuucuauguacuuaaaaucuucaugaucacccagcuguaauggugcuccccuuuaauggcggcacucgggagugugggggagagucagaguggccagucuggucuacauacugaguuacaauucaaccacagcucuacagggacuacuguuuccuuagaacccucacugucuaacuguaugcuucaagccagcaacaguagcagcaaauuaaauuacaaauuaaauuccuggcucucuggucagaucuaccaagccaaaaacuguggcauaaaugccagucucugugucuuaacaaccguuccaguagaugcagauuuaugucuuauugacuuguaaauccuguuuuaucuaguuuguuuuuguuuuuuaauacugauggguuuucaugcuaaacagguaaaugugcucccacugaaguuuaacauguuaaaagaacuuacuaaacuaaguguuccaaauuauuaucaaagacaaaaaaaccugagaauuacuaaggcuaaccaagagaagagagagagaaaaagugaaaaacaacugguuucuacuccuuaguuguuuuguuauuuuauuuuugcagcagauugugacauagcguaggcuagugucaaaccuaacugccuagagugauguugaaauuccgauuauccggccccuaccaccugugugcuaagacuguaggcaggcuucacagugccuacuuuuugugaugcaggcuguuaaauuaagcgagcaccuuaccuacugaaugaguuaaguucacaguccucaacuccccacccccacuccuuuuucuuuuucucuuuucuuuccuuuccuuuucucuucucuucucuucucuucuuuucuuuuuuuuuuuuuuugcuaggucucacuaauauagcccaggcuagcugcaaacacauguugauccuccugccucagacuuccaaguacuggaaauccaagcaugugccaccauacccagccuccaguguuauuuauacuguuggaaguauucucuucuguuuguuggcacugguggaaauugggcaguuugugaguacaccugaauauauuucuacuuuuaucuucuccugcgauuacggauuucuuuuucacaauaccguagaaugcaauuccguuuucacuuugaauguguauuuccuaaaagaucaacguaaugcucauugggugucacuaccucguguuucucaguuuuucaucuuauuaaguaauuuuauagcauuugauauauuaaugguuuuaugcauuuauacuucugucaugcucauuuuaaaugaaggucuuguuuaaaugcuuuaau

SEQ ID NO: 7677 - RNA, 1410 nt, Mus musculus
ugagccuugaucagaguaacugucuuggcuacauuucuucuuuugccccgucuagauuccucucuuacagcucgagcggccuucucagucgaaccguucacguugcgagcugcuggcggccgcaacauuuuggcgccagaacugggaccugaagaauggcagagagaugcuaagaggaacgcugcauuggagcuccacaggaaaggaucuucguaucggacaucggagcaacggacagguacacaugcuagcgcuagcuuaaaauuucaguuuuguaaaguguugcugaggaugcgguaggauacgaauuaagcuugaaucagugcuaacccaacgcugguucugcuugggucagcagcguguuaaucggaacuagaaacggaaacaggcagguuagccgcagcuuuuuaggaagcugcuuagguggaagaagaaaggguuuaaagucguggaucaggcgguaggccguagcucuccgaagcuacaugaggugugagaaaagaaaggguuuauuaaaaggaauaggcggauugccccaguuaauaaaaaauauucuccggcucuaccucgccuccccaaaagguaccaagagccacauguguggguuuuacccacgggaggaaucggguccauguccacccaagccaagguuaaaagcccacucaucuacggaugaaaaaaucauuugaucaccucaguuaagcguugccuuauuuaacuuaauuaauaggggggagagagauuggagacguacuauugaaagggcaagcccuucacugccucccacccaaauaaaaaagccaauuggccuuguacuacaagagccggucacuccuucucccuguuucccaccuaucuuccaaaaaugcggaggaauaucaacuuagugcuauuuucacaucguucagucaaacuuagccagaguuccaacgcccuacuuaaaauucaacuagaaaguuaccuaccaaguacuaauuagcauuauaaagucagagucugcagcuccaggccuuucaguuaguuguuuacuagaaaggacagucuuaagccagauacaguuuaccauaagaaaaguuaaagaaucccagugaagcaaguuuuuucuuuaacccuagauuccaggcagaacuauugagcauagauaauuuuccccccucaggccagcuuuuucuuuuuuuuauuuuguuaauaauagggaggagauguagucuccccucccccagccugaaaccugcuugcucagggguggagcuuccugcucauucguucugccacgcccacugcuggaaccugcggagccacacccgugcaccuuucuacuggaccagagauuauucggcgggaaucggguccccucccccuuccuucauaacuagugucgcaacaauaaaauuugagccuugaucagag

SEQ ID NO: 7678 - RNA, 58121 nt, Mus musculus
caggcaggcggaaguggguggagcuccggcuggcugggaaaugucagccgauugacugggagcagguuuuccuuuucccggagcucacgggccuucgggugaucaccgccacggucgcccgggacugaaggauccgugaccccggcaggcugcggcggacgcgaagcuucugagucccuuccagacgcugucuggcgagguccgacggugagcgugaggggggcggggacgcgugaggugcgucagggucuggggucccggcccagucccuggcggacauagacuuggggggaguuccagauggugaguggccgccgccgccaggcccaucuccggggucucgauggcccgccaggugagaggcugcggguggcacuccugccauucgccuuccuccaccuggcagugggcggcccuuaggacugggucuguggacgcgauccuuuccucacuuguaaacuaggcucgaggacgcggcacaccucaugggcuggcacugaagaucaaaucagcgugcgaggggaagccuuuuucgagcuaaagcgcagcuccaagaggagcgaugguuuauuuuuaaggcggcaggagccagcagugguucccgcgugcauccucuuggauccuugaugagucucccaaauaccaaagggaaaaagggaggcuccgcuugcaaggagagaccacccugaaagcuguuuaggugccucugacucaauccacagccuguccuagaaucucucugccuagaaacuaugcuaauuuagccucugaagaggucgggggcgauuagauuagaaugaccaugcaaaauucaggugugcaaacugugcaacaggggagaggguagggggaugcauuucuaguccaguaaaaaugaagauuuauagaguugagaaaaaagcaggccaccuucaucaaaaacauuagaauauugguuuaguauguuagauugcauacacuuguguuucuuuguggagagagcaagauucguuuuauaguggaauuaaauccuucaugcucaguuuugucuuuguuucuagcauaaucuuugcaucaguuacuucuugagaggaagagauucaugaacuuuuaguuccugugagugagauugguguaaaaaaaaaagaccuuuuugcaaauugguuuuacuugaaaagaaagacuaggagaauaaguauguagucacaguuuuguuauggaaaguaucuaaagugagaccuucugaaauaguguauaaaguuaucuuuuguuacuuugaaaaacucauuugccuucucuugaacuuuguccuuucuguuaggauguaacucguucaagaguaaauucuaguaaauauaaaacagcccugaauucagcuaagaguuagcagagaccuuaggauauuuaaauuagugggcacaagguucucucuaggaaaggaaagccuaucaacuuugaaauuaggagccuccugauuugccuugauaaugaaaccgguguucuuuugcauuucuuuaaucacagcuauuuccauaauauacugaaaagguuuguauugauacacacacgauucuuuuuauuuuuuuuuuccuuugguuuuucgagacaggguuucucuguguagcccuggcugaccuggaacucacucuguagaccaagcuggccucgaacucagaaauccaccugccucugccucccaagugcugggauuaaaggugugugccaccacugcccguuacgauucuuuuugauagaggaauuguguccauugaagaugugagguuauuagcuacauagaaacucaccauagagacuuuaagagacugaucucuuaaacacuacauugugauugcugcuaauguaaaauauuuuauuuccugauuaaucuuauuuaaucuuacuuaacacauuguauuuuauuuuaauaagucuuuuaaaacauaguuuuagcauuagaaugaaugugaguccaggauaacaaaaucauuuucgauaacugaaaguaucauuagguugaauaaugucuaauguucucuggaagccucagcuagaacacugacauaaauggagaaaggcaauagcagugccauuuacacagcuaaaaccaugucguaguuacaggcagucacugucuguagggccccggagagucuagaaaggacugcccaucacaacugacauauaugcuguauguguguccaucacaacugacauauaugcuguauguggguccaucacaacugacauauaugcuguaugugugcccaucacaacugacauauaugcuguauguguguccaucacaacugacauauaugcuguauguguguccaucacaacugacauauaugcuauauguguacaacuguuggucccauuuuugaaaaucaaauacaaccagagaaauacaaugaagccuaaaggcaccauugugacauagagagacuaagagauuccuuuugcuccuucuguuauuuagguuagaggaacaaaaugcaagagacaguuuuagcaagcauguuuccaguugccugucaaauuccauaacuaucuccuuuucuuccucaguuugauuguuaucuucauuuucuuugauuuaaugaucuguauuggcagauuagaucaauaacaaaaauauucuuauuucuucuagcuuacuuuguaguucuuucauaaaaauuagaaaagaaaaacuacuguaauuuaaaugaaauaauuacccacaaaggaaaaaguuaaauucccuauuaaacaugacuuuuugaguauugagucuugaguaaucuugaagacuaguagaauauuuuuaaauuauucuuuaugaaaauggaaccauagaaauuauuuaaaacaaauuguauuuuaaauggaugucuggauuggagaggagacaugaaauugaaaucuauucucuguggucaggauaccuuacuucguuuugcacauacuggugugagaacuuggguaaauaacauauccgcucugccaucuacuccuuauuaagcaaaaauucuaacaaucuuuucucauuaguuuguaggaacuaacuaaaaaaacaauguacaguguaauauaauaaacauacauuaaaucuucaaguuccuuuguaaaaacaauacuuugugagaaaggaaucucuagaugccaaaguaauugguauuggaauucuuacaguuccuacaacugaaauccucaaggguuuguugagaguuuagaguucuccuuacccacugaccugguugucaacuucagcucucaagccuugccaaagaugaaucaucugcuccugccucuugucacacuuaggaauccuagucaccugguuugucaguuucaaaacauaggcucuugaguuaucuaacuuuuauuaugucaccuagaugaguuaaaauacuuauuuacauuaauacugcaacugggguguggcucaauaguagacaguuuguauuuaggcaucugaaggcccugaauaaaagaaaaaaauuaauaucaauucuggugaaucuuuaggucuugauggccaaauuucuuauugauuucagaauuuggggauuugacagauuuuugucaguuuuuuuguuuguuuguauucucaucaguugcuucugugucuugcucuuuuucucauucuuuugcuuaaguuccuucucucuccuguccucucuguuuuugaacauuugaaauuccucaaauuccgaaauuaucuuaaccuuaaauuuuuuuucacauugagcauguagaacuuuuaacagccacaacauacauagaagacaguacuccugaaccauuaauuuuagcaagaugguuauaaaaggcauuugaaaauaauagcaaauagaaaaagguggcauuggauuuuaaauauuuaaggcuuuuguaccugauguuuuaaaggguucacucugacuacuuguacauuaaaguuugaucaguuaagucaguugguauuugauuuuaaguaaaaucaacuuuacuucuaugguauuaaugccaacccaugaaaacuaagaugcuuucaaauacuaauuaucaucucccuaaaccuauuaauguuugaaaaaauaugucaaccuuuguuguggucaaaggcacauuuucucuuuggcucuugaaaucuuuugcagaguuacacauaguuacgacucaacacauuuucugcaguaaugagcccauuuugauucugugccuaaaugauugacaucuucuuccugucuggcuuuggggugcuagaugcaccuucuugacaugauucugaauugugcuuauucucuugcaagcaaacagaugaagaacugcuuaggugccuugcaaacugaaugccaauuuguuguaagggagcaauaguuauugugagccugacucauaucuuagaaagggauaaggaugcacucuggggcugugguaucacagaugcugaaaaguaaaaugcaguugcuuuccuuucuuauauauauauauaccuuuuugaggaaagcugauugaugaugcugaggguaaaaucaauaccuugagacuuuuagagcaggcagauauuuucuagaagacaaagguaagcagcuagcacauugucuugguuaggguuucauagcugugaagagacacuaugaccaaggcaacucuucuaagagaaaauauuuaccugcgggcuggcuuacaccuucagagguuuagaccauuaucaucauggcaggaagcaugacagcuugcagacaagguguuggugaagaggcugaaagaguucuauauguugauccaaaggcagccagaagaagaaggucuucuguagacagccuggagacuggaauucuacagugggagaagcuuaagcauaggagaccucaaagcaagacaggaaaccagcugggcaaacuccaaacucugcaucuccaugucuggugucaaagggucuuuaggucuccgauuccuuuuucuucuuuguugacugcaacaccaagccuggauuuaaguucuaauucacuuagagccuacucugucccaggcuggcuuugaacucagagaucugcaugguuuuuucuccugggauuacaaauguguaccaccauaccuggaucuaaacuuagcuggguaggaucuagcccaaagucccacucccuuaaucugcuaucuccuagaacacaggauucggcuccauuuuacuggugccccuuaaauacuugaagcauauauuuguuauuuuuccuuucucaacuuucuccuuuuuaucagagugaucuuuucauaagagugaauuuuuguaaucacacaguggaauuuacaccagacuguuuugagacuuccuuaauugucaaugcaauuaaucuaaaucucuucuuuuaccuuauccguaggcagacucuucagacaagggcaaaaaguagccaccuucuucaccaaaauaccacaaaaauagucucuaggccacauacugaaauucuccacugaaaguucucgggcagguccauacaauucaaaucacucucaguaacaaaauccuacuaggguagcccacuaaaccccauuuaaaguauuccauugcuuuccaaauccacauucuuccaaacaaaagcauggucaggccuaucacagcaauaccuuacuuguaccaccuucugucuuaguuaggauuuuacugcugugaacaggcaccaugaccaaggacagcauuuaauuggggcuggcuuacagguucagagauucaguccaguaacaccaaggcaggagcauggcagcauccaggcaggcaugaugcaggaggaucugagaggucuacuucuucaucugaaggcugcuaacagaaaacuaacuuucagacagcuagggugagggucucuuaagcccauguccacagugacacauccacuucaacaaggccacaccuucuaauagagcuagugucuaggcauauacaaaccaucacagaaguuaaaaaucauuugcugauguuccuauuguacauuuacaauuuaaaaauauuuugcagguaggugagguaguaccugccuguaaucccagcacuugagguauucaaggucauucuuauuagaacugauggugauucaugaaacccuauuucaaacaaaccaaacaacaaaauugucucaauacugaggaaguagaaguaguagaguuaccaguucagagccagucuagucuauauaaugaauugagguuagccugggcuccauaccaagacuaugucuuaaaacuuuagaaaaaaacaaaaugauauuacccaguauccacugguaagaccagcuauggugccauauggcugucaccucagcauccaaguaauucacaguagcagauggaugcgcccaacucggcuauaucaugauuuucaguccaguguauuagagauaguaagauccuuuugcagcaguaauaaaauaauaauaauauaauaauaaguaauaguaguagcaguggcagcagcuuuauacauaaaauagaaaaguuacuuuuuaaagagaaaguaagcuuuauacagauuagugggaaaugguaacuguaaagccgauuguaacaaacuuccaaucaugaaaguuguguuugacaaagcacaaaaggauuucaaagaagucacuguugaauguuucugguggugacuucuuucagaaaauguugaauucuuggcuauggaugauauuagaaagcuuuaguaaaugucuaacuuccuaagauaaacuuaauaucuaauuuucuaggauaacuuacuucuauaaaauauuuugcuaaggaccuccuaaccaagaagcuauuugcaguugauagcugcugggaaaggaaaaaaaucauuuuucuccaauggagugucauuagauauaucaaccacacuccagggcagccucgugccccagaguaguuggccaacacaaauagacuccuaugcuuuuuguugucucugucucugucucugucugucugucucucugucugucucucugucucuuuucuguguaugugugaguuucugucucucuuugucucuguguguauguacccuuuguuugguauuuuuauuuuacaguuuuuuuauuuugauuuuuguuuuuuuguuuuacguucuuugccgagagagaacaugaaguuggguagauaggggagaugaggaucugggaggaguugggagaggagaaacaauaugaucaaaauauauuguauguaaaaauauuuuuaaguuaaagauaguuuaaauaguuggcuaacauaacauuaagaaacuuacucaaaugauauauuaaaauuguauuaaugcaguuuuaaaagugauaauucucccuuuauuccugcuagcucccaaauaaaugagacagagauuguaagacuuauuuaaucaaucuuuacggcacaauagcugaacacgcuuaagucuacuuuaauugucuaagcuaauauggcuaccucccagccaacauucuggagauacuugcauuuuaguguuucucuggcucucugcuccagcuguguuccugugauguugccuguaugcucuucucuuggcuaauccuuucucuuccuccuccuccaccuccucuucauccuccucuuccucuucuuccuccucuucuccucuuccuucuuuuucuuccuccccccucccccaagucucucucucuuccccuccccuggcugagaucagaaguccagcccuauucucucugcucagacacuggcugaucaacuuauugacaaaucagagauuugagaagcaauguuuauauaacauugaggcaggagauacuagauuaagcauuacaaugccauguccagaaccagaccugggggcagagaaaucagcauuugaauaauacacgguuaaucuuuacacagugcaugauaacaucaugccuauaaaauguucauaucuuaguauuaagaauuuauuaauuuuuaauauauuagaaacaaguguggcuuuucuuuuacaauauuuuuccugaagaaauuuuauuuuuauagagagacagagucuugcuguauagucuaggcuggcucucaucauccuucuuccucagcauccagagugcugggcuaaaggugugguagcacacucagccuaccuguaaacuuucaaagaugcacuuuaagaaguaaguuacagggggcuggaggauggcccagugguuaagagcacugacugcucuucugaagguccugaguucaauucccagcaaccacaugguggcucacaaccaucuguaaugagaucugacacccucuucuggugugucugaagacagcugcaguguaauucuauaauaaauaguuaauuuuuuuuuuuaagaaaagaaauaaguuauaaaaagacuugauauuucaucuuauucaaaugcuaguguaaacuuauauggcaaauuuccaaagaguuuguuaauauauuaacuagguaguuauaaaauuuccgcaauguuauuuucuauguuaauguuauguuucuuucuuccguuuuuacgcgaacagauaugguccagaacuacccaugagucaguuuggcuggagcucgugagcauucaauaaugaguggugcggcuuuaggacuugagauuguuuuugucuuuuuucuggcauuguuccuccugcaucgcuauggagacuuuaagaaacagcacagacugguaaucaucggcacacugcuugcuugguaucucugcuuucucauugucuucauacugccgcuggaugucaguacgguaagaggcggaacugagauacagcuuaaaagacaauuguaaucauacaaucuggaauauguuuugaauauugcuuucuuaaaguaacuaaauuauaugagguuauccuuccauuuugaauuuaaaugcuguuuuaagaauuuagcuguuaaacaguauagacaggaaaauagguagauucugaaauauccuuuaaggacuuggugaauucuugguucucauuauaaaacccuguauucauugcuuuagacaauauauaaccgaugcaggcaugcugcugcaaauuccagcccuccugaaaauaccaacguuacgggacuggaugcaucugucacuccagcuccaagguaguccuuuguuucuacuuuccuguucaauauaaacauuguaauaucgagggugaugauuuuaccacuuguauuuuauauucauaaaauuucccuuauuccuuauuagucauccuuucauucuuucuaguauauuuauuguauugcauuguuaauuauacauuuuaaauauacaucaguacacaauguaguacuuaaugagaaauuuaaagaagauauaaguuuuagucuguuucuauaucuuccuaaaauauaaaacuuccuauuccucucaguuugucuuuuuguaaaaaaauuauggacauucucaacuuucagccccaugaauaaaucuauaaaggaggagcauuuccguuucaucuaacuuacaugaguuaacagaaguagaguuggcuuggugguauacacuucuaaucucagcacaucaaaaguucaaggccagccucaccuacauaggcaguucacaacuagccugggagagacuuuguuuuuaaaacccccaaaugaaaacaaacuaaagcaaaauuauugugaauauaggauauuucucuuguguuacacauuuaauaaacauuguagggacuugagagauggcucagcaauuaggagcacuugcuguucuuguagaggauccagauucaauuccuagcacccauguugggcaauucacaacaaaauauagccucuggccucuccaggcacgugcucucucucucacacacacacacacacacacacacacacacacacacagagagagagaaacagagacauacucauaguuaaacaauguuuaaaagaaacauaauuucacauuaauaaacaauuucaaaaggcuauauuaaauuuucauauaagaaaccuauucauggugacaagacgcuuucguuaguacuuugaguaguauuuaugugcuucuuuauauaguuuuuaaaagaaaaucuagggccuagugagauagcucaguaaauacaguauuuggcuaacaaucauaaggucuugaguuugguucucagagucuacauaacagugcugaacuuggugacaugcuguaguaaacucagugcuggcacacugagucuccaguguggcccaacugaugagcuucagccaaucagaaaacugucucaagacguggaauaguggucuugaggauggcacccaaagcuggccucugaucuuguugcacacaugaacuuucacacauaugaacauacgcauacacaugcaaaaaacaucuaacgaguaaagguaaagagcuuaucuuuaagucacguaaauggucaucaccauucaaaacuauagauagaccaguaacaguuggacuauuuaaaaguucuugaauuaaaaagauaagaucguagucuagaaaacuuuaaaauagaaguuucggucagagauucuucauuagaaaaugugaacagaauugucuauagaugcuggugcuaacucugccgaaguuguuugacuaguaucaggauuaauagcuuuuucuuuuauugaauuccuguucaauucuuauuccagccuucacuccuguauaacaauaaaaggcaaaguauaaugagcccuaaaaaugggaugaguagaauuuuaaguguaauuauuaaguacuugauuccauaaaucgauuuuuuaaacgauuuucacacuaucagucaguuaauuaaauauuaugguuuccuucccugaacuaccuaagaguacauugggaauuggaaauguccaugucacuccucuuuagaauggauggcuuuguccuuacauauccgguguuugguuuggcaacuuugguuuuuaaauuuucugggagauaugauuugaucaguaauuacuaauuugaugcauaugaacuuugcuacuuacaaauuuauacuuucauuuaagaaguuauuauuuagauaaauugacuuuaaauuguuacugaacagacagcauccauguuucaagccguggaguuacauuccagauggaaucaugccaauuuucuggaggguaguuuauuggacaucacaguuuuugacgugguaaguggcagugaaggcugcauuauugacuaaagugauuagauuuuaauaaaccuuaauucuuugagauguaguauccuauuuuuacaagaagaaaagaaagaggggggaaaaguucccgaaaauagaaaacagagaugaaaauguucuagugacguuuccuuccuugaugucuuucuuguuugaacuucaguccaguccucauuuagcuucguuauucaugaaagugcuauuaugaaggucaccgcucuccccugguuuccuuucuuuaauuuuuguaaaguaugugucauaaugaaaugggaucacauagcuuucccuguuggcuuuccucccuccagccuaucccaaaugccuuccgucacacccaucccuuaaaccccacuugcaaauugauagccucuacuuauuugguuaucucuguuacauagagcaggucaguuuuugguguuuguguguauggauucagggcugaccacugugcaugaaacaaccaguaaggaggcucaucccgggagaugcuagcucucccucucccagcagucauuggugaccugggguuuuuagucuagagcagcgcuuuucaaccuguggguuggaagaaacaacuuuuucacaggggucacauaucagauauccugcacaugagauauuuacauuaugauucauuacaguagcagaauugcaguuaugaaguagcagugaaaacaauuuuaugguugggggggucaucaaaacaugagcugcauuaaaggguuauagcuuuaggacaguugagaacuacugcucuagagauaggaccccacaaaaaguuccccuuucuauguuaaugugucuguuaauauugccauuguuccaguguuauuuauaugcagcuauuucuaggagagacuguuucaguccagacuuccugguauucugccucuuacaaucucuccucuuccacaguggccccggagacaccgaugcaaguacuaagauguacugugucggggcugugcucccaacagugucuugaucugcacugugcccuuuuguguuuucugggauggucuccauuugcuguaaagaggggcuuuuuuauaaggcaugguagccacauugaccuguagguauaaagagaagauguggaauauaauaaggagcuaugcugguuuagcaacauggcagaaguagagucuucuuuaaugucuauguccucaccaguccugggagcuggauagguuuucaguaccaggcauaauuuccuuccuccugaaugggccuuaaguccaguuagacaguugcuaguuaccaucagccauuugcuauuuacugcaccauuguagauaucuugccauacggguuauuguugugguucacagguguuuguugcagcugaauaggacgauuuaauugcuucccucucuugucagcuuguguagaauuuucuucaggaugauagacugaaggaaagaaguucucagacuguauccagcucuaauaaucaagucuuguauccuacaaguguagugucuauaguaauagagguucacccucuagcccugccugcuuauucaucauacauucucauuuccugcauggauguuuccuugaucucugugacccaguucccaguguugcucuucccuugauccuuguguucugucaucuugccugccuguccuccuuauauaccaucaguuacaguugugguuuuaauaaccaggauuguaccaagucuguuucucuacccaucuagcuuuguccuccuccugugcucuacacugccaguuacccucugucuucugauccuuccuuagauacucugcaggacacuaagcucucaaagugaauauagcaaacacuguaagagaggaagauuacaaaacacaauagaauaguaucuuuggaaguuuauucuuaauaaucuaacccaugcccucaaaauugucagauuuucauuugucuauuuguuuucuuucucuucacuuucuaaauuguaguuuuuugugacccuuuucuaggccuucugaaaugucaccuuugcucuuggcaugugaguuuacuguuugcugcauuuagaaguugccacauggcaguucuuuuaguaucugucuuaucaacacaaauaucuauuuaccaguccuuuucuccagggaugggcgauucguucuuguuaugcuagccccacuuccuaaaauaggagccuaucuccuuaagguuuguuacuaacuuauagcuuuuaguuuugacaauguaauuuccucaucauauaaaacaguaauccugugcacauaaagaaaucucuugggggcuggagagauggcucagugguuaagagcacugacugcucuuccaaagguccugaguucaaaucccagcaaccacaugguggcucacaaccgucuguaaugagauuugacgcccucuucuggugugucugaagacagcuacagugcacuuacauauaauaaauaaaucuuaaaaaaaagaagaaaucucucacauagaaacaaauaucauuuaaaaugucucucugaacucaaauuccuuuccagucucaaccucacuaauauuauuacgaccauuguuuucgaacacuuuuuaaaaagacugaaguaugaauaugaaaucuugcagaaaagugaccucauuguguuaaguucauuucgaaguagaugaaccggugaaucagucucagugaugccggcuguuuccagugccccugaaguuuccuaaugcucuucucuagacacucuguacccuuaagaguagccauaaguuuuacuuccaucauuauacauuaauuuguugugcuuagaaauuuauaaacauagaauuauacagcaucauucauucauucauucauucauuuucucucuuucucucuuucuuucucucucucucucucucucucucucucucucucucucucucucucucuuucucucuccauucauauacuugggagauuuaccuauacaauuuuguacacaucauuguuuuguuacucaguucugggagacaucuacuuuauguauauaccauaguuuauaauacaccucuuaaguaaacuuucuccauuugagaucuucauuugcucaguuaauuuauuccuuccucaguccauaguacccuucaauacacuccucagucuauucacacauacaaacccuucauaugcuugaccuccugaaagcacuuauuuuaugguuuucucuccucuauuuucacauacuuucuucuuguuucugcuccauauacucguugguuuucuuccuugccucuuuacggcucugucucagucuccuucacugcuuccgccuccccuuucccuacaacucccuaaaagguugauguuucucugaggucagccuaaauuccuuccuuuguacuugauguacuagcuuugccagaucuaaccuggugauguuacuuuauugcugcugacaucugauagcugcagaaucuguuucuccaguccguucucaacucugaaguguguaugguagcuacucuguccuccuacugcuacuuuguauuauguaucauuagcuugagagucagucuucucuuguugucuuagucaggauguuauugcugugaagauacaccauaaccacagcaacuaugggagaaagcauuuaauuggggcuuacuuacaguuuuagagauuuagucccuuuucaccaugguggggagcauggcagcagagaggcggacaugaugcuggagaaguagucgagaguucuacgccuuguagcagcaggaagggacuaugccagugagccuggcugggucuuuugagaccuccaagcccucuucuagugacacauuuccuccaacaagaccacaccuacuccaagaaggccacaccucuuuauccuuuuaaacagugucacuccuuuaugacuucaaauauucaaaucagcacacuuguccugcucucaccuggaccacucacuaccuuuaaccuucucaacuacuugcacuuuuguuugcuuucaaucaguuuucuaugggaagccuuaggaaaccagacauuggaaaguguuuucuucagugaagaacaaugcuugccagccaaacauggugcccugagcucuuagcuggcauuuaaagaugaggcaggaagagugugagugaaugugcucuugaaauccugugcuuuuugaaaacaaaaccaauguuuucucauucuuuguaauauauuucaaagucacucuaaaggaauaauguuauuauuuaugucuguuuuugaaucugcugggucuguauggccgaggcugcccucagagucagaacucuuccugccucaguuauccaagugcuaagauuacaguuauaccacaacccuggccucuccagggccuaguuuuagaggaugugaggucacucaugcugcuugagucugcgugucaucacagccuccuguggugucuccugcuucaggaccucuguuucucccagaaucuaauauuaaaaaaaaaaaucaucuaucauaguucauucaguaguaacauguacuuacucauaaaacauuuguuggggagaauuauauauugagguuuguacauuuuggguauuuuagauucaacagcuacacaguugaguuuuugaugauauauuuuuccauccaaccaggauccuguuaccuuuuaugcagucauaugcaagaucuggagguuucuccaucaccggcaagaucaaaacagcccugauugagaaugccaucuauuacggcacuuacuugcugauauuuggagcauuucugauuuacguagcuguaaacccacguuugcauuuagaaugguaaggaaagcagucuuuauaacacuguuguguguguuugugcuguuuccguugauuuuuacugcacacgugcaaauaagcaaacacauauacaacauuauaugucuuauagauacccucaaagagugucugaguaaugcauauuacugaggaagaaaguccagcauggcaucuuuaaauauaacuguuagauggugaacuaguaaugauaaguuuuuuauagaauuuuaaauuuuauaaauauuaaaaauuaauuuuccuccacuagaacuuacaguuuuucuuuucuuuuugcuuuuaguuugagagaauaguuuuccuaauguuacuuugaacucagguauuucaauaaauuaaaauucauuuguguauauaauuucuaauauauguauauuacucccaaauuuauguuuugacuaguagagcuagguuucauuguugguauagguaaaccauaacagguuaauuuaacuguuuacaagggcuuccuaguuaaucuugacuaaagaagcaccuagugaaaaauguuuucuguggaggaaauauauauauaugaauauauauaugaguauuuucuaugaauuaucuuacauucuaauuuugacuauaauagaaacaguguuucccauauugaaguauuuuuacaguuacacucugucuuuccauucaaacauauagauuaucugcugugacuggaaagaggcaaaaauuucuucauauaaaauccuacuuuuccucuaugacaguuuucugaaaauuuauuuacuaauuaauuagucuuauauuuuuauauaaaaucauauuauaucagcaaucuguuuacaauuucuauuuuuuaggaaccaacuucagacgauugggauagcugcugccaacacauggggucuguuucuccuuguguuauuauugggguauggauugguggaaauuccucggucauacuggaauggagccaaaagggguuaucuucuuaugaagacuuacuuuaaggcagccaaacugaugacagagaaggcagaugcagaagagaauuuggaggauguaauggagguaagcaaguuuaguccuacaaaaccagcucugacuuauaacucugucucuguugauuguucuccugucggaaaaugagccauguucugucauuggguuuugcuccauuuuaacuuuugugguagaugucuauuuuaugauaguaaaugcuaaaacaggcuaugauuuacaugucuuuuauucaucaauaacuccuaauuuggaaaguuguucaacauuucuauguugugcugaucccaugugaguuuuauuaacauguuggagaucucagaaaauguauauaaguagacuugcacaguucaaacucauuuucaagacuuaacuuuaaucuuacaauuuuacaaaagagauuuuuuaaauucccauuuuauaaugaagaaagugaguuauuaggaguuuaaauaauuugcuuauguacacagagcuaauaaggagagccagggaauuuaguuuuaguucacacuuuaacaacaugaagcuccaggugguaagugucugaggcuuuguugccauguggucucuguugugcaugcuuggcgauuguggucugaaggcaacucuagacucuaauaagugagugagagcaagcuuauauuucagucugagaacaggugguagagcacuggauuugcuuuaauuugaugaccccaauucuuaacuauauccucuugucuuuucugucucugaacauuuuauucucaacuuacuccaucuucaggucuuaagaaacaacauuccucagggagccuuuuacauuagcaacaaggggcugcuauaauaauaguaccacagacuguguggcuucagcagcuguauugccucauagaccuagaggcuaaaaaucuuagaguaaagcaucaaaguuuguaucuucugagagccuaaugaaauuuuuuauauuauuugguagauauauccuuugaaacuucuggaaaaaaacuuuauaaauuuugaagauuuaugcuugauaaaacauuugcauuugaugaaaguaguuuuuuauuugauaguguucugcccaaaaguuggcauuaaauuaaguuguugcagauuugaagaauuuggauuugccagcugauuuacuguuucuucaacaaaugcacaucaaauguauuguuuggggucuuuguuugcuuucuuacaguacuagggauugaagugaguauaucacauacaucuguuaguugcauaccauguacuguaucccuagcaucuucacuacuuuuugucugucugucugucugucuaucuaucuaucuaucuaucuaucuaccuaucuuucuaucugagauagugacaggucucucaaaggugccuagacugugaacucacuuuguauuugugacccagcugccucagccuccugaggagcugugggauuacaucugaccuccucacuggaccgucucgaugaacagugucugaaugaaauagagagauguucuguuauuagauaggaacccuuaggaaugagacaugaaaauuaaaaccuggcauuugugccuuguguguuauuucagcauacuauucauauguugaaaccggcaggauuuaaacauuuuuuuacgagcuaaagucacauauagaaaagaaggcauccuuuccccuccucccuuucggucccuuuuccuuaccuccucauuccuuccuauucuuuccccuucuucuuucccuuucaucccugccuccuucccucccuuuuuucucuuccuuacccccaucucucuuucucucuguuuuuauuugagacaggaucuugcuauuuccguauauaguccaguguaccaccaugucugcuugacagcauucuuuuuuaauggcuguuuaaaaaagucacuguccuacauagauagcagaauguucaugacuauagcaacuuucuagaauagaggaccaaacauucccguauagcauaugauaaaaguauacuugaagugcuuaacauagagaggcuucacaaaaucugcagagagaucagaaaaaaaaaaacauugacuagagauuugaagaauugcuagaauguugguagcuaaaaagauucuaaccaaauaccaguuuggaagcauuggcuuccuaaacaagcuaguauuauagauccucccaaacuuuaaaaauuaacuguugaguaaaccuuaaauuuauaacagauauguagcuaauaugaaaaguuaacuguuucaguucaugcuuuuauuuaauguagcuaauaauuucaagaaaaacauuuuacauauauggucagauuaguuaauuuuugaaguaaauaaauaugugccaauuacagacuuuaaggaaacuuauaaauggaagaauacauuguacuaguacccagaguguccuuuugaacauacaagugugaucugcacaucuuagcacauaaugcuuguaaucccagcucgcuuggaggugacuucaaaccagccugagauguguagcaaauucaaguccagcuugggcuauauagggaaaugugucucaaaaacuaaacuaaacuaaacuaaacuaaacuaaaauaaaaaaguaaaguaaguaaaaaaaucuaaaaaugaaaaccaaaucuaaucuugccagucauguacuuagauugaacguagcucagaauuaauugcuaguuagauuucugggagguuuuggguauguuucucagaucucaugcuaaccaggcauuuagugucauuuuccuucuguagucauuccguucuuuuccucuaacaccgcgccuucguuucugucuggagaccuucacucacugaccuugucccucuuuggaauauucucguuuuccagaugaggcuuacucauuuggcuuuguuccacuuaaaugaucaguucaucagaaagacuccacacuaagcuguagucauccagaauguccugugcugggcuuugcuuuuauagcauuucuauaucuuuuuuguuuguaugucuuccucaguaagcugaguuccuuacaggaacaguguuauugguaucaauuuuucagaguaugcauauauuagauuuucaugcuuaccagaaaguuauucuccaaauagaucacuuuuuacuguauaucguguugguuuguuacuuuauuacauaauauaaauguuuuauaauuuuaugaaaaguccuuuggaguuuacaauuucuuuggaagcuugacuauucuuuuacauauuuauuauccaguucuauuuugaauucucauuuuuuguguuugcuaauaagaaagcuucacauaguaaagugacugugguguauacauguuuucauuauuuucuuaguauaucagaugguuucucagcuuuucauucucuaucacugauagcugugcucuaacacuccaaguguucguuuuaaguucauuuuguucucucuuuauucuaagacugcagcccgucuccuuucuccucuucuuccuccucuucuuuuuccuccuccucuuccuccuccugcuguuauagagcagugacucuaccauuuuaaguaacaaauauauagaauauugugauuccuagggaaugcuaauuucaaagacucuguuccuaacccacccuuuuuuccucccuccccuuucucugugugguuuacuuaguaaugauguuugugcgcauguguacauagcugaaugcccaaggugaguauugcauaguuuuuguucauugaugucaaccuuuaguuuuugagaaagggucucucucugaaccugaagcacauuguuuuaucuagcccggcuggccgugagcuucaggggucccccugucuccacgucuacaguucuaggguuauaagagaacaccucuaucccuggcuuuuuaccuugguucuugggauaugaacugauaucuucauguuuauauggcauugucuuacccacugggcuguuuuccucuaccccuuaugccuuuaguauuuauuaaaacacuuacuugucaccagaccuuugucagugaaauugacugacagugcuuugcugcauugguuacuguuuccaggauaaaauaauugacaagaacagcuaacagaaagauaagauggcuugggcuuacaguuugaagggcuagucaaucaugacaaggaacgugugauaacggaguguuaggaugcuaggucuacuguuaggaaacaaagcgagaaauacuguugcucagcuuacauucuccuauuuauucagaugaaacuaguauggguccuccgaccucaauuaaccuaauguggaaaauccuucacagacaugcuuacagaucugucuccaaagucauuccagaucuugucagguugaccaucaaucuaagucugcccaucacaagucuacccauugucaaugcgauugcagacauaccacuuuuaagccauaaccuuucacuccuuauccccaugagcucauggucaucucauaaugcacauguacugggucuaacuuuaaauacaguuuuuagauuuaaauagauauauaaauagauauaaaaauauguauaguuuucaacaguuccaacauuguucaaaaugguaaguucagagucucucugaaucuugagcaauuucuuaaacgugagucccuauacagccuaaaggaaguauauacuucuaacaaaugaugguggagacuaaacauucacaccucaaaaggaaagaauaggggcauaguaaggaaaguuuauauuaaagcaagaccauaacccagcaggaaaauacuaaauccuguaauucugugucagguaucugggguucaugauagaacaaucugggccccaaagagcuuguguaaccuuucuccucuaguucugccacuuguaacaccuguaacuuagucucuuggauauauaugccaguggauuccuugguagaccucccauggucccagaacaauaauauccuugaguuuccauuucagcuuagccuucaccuucacuguuucauacaaauggcccuguagggccuuuguauagggaaucugacccugcugcagacugccuguccucaguagccuucuggaagcuauguaaagccucuagggcccucucacucuuucauccuucaggccucugaaaccuuuaccauguggaugaaacccagaccuuuuggaccauagcugcuaugguuucugucugugcagacucuucuucuggaguaggaaaccccuuuaguggcacucauaauucagacuauuucaaauuauuuugcauuuucacagaaucuucaguggagggauuuuugucuucagaucuucuuuccgaguuccucuaacuuuauagugugcauucuuuucuuuaccaaacccaguccauuucuuuguaaucucucacuguggaacugaauaaaagcagugagccguugccaugacauaacuugaaugcuaugcugucuugaaauuuccaccaucaaagaaauuaguccacauggauucucagcagcuaugauuauguguaaaagaucaaacgggccagaaucccagcaugaaugggaaaggggccaucuagucccacccauagcuaggagcuauuuugauaauucauggcugcagggauaaggguagucuguuuucuucaaauauauggucccugaaagguuacaguacucccacagauacuccuauuucccuauacauacaggaagcacuaaguguacucaguggguuuaaaaaaaccaaaacggaugaaguuggguggaaaaguggaaagcauaagggaggaauuagugugaaagagggauggguuugaucaaacacauuauaugcacaugugaaaggaaguuauuuaugaaaccacagucuugccuaaguucacauauauuguguuuacaguaaauaaauaaauuaauuaauuagaguaguccauuacuuuuuaauucagucuugucuagcuucucaggacaugagcagaaugccagaaugaagcaagcauggcuucugucccagauccuggucguacccuugaucaccuccaaaacugcaugaguugacccuccacaccuuuguuucacuugggcacuucaguuuauugaccuuuuugaguucuguggccugacacuauuacugaggcuauggugcucacaaaaaggaaucuagcaugacagcacuccagaagacccaacaagcagcugaaagagucagaugcagauauuugcacccaaccaauggacagaagcagcugacccccguuguugaauuagggaaggcugaaagaagcugaggaggagggcgauccuguaggaggaccagcgcucucaauuaauugggacccccagagaucuuacaaacacuggacuaccaaacaggcaguauauaccagcugauaugaggcccccaacaaacguacagcagaggacuuccuggucuguguucauucagagaugauguacuuaacccucaggagacuggaggccccagggaguuuagaggucaggugggguuggggguggugugggauguggagcagacagaggguggaugggggcugggggaauagaauauggaguguaaaaaauaaauuuaaaaaaacccaacaauauuuacuaacaaaauaaaaauggaaguaauaugaaaagaagaaauauaaaccuugacagauccuuugugaacucuuuuuauuuuauuuuuugagauuuaaucucucucuuauuuccagucacucccacuccccuuucucucuuucaaaucaugacuucuuuuuuuuuuuuuaguuaauuguuguuaugaacaucugcuguauguaugcguguaaacauauauguucuaaauacaggccacucagucuguauaauguuauuuguguuuagguguuggauaacccauugguauagucuuucuucccugggaaggcccgcucucagcauuccucaguugcuugcaguucuuugucaagaccucuuggguguuccccguccauaucagcaugccuguuacugcuguccuuguucagcucauguuuaugcagaagccuuagugagacuuuguggguguagcuugugacaagccuaggagacucagucucacagcgacucacugauccucuggcagggaggcuccggcucuuacaguccuuugccccugacgccuaaccccacagugauccccacagugauccccacagugaucccuaagccucagccgagagaauaguguuguaaacgcaucacuucagacugggcucuaaaacugugcauuugauucauugugguuucuauugggaagagaagguucuuugaggagggugggaacuacacuggucuguggguaaaaggcaaaugguuauugucauguucauaagcaucauagcuggguuggacaguugaucacuucccuccuuugggagauaucauggcaucuucugguacuaugaaagcuaguccucaaggauaaggcuuucaaaucaguucuagcucacggguuucugggcccuaugccuuaaauguacaguguuuucagaaauagagauuuuaaaguaauaacaguaggcuagcgcugaccaacaacucaauaaaaggacuucucauacccguguugagguuuuuguuagauguuauuuagcuagcucuugaaauaaacuugucagccccgaugggagcacuuaauuuaaacuauauauguuuauuuauacaugcuguguccaaguugcaggaaccucaaagaccacugagagacugacuucaauguaaacacauaagggucuuuauuacaagcucuagagcaaguucucucaucaucccuguugcaguaggucagagugagagccuugagucugggggugcagaguauuuauuguaguuacagcaagcuuggggaauuuccauaugggucagcaaauuaauauuuuaaaaacuacauuucuggcauaaucugcagaaacugaacagguggacaaaaccaccugaaaagcagaauggcuaaguuaucuguucucucuggaugucuuaaguuaucuauaugaaccuugacccugcuguuguagccugacuggcuauugcuaugggggguugccauaggaggcuuacucaggaggacucugguuuucuuccuggaauugaaguuuagccccuggucuugcacuaaauggaguuucuucaaaaauggaauuggcugggcuuuacauacacacauguauuauaaacuuuugaacuguuaaauaaugcuagccauugugauauaugaaauaagcaaacaauggagggagacauuuagaaauccauagaacagugaaggauguaaauacagcuauuugaauacuuuauuuuauaagugcucuuaauaaauuuuauuccaugaaaaaaacuuauaaugcuaaauaauuugagcugaaauuaaaaucuggaacuugugugaacucucauuuaaaauguaugauuuauagaaaucuaaauauuuuuauuuuacuguuuuuauaggagguucguaaaguaaaugagagcaucaaguacaaccacccacugaggaaguguguagacacaauacuuaaaaagguaaucauguuauauuguuuccgcuuuuucucgugaaguacauuuuuauauacuauuguaaauuaauuuuucacauaggaaagugugauuaaagaauauaugguuaagguuuuccagauggauuuucauguaaacuuuaccauaaacaaaagaguaguuuauauauagauuuuuuuuucuguucuaaguuuaguaguaauuauuggcagcauuuuacuuugaaaugugaaacauuugaauauaauuagaaugcccuacaauuauugccauggcauagugauguagguacauauucacagaaccaucgugucuuaucauuaauaucaagcauaucuccuguaggaaaauaagcuagggucugaguaauuguuuuuaauuaacuaauuuguuuacaucucaaaugcuguuccucuuucuggucccucccucagaguuccuccccaccaacucccucucccucuccucugaaagggggcccccuuagugcaggagggccucguuccagccucuguauguucuuugguugguuguuggcucagacucugagagcucccagggguccagguuggcugacucuguuggucuucugugagauucccaucuacuucuaggcuucaguccuuuccuccaacucuuccauaagugucccuaaccuccgucuauguuuguucagucaccugcuggguagagccucucagaggacaguuuugguaggcuccuguuuauaagcauuacuaaguaucauuaguaauguuagggauuggugcuugcccaugguuucaaguugagcuaguuauucauuggccucuccuuagguuucugcuccaucccugcuuuucuuuuagauaggacagauuuugggucaaaaguuuuugaguggguuggugucccuuuccuuccacugaugguccugccuggcaauaggaggugggcuguucagguuccaugucccuaccauuaggcauuaacuuuugggagccuccuauuucccaggucucugggacuugcuagaaaucccacccccacccccugcccaggcagcugcagauuuugguucauuuucuugccccacugggccucuccucucucuuccccaaccugaucugccuuuucauucucuaccucccccauccccauuccaacucccagucccccccaccccccgccccggcuccucugccuuuuaugacuguuuuguuucuccuucuaaguaugauucaaggccauccuuacuugggccucucuuguuuauuucuuuggguuugugggguguaucauggauguucuguauuuuuuggcuaauauccacuuaucagugaguacauaccaugccugguuuuuuuuuuuuuuuuuuugggucaggaugauauuuccuaguuccauccauuugccugaaaaauucaugaugucuuuguuuuuaaauaauugaauaguaucccauuguguaaaugaaccacauuuucuguauccauuuuuugggaaagggacaucaggguuguuuccaguuucuugcuauucugaauaaagcuguuaugaacauaaugaagcauguguccuugaucucaguaauucuugcaaccaucuucucacaugucaucucauguuaugucuuauguauuauagauuacauaaacauuuaauaauaagcuauacuguuaugauuuugauggcacuaucuugaauugcaggcauauuuuuaugccucuaaaagaauuauugaaaaguugcacaauuaccuuuuauauacugucuuaguuuggguuuuauugccgcgaacagauaccaugaccaaggcaauucuuuuaaggauaccauuuaauugggacuggcuuagagguuuagucuauuaucaucaaggcaagcauggcauuguccaggcaugcauggugcaggaggagcugagauuucuacaucuucaucugaaggcugcugggagaagacugguuccaggcaacuaggacaaggguguuaaaacccaugcucacagugacauaccuacuccaacaagccugcaccuccuaauagugccacuccuugggucucgcguagcuaaaccaugacauuccacuuccuggcccccauaggcuugguucaaacacaugaaucuauggaagccauaccuagccauagcauaauaaagaaguauauuuaguccaacuuccagagucccuauaaucuauagcagucucacaauguuaaaaguccaaaguucuaagucuauucugagguuuauccaaucacuuaacuguaauccccaaagcaagucaggaaaccaacugggcaaacucccaaacucugcaucucaugucugauaucaaaggggucuucagaucuccacuccuuuuucaucuuuguugaccucaacaaacuucuuucuccugugcugguucuacucccuguuagcagcuuuccucugcagauaucccauggcucugacaucuuuaacagcuugaggucuucaagucaaccucagcuucccagcuucuuguuccacugucugggauccacacaugaucuucugagcuccugcaaaggcuucuguagcacccuaggcuuuggcugacuccacgccacugcugcugcaguucuuggugauuaucccaugguaauggcaucucuaguaaacuggggucuucaccuacaauuaggcuucaccaauagccucucauaaggcucucuucauggugcccaaacuuaacuucuuugcaugaccucuucaguccugggccaucaaguauaacugagguugcaccuucaucaauugccuucccuggccucucacagugccaaaucucagcugcucuccuugaccccuucauaccuucaaaaccaguauccccugggcgauucuuacacauuaucaaguccagcugcagcaugagguacaaccuuuccuacacacagcuucuuugugcucugagaaaacacuucucagaagauuucaccuaagugaugcuggucucuucuuaaucacugcuaauuucuuaguuucagcugaccagcaucaauugucccaguaaucucuccuaagcuuggcaguacugaaacuugcuguagauugaccuugaacucagagaucugcaugccugucuucuaagugcugggauuaaagaaagguguggucuaccaagccugguuuuaagccuuucuguacuuagaauuuucagugacccaggcuggccuugaacucagaaaucuacuugccucugucuccuggaauuaaagucauauaccaccuugucuagaccuaagcuauucauggccucuaugccucaagauccagaucaaaagccugugucuuucauuucuggauuguaguucauuccagauuaaaaauccaaacuauaccuugcucagcugcaaauacagacaguaaguuuagcugggugggaucuugcugugaggucacuacucccuuaagcucuuuaucuccuugaacacaggauucggcuccauucacuuccuagucccccuuuauuacuugaaccauacauuuuagauuuuuccuuucuaagcuugcuaugguuguucaaaaugcucucccugacacuuaaccagagaacaaagucucugcugggccucuuugaggcuuccuuuuucagugcauuuaauuuaaaucucuuuacguuagccucagguagacucuuaagacaagggcaaaaaguagccacauucuucaucaaaauaccauaaaaacagucucuacgccacauacugaauucuugcgcuaugucugaacaguucaaaccacucugggcaacaacgucuuccauauuucuacuaagaugguccauuaagccccacauaaagcauuccacugcuuuccaaacccauacauaguccugaaacccaaauucuuccaaacaaaagcaaggucaggccuaucauaucaauaucccagucccugguaccaacuucuuaguuuggguuuuacugccaugaaaagacaccaugaccaaggcaauucuuauaaggauaccauuuaauuggggcuggcuuacagguucagagguucaguccguaaucauuaaggcaggagcaucauggcauuguccaggcaggcaugguacaggaggagcugagagcucuacaucuucaucuauaggcugcuaggagaagacuggcuuccaggcagcuaggacaaggguguuaaaacccaugcucacagugacauaccuacuccaacaaggccgaaccuccuaauaaugggcccacucccugggccacgcauauucaaaccaucacauguacccaaauuaucaaugaaauuugucuucuuuuuuuuuuuuuuaaagauuuauuuauuuauuauauguaaguacacuguaguugucuucagauacaccagaagagggcaucagaucucauuaugggugguugugagccaccaugugguugcugggauuugaacuucagaccuucagaagagcagucgggugcucuuacccacugagccaucucaccagccccgaaauuugucuucuguauuauaaaucuguucuacuggcuauuauuagcuauuguuucuuuagcuaaagucauggucauaggaguaaacuuccuaauaauuucucucauauuuguuguuuuugaggccuauuuaggaaaguuaaugaacuugcaaaacuugacauauguaauaaguaaguagccguaggacagauuauuuguaucccuuucugcuuacugugccuuucagaacuuguguuuguuuguuuguuuguuuguuuuuguuuuuugagacaggguuucucuguguagcccuggcuguccuggaacucacucuguagaccaggcuggccucgaacucagaaaucugccugccucugcuucccgagugcugggauuaaaggcgugcgccaccacugcccgcugggcuuucaaaacuuaagcacuuauauuuuucaugguucuuuuuuauuauuuaggaaaaugauugacguuucaucauuaaagugccuaucauuagaauaaucuucucaaauaguuguuacuucguguagguaagcucccuccacuuuccuagucucuagcucguauagcugagcguaaaguagaagcgugaagaaacucaacauaccuaggagauguuuccgugaaaauguuagcuagugaaaaccuaaccaguuagaaaugucaauaaaagaagaaaauuuaaaauuucuagagugaaagauuuuuaauaaaaauaaauuuuuguaucauuaaaauuucaugaauuguuuuuuguuuagugcccuacagauuaucaggaaaagauggguaggaauauggaugacuaugaagauuuugacgaaaagcgcaauaccuacccaagugaaaaaaguuugguaaaauugcauaaacagguaaguuuaauuauuaauuuuagcuguuuuacauacaauuaaaggaugugaauuagauuuguggcuguuucccuuuacaaagggcuuucugcuuuuuuggcucggaaguuaaagggcuugcaacucgaguuugaggagcugagcucagucuccagccccuguguguaaagccaggcagagugguaugcgccucugcuuccaguggcugggagacagagaugagaggaccaauggccaggcaggucacccagaucugagagagccaggcucagugagagaccgagugucaaaacaggaggaugccuggagaaaaugccuggcagggacuugugguuuccacaugcccacaaccacacaugcaggcacccaccucuccaaaugugugugcaugccaaugaaauauauaucugaaacucuugaucucauuuuuguuauuguugaaauguucuaacuuuguguuucuggauaaggauucucuuggcaacucaauauaagaauuauaccuguccuauuaauaggaacugucauuuuaaaacauuaacauacuuggucacauuuagaaaauccauuagugccggguguggugucacacaccuuuaaucccagcacuugggagguagaggcaggcagauuucugaguucaaggccagccuggucuacaaagugaguucuaggauaggcuauacagagaaacccugucucaaccucccccccccccaaaaaaaaagaaaagaaaagaaaauccauuaguauuauuuuauuagacacacacaagcccuguucucuagcagaaaguugaccuaguguucaggcauauugacaagcuuauuccucucuguguuccaggugauuuauucaguucaaaggcaccgucggacucaagugcaauggcagauucuuuuggaacaggcauucuaucuagaagauguagcaaaaaaugaaacuagcgcaacucaccaguuuguucacaccuuucagucaccugagccagaaaaucgauuuauccaauauuuuuauaauccuacuguugguauguaacuuaacauaaauuuucuuuuuuuuuuccauuuuuuuauuagauauuuucuucauuuacauuucaaaugcuaucccaaaaguccccuauacccucccccugcccugcuccccuacccacccacucccgcuucuuggcccuggcguuccccuguauuggggcauauaaaguuugcaauaccaaggggccucucuucccagugauggccgacuaggccaucuucugcuacauaugcagcuagacacacgaacucuagggguacugguuaguucauauuguuguuccaccuauaggguugcagaccucuucagcuccuugggugcuuucucuagcucuuccauugggggcccuguguuccauccaauagaugacaugaauuucaaaguuaguaauuuuucuacgaggaaaauuauguuucaucaauacaaugcugacuuuuacuuguauaugaauuuguuucauaggguaguauuaaauaucugauaaacuuacccuaaaaucauuauuuuacuucuaauucuccuucuuccagaagccauugcuugccuguaguucucugucuagggggauaccccacgaaguuuucccucuucuaaguuaacauauccauuaaugcugccauuguuccagucuuuuuuuuacaggcaguuaggaaagacuguuucaccacagacuugcugguguucugacuuuuagaguccuacucucgcuacccugauacuccuaagccauagauaugggagcuguaauauauuuuaaaaauacaaauaaaauauuugauuacaaaacagguuauauaaaauacauuuuauaauuuuuauggaagcuguuugaaguauucacucucacuaaugaucucaccauaaauguauaucauggcuuucacucuuguuaguauaaaaaccauauuaauuagcuaaacuuuaaaaacuaagcauuauaaauauuaacagaaauuccuacaaauuaaucaaugguguaugaaauauugucuccauaauaucugguagcauuucucucaacauaaugauuauuuaaaaaaaaguugaaacuucuuaauauauuuaugccuaugauuuuaaaauauguauauauaaaauauaauuauaaacaauuuacauacaugaucaaacaugcuuagagaccaaaaauuaauaaaugaauaaaaaguaaaaaugaacagagauaaggguaauaacugugguaaauuaggggauaagaguuugaaacauaguuuauaauuuuucaagaagguacauagagaagaaaaugauugaagcaguagggaacucugaagcaguauugguggguaguggagaggagacaggagauagugaacagugaagagaauagccuuacuuuaggaggagagauagacagccagccagcauuaguguaagaaaguguagcaaucaauggugguaaguuuccaucuaacugcuauacucucuugagaauguacugacaaaugcaaaguaggagauuuuucaagauacuuuaaggugagaauagucaguaaaggugugucuuuguucugcaguguacagacucaaaguaaccaaggaguuggaccaaacaaugguuuaaccaaacaaguacagugaagcaagagaggguaaaggcauugagacuggagaguuguucucuuuaagccugugggaucugagcugggaaaggaagggagggagggaggaaggaaggaaggaaauugcaguuguucaauaacaguaagaaggcaaaggaaggaaacauugcgcugacugacggccaggcacaauggccagguacucuugcaguacagacgaagguauugcuccgggaggaggaauugggcuguauagaaaagucaccauuguuagcaagacaacgucuaggaaaggcuaugggagggagugauuggguuacugggaggaguggaggaugaacucauuagaagagaggagaugaagacaaccagagaagaaagaauuacgugcauggauguuuaaguaggaauuauuuggaggcagugagccugaaucauagcuuuucaguaaauaaagagaauguagccuuacugcaagcuguaacucagugguagaugauacagcacacucgaacccuggguucagucuucaaugggauggaugcauggaugggauucagaccuaauaaaaccagaauuucaccaacuauucucauauauccagguucuucguauauuaacacuucauuaauucccuuuuucuuuuucuacauacacuuuuucuuuaaucuuucagagauuuccauauaugaggccuuuugucccuugguaauuucagucuauacuuucuaaaaauucagcuacucaaguauaacucaaaaauaguuggaaaauuaacauuaauaauuuacuuuuauauaccuuuuacauuaugucauaauuauaccuaauuaugacagggauuuuuuggaaaaagaaauaaagcacacaguguauuuugucauauugcauaguugucauauuucuuagucuuuuuaaaucggacacagaauuucaguccuauguauuuuauucucuguguauuuuauaacauugauguuuauggacagcuaguuuuugcugaauguccccaaauuggagauugcuguaucccugugauuagacagagcugugugucauuugcuggaaucccacaaaggugauggaugucaugcucuccucagugcaucagagcaggaagcacauggcucucgguuucaaccccacuggugaucuuugccuagcgucaugccugguuuuccacugugacguugcaauguucucuguagugucugauuugcugcuaccugaaagacuauaaauacuucauacugauguaguuuuccuaacuguauuuuucuuguauuuuccagagugguacugggaaugccuuuugcguccaugguuucacaggacccuugcugugguuuugucuaucuucucugugauuguuguguggucagaguguaccuucuuuagcacaacuccugucuuaucccuuuuugcaguauucauacagcuggcagaaagaacauacaauuacauuuauauugaggucaguuuuuccuaucagccauaaaucuacauuuguuccugcgcaugcuuuaacugcuguaucuuuucucgugcuucuuuuuguaagagugaaaggaguaguuuuccacagugcuauuaugacgcaggcuuaauucacacagacuaaaaacuaagacuguagcugaagaugaaugagaaguauaggacagcgacagccguucuacgaggcugcguuggccccuguugucagggaagcugugcaccuuacuaucuccauuagaguuuucagggaauaguuaaauaggaucuacgauauugaccugguugaaauguacaguuuuguuuucauaauuuccuuuuuccuauaagaaaaaaaccccacacuauuguuguauuuauauuuuaggaaucaguaaauguagcugaggaugagugauaauucuugugacaguaaauaaaguaauuaaguccuaacucaaguuguaacuauuuuuuccagauugcuugcuuccuuuccaucuucuucuuaagcaucuguguuuacucuacuguguucaggauccgcguguuuaacuacuacuaccuggccucacaccaucagaccgaugcuuauagccuucuguucaguggcaugugaguacacugcgcuugggaaaagaaaugccuccguuuugcauaauaauuauaggucucuuauuucuuguucauggaugucgcaugaacauauauuucugugagcucacuguucuauguauguauuagauaguuugcauauauauaugguggcuauuugcugauuaccagcuaaauucugccuuuaaauuuaugguaauuuaagaaugauauguuaggcugggcccaguggcacaugccuuuaaucccagcacuugggaggcagaggcagguggauuucugaguucaaggccagccugguuuacaaagugaguuccaggacagccagggcuacacagagaaacccugucucaacccccccccucccaaaaaaagaaagaaaaccauuuguuucauagaaaaauuuacagggcugccuuuagcuacacuagcuauacuauaguauuuauaauauauauaugauaggcuagacuuagggaaguucaaaguaauaucuggugucaaaauuuugucuuauaaaaauaucaaaaccaccacuguguuaguuuuuugugacuguuuuuuuuuuuuuuuuuuuuuuuuuuuuugguuuuucgagacaggguuucucuguauagcccuggcuguccuggagcucacuuuguagaccaggcuggccucgaacucaaaaauacgccugccucugccucccgagugcugggauuaaaggcgugcgccaccacgcccggcuuuuuugugacuguuacaaaaccugacacaaacaaccuaggggaagaaauaguuauuaugucuaaugguuucagagacuuuagucuagcauuacuugauauuuuuuugggcaagaagugaggcuacacauggcaagaagaguauacuggagcagacagaguuaacuacuucaugguaccuaggaagcacaggcaggcuggcaggaccccaagcaugcuaacuuuuguucauaccuccuagaggugacuugcuucuuguagcuuggcccuaccuccuaaaauagagccauccacugaagaggaacucuucaacacauaagccuguggagguugugucauauaugaggcauauuuaaacuauaacaagaguuuucagagcguuacagauauaccauauaagccuccucaaacuucuuaccauagugacauugucuguaguugcuauacaauaucaaaccuaagaacuacauuagcaguguagacuuaauuaguucuuagauuuucauccauuugauguguagacugcuacagcuaucaccagcauacagagcuuccucuuaccacaaaaaaaaaaccucuugucacuaucuccuccuuauauuuaaaccuuuucauucuucaaacccgucguucuccaacgcuagcuauguaagauccucauuuuauacuugaucuuagccagaaugcugaaaucagacacccugaggcuauauaaguuaguuauauaagcauucauguucuuaaaggaaaugugauuaauaggauuucugaauaugucccaguaagggcaguucauauggagaauucaaacuauaguugacuugaaugaauauaauugaaauauguauauauauacauauauauacauuuauguguauaguaugcaaauagaugaaaauuauaguuacaaugaccugaaaugucuuaauauauuucacuauaauguaaauuguguuugguuauauuucaaauauauauguuggcaguuuugaauuuuauuguagguuauuuugccguuugacuccuccuuuaugucuuaacuucuugggauugacccauauggauucauccaucucccaccagaauacccagccaacugcauauacaucuguaaguaugguucuuuagguuccuugucuauguaagauguuguuaugagucaucuucuguuauuaguagaaaaucuguguagcacauugaacuccuuuuuaaucacuaaagccuuuucuuaaaggucauguauguaguuauuaaugauaggauuaaaguaauuuuccauuuggaauuuuuaaaaaaauguauauuuagauuacuuagaugagcagcaucaaaaccuguuucauaguagcauuagcauguauauggauaugcauguauaugcauguauauggauaugcauaugguuuuguaguagucauaaaauacuagauuucuuuagaagaaagcccagacaggaaaaaaguuuaagaaauucauaacacuuaguacuuuguuucuaaauuuugaaaagucaaauuuguuguuguagcuuccuguggguaaauuuucuaacgaugggaaagaaggagugaauaucugaagcccugcugacuuaacucuucucuugcucuucagaucauggguuccaugaaaguuuuauccuuuauugcagauggauucuauauauauuauccuauguugguaguaauucucugcaucgcuacguauuuuagguaagaaauuuaacauuuccuuuuuuucauacucuuaguuggauagagauauccauuucccuuaaaagucuacugaguauuuauuugcuggcuugguuuuaguuguuuguguuuuaggagguuaggggagcuaggacaguuugaagggccuuuuugaguaguugagucagguucuccaucugcagacaguucaaagaauagagaaguggaauuauucuguugcaguuauauagccuguagagugaaaagauuaacuauaugaugggaacuccagagucgugggcugcagcccugcaagcaugucuagcuucuuucuaauaacguaaguuagucuuugggcuuauucuauauuguugcuggguuuuuaaauucugcagaugcuagccaacacaaagggucaggugaggagcacuuauaaucaagauguguauauaaaguuggaagaaaaauacuucucuaugcuuagaagaugcacagcuugcucuuuuucugggcucagagaagauuauagaaacuuggcaaagguaagguuuaaaaggguuaagucuauuaacaguaaugaacgcauucuagccaugguuaccuacauaggacuuacuauaccaaaucaagccagcuacaguuccugcagagaugggacuugcucuccaggccccaucccuuccugaggagcaguuggcaguugguaggugcucuggaagggcgaccuuuuucuuugcguuagcuaaggaaaguuucccguguuccuggcugacccuauacccacgcaaguauggaaagcacucaguggaccugguagauuuuuuuuuuuuagaaaaagaugcaaaguuaagggaggagguguuaaggaguauggggacaguuggaggaggaauuagggauuguaugugaucauacucaugguauacauguaugaaauucucaacuaagaccaaaggauacaauggccucagcaccgugucucuccuucucauuccuuacucucauaccccuucaaccuuugcuuacugcuucagugucucaacacgugucaaauaucacuuuuauaaaaauaugucauuaauauaaauuaauuugccuuucuaauaacaguaaguuuuauuaacuuugguuuaaaucuuguacuauuugugcauaaauauaaauacaauuagcauguugauauuagaauguuuguuuaaaucaauucuccauuaaguuaaauuuuuuaguuuuugauaaauaaauuagcuaaaagauuauaauuuaaaauaagacugaugagcaugguggcacaugucuauaauuucaggguuuuguaggcugagacagaggaucccacguucaaagucagugucaguuguauagcaauaacaugcuucaagagaagagcauauauaaaaugaaguauaauaagauuaaaauauuauucgaggccagccugguuuacagagugaguuccaggacagccagggcuacacagagaaacccuguuucgaaaacaaaacaaaacaaaacaaaacaaaacaaaagauuaaaaauauuaauaugaauugacaccaaaauuauuguuuugaguguuuccucuaaaguggaaaaagcauuagccgacuuuauauauuuaaugcugugcuguuuauuauuauuauuauuauuauuguuguuguuguuguuguuauuguuguauuuauuguuuacucauuuaauaguuuaaugaacuuggcccauggaaccauaauggaacuucgugaacuuuuaauaagcacaucuuuuuauguuaguuuucauauuggcaagauuaaaauuuugagauuaaaugacucuguggcucaaaguaauauaaauuagaauaaugcugugucaaauauaaaaucuuaaugaagaaauaucauuguagggcuggagauguagcuggagagggaagcucgggggaguuggaaagcguagucugagguguagggcagccggagcucguucaggggucccugggccugaggugagauugggaccguggcguucccaggcucuuggacucccaggcaccgcugcagaagagcugaaaugagugggcuggaucuagccguggccagaggggauaagggacgagcuggucccacaggugagaguccuuggcuugauggugggcuugguuugggcuugguggcagucauggcugggagugcaggggggccuucuauaggagauuagacagcagcagcucuguagacaaaggccaccuccauggcuccccacggaucucgauggaaagaggcaguccacgguuuuaaggcauuuauugucgugucagaaaguggauguguaaaaccuuaccccacuucucagggugggccugagauuagauaccuuugcagggaggagugucugggaaggaaagcuuauuggcuauguagguaccucauuaaaauggagaucugucuugagccuaugugaccucaggucacauguggagggguuggggcguugcccuuaugugauugauggcaaccgauauaugggggacugcagcuagugacaggggccugguacccaggaaaaggaaaagcuccuauuguccuuucagggucuccugggcuuuuagccuuagcucaucuggggacuaugcuaccuuucauggacggacacacacacacacacacacacaccaaaaaaggaagaaagcaagcauuaaaggguucuucguaagcugggaaugauguaugcuguaaaugggcagcaggaagagccugccuuugagagcagccugggcugcacagugagcuuuagguucuaauugaaucaaaggaaggaagggcugcccucaaagccaugcacacagucuucuuccaugacaacaaguauucucagucagauguuuauacuuuucauaauggaaaucagagauuuuuauuuuaacugcuguuuuucuuuacacacacacacacacauauccacuucuuucuccaguccuucaagugauaaauauauuuauuccuuaggauuauaaaagaauuaaauaugagugaauugucugauccauguaugaucuuuuuggggggugggucgggagcggcguuuaagacaguguuucucuguguaguccuggcuguccuggaacccaggcuguaaaccaggcugaccuugaucucagagauccaccugccucugccucccaagugcugggaccaccacugccuggcgucauaguaggaucuuaacaguauaaauugugcuuauccauauauugcuucuucccuuguauaccauguuuuuaagguacucuugcucuauaugacagauuuaaaugucuaauaagauuucaaauaauuacccccagauaacauauaaucauuacaguguauaacagaaaaacuucaauucuugagugaaaaaaaaaccauaacauuaaaauuuacauaauuaagauuuuuguaugccaagucugaaagcacagaccucgggaggcugaggggggagguucacgcugagugugaggcccgccuauucuaauacagugcuaauacagaauucuaggacagccugaacuucagugacaccagcucucagaaaccaaaagauugucuaaacaagaaaucccuacacguacagaugcugauuuuauuaauuauuuuacucauccacuguguagccuuugcugucuucugccucuagagggcugggauuaaaggugugugucaccacugcccauggaaaugcugauuuuauaugcauacuucaguauuaaaacuacucugaauauuuaaaaagaacacauugauuuuguuacagccaucauguagcaauacaggaauccuacucuacugagaaaugcaacauaacauuugauuguuuuguuuuuagacaaaguuucacuguaaccuaggcuggccucaaacccaugacaguucugccucaggcucccagauacugggaugauaggcaugaugcuucauaugcaucuggauguaagcgcuggaaaaagaaagagaaauaaggaccuugugcggaguggcgagcugcguugcuaugcaguuuggcauucuaauacugagucaugguuucucuggggcugacagugguaaagaacaauuuaucaaaauauuuacaaaaugaaauaauacuuauuguuuugaaauuugcuuuuauuaguuugggcacccguuguuugaaucugcuugguuuccagcaguucaugggagauaaugauaugacaucagaucuaguugaugaaggaaaagaauuaaucagacgagguaagauuuguuauccuaaaauaaauaaaagggcaauuuuaagugcuaagacucaaacacaaaaugagugagugcaaaauuuguauaugauuuuauucuaccuuaggugguuuaaccuaaaaaacccauauguccuguuuucuucacaaaauauuugaaaauauaauguaagguuuauugugaggaaauucuguagcauccauuaguagugaaucugcacuagauaauaagcauuugauuuauggucuuggacuuuguguuaaucauccuucugacgaugugacaaaauaacugggauagcuugcaaggaggaaagacagcuuacuucaacauuuaagugauuucaaucuauuguuacuucccuuuugaccagcauaguguaucauggcagagagcaagccaguuuaucacauagaaucaaugagagacacaggaaggggcuauggucccaguaguaucuucagucuaccccagugauuuagugauuuagcuuccuuccccuuggcccugccuucccaaggcuccaguaccuaccaaaggaaguacaggcugcacagccuuuggccagaacuuuaaggaaaauacaacauccaagccacaguagauugguuugucuuuguuuugaagcauauuugccaaguacugugcaacuauaaagcuaauuaacuuaaagauuugauaguuugccgcuaugugcaauaucauucaaacuguuuuucucuuggaauaaaugaucauugauaagagaaugaaaguacuauuaaaauacauagagcuuuccuaaagccuauucacaaagaacaugucuuauguuuucuuuuguucacgugcugguaggaugagugaaagccuugauuuggggacauugcuucuucgucuccagaauccagccuucacaugcucucugaagaaguagugucucuuuggugugauaauucuguauuuggcauagaaaccccuuccuaauauugauaagaaugguaagcuggaagauacugagagaauggcugucauaacuuguagacucuaucuuaagggaagcauugcacauacauccaaagagcuuauaugagagcagaauuguacagaaaguauaaacuuagaagaaaaguccaaaagagaguagaagcuacagaaaaacucaucucagaucaccaaaaggaagaacauuuuuucacuaaagguagacgggcuccaaaguuaucuguaguaaaacagggauuuguaguagauuguagauacuguaugcucuugcuuugguuacucuauuucuaaugaaaccauguuauacuaaauuugaggccauuuuucuugucuuuagagaaaagaaaaaggcaaagacaagaggaaggugaaaauagaagaagaguaaguauaauaguuuauuaaauugcuacuaaucaugaaauaucuuggaaacaccaugagaaucuuacuuggaguauauaguuacagaugagaaaaaguagguaaagggcauaggauuuucuuuucccuuugauguggaugaguguuugccugaguguaugacuuuguaccagguguacugguguacuggugccuagaguaugcggaagugcacuugggucuccuggaacugaauuacagaugaccaggaaugcaacccaggucacuuggaggagcagcagguacucuuaaccacuaagccguaucccagcccugggcauauuuuuaaaaaagggaacauuuuuuaaggcuuuuacauacacguagcgugcuagguauccugucagauuggguccaauauccaucaggucgcugaguaaacuauauauacagugacugaguaaauuuaugcagccuuauugauaauguaaauuagguugcuuuaaaaucauuaugcuuuuucuaauaugacauguguauuuucaucuuuaauuucucuuuagugcuccauuuucugaggcaaaucuuuucuuugagaaagugggaaaaaaugaaagaaaagaaaaucuacucacaauuucuuuaacuauuuaauguugauguauguaacuguaauucagggucaggguuucuucuucccuuuugcucccaaauaauugcagaguguuucuaugccuacucuuuugaaacaauaucuauuuauuuugagacagagucucucacuagagagccuggaacuugcuacguagcccaagauggccuaacacuuacucgagaucuacuugucucugugcuggguuuagcucccgaaugaaugacacagagaccugguguuuuuuauuagcaagcugcaagcacuaagcugggugugguucugaguaauucuucuccagucaugcugucuacuucccagcccugugguccuuugccugcaucugagucuugcccugguucgcuuagguccgccuguguccucauggcugcucucccauugugaccucauggcaaauccugguccaucuacauggucucuccaccuuucuucucucccucucucuccucuccuucuucuggcccccuuuucccugagaccccccccccccgcucccccccucccccacaaacugggaucagaaguagggcacuguucucuucucuucugcccaacuaauuggcugaucagcucuuuauuaagcaaucauugguaaugggaaacaauguuugcuuaacauuuagacuagagaugcuugaccaugccuauguccagacuauaaccagauguuugggcauagagaucagcaucucaauacacagugcacaaaaccaucccccaacagauauauuuauccugaaaaguacuuaaaaggagaugucauaguugucaguguauucuaccauaugccguauaaaaaggagacuuguauauuugguaugguagguagcacaugccuuaaucccagcacagagacaaguagaucucagugagugcuagcuauucuggacuacauagcaagauccaggccuacuagagagacuuucucaaaaugaacauuuuuaaaggauagauauguuuuuuauuucccaguuagaaccaaaaguagacauuacuagaaauaaauuucaccuucuauuaggacaguucuucucaaccuguggggguugaacaguucuuucacaggggcuacauauuuuguauuaaaauuuauaacaguaguaaaauuacaguuuugaaguagcaaugaaaagaauuuuaagggaggggauuaccacaauaugaggaacuguguugaagggucuuagcauuaggaagguuaagaaccacuguuuuagaacuuuuaacuuuaggcuggagagauggcucagugguuaagagcacugacugcucuuccagagguccugaguucaauucccagcaaccacaugguggcucacaaccaucuguaaugggaucugaugcucucuucuggugugucugaagagaacaaugguguauucauauucauacaauaaauaaauaaaucuuuuuuaaaaauuaacuucuacaauuuaccagaauuguaauagacuugacuacauacacauuaaaaaaaaaaaguauucaaaauucccaaagugccuggcaugaaugaauggcuuguauaaaacauggaauaggugcucucaaaugaccauuucaguuagguauaagguauagaauguuaguuaaugaggucauacugucuuccaugguaacucauaaguuucugugagucauagucuuacauacaucuuuaguuaccaaaagugacuuaucagaucuccuguauuuauagcuugcucaaguaaaagaagguuuuuaacaucuuauaucuuuuauaugguuaggguaagcuugcuauuauuauauuuuuuugaaguuuuaguuagaauaauaaauaauacaaucauagccagcaaaauguuuuuguuaaaaauuaaaggugauaaaaauugauuuuaaagauacuauuaaaauuauacugacuucuaaugaauuucugaugaaaaaugguuauaguacuuugcaucuagacuauugacaguauaacaguugcuauauuucgauugggguucugcucuaggaguggaaagaacguuauggacacaacagagaggauuccacucggaacagaaacguccauccugaccccaaagagucaaauuucucagacacgacuaccaacugguguaaguaccguauuuccuaguaugcuuaggaauuacuuuuaaauguuugcacuguauagaacugaaaccauagcaucuggcaucacgaacaucucuacacugacuuccuuuaucauugucuaguguguaaaaggaaaaggaaaugguguaucagguaaguaguuguguuauuuccaaggugugugcuagggagguaauuauuucuacaauuuaccuucauguuuuucguccuuuucuacuaguugauguagguuauucauuuaucuuuauaagaauuuguuaagccuuacugaagugcuuucccauauauguagugagagaaaaauaaacuucuguccccaggauguucauaauuuagagaaguccuaaagauagauacaagucagccaccacuggugcgaguuaagaaaccuggguggcacugacgcugcacugaugugaagaggaaacaaacccacugaccuggggaaaacaccaggaacccuuucuuugugcaggacuuuacacuguguagcaggcaaaguuuugucauuggggaagaugaccuauugcuaaggagcuguacuacugaggcuucugugaauagggcucugucugagauugaaaaugaaguaggaaaucugagcauccuucccuagcuacucauuuguacagaaacagugugguuagaggagugauagucgcacagguacccuccuaauggucugaaagcagaaaacagguaccagaaacauuccuguguauugaggccaucuaaacacaaggaaaacggaaaucuguagcagcugaagggaacuaaagcagagucuaaauucacaguaaguacaguagguuaauucagugcuccaacauucagggcccuacagaacgaggcaggccugccccauuuugaauauauguuauuuagcuuaacuucuguauucauuuaaaugaaauuucuagucuuuaacaagaauuucugagguauauaaggaaauaaagugccucuaguuuuagaauuaucaggcagaucauugguggaaauaucuaauuaguaugcuuaaagauguaguggaaagguuggauaaugugcauaaagagauguagggaauuucaccaggcagcuggaaauuauauaaaggagcuaaguggaaauuuuagaaauauuuuaacggcagacuccagugauguugccgacuucucauguaaguuguuagcacagagaguacaccuaugcugaaggaaauuacucugggggauagaaaaaagguucucucuuaggaggguauuuuuauaccaaauauuuccguaaugaaaauugagcugaguguucagaaaugaauaauaguuaccuagaugaaagggguuuuaucuagaaagugaccgagcuguugugcugugagaggauguuugggaacgcgcuuucucaugacucuagagcuuaaacaggaggccccuagcaagaggggcuccaggcaauuuagagacacacacuuucauccucagaaguauggacguuagaauguagguaggauuuguaacuuggaagaacauagucuuuauuuaaauauuuuuauuauuuuuucaauauucacauguauauuugaccauauucuaaccacuugcccaucuccuuccagcucauuucccucuacacacccaacuucauaguuuuucuuugucuuaaaacaagcagcaacauaaaaagaaaacaaagaaauaaaaacaaaaccaaccaaugagacaaauaccacaaaguauguuuuguguugcuucacuauucucgagcauguggccugcucugggugugguagauauauccaguaucacuccauuugaagaaaacugauuucucucucuccuagccgcuaucacuuacaaauagcaucuggcuuaaggacgagacucugugccuaccuuaacuucuccaugcugggauuuuugugaguuugaacauguacacauucggucauaguugugugggcuaagguaugcacaauacgcugagagaaguugaacaacucuggcucucucucucucucucucccuuuuuguuuuuuuguagaacaugauuuuaauauuuucaacuguuaauauucaacagacagaauaauuauuuuaagauacauuucauuguuaugucuccuguauuucuuuaaggaaguuauuuauguccuucucaauguccucugucaucauuaugagaaaugaguuuagaucugaaucuugcuuuuccaguguguugggguauccaggacuugcuauggugggagaauuggguuccaaugaugccaaguaaccuugguuucuguugcuuauguccuuaggcuugccucccaccaucugguuaucucuagugcugccugcccucucucuaucuaacuggagacuguccuuccugugauccugguugggucagaauccugagaguucagcucucucugggauccugggauccugugugugucagagcuccuggaaguucagcugccucugggacucugagauccuggugugauuaagcuccugggacccugggaaccugugauccugggcaaguuagagugucugggaguggagcuucuucuggguguugugggacuggcugcggaguguacacccaaggucugcucaggacaccagcccagaagggaaggaaccugugccacuggucgggcagaguuccugggugccugguucacacuggucccaguuacuucuggaauugaagcagauguuguauccuccucaccucugauccuauauguuccugggaguauuagagcgccugggaguggugcuuccucuggaaugugggacuggcugcagaguuagaguccauggucuguuuagggcacuucugauccugcgauccugggcauauuagagcuccugggcaacucuagcucuuacaaucugucuguccccuuuucuuugaggagaggggaaugauauaaagacauucauucuauuuagggaugaaugcuucagagucuuucacuuucugcuguuguccaguuuuggaucuauaugauaauuacuuauuauaguuaguaaugaauuuagcuucucugaugagguuuaagcaaugcacuaaucuuaagguguaguaaaauauccaaaggugcuggauucuuagggguaaguccaaucuuuguugucagaauauccagcaaaugcaacagcaaaccagcaauagcaaaagcagcagcagugggggccacagccgccacagccccucucaaggcuguugcauuuauacccuuucaaaguacccagaauuaaccaucugcagcuggcacaaaucacgcccuccuacacacacccuagaccacaagacagucauaguuaacagcuguggaaaaucugaaacagcuucauacccugcaccuaggaauaaaacaaaaacauauucacauaacacaacugggcuuuucaagaaaccaaggcucucacuacagugguugguuacucugcuauuacaccaauggguuuuuuacaggcagguugcuauuguagcuuacagggcucacaguggagugagacugauggucacuguucuccucuaguaguagcauugaauagagcaguaucuuccaacacuacgauguuaagacaguaccucugaaaucuaggguauagcuccuaguugagaacuagcucaucuccguguucagugccaugaaguaugaucuacugcuguuuagaaaaaugaauuuaaugacaguauaaaauaugaauuuggguggguuagggaaaaauaaaauaugacuuagagaaaugaagcucagaaaccauuuaaagucuguuuuuauagugaagucaaggaguaaugugggcuuaaaguaaagcaaagguacuugaauaaagacagaagauuguuugaaggauauuuaggauagaauaaauagagguuuuagcuaaaacucagaaacagugaagaaucuauaaagggauuuagguucuuacugagugaaagucugcagaauugaaagaucugaaaguaugagagaacuguuaagaaaagaacaaacacagagcuuuagauagugaguuagagaagaugaccauuuucucuauguuaauuucaccgaucuaugagcaguaggacagcuuuccaucugauguccucuacaguuuguuucuucagagacuugaaauucuuguaauacagaucuuucacuugcuugcuuaaagcuacaccaagauauuuuauauuauucauggcuauugugaaagguaauguuucccuaacuucuuucuuggcccauuuaucauuuguauaaaggagggcuacugauuuauuugaguuaauuuuauauccagccacuuugaugaagguguuuaucagcuguaguucucugguagaauuuuuggggucgcgcauauauauauauauauauauacuauccuaucauuugcaaauagcaauacuuugacuucuuccuuccaauuuguauccucuugaucuccuuuagauaucuuacugcuauaacuagaacuucaaguacuauguugaaaagauagggagagagucgucagcuuugucuugucccugauuuuaguggaaaugcucuaaguuucucuccauuuaguuuuuuuuuuuuauagacuuguuuuuuuuuuuuuuaagauuuauuuacuuauuauauguaaauacacuguagcagucuucaaacacaccagaagaaggagucagaucuuguuacggaugguugugagccaccaugugguugcugggauuugaacucuggacuuucggaagagcagucggaugcucuuacccacugagccaucucaccagccccuuccauuuaguuuuauauggacuacuaacuugcuguauauuacuuuuauuauguuuacauaugugcucuguaucccugauuacuuuaauaccuuuaacaugaaggaguauuggauuuuaucaaagguuuuuuucagcaucuaguaaagauaauuguguggguuuuuuuccuucaguuuguuuauaugguggauuacauugaugaauuuucauauacugaacuucucugcaucccugggaugaguuagagaggcacuauuuguuggauggauaaaugcaugaaagaaacaaggaacaaacuuaagugaaugacuuaagcacauucaugauuaauuccaaguaaccaauaaugcauuagugucacauuaggaaaaaaaaauacaagcccuugcccuugggcucauuuagccaagaaugauuccagguuugaauucuguacuucaugcuuccugucuccauccucugucugucugucuaugauaagagucugaaucugugcccgccugaaggcugccuugugaauuugucccugugugacuguaucuguccaaguguguguguguguguguguguguguguguguguauguguguauguuuggaauagcacagaaagaaucacauggggaaagaaagaaauacuuuauacuuuacagaaaccuuuuuggcuuuguuuuucaagugggguuucuuuauguagccuuaguuguccuagaaucagaucuguauccaggcugaccucauacuuuccugccucugccuccuaaguacugggauuagaggugugcugcugcuaccaccaccaagauauuucacaugaaucuuuaacaagaguuucucaagggauucagucauugaucccaacagaaccaaauaacaaauaguaccucaaacaucauuauuuaaucaaccaauauccaugaguagauauucauuuuagaagauuucuuucaaccuuuguguuuacuccuuuuagcauuuacauuguuccagggcaaggacauggaccaguauaugacuuagauuacagcuauacaguagcuuugguuauaaaaauugaucacaugagaaacccaaagguuguuauauugcuuuauuaaaggcaggugggacaaaugggcugaauacacauacgauagcccuauugugaccucagggugucaauaagacuggcugugagauccagcaaaaguuccagucucuuaaaaugucauagauacuguuauaauauuguaucaccacauuaggaaagaggccaaggagacaaagagaugauacaaaugucuugccuaaguuuuccaaaagaacucucucacaaaauugagucuuuuaauuuuuauaauuuguuuuguacuugugggugcagugcauacagagaccagaagagagcagcauauacccugaagcuagacuuacaggcauuugugagccaugugacaugccuguuagaaacugaacucagcuggaaagaaccaagaugucccucaacagaggaauggauacagaaaaugugguacauuuacacaauggaguacuacucagcuauuaaaaacaaugaauuuaugaaauucuugggcaaauggauguaucuggaggauaucauccuuagugagguaacccaaucacaaaagaagucauuagauaugcacucacugauaaguggauauuagccuagaaacuuagaauacccaagauauaauuugcaaaacacaagaaaaucaagaagaaagaagaccaaaguauggauacuucauuccucuuuagaauagggaacaaaauacccaugaaaggaguuacagagacaaaguuuggagacgaaaggauggacuaucuagagacugccccacccgggaaugcaucccauagucagccaccaaacccagacacuauugcauaugucagcaagauuuugcuuaagggauccucauauagcugucucuugugaggcuaugccagugccuggcaaauacagaaguggaugcucacagucaucuauagaggauggaacacaggguccccaauggaggagcuagagaaaguacccaaggagcugaaggggucugcaauccuauagguggaacaauaauaugaacuaaccaguaacucccggagcucgugucucuagcugcauauguaucagaagauguccuagucggccaucacugggaaaagaggcaccuugguauugcaaacuuuaucugccccaguacaggggaacaccagggccaagaagugggaguggguggguagggaagcagggcauggggaggguauagggaacuuucgggauaggauuuuaaauguaaauaaagaagauaucuaauaaaaaaaaaagaaagauuugcuucuuauagaaggcaaauaaaauuacauuuaaggaaagaaaaaaagaaacugaacucugauucuuuucaagagcagcaaauguccaguacagcugaguuaucuuuccagucccauuuuuaaaguguguguguguguguguguguguguguguguguguguauacuugaucugccuaaagcaagaaagacuuugauaauguaaauuguuuacaagaaacuccuauugagaggggauacuuacugggacuguaaugaccuagaugucaagcauuaccaaugaggccacuggccacuaaauacuugcggugaggaugucucuguguugacaguauuuuuggauaaauuaauuucagcugugucuuuauaauuuuuaauaugguggcuagaacauucaaaguaguuauagacuuuuuuauuuaucuauuuauuuggccaguauuccccuuauacuugcuucauggguuagauaguauuuucuucaagaguugaaguugaacugcuguauaccucaaauuucuagccaaaauagauaaauaaagguucacugugaaaccaaaugacacuuuacacaacuucacuguggugauaaccauaauuaaauauagauucuaauuuuuacuuucuaaauugucacacuaccuggucugagcuagcuagauggcucaauaaauuuuccuuauuuuguauuacacugucauaauuugaaucugauuuucuaagaaccaaacaacuuaugguuauugucuucacaaucagcauuuacugcagucuugauuuuuuuuucugugauucauaaauucaaagucaauagagaaguagcuaauguuuuucuucuuugaacagcauccaaauacaccagggcuaauaacaggacugaaagagaccgaauagaacuucuccaggaugcugagccucuggauuuuaaugcagaaacguuuacggaugaaucucuggaaccugagucaggaaggugagugcugccuguguccuuuggcucuugugugcuucugagauuuuaaugaugagcugauauaaggagcuuguaaacagcagguaacuaagcauaagaaaacuauuguguugaggauaaagcuuggugggaguuggcuugucuggaaugcagaaggggucgguuggauacccugcauaacaagagaagaaaaagauuucuuuuucauuaucaauucaaaaaugcacagucauauuuaaugccuuuuuggguugguuuugcuuuuugagaccaagucucauguagcccagguugccuuccugcagcugagggagguuuugaucugguccucuugcauugaccuucuauucugagugugcacaccgccagaggcgguuuauuuaguacuggagcguuaagcucagggugcuguacaugcuaagcaaacaucuaccagcuaaucuaugcccuuagcauuugauaccuuuuuauacugucuaauuaguuuguuuuuaaaaauuaugacauucugcuagguguggugauaucugccuguagucucagcauuugagcagcuaagauagcaggcugcccuaggucaguuaguaaauccaugccagaaucagaaauacagagagcucugcugaagaaaaacaaagaggcaccaaaaaauuauaucauucacuaguauaacugaaguagguauuuuuauauaacacuagugacauuagaauuaagaaagaagauagagaacaaagaauuaugacuguauuuacaucucuauuugacaauuccauuuaugacauuuauuaucuuuagucauaucuauaugucuaauauguuucgaugucagacacaauauaaaaauuuuaacaacauuuucuuuuauugcaaaaauucuaacuggauuaauguccucaaaggcucaguaauuugccuugaguugcauaguuuauuagucaggcuuuuaauuucaguacucugacuacaaagccuaugccuucaguuguuuugccaugagaaacaguaaaauaaaaaguauaggaagagaacggccauaugacccaacucugccacuguuuacaucuccaaaagacucguaaguggggcaccauacagacacuagcacaucucuaucuauuguucuuuauucauaguggcaaagacauggagccagccagaaugucuaccagcagaugaaagguuaaaagaaaaugugaucucuguauacaaagggauuuuacccaaccauaaggagaaauguaaacaugacuuugcaaguaaauauuuguaacuaaaagucaugaaagggucauaaaaguauuacggagaugaugagggagaagaaaaagaucuuaggugggguggaagagaggaucagaagggaagacuauuugugaggaagaagaacagcaagaagggaacacggcuggggauaacaguggaagggaaugacuaugaauacaauguaaugauuuaugugugugugugugugugugugugugugugugugugugugugcgugugugugugugugugugcaugccauaaauaagcccauuacuuuguaugcuaacuucaaaaaugaaaacaggaaaauaaucauagauacuaaagguguuuacuauuucauuaccuauaaauagcaaaaucccuagaauacucuaucuuuuaaaauugagcauggcuauuuauacagucuggggaauguuucuuacaguugcuaguugauuuacaauuaaguccuuuuagauuauaauuuugggagauaggguucuacuuuuagcuagugaauacauguuaauggucuuuacaaauuggguagucaguuccauuuuugacauuuuagaucauuuuuguauguuuacguuuuagguaucaaccuggugggcgauaucucuccaugucuuccaguauaauauuugaagauaucuaaagucugaaguaauucuuggaucaaguaaccaaggucaacacaugagcucagccuuuaugaacaucuuugugcccuguauuuccucuguucucucuguaaacggugugaggauaacaaaaacagcauugaaaaccgaucauaucuuaacaauauuaggcuauaguuuguugaauagagcauccucuuuucugauaggcuuuauuggguaccaucugaagcaucugccuuagaaguguaguuaaguggaaggauucaacucaugauaaacauagagcuaacuugguuucaugcuaauuuuuuaggaaaguuauuuuaaaguucaaugaagccauaagucacacuaaauucuacaauuuuauaacuguaauuuaaauuuuuacuauuucuuuaaaaauguucaaccuacauuuuccaaagaacugaaagugaacugagaccucaaauaauuacuguauucacuaaacucaugucuuaaaacaagguuuaugauucagacauaacugaauguaaacagcucuucuucagauuuguauacacuuacgugggauugauugugcauguacaauuaagaugauucuucaauugauaguguuaguguccugagcauguguauucuaauugggugauguauuauucuucuccgucuuuguaguaacuggaucuuuuuaugguuuugacauuauugcuuuguaaaagauuuucauuucagagaaaaauauucaucuuuaacauuuagaauauugacuuaaugcuaaucauuccauccaagaaaaauccuaaguauuaaugaugaauagauuuguuuguuuuauagccaaagaguuccccagauucucuaauauuuaaauuuuuuuuaagauuuauuuuauuuacauaaguacacaguagcuguuuccagacacaccagaagaggacaucagaccccuuuacagauggaugugagccaccaugugguugcugggaauugaacucaggaccuuuggaagagcagucaaugcuuuuaaccucugagcucucucuccagccccaauucucuaauauuuaaaagaugccuguuuaugcuccuuguaaagaaaacaucuggcuguucagcuauugaaugguaaaaauaaaaauaauccauuuaugaguauugcuaacacuuaaauuauagcauagaaaaaaacccagaaaaauguauuugaaugaaauauguaguaauaacuuguuuguuaaacaugcuuauuauuuuagauugguuguuucaaccuuugcauuuaagccaaaguuggguauuauguuuuaaagagccaguguuuuauucccaaaugaacauggcuuagcauguguuagcagggauuguucuauuuguguuucucacagaauacguucuacaugggguggucagacuugaacuuguccagggcaguuucucaccuguuccccugcaguuauuacaagugcucaaguguuacucugucauaugucgaggacauaguucuauguagguacugaaaggaaguauucauuucucauuaucuuuuuuuuuaaaugguugcauuuuuuaugaccuuccauauagauucccccuuuaaaucauuaucaauagauagauuuacucugaauugaagguugcauagcccgcuugauccuaggacacauuugcauauaaccuuuuacugugaaugcagucagagagcaguugaccagaacagugauaauggaaugcugcuuauaauuucaugauugguuucuggaauaacuuaggcagaucacggaaccuuucagugccucaguuucuucauuuucagaaugaaggacguauuuacuacuuuccuacugaucuaccucucuaaccuguugugagggaguuaaagugaugaucaugugcugggguuaagaaagaggaagcaaguugucugcugugcugugcccuugugcccuugcuuuccgucccuc

SEQ ID NO: 7679 - RNA, 975 nt, Mus musculus
ugggucaggaugauauuuccuaguuccauccauuugccugaaaaauucaugaugucuuuguuuuuaaauaauugaauaguaucccauuguguaaaugaaccacauuuucuguauccauuuuuugggaaagggacaucaggguuguuuccaguuucuugcuauucugaauaaagcuguuaugaacauaaugaagcauguguccuugaucucaguaauucuugcaaccaucuucucacaugucaucucauguuaugucuuauguauuauagauuacauaaacauuuaauaauaagcuauacuguuaugauuuugauggcacuaucuugaauugcaggcauauuuuuaugccucuaaaagaauuauugaaaaguugcacaauuaccuuuuauauacugucuuaguuuggguuuuauugccgcgaacagauaccaugaccaaggcaauucuuuuaaggauaccauuuaauugggacuggcuuagagguuuagucuauuaucaucaaggcaagcauggcauuguccaggcaugcauggugcaggaggagcugagauuucuacaucuucaucugaaggcugcugggagaagacugguuccaggcaacuaggacaaggguguuaaaacccaugcucacagugacauaccuacuccaacaagccugcaccuccuaauagugccacuccuugggucucgcguagcuaaaccaugacauuccacuuccuggcccccauaggcuugguucaaacacaugaaucuauggaagccauaccuagccauagcauaauaaagaaguauauuuaguccaacuuccagagucccuauaaucuauagcagucucacaauguuaaaaguccaaaguucuaagucuauucugagguuuauccaaucacuuaacuguaauccccaaagcaagucaggaaaccaacugggcaaacucccaaacucugcaucucaugucugauaucaaaggggucuuca

SEQ ID NO: 7680 - RNA, 3433 nt, Mus musculus
uggggucuugauacaacuucagaacgguuuccgugucguuauucguacaagacccucgucucucucuaccccccauuugguuauuaggaggagguccccucgagauccucgaauaacuggaccugcuggacgggucaaguggcgcccgacguggagcacgagguacgacugcccuccggacaacggauuaaggauuaaagagguaccgcacagacagagaaacagugggacaguccaccgacacuucacucgagugucgaguacggacgucgggagguaagccuaggcauucaguuguugucccauuaaccauggggcauuuagugaagagauaaaggauucucuuaaggagagagggauaagaguuuaaaaaaaaaaaggggaauuuaauaauauauuuuuguuuuguggacaagagauguccauggcugguauuaaaugguucugaaacuuagaauaaaguaggcaaagauguuaauguuuugauaaaacaaggagaagaugucccuaaguccuuuuuagcuauuggggaaucaucagagaucuccuugagcaggcagaaaagggcagaaaaggugcucgccuccuagcccuuacugaagauuuuuuagaaagcucccaaucgccaucucacaaaagcaaaacuaagcugccggcgcacaguaucucuauuagaagguuuagcagaaggcuacuugauacccaaugaauggaauaaaguuauucagucuguccucacuagaggccaauauuuaacuugaaagucagaguuuguggaagacagccuccuggacugcugacaaaaucugugguuaaggcaauuucgcugcagacauaaaacaauuagggcuuuccccugguguccucgcccagacggcacaagcggcccugagagcuuggcgcgcugucccugcagcaagggcgcuaacuaugccccuaaccaagauuauauaagggccccaagaauccuaugcgcgguucauugccagauugcaggaagcagccgagagaauuuugggaacugaagaaagugagggucuguuaguccgacaacuuacucuugaaaacgccaauucagcauguagggcugcccugagagguaaaaccaagaguuuagauauaaaugguaugauaaagcuuuguaaugagguagauguguuuucucaacaaguuucuaagucuauuaacguggccauuggggcugcucuaacuccagcuccaagauuggugccgagccccauuggcccaaguuaaaaguagacaucuguguccucacauugggugcagaugccgccuggggcaccccugauuauuauaugccucaauuaacagcaguuaacacaggugaauuugggcccccuccccaaaagacguuuuuucucaucaucggccgaguguccagacuuuuacaaggccuaauggugacuccuacagugguuaacaccgacuaccauggggagauaaaaaucuuagucuccgccaugcagggacaacuuacccuuagggcuagagagugcauagcccaagccuuaccacucccacuauucagccauuucccuuauuugaaagaggagcaaggaccauccucccugggauccuacugggcacagaaaauaacugauucauggcccaugccgacuuuguuucuagaggacaaacaguuucaagggcuccuggauaccggggcagaugugacaguaauuuucucaacacauuggccugcagccuggcccuuacagcccacuaagggaugguguaauccacugaucauaaaauuuacugcuaagaggaggaacuuagaggcuugagaaaguucucgcucucucaccuggggccuaagauuguaucaagauaacuaugacaauggccugaccuuuaaaaccaucccuaacaaucauaaaggauccauaggacuuccaggcaccugccccccuguuccugccccagggugugcuacgacccuguuucagcccacucucccugcggggaggccccccucuuccacugauuuacuguggucuauauugaaugcuucugcuuuagccuuguugcauaagacacaaagagauaaugcgucagaaucugaagauuguuggaugugcuuuucugcuucccugcacuuuuaugagggcauagccuuauuugaaaauuuuacccugcuuucagauacuaggcagcuuccccuugagucaguucagcuuaccuugacagaacucucugggguaagaaguuguguguugggcccaggcaugcuucaaggcccuugcuagagauuugcaauaacacguuuagaguaaauaaaaauggguuuuaaagagacuucguaaaggucaaaaaauucauagauuagguuuuauuagaaguuaagaaaucauuuccuaaaacuauauaauucauuuugucaaugguguuuuuguugguugcagaaaauagagaguguuuuuacagauggcuauaaauuauuuaacuaaguguggacugauaaugacuucaaaaaagauuuagcaugguaaacuuuuaggcuauuugagacauuuaguguauagagauuguguguuuucucaaaauuucgcccucagauuaaauaaauuaaaaguuuuagaugcuugccagaaacuguuagaaaauuuuggauuuuaaucuugguuugacaagcuaccucuucuuacaagcaggaaaggaaaggaaggaauaaaggaaaauggauuuuagaacucucccagggacagagagaaaucgggggacgcccuguuuuauucucucuggccccuacaggagaagcucucuacccucuuucuauugucuaugguuggugcaccaaucacaagucaauucauguauguuuucugucucguugucugaaugacuguuucguugucugaaugacuggcuguuuuauguuucauguuaaaaagaagaaaaaaaaaugguaaaaacuuuaccugcugaaucacucucaguuugcacaacggaggcugagagaggccccucccuuuagcuaaaaaucaagcacagcaagagagguccugcugaaaaacuuguuuuuaaagaaaaagaaucuacaaccucuuaguucuaaggcaaauaagcugauaguuguuuuuuccuaaaaaauucucugcaauuuugugauuauuguguuuagcaaaugacaaagugugucuuuauaaguauagcuauaaaaaguaaaagucuuuaauugaucuaaauuuauaagauucgugaagccacuucauuugguuuuugauuggucuuaaagguauaaauaugaucuacauaucuuggucauagagaauuggcuuauaaguuauuuggguaugauuaaaaagguauaacacugguuacaaaguuagcuuaaguaauaacucaaggcuagagucauuuucaaacaaaagcaccuggcauaaaacagcccaaaaaacuaguccucuaa

SEQ ID NO: 7681 - RNA, 2771 nt, Mus musculus
augaagacauaccauuugucuauugcuauuugcaacaaauuaucacacacucggugacuuacaacugugggaacugugggcuguggagauggcuuaguagguuaaggcacuugccuccaagccugacaacuggaauuugaucgccaagaccacaugguggcaggagagaacuaacucccgaaagucauugucugaccuccagccaguucacaauaaauaaaugaaaaaacaacgcaagcccagucaugaacuuacuauuugggaucuuggguaucagauagccuaagaugcacguuggugaaauaaagccagagcguuugauuccuucuggaggcacuagagaacccaucccuugucucuuucagugucuagaggaggauuguguucuuggaacugucagccccaguucucuuuuucagucuacagggacagagacaguggcaccaauauaugucauagcauacccugaauacaacagcccaacaaagggucuaucugcaaacaugcuuguugauacagauguagucuaucuucaggguggaaucaauaacuacccuauacuccccaccaagcaaauuauguggauaggggccuucuuugcaggaaggguuucuuuaaaauaagacaugaaagccugccacuuacaaaaacagugcuguaugaguugggacugcuguaaguaaccauaaguaagaagauaagccauagaucugggaaauacuuuauaugaggugggacuggcaaguauugcuauccagaaugcaucuaagcaaauccuagaaagucaaugagaaaauuauugcuguauguaaaaauaaucauucuuaaacuuuuggucucaagaccuuuuuaaacucuuaaagcagaaucaaaaaguuucagcgugugggggcaguaguuagugacagucacuguauuuagacuuaaaauugagagaguguaagaggcauuaccuuaacacuuaacauucgucauuaguggacugaagagauggcuuaguagcaaaggacuuguacagcauaaggcccugcguuuggauucauagcauccguguaagagccggaugugguuguguaucuauaacccuagcucuggggguuggagacacaccagugacuugcuggcuaccuggucuaguugaaauggcaagcucuagguuuggugagagagugugccucaaaaaguauaaauauauucaacaucaaccucuggccucugcauucucucucucuccuucucucucucucucucucucuccauacuagauaguaauuuuaauagacaaaauuucaaaacauuucaugaaaagagaaacacuauuuacaucuuccagugucuuggaugcgaccuccccugucacaucugacuccagcuccccuccacugacaaagaucugugauuucacugggcucgccuggaucacccaagauaagcuucccauuuuaagauccuuaauauauagucuaucucuguuuuccucucaucuugcucucacuuuggugcgcuagagauugcacccagggccaaaagcauguuaccucuccaacugagauauagccucucucuacaaaguccccucugccauguaaagaaauguucacaacuuugcagcuugcaagauuuaaaagacauauauuuggggcaggaauaauauuuuauuuguauauuucacucaagggauacacaggcuagaugguaaugcuacaggauauagaggcuaguuuugcuauaaacuugggucuguaggcaccuaauggcuaacuuuuuaauagaacuauauugcaucucugguuuuuuuuguauuuauuuccuuaacuguuugacagcuuugggucagauuucuguucagcucugcguauaggaauguuaaccacuuaaaaaguauuccugauaaccuguaaaggugaaagaugccaagauagaguaacuaagauauuuucaaggucucuuugguaucagaaucaauaaauugccaccugcuagcuuuuuuuuuuucuugguuugaauccuuuauuagaaaccaugcaaacuucaauuaaaaaguacacaugcaauaaaaaucuaaguguugguacaauucccgggauuuucucaacauugcagcaaucccauccgugagcagaccacgcugagaugacugcaccaccauggcuggccucuccugcuccuccuucuucagucacaccagaagagaagugggauggccucagucucauuuaucccauuauaccaugcccauagccagggugguacccaaaagugucaagucaucuccccguuaucgguuagcucugaccuccaggagcaagcuucucacgauggagaaccaaguugcuuccucagauggcagugauuucccuggagguggacaaccaguucugcuaaugauaaagcagacuaggguggccaggauggcuuggcuaugcaugguucuccuuucuuguuucuuuuuuaaggggaaggcuguuaaggauuaaacccagagcccaaugcgucuugaacacauacuaugccugaacuacgcagcuucaccauguagugcagaacaaccugcauuuguuacaaaacucaggcuuccucaaacucaggguccuucugcuucagccucugcagagcuaggaguguaucacucagcuugugugcuggcauacuucuuagccucuuucucucuagaauccugaugcauaugucacaagauagaacagaagauccuuggucccccaucacuuaucuuucugauaacgguguuuugaauaaaucccuuugcugca

SEQ ID NO: 7682 - RNA, 23813 nt, Mus musculus
guaugugucaaaauaauuuaauuuucccuguacauuucuguucacaugagaaauccagauacacauuuauaauauuuaccugucaugaaacauucaagugaauucagauggcaaaguagaauucaaucacuagugaaauguuuaaaaauauauauuaaacaaaaaugucuuuauaagauaaaaauaaucuuccacaaugcaaugaauugcagaucacugaaauuuuaacucuagauuaugucaguucaguuuuugguuccagaucuagagacaguuaaaaaaaaaaaagaguuaacagaauuccuaucuacuucuacgcuucucuuucuuguuccuaguuacacuguuuaaagaugcuguggcugaaggugcucuugcaugaccaguagccuuuagaugaucaaacaguuuauuccgggauggaaauucacuguggcaagucgcacagcugaugaggacaucacucugaggaaagaggggagaggacaucagagcacaggguaagcugacacaaguguuuuaugacuuaaugucaagguuaaacaucaaagaaaugcaaaucugacagcuaccaaaaggcagauguucucagaagauaaaugaacaagcacuaucaacucugaaggcccagcccagacugucaacagcuuucacugcgcagacuauaaaagucugugcuucaaaacugaucuucacaacuuagcacauggaacuccuauccccaaggucuuucuuauagucauagaaaugaaauagcuaauuugccaguauccacuauuuccaauucgucuauauuuuuauacacuuuauaacuagguagagacagaauuccauagagauccuaguucauucuuggaaagcucauggguacagacuaacaccauuaagacaugaacaaggucacuguggagcaaggucauuagggcugaccuaccacuggcugugcuucagcaggugcuuugacagauuuuuucacaucuuugguuuucuuuccuuuggauuuaggaacacuggaaaauaaauuauuuuauauaauacaaaaguaaaaauccuuuccaguugucaucuauucccaaaaauauucaaaauauuaaauaugaaucaagcugauuuauucauuuuaauaacugauuuaauuaauuuucacaugucaacaaagaucuuuaaaaaacaaccugagagguaaagaauaaauuuggcauaaaaccaaagaaucuacuuaaagcaaaagcuaaaccaauguccucaaaacauccuuacguauuuauauauggucuuuuuauugaaaaggagagcccuucacacuuccuuugcaaccagugcugcucacacuaguacaugauauugaguguccuguaacauuaaguucguugguuuuuuuccuccaguuuauuggcuuuuuaguaguuauuuuaguuuuuuguuuguuuguuuguuuuuguuuuuccgagacaggguuucucuguuuagcccuggcuguccacucugccucaaacucagaaauccgccugccucugccucucgagugcugggauuaaaggcgugcgccaccacgccuugcguuauuuuaguuuuuaaaagauguaucacacuauacccaggcuagcuuggagcuuagcugguagaccagguuacccucaaauuccugacaaccaaccugccucaaucuccugaaggcuaggauuacugguguuagcuaccaugccccacuaacaacuugcugaaccugaucaagucuguacacucugacuggaacauuuccacagugaaaugagaauaaaaacauuauuaauacauuuuucauaaaauuaguucauuauauaccaagaaauuugcuuuuauuaaaaaugguaucugggaugacuaugaaaaaaguacaaugugugaaaaugucauaagacaaacuuguuuuauaugcuagcaaagaaauuaguaauacaaaaauaauguccuucggcuaaucugucuuauuucccuaguaccuuugaaaacaaaaucacagcaccggccacugacaucaggucccuccuacucugccugaauccggaaccuuccacucaaccaccuuccucugugagcucugaucugcucucugccaugugacgugugcuucauuaaaaacaaagugagggugcugaggcaggaggaccgcaagugugagaccagcuugagcuauacuaacaagaaagagagcuugccugacuucuaacugcuaaggaaugguagaaugaagcacuucuacauacacccuacaagagcagcgcugagggguuaaagcgaagucucacuguuugaaggucaguuggaggguuagauggagcuaugagccgucuccagccugcuacucuucagcaguuaggaaaccagcugacuaagucgucagcucacauccguaaaaugagaaaacugaacucagacccucagugcugcugaaucugucauucccaagggaaugccacucaugcacaagucccauggcaaguaacaaacacguuagcucuagacacaggcagagcucggaccuauagcuggguccacucugacccaguccuuauguccacuggacagcccagaagauccuuauggaacaggcccguggagcuagacucucccccuaguaaugaccauggugauauuauugcugccauagugauagcacaaugucaccucacaucugugugugauuguguggcuacguacacacaauuucaguuacaucuaacucaggcaugagaggaggcgcuuugaacuacucuugaugaacuuugcauuaacuacucaguagucagaaagcaacagggcacucugccuuaccuuuuagcuucgcuuuuuggauccucacaggcuucuguggucucuguaauacagguauuuucuuggggccuauuuucuaauucuuuggcauugucuucauuugacuuagucuuuucuggagcaaucuuuccuccuucuucaguuccauuuucauugaaauugucaucaaaauucuagagaagauauaugccauuauaaaaccaaacgaagucaaugcucuuaaccgcugagccaucucuccagcccauuuuuuucuuagaaaaaaaaaaucuaauugcuucuuuuucauacgugugugugcauauauguaguguguaugcauguacaugugcacgugugaaggcgucaggagccuuugaugaucauccucuaucuuucugugacagggucuuccacugaaccuggugcucaaugacaggcuagacuggcuuaccugcuagccagucuauuagagaaaaugguaagucaauauguggaaugagaaauaaauuuaaccuauacuucuaaugauauccauuuaauaaugugaagaaaaauguauuagcaaaaaggaaaugaaaaauuauauauaggguccagucacaauuuaauuaauuuaacuuaauuuuaauuaaaugaugccuagggggcuggagugauggcucagcaguuaagagcacugacugcucuuccagagguccugaguucaaaucccagcaaccacaugguggcuuacaaccaucuguaacaagaccugauucccucuucuggugucugaagacagcuaaaguauauuuacauauaauaaauaaaauaaauguuaaaaaaaaauuaagugaugccuaaaggagaacccacuaugacuguccuggauugcaaugaaagcuuacuuuuacagucaggauaagcaauaagaagucacaagcaaagguaccuggcaaauguuacagaguacaacucugguuuauucugugcaacagccgccauguuugcacacgcacacccauguguacucucuuuaacacacaugcuuuuccucuugaaauaacucaagcaaguggcaagcagauaggaguccuugccacauuucucucagaaagcuaauuccagaaguccacauuucagaucuuugauucagguccacauuaaggucucugauucauuuuaaaugcgacuauuucacacaacaaaauuauucuuuaaaaucaaagauuaaaacuguccaugaguccaugauaaauagauuauauuuacauauacaacgaccaacacccugguuuucauauguccagacuguaauugcuaucuugacugaaaaacccuaacaucagcuauauccaauuuaaacauaauggcacuaaguuaauuccuaucaggugaguucuacaugcaaaaaaauucaauaugcaacaguaauuauaggcauacaaggaggaaaacguaauaaauccugaaacuuuucauuuccuuuugaacaauuuuauaggaucaaagagauuguucagagggugaugagaacacgcugaaccaaccugaagaccugaguucagaccccuguaccagagagcaaaauaggcauugucuauaugcacggaagccuaguacuguagggguggcaaugagggucccaaggacuugcuggcuuccaaccuacuugaaaaauacagcuucaagaucaguggaagacucugccuuaaaggaacaaggcagaaaguggucaaagaagaugcccaacaucuuccucuggcaucccaaagcauacacauacauacauacauacauacaugcaugcauacauacauacacacauauauauacacacaccacauacacacuaauuuuaaauuuuauaaauuuuacuaauuuauaaaaugagugaagcucuucccccuuaauauagaguauacuaaguaaacaaguacacuucaaaucuacaacauguauuuuacuauuuauauuuauugugguaguuauauguauaauaaaagcuuucaacauaccugugcugauuucuguuucuuuuucuucuguuuuuuagaaagccuaagagcaaauguaaaccgaaaacguuaaggauuugacuuugugaagauuuacuaaguaaaaauaaaaaauacucaaacagaaugguaaagaaauacuaaaaauguauaacaaucucauacagcauuaaaaugacaggaaaaugcuuacauuauuauuauuuuagagaacacuggacaaacaguaauuagcaugccaacugcauaaggaggaaagugcuuucaauacauguauaacauaauccaugaaaauaaggucccuacccauuuaacccuguaaggcuccugcuaccuggggagaugcagaacugcagguuaagaagucacagacagccaagcggugguggcacacgccuuuaaucccagcacuugggaggcagaggcaggcggauuucugaguucaaggccagccuggucuacaaagugaguuccaggacuauacagagaaacccugucucgaaaaaccaaaaaaaaaaaaaaaaaaaaaaaaaagaagucacaggcaaaggugucuggaagaacaagcuuucuagagaaaacacacaucaauacuaccucuaauguucuaaugugaccacagugucaguggaauuuaguacugugacuuacuucugcuuugguguaucuuccauuuccuccucagaauuggcauucaauacauuuucauccauuugaacuccugaaaacuguucuuccuccuccuccaacugcuguuuuaacaaggcaaccauuucccgauguuucuuugacuucucgugauucuucaugcugaaagaacaaugugguaugaguggccaugcuaugguaaucacacgugcucaggugcacugagggacggaagacugcaaccacugacuugccaaguguuaggauuuuacacacaagucuguugggacugccaggaacagucauggagaaguucuuuuccccgauaccagcauuccccucauuacuuccuuuuuauuuaaacgaauuuuccugccaaauucucuauuuuuuuuauuuauuuauuuuuucuauucuaaaacuuuaagucuuugccagguucguuuuaaccacuaaguauuuacuuaaucugucuagguugcaagucauaguacaggcaaacaagaaguacacagagaacaaguguugucaagccucaaagaacaauaguucacuuccuuuugcuuuuucaacagcguauccucaccuccuuaaaugugaguucagagguauuccaaaacuccauaggcagaauuaacuuguuugacauacaggaaaccaaacacauucuacagaccaggacuaacauuaaccugugaaacuguagucucaggauauagcuagcucaugguagagugguggacuagcaugcagaaaguccuugggguugaccuugaauaccacagaaacaguaacaaaaucgugggcaccaacccugucaccauuuaauuuguguucugcuuagauuuuuggaaucuuuuuccuuauuuuguuccuuuccacuaaaauucuccuuagaccaaaguccucgggggaaaucaagguaucuugaguuagaaaauaauuguccaaaauaaaaaggacacauuaaaaagacaaaggaacugacugguguggaagaauccuuacuacagugaccugagaacauaaacaggaacaggauaagagaaaauuaugaaugccugaaaccuauguuuaaguucaccaacaggaaacacagcauuccaucaccaccauagaggcuggcacagguagguucccccuuuccaaaaugccugcugccugaguaguuuagauuucaauuuuugaaauacuuauucaaauguagugggguauguagaagcuggaauccaguccuaagcacaaguccuuccugcuucaccucugucuugcccaugcuccgggaaggucauuuuaugcaguauuuaaaugcauuccaugcugaccgauguucucacagcacaucagcugcugaguuucugccauguggcacucaaaaaacguuuaaugucucuuaaggagaacucacugcaaaagaaaaaauucuaacucuacagcacaaaacuggauagcacuuagauugagugguccaacugcucagcaccaauaaguacuuuaagcgccagcagacacgggaugcucagaaacacagcacagccguacugucagcacaagugguuguauaccugaacuuaaucauaaacaaagggacaaaccagauagagaaauacucuuuuaaaaagguugacauuguaaaucagauacaagaucaacaaacaaacaaaaaauuccagacuaaggaggcuaaacacauaagcuaagucacacauccccagaguggauucuuuaccaaaauggggaaauauaguauacuuaaaaauacauugaugaaacgagaaugacaauaaauuagauauaauuaccaugucaaugauacuaucucuuaaaguauagcaauuucuuugcuacugaaaaacuauguaaagagauagauguaaaaaagcauuauauauguaauauucaaauuauugaggaaaaaacacuguguauguuugugcacauuuacaugccuaugugugugcaaagagcaaaccaagcaugcaaacacugcaugaacaaugagcuaagaagugcaucaucugcuaaucuucuaacuuuucuuuagguauaauaauuauuuccaaaaucaaaauaaauuuuuaaaaaaucucucuaacuuuugucuuguguucuuguuucuacauccccugcgucucuuccuacccuggcaccuuuuuuugguuaucuggaacccucucuucugacccccacaaccccauucucaucuuugcccuuucuucuugacugugggaauguugcgucuuuuccauggugaucuggcucuccuguucucccaagcuccuccuuccucuacaguggcucccaugagaggaagcacuuccacguggaagcgaguuucaccccaacagugcagagaucagauguggucucacucucccucaucuacgccaaccaugauuugucauagaugaauuuauguuaauggcuacaacaagcuugaaagcaaaaaugccucuucuuauuguacgaaacaaaccccaggggauggggguaguguugaucacacugcagcaagcacacucucacaccaugccuuaaaccagcaggcaaguucagaaggagcuuacgccuuuucugucuugaaggauuugucacaagcugggcaguaaagguccugguaaagcucagccuccucagccuccucgcuguccuugccugugggaagaggcccaguguuaacaaagcgcgcgucucuagggaggaacucaagacgcaaaagacaaacacaaaugcuguugguaucugaguugucccuuuugagcaucacuguuggaaggaagaauucaaauuaaucaccucauccuucaaguucuuuucuuaaauuuguucagacaugucagaaaauucuaaaaccaagugccacugccaugccuuuaccauaagcuccucuccaaucuucuucagagagacucgcuucaaacccacucucagcuaccccaacacacuccagcuuaguucaaagcacucacacugccagcgaggucagaaacagcguauuacauaaguucagugcugucuuugcagaccuuuuuauuauaaccugaggcuuauuacagcaacgcaacugcugccaacaccaucuguaagcucuaagugacaaaccuuaagcaggacucuccacaacuuacuuucuacuuuuaaaaaaauaaauggccggacgugguggugcacgccuuuaaucucagcacucgggaagcagaggcaggcagauuucagauuguuucagauuuauaucaauaaggaugccacaaugucucauauuccacauuuugguucuuugcaaauagaaauaugauucugaaaggcaaucugacuaaaauuaauuuuuuuugggggggggguuccagacaggguuucucuguguagcccuggcuguccuggaacucacuuuguagaccaggcuggccucgaacucagaaauccaccugccucugccucccgagugcugggcugacucaaauuauuaauagccaaaauauacauccuguguccuuugggcagugcuaauuucagcaaauccuuuaacaaaggaugccuaaaaccuuagacaguacagaaccaaauaauuacugcauguuccauuucaacgccauacuuauacaaugugucuaagcuacagcuuuacuguuugaagccugacagcaaaacaggcaugguacccuucacucuucuggauacgcuggcaaccucaguguauggucuuuucccuuuccucccauuuaaaggaagcacuuuauagcuucucuuagccagauuccaugucagcauccauacugucauguuugggggccaccauuacauaaguucuaugaaccaucacaacugagcugacaacuauuuggcuaguaagugaggaagagcuacccaagugaauagggagguauguacugugcagacacugcacagaguuagaaugggacagugcaagaucucaucacauuacacaggccaagcagaauuuaaaauguagaggacuuauuucugaauuauuccauuuaacauguucagaccacaguugacugaaagucacucaaagugcaaaaguaaauuggagggauaaggcagggccacgaugucaugucauuucuuaacugcacaucaacuuccaacauuucccaugcauggaaucaucuuuaauacagcaaacaguuaacaaaaauucuggcuuuaaagcagaaaaauauuuuuuucuacauucagaaugccaauuaaaccagcaacauuuauugaaaaugcucucuuuuuuuccccauuauauacuuuuggcuucuuugucaaagaucaaguguccauuaaguguguggguuuauuucugggucuucaauucuauuccauugauugacaugucuauuucuauacuaauaccaugcaguuuuuaucacuacugcucuguaguacagcuugaggucagggauggugauucacccagaaguucuauuguuaagaauucuuuuugcagccgggcggugguggugcacaccuuuuauccuaggacuugggaggcaaaggcaggcagauuucugaguucgaggccagccugguuuacagaggaauuugcauugaaucuguagacugcuuuugguaggauggccauuuuuacgucaauccuaccaauccaugaacaugggagaucucucccauuuucugaggucuucuucauuucuugagagauuugaaguucuugucauauguuuuucucuuguuagaguuacaagacauuuuauauuauuugugacuauugugaagaguguuguuucccuauuuucuuucucacccauuuaucauuucuauagaggaaggcuaccgaugugucugaguuauauccagccacucuacuggaguuguuuaucagcucuagaagucucugguacaauuucugggauugccuuguguauacuaucauaucaucugcaaauagugauaccuugacuuauucuuugccaauccccugaucucuuuuuguugucuuauugcucuagccagaacuucacacacacuauugaauagauauggggaacaacccagaugucccacaauggaaaaauggauauagaaaaugugguucauuuacacaauggaauacuauucaacuauuaagaacaaggacaucaugaguuuugcaggcaaauggacaggacuagaaaauacgauccugagugagguaacucuaacccaaaaggacauguacucacuaauagguggauauuagccaaaaaaguacagaauaccuaggauacaauccacagaacucaagguuaacaagcagaagggcucaagugaggaugcuucaaucucacuugggaagaagaaaacaaucaagggaggcagaaagagggugggagaggaaagaggagguggaaaagggaacaagauugggcaucaggggggaggggacaggagagaagcccagagagcuagcagaaugaauggaaauaugcaaacucaggagguaagaaguggggagaccaucuagaaaguaccagagaccugaaaggugagacacucucaaaauucaaagggaggguccuuagaugaaacccccaacagugcagagagggaacuuguagaguccacgucucauagaaagacagggcaucaaguggagguauaggguugccauuccacagucagaaauucugacccagaauuguuccugucaaaagaacugcagggacaaaaauggaggaaaggcaguucaauaaccaaccaacccaacuugggauccaucuuaaggggaaacuccaaggccugacacuauugcugaugcuauggugugcuuacagacaggagccuagcauggcuacuauccucugagaggcaggcccaauaagcagcugacugagacagaugcagauacuuagacccaaccaauggacuguagucaggcugaaauagagaaaagcuggaaaaaacugaggagggcuaccccaaaggaagaccagcagucucgauuaaccuggacuccugagaucucugacacugagucaccaaccaggcagcaaacgugagcuggucuaacgccccugacacauauacagcagaggacugccuggucuggccuuagugggagaagaugcaccuaaccuucaggagacuugaggacccagggagugaggaaguuugguggggaggggggcauccucuugcagacggggggggggggggggggggggggaagaaugggacaaugaacugugggagggcggggagcaagacuagacuguaaaaaaguaaaauuuuaaaaaagaaaaagagcgggcauaguggcacacaccuuuaauuccagcacuugggaggcagaggcaggcggauuucugaguuugaggucagccuggucuacaaagugaguuucaggauagccaggacuacaaagagaaacccugucucgaaaaaccaaaaaaaaaaaaaaaaaaaaaaaaaagaaaaaaaaagaaaaagaaaaaaagaaagaaaaagaaaaaucuggacuuuuaaaaaguacucaugugucucagacauagcccacaacauuagacuccuacucuucucaccaguuaaaugaagagaauuccauuaguaaaauuuccacuuaaggaauauuuucugaagaccaagcaaagucuuguauguaaaaggacuucauaaauuauagaaauguaauuaaauuagaucauuucacauuuauacagugcuguauacuuuucaaaguacauacuacuugacucauuaauaaaccauuuauacucaaaccauuuuggaaaaaaagaugucaucugaguuacuugucagaaaaucuacaguuuauaaauaaguagaaguaggaacucuauucagaucaguguuguggguggaagagcuaguaaucaugagaaaaucgggauuacuggucagcaguucucuguaucccaggcuguccuggagcucacucuguagaccaggcuggccucgaacucagaaauccgccugccucugccucccaagugcugggauuaaaggcgugugccaccacgcccggccuggucagcaguucucaaaggccucaaccuaacguguuaaacacauacacacucagugucugcacucugacaauguagguaaagcaccuuccggaagcccuaagugggaggaauggcacauaugacacacucacuccuaugcaacaacuacugucuuuuuuuuuuuuuaagauuuauuuauuauacauaaguacacuguagcugacuucagucguaccaaaagagggcaucagaucucauuacgggugguggugagccaccaugugggugcugggauuugaacucaggaccuucagaagagcagucagugcucuuacccacugagccaucuugccagcccccaacaacuacugucuuaaaagagauauuaaggugugcaggacauggcggugcacgccucuaaucccaggacuccagaggcagaaacaggcagaucccugagucugaggccaacuggucugaggaccuaguuccaggacagccagggcuauacaagaaaaaccuaucuggaaaaacaaacagcaaacaaaaugcuuaacaaaauguucuuugauugcccauuagaacucccaauuucuaguucagucuagaaaacaggacuguggccauguacggugaaguacaagucagaugcucucuggauuuucaucuccucuucuguucucuaguuucuuacucuugagccacacugcgggcaucuaaguacacacaguaagauuuauuguccaaauuuacuuaaucuagcaagaaacauuaccauccaauccguuucugggcuccugauccuccacuucguuuucaucugauccaucuccaaacuccuucucguaccuugcuuccaucuccuggagcuccuucuccaaauuggccauggucauccagcucugcucucuguacugcucugccagccuagacacacagcagagucucaaucccacuggaaagcacagcucuaaaaccaacccuauugagaacgccccugaugcugccaaugggaggaaaccaaucacccauccucagcuacaacuggugcaaagucacuggcacugaguugguuuuaacuguucuaaguaauagaacuugaaauacaacuuucagcagcuuugacugcaaagucuucaggugacuuuaaguguuaaguaccaagagcaguacaagauacugcauaguagcuauagcagggcucugcagguugguagauggcucagcaggaaaaaaacuugcuaucaggccugagaaucugaagcccacaucugaaggaaagaacugguccauggaagcugcccucuccacacaaguaucccacacauacaaaaugaugguuuguuuugguuuguuuugguuuguuuugguuugguuuuuugagacaggguuucucugcguagcccuggcuguccugaaacucgcucuguagaccaagcuggccucgaacuuagaaauccaccugcuucugccucccaagugcugggaucaaaggcgugcgccaccacacccggcaaaauauuuuuuuuuaaagagcagggcucuguguuaaaguucuuaaacuccauuccuaggugcggugcgaccugccugcuacaggccucauuuccuuauaagagaaagcagaaaagcaugugaacagacguccaccagaguaagaacuccaucagcaccggcugcuaacacacugcaguagaggaucaaggauaaaggcucugaaggaaggaugcauacagaaccucgauguuacauguagguagagaaacaaggcuagaauucacagauuuuuaaaaagaaaaacuauaagccaggauaauaaccaaacuuaacauggaagcuucgugcuggcucccuuuggacacacucuaccaugcuggccacccuacugacauccacacagacccacaucagcagagaggagcuaguuccagauugcauacuuggcuugcuucagcuucugcugccuccucaucuccucugccuuccucgccuucucugcguucugcuccuccacaagcuuccgaugggccugcacucucuuaucucguuuacgaaugaaggcuaccagcuggcgcaccaguucauuuuucucuuuccuugcucugucucgaauuuuuuuguuuucuuuuuccauggcucguuuuucccagcgguucgaggcuugccggguaucauacucuuccuuccaggaaaaauucuuuugugugcagaaacucugccagugagcguagaaaggguggaccaccuagugucaaagaaaaaaaggcagaaaauauuaaggaauaaaauaucuucuagcuuucuuuucauguaucuaagauuccuucuguuguguguuucuuuagcuuuugcagugcugggaauugaacccagggccucugugaauguucuaccacuaaagcacaacucuagacccucagacacuaacgucaaucacuggacaagaaggcaguuaguucucuuaaagacacucauucuccuaggcagauucagaaaagaaaaauagucucgcuggcuagaaagacuguagaaagagacuacuacaaccacagagagaacaagucaagagucaguacaagcuccggcaaaaaugagggugaaacccagcucaggagacaaaagaugguuucuuguacaucuagaaaaccccaggagagagcccgggagagugagaugcaagguaguuuuucuuucaccgugucauagucgcucugggagucgccgaagguuggaaaauccucaacaucucccucugacauacacuccaguucuucuuuugcaaucagcucaaagacaacacgauacacugcauagaaccccuaaaacaaaauaaagccaagccagaaacucagugaaccacagaaaacaggcuuuagugcugaggcaguacaagggccagcucucacuaccucgagugcccuucacccacacgugcccacagcuuaaacagacgugcauucacuuuguauacaauuuuaggacagccccacauuugaguuguacuuaaccacuugaggagaaaguagaaguuuuccuaucuuacccuuucaucguccccauaaccagaauaacagguaaccgugaaauaaugaagcagaucuaagcugucaucuugauauuccccaucgagcccuccuuuaaguaaggccucucggugguuaucguaccuaaaaaauucagaagugaaagggacucaauuaaaugcaauuauauaaaaugucacacuggaccugucuuccucaaucagcugacacaacagugcaguaugucucacacaugcaacucauagccucaagguuuuaaagaaagcugacaauuuaaaaaccaggaagucuuucaggaacuggagauuaaaaucaugccugcaauuucucauaccauauauaauaguagccccuaucaacuaggaaaucuagacuuccucaacaggaagcugaaauccauaggaaagagaacuacuaagugguacaguauugaacauaauaucguccauaaagauggaauuuaccaucaguuaccggaaaaacuuauuuguauuuauauaaacuacagcuaggagacacacccacaccgacacuacaauuuguucuucauaaaaagucuguaauaguauuuauuaucauccuugcuugauaauacugguugcucaucaucauagagucuguaagaagcaagaccagaauucaaagucaggucacuccuacuucaaaggaugggcuccucaccucaaaaugguaacaaguaccaggcaacagggaaacaagcaggcgggagcuuuaaggggaaaugagacaaucuaagacugagaggaggacuaaguaaaaagaagccacaugggauaccaacacuguaaaggaaggaaaaugguuuuguuugguuuuuggagagaggaucucccuauauagcccaagguggcuugaaacucccccuagguagcccaggugacucuugaggacaggggccacaugcaaagacaagaggcacaucuggcuuuaguucacaauuucaaaaugcuuggucagagaaaaguuuaagcucuucuaggagguuuaagagaauucguauacaacuugcuuuuaaaccuuucucuuuugagaaucaguaagcuguccagagucuaagcagaugacuuucagggcagaaccuuguuaggagcagcauuuuucacuauuaagucugaguccaaaaccuauucaucugcaacaggaccuagacgccgaaaauucagaaccucaaacauacagauucuuguuacaaaauuaaacuguauuaggagcucaucuuuguuaaaaggaccuauuugcacaguagaauuuauucaagugcucuauagaaauguauaauucuuacauuaaaauaauuaaaacaagaauuacuacaaaacccaaacuuccuuccuauguuacaaugaacucuucauacauacacuaaaggaacccgcucagcgagagagaaagcacuugcagcaucuaaguuagagcuguguaacagcagcagacuugcuucauggauaacagcagacaguuggaauaaucauccuaguuccuuccugcccacauacugcacuuuacauaaccaagaggugacagauguuucagggcacucccaaccacucagugugguaaacuguuaagaaaccaaugaccucacauugaccaugccuacuaacaaauuaaacacggauaaaaguggcaacauaauacuuaccacgcucuuuccugagggucacuuaagacgucauaugcagcuuggauuaauuuaaacugcucagcugcuucugcggcauuguccagauuuuuaucuguuaaagucacagaaauuuagucaugaaaaaaguagaugcauaggccaucaaaauggcuaaguggggaagagcgcuuguucccaagccugaacucaauucuggaacccauauggcagggugauaaacuggaucuuguaagcuguucucccucuggccuacacaugaucuccauguacccuccauggcauaccuguacaaaugccauauacccacauguacacagguguguguguguguguguguguguguguuggaucucagaauucaagaccagcuuagucuaacuaguuccaggcuaguaaaggcuacauaguuaaacccuguaucaauauguguaucaaaauauauauaaauuuuaaauaguaggggcugcuaacaggguacaauaaaggauaaagaugcugcccaucaagcuagacggccugaguucaaucacugagacccacaugguaggaaagaaagaacccacuccuaccacuuguccucucaccuccacauaugcaccuuuuugugugcacaugcuaauuauucuuuccuuggucaugcuuccuuaacugcaaaucacaaaagcaacuuggccugcaaauggcaacagcagugaucucuucuuccuucuuguugaagucccucaucagcagugcuggucugaccaacagcaggcgcagaaggaaagcaaggugugcuaagagaugggacuggacuggacagcagccuccauucugggcucuugcugucuccagaaauacucaugugacaguguaaagaacucagauagcuucaaggaaugaaguucaagggaugaagaacagaggguaggaggaacaaaugguaggagccaccgaaugcccgugagucuggaagcagguccucccaacaguggugagauagccucagcagaagcuauaagcuaagccacucccacauuuauguuucagaacccugggugucugucugcauaacgaacugauacacacuaguuuuucuguuugcuguuuuauacccuaaggcuuugguaauuuuguuccaucauaaguggauuaauucauaaauuaaacuuuugaaucuaacauggaacacaucaaguucuuuaagcuacuacuacucaauacuugucuucuaagaguuuaagguacgacagaaugugcucccuccaaacagccaugcagccuuacuauugugccuccuuuuaucugucagcagcacuugaucccaaaccaaacaaauagcuaacacuaauauuuuuccaagcauagcagguuuccaugacucuuugauccugugaaacuaaaaguagucuuguauuaacuaaaaauaauuuccaacugcuaucuauaccuuuguauauaccucacuuuccaugaggaguaacaaccauaauucuauugccccuuucagaguguacccauuugaagacagccagcauuaggcaaccaacuguguuccgagaaugccccucaugggcucaaauguuugaauacuuggucccaguugguggaauuguuuggaaagaauuaggagguguggccuuguuggaggagauguguuacuuggggugagcuuugagguuugaaaacuaggaccauuuugaguuaguucucucucccucguacuuacagaucuaaauguaagcucuuagcugcugcgccagccaccugcuacuuaugcuuaaccaucauggacuaauagcccucugaaaccauacacacaauauaaacucucuuuuucuguauguugccuuggucuuggcauguuaucauagcaauagaaaaguaacaaaaauaagaugcaaaggaguuuacuaagugauacuuccuagaaaaucacaguucuaugaaaagaugugugcccccccccccuuguuacagugugcccuacaccaccugcuggguggucuuguuacagugugcccuaccccaccugcuggguggccuuguuacagugugcccuaccccaccugcuggguggccuuguuacagugugccccaacccaccugcugggugguccuuguuacagugugcccuaccccaccugcuggguggccuuguuacagugugccccaacccaccugcugggugguccuuguuacagugugccccaacccaccugcugagugguccuuguuacagugugccccaacccaccugcuggguggccuuguuacagugugcccuaccccaccugcuggguggccuuguuacagugugcccuaccccaccugcuggguggccuuguuacagugugccccaacccaccugcugggugguccuuguuacagugugccccaacccaccugcuggguggccuuguuacagugugcccuaccccaccugcuguauccuccuccagcuuuagcucucuaauacaagaauugcagcagacaaauucacaccccaaauuuacgguuccuuucuuccaaauaacaccuggcccuuguaguaaagauucaguucuucacccuuaaaguuuaggugcaaacacaugacuaaguuaauaaagacuacgaaacuacucuacaguggguuuuaagaaucuuccucaaaaggcaacuagcauaaacccuugucucuucuuuacauguuccuccuccugugacuagaaucuugaaccgucacucuggaugacaaaagagggcccauuugagaacugcuaggcauuaaaguccacugggccauaggagagaacugcuaucuuaagcugucccagcugagaaagcacuucugccuuugaggcucacuguuuauguuugauucaaggguuacacacacauggugaggacgauggagcaauucucccguggcuucaugaaacacgggaacuagccaccucugauuucuuccgaggugagaaaaaauaaauuggucuuugaguuugcuaugacggccagcuuccugccacauucagccacacacaacccuuauaaccuuucaagguaugacaaguguuacgaucuccaugucuucaucaacucauucauaaacaguuccaaggagaaaaggaugaaggagaaaucccuaggacacucugguauuuuccgacauccaucucagcauucacaagcauaccccaaaugggguugcuaaacagucuacucugccuuuuuuuggggggggcgggggguuuccuagaaaaaugggagaaaccuuaagucucaaauauuccugucaagacacaauaguuccuuucaaauuaaauaaccuaacaacuuuuuaaaaaaaguugacaauugauucuucuuaaauuaaaaaagaauaaacagccgggcacgguggcacacgccuuuaaucacagcacucgggaggcagaggcaggcagauuucugaguucgaggccagccuggucuacaaagugaguuccaggacagccagggcuacacagagaaacccugucucgaaaaaccaaaaccaaaaccaaaaacaacaacaacaacaaaaaaaaaacaauaaacaacgguugccagguguguguuccuuuuuaucaguaaugcaccugguucaacuucuucccaucccuucccucccuaaagaaauuuguagaaagcuagcgcguuuaaacacacaaaaccuaugcauacaccaucuaauaacaagauauaacuucugaauagaacuuuuuucuuaaauaauguuuucaaucugucacauggcuuucacuuuacguaagugcaucugugcuagauggcugugucgaacugagauuaacagccggagucuaaagcuguuaagcaaaaaaggagccuacauuuuggcacaaguaccgcaaacagucacugcgguuuaccaggcguccacucuugcacuauucugugugguuuucuccugacacaagcccacauucugcugucaucuccuaaaccuucuuacaaugccuucuggaagcuuuugucggcccaucccuugcaaaguuugcucugagaaagcaucacuucucugcacuucucuuguuacagcauuccuauggcagccccauggugguacaggccugugccuggacacuggucccuuaucacuauuccuucuaguggucuccucuaccaccacgaucucuuucuccccuccucucaaccacugagaaacuagcaucuugcucaguaucuccacuaugguacuucuggcaucaccuccaggcuggccucucucucugaaacacucucucccauuacaaccaaagagaaacuugaaaaacuggucacauuuaucgcccugguguuuccaguucuucuauggucuaccaaagcucucaggcuaaaaugcuacuccagaauuuagcauuccuccugaccugcuccuacuugguugguucugcuagccuuucucuuaugcuccuuccuccucucuccaauagccacaguuacuucuucacagccaagcuuccaggauggcuuuucccgucucucaccaacauacacaaagcuggccaggcauggacuaaucaacacuugaauuugcccucacacagaccuucucgucuaggauucaaaaucccuguuuucuuuccugugucuccacagaaugcauauucaaccagggcagaaaccucuccugacugguucaccuagcaaaguguaugcauuugcccuuagaauuaauucugucuugaccuuuucauucugaaaaucaaggcacucccaacuuccuuccaauuccuaacucagcuucuaaugagaacuagccauuacacuaugacaacguauguuuucuuuggauuuaucuaccuugacuauuucuuuugacauccugcuaugauaagaauucugcccuuucaauaggugugugcacacguuucucauuuauuguuaucacaccaauacuuaugguuuuuguuccauuuacuagggucuccagucuuccacucuugcaaaccauucuauauccuuccccaguaaguacugcccuccauuccccugggacuucuuuggcccaccuuugugcucuuccugaaacaggacagucccaggcccucccuguguugaugccucagcaucucuagguacacagaggaacccagaccccauuacaugagugcucacuaguugcuguauuaacccaaacagcaaugacacuauuuuacucagacaaauaguuugcguccauaugugcaaggcuuguuuuccuaacaagacugaagucccuguuuuagcauuucaaaauguacauauagcccggcagugguggcacacgccuuuaaucccagcacuugggaggcagaggcaggugaauuucugaguucgaggccagccuggucuacagagugaguucaaggacagccagggcuacacagagaaacccugucucgaaaaaccaaaaccaaaaccaacaacaacaacaaaaaaccagcuaaaaacaaaacaaaaaaccaaaaucuacauauuauacccucaugcaugugacuugcaucuucucgacagggaugagaaaaacugagcuucaacuuguuugcguuauauggcguuuuuuccuccuuuaaacaaacaaacaaacacuccaaacuuauuagucauuuauaugacuauccaucuucuguagacucugguaagaacagcuuaaagguaaaccgaaacuauucuuaaaacacaacuacaacaaaaaacagguaaaccagucacgaagaaaaaaaaguauguaaaaucacccaugccugauggcaauggacaguaaucccaaguaauugcauguaauuuacuugguaaggugaggcaggacgaucacucguucaaaggcuaccuuggcaacguagcgagagaccccaucucaaaagugauucguuaaaaaaaaaaccaggggcgguguuguggaugcuggagcgccuggcagcaggugcgcggcgcuggcuuuaauucccaguacccagagaggcgggauugagccucgggacucccaaacagacgggguucaacuccgaaguuucgaagccugguagaugaagagacuucgccaaaagucccgcagacccguuucacaaccacagcaaccaugccggggaagcaaacuccuaaggaaccucgcccaggucucccgccguggcaaacucgugucccgugcggggccgggucugcgggagccugggcauugggaaggcgggcgcgagcgggccuguuuaaaagccugucccccggcuggccgggcgacgugaggggccggcagcccggccgcaggagccggaggcggcugagcgccgagcccgcuuccccucggcggugcgggcagggccccgccguccccacggcgugcgccccgccaggcccggggucggccggcuggguccccgcccgccggucaccuacccgggugccaccucagggccagcuuccgauaggccuucuugagcuccuccucgcuggcgucgcgccgcacccccagcgccucguagugacacuucauggcggggcuggacaccgggccggggcccggggcggggccgacgcccgggcccgggcagaagccgcagcggcggcgcuggcuguccucuccuccggcgggagcccggcgccagcagcccgccagccagcgagcccggcggcggcggcggcagcggcgcgggguggcggaggcgcgcggcgguggacgacgcgggcugcggcacgcgggcgcgcg

SEQ ID NO: 7683 - RNA, 11172 nt, Mus musculus
gcagagcgagcggcagaaccggaagugcaggcagcgaccgacgcggcgaggcgagauggcggcgaccaagagaaagcggcguggaggcuuggagguucaagcgaagaagccaaaaaggagcucgaaagaugccgggcagccagcuaagcaggccgauguggccaaagaggcggaggaggaaaauagagaucguauuccagguccgguuugcaagguaagaggcccgacucccgaaguuggagucggcgcucugacccaccuuugggccaccgaagcagcgaagugacuccagucaaaacuugacaggaucuuaugcuuaggguucccuggagggacuggacaguguuuaugucuaauuuucguguagauggccuucuuccuggagacagcaguucguagacccuaagccaguuaacagggaguugauuuaauggguguuuaguuccaggauccuugucuuccaguuacugacccccaccccgccuccccagaguaaugguuuuccuuugucuuuuuuuuuuuuuuuucucagagucuuuuugguguaacuauaaauuccuucuguuuugguccguaucacauaggauuaccgaaguauguauguauguauguauguauuuauuuauuuauuugccaagccuuuaaagcuacaguccugugagucugugacucugacuuguuugguuagaucuuuuaacucaaggguccuagaccacuaguuuuacugugucaaacagugcgacacacuuauaccaagaugagcuucccuggccuuagcaucuaggaaauaaugaacaagaguuccuccagaaauauuggaguuuagaaggaaagaaggcuucauagaaaacugugugucucuucuaaaggccagcagguucuuguuggaguuacuuucagucaccuggaaacuccuuaaggaagguaucuguauggaggaaaucuugccucagacuuguuaguccuuugugcuuaguguaguacucaaguacugagugaggcaauguggacauuguaccccacuuuuaauuaacaguuaaaucuuguaccuuugucugaaaggauaaaagugacuuuugaggaaaauuagcugguuuucaauaaaaguuagugcgcucccucuuaggagcuggacaugaaacaugaagggaacuaaucugaaucacacuaugauauaugaauuggaauuaaugagacaauuacuacuauuagggugguaaggaaacacccuaauaguaacuuuuagcugaauuucaaagaaaggcuuaaauuuauguauuuagaaagacagggggggggggugguggaaaaaauucaucaacggcauuaaauggggguuuagaaauucuaaacucagcugguuagcugagaaugugcagggucaguguugggcaguggagguguaaacagugaacauguaguauagaggguauuugacauuuugagguuuggaaaccaagauuaaauuggggcuaguuggcugucagcggugauucugucugggcaagccagacauccaagagcuucgcagcugauaaucagucacagggauuugaggacacuuguaagcguuauaaauuguuguaaggagguaccgauuuaguagugcuuaugaugucuauauaagaaacuagagacagcugggcgugguggcacacuccuuuaaucccagcacucgggaggaagaggcaggcagauuucugaauccaaguuccaggacagccagggcuacacagagaaacccugucuugaaaaauagagagagagagagagagagagagagagagagagagagagagagagagagagagagagaaacuagagguaaaggggucuucagagcaugaggaacugaaaugaaguagcagaaagauggaaggacaggagaggagaaaggaauguugguaaggaaauaugcuagauuuaaauuugguaaagguuuguguuacacagacgagcuugaagcuuuacuuuagugcaugcauuacuagagcuagagagacuucuuacccuucuguacaugguuaaaacuggaaaugaagccaggcacugauggcguacgccuuuaaucccagcacucgggaggcagaggcagguggauuucuggguucaaggccagccuggucuacagagugagguccaggauagccagggcuauacagagaaaccaugucucaaaaauccaaaacaaaaaacaaacacagaaaaaaaaaaccuggaaaugaacauagguacuguaauggagaccaauaaaaaguuaaaaaugaaagggugcuaagaaaagauccuuaugguggugaggggcaguugaaaagugguuuguuuuguuuuguuuuaauguuucucaguugcggacaguugucuguauucccaggauagccucaguuuccugguucaagugcuccuccugcuucagccucccuagcugggacuacauagagguauaccagugaugccagagauuggagacuugacgacugucagaaacacaccaaguauguucagcacaaaauguuaagcucuaagguuuucuuuucuucagggcaaauggaaaaauaaggaacggauccucaucuuuucuuccagaggaauaaauuucagaacaagacacuuaaugcaggacuugagaauguugaugccucauucuaaagcagguacuuuaauaucgggcuuuaaacuguguguguauaagccugcuuaccguauauuacauacuuacuuguuugcucggcuuugucaggcaaagaaccccaacacaaggguuucggggacagcuuagugaaguagaucugaguuuaguccccagaacugccaaaaagaaucugggugugauggcacagauuuauaacuccagcucugagaagguggagacaggugaauaccuggggcuugauggcaagcuagucuugccaaguuggcaaccucucugccaguuuagggacccugucucaaaaaacaucugaagaaaacaccccagggugacuucuggacugauggaaacacacacacacacauuucaaaaguucacucuuucaggugucacauuguaagaaaauuuguaacauuuuauaaacuguuuugaguaggcuauuaaggaaggacuggccuguauugcuuucugaacauuuaaauuuuuuuuuuuuuuuuuuuuuuuuuuuaugacagggccacuuuauguagccuuggcuucccuggccuagaacucauaaagaucugcuuacuucagcccagugcuaggacugaaaguaugugugccaccacccauggcuuaacaguguucuuucugucuuagaggcuagugaaaaguguuugcucuugagaugagacaccugucacugcuguguguggcuguuuccugagauguuuuuggauugugcuuuauguaauggcuuaguucuuuagucuuucucaagccaaaguugccuguacugucuucaaucccugaaacuaacugcaauuuuucauugauguguuucauuucuaugguuauccaaaaccaauuuuaaaauuggcuuugauucaaaauaauacuuucauaaguuaaaauuaaguuuugaucaggugugguggcacaccuguagccccagcauuugggagguugaucucuugaguucaaggccagcuuggucugcauaauuucaggcuagcuaggccugcauaguuggucucauuuuugucucaggagcugggcauaguggugcuucccuguaaugucaucgaugggcgaugguggcaggaggaucaggaccugaaggucauccugaaucuccauaggcacuuugaggccacacuaaacuaccugagggacagucuuaacuaaaaaguuucaguuuucagccaggccagguggcacaggaccauaauuccuacuacuuggaaguuggaaguuugaaaguucaaggccagccugaacaaauuagugagagcagucggaaagcaaaaguaaagagggcuuagcugcaggucugugggaaugcuugccuggcuugugccucgccucccuggguuccuguccccguacaguggcaagugugcacugcauaucugccuaccacuuguuuaguuaugaagagguugaguguuuuuagguuugaucagucuuuaaaaaauuauuuagauagcaaauguagucaaagucagguagucuugaaaucuguuauugacuugcuuucucuuuuucucuuuauagauacuaaaauggaucguaaagauaaauuauuugugauaaaugagguaauuuuaaaauuaauuacaaauacuuuaucaacuaaagaugacuuaaguuaauaacuuaaaaauugcuuugugaauaauuccaauuuuauuaaguucacuaauuuaucaguuauuuuucuucugugauaacuaguauuacuugaaacuuacagaagguacucaaggauuaucauccaaaauaaauaaaacaauuucaaaaaauguuagcuauagaaaacccauguuguaaaaaaguacucucauuaaaugugcaggaaaaauuuguucucuggauauuacaaguuaauaguuguuaaaauuucaaaguacuguugaagauacuaagcuuaugucucaaacaaaguuuucuaaacaguuguaagguaauucuuuggcuacugaaagguuucuauugggucguuuggcacagauguuguuguaacacagcauuauuguacaagcuguggccacaguguugaucagaacuagaacaauucccucaguaucagggagcaccaaugagggaggcaggacaaaacgagauuauacuuuccaguaaggauacaagaagaacuaaagcacuguauuuuucauuccugagcuagacuuagaaaagccucucugagaggcguuguccugaagggggcuugucaguuuacucuuucagacuucaaaaggaaauggaagagcaguccaguagagaaggcaaguacagaguccaggaagaaccuaaaaagcaacagaaucaaaggaaaauguguuuuuuaaguuggcaaguuuuauaucuugaguacuuugaguuuacuauaauaggaugcuuuugucugucugucugucugucuuucaagauuuauuuuauguauuuuauguauagcugucuucagacacaccagaagagaguaucagaucccauuacagaugguugugagccaccauguggugcugggaauugaacucaggaccucuggaagagcacugaguccccuuuuauguuuccuaaggauguuuuuuaaaucuuuaccacguugcugggcauggugucacuugccuuuaaucucagcacucagaaugcagaagcaagcaaaucucuugaauuugaggccaaccugggcuauagagcaaguuucagaauagcuagugauacauagaaacaaaagaaaacaaacaaacaaaaaaaaucuuuaagauguugaucaagucacuuugaaauagguuuuguuuacuuuuccuuaccaauccccuaauucaugaaugcauguuuguaaauaaaaauuuaaauguuauaaaauuaaaauaaaaagcuguugguugaaauaaaggauauuggggcuggagagauggcucagcgaugaagagaacugacugcucuuccagagguccugaguucaauucccagcaaccacaugguggcccacaaccaucuguaauguaaucagaugcccucuuugguuuucuuagagcuguauuuggggauacaguucuaguaucacauauuuccugguguuauuuucaguccucauaguuugugcaugggacuauaggcagaagagaucuucaucuucaguacagcaagaguagcagucacucuaaacuguuaggcuaaugagccugcaguccaccacgugggagguggcaguggaucgggacaaggccagcaugagcugcaugauaccuggucaguaagaaagaaaauagaauaccauauaugcaagagauuuaguggauccuugcauagaaugucaauuuuaccuugaguagaaugccagcaagagggggcuggugagauggcucaguggguaagagcacccgacuguucuucgguccggaguucaaaucccagcaaccacaugguggcucacagccaucuguaacaagaucugacgcccucuucuggagugucugaagacagcuacaguguacuuacauauaauaaauaaauaaaucuaaaaaaaaaaaagaaugccagcaagaaaauaaaauucugugaauaaauauacacagauuguuuuuaaaaagaaauuugcuuacuuauuacuuuaguucuuguuauauuaucuguugcuuuuucuuuuuuuuuuuuaggucugugaaaugaaaaauugcaacaaaugcaucuacuuugaagcuaagaaaaaacaggaucucuauaugugguaagagaauauauugauaaaauugaguaaaucuuuuauaacaggauguaauuuuuauguaaaaggaauggagcaaacucauuugauugugcaauauuugaagccccuaaagaacauuuaacaugaauauuguaggcaugugcuaucucacauuauagacuuacacuauagacguccugucuuauacuauagacaugugcuguuuuauaaucugcugguaugggugaacauugcugcacuguacauucuaaucuuuugaaaaguuguuuuuauauauuucaggcuuucaaauucaccucaugguccaucugccaaauucuugguucaaaauaguaaguuugacuuaacauuucuugaugaauauuuuagaaauguuuuuggauaauugugucaaaauuuuuaacuuuuucauuacuuuuuuuuuuuuuuuuuaguucauacccuggcugaauuaaagaugacuggaaacuguuugaaagguucucggccccuuuugucuuuugacccuguaaguuucucauucuguguguggucuaacuuucuuauuuuaaaugauugaaagugugugugugugugugagaaguuuuaaggaacguacucuugauuuuaaguaauguguucauauuuuuauuuauaggcuuuugaugacuugccacauuaugcuuuguuaaaggaauucuuaauucagguaauucucuuucuuagaaaguaguuuuaggaauauaauagacaaagcacauuugacuuagacaucaaaacauaugcugugccuuggaaugaaaaacuaacagaccuuguuuuuauaacaagaucuucaguacgccacgauaccaucccaagagucagccguuuguggaccacguguuuacguucaccauucuggauaacaggauaugguuccggaacuuccagguuggcuuugcuuuauuuuucauguuuuaaauauuugggaauauguagcauuaccgacaaugcaaauuuuuaaguggcuccauuucuccuucugauauuuguggcaagugauugcugccacacaccugaagugaucucuacuugcuucuuucucugcuugucagcugauguggcaucaacauuuguaacaagcugcucuacucauuuaaagagagaacguggacuggaacucugugcugauugguucuagcccuuccugaguccuguaaaggacaguucauuauuucucuuccugaaauauagcagggagagcgucggaggcuguuacggcuuaggaaaacauaauugcuacaguaauaacuuuuaguuaagucaugagaugauuccucaaucaggggaaguggggcuucuagaaaucucuagcaguaauuugucauaaugugcagaaaagugaagaaaagcaagaacaagauuucauucaggugugggugauggacgcgagcuccugucugcuuguuuuauagaugucuuacggcaucagucacaucugcugacuugggaaacuaggucuauugagaauguuaauaagagugcuuucccagcacugggugggagguuccagaacagccaaggguauggagaggacccugucuuaacggacaaaugaauguuaguguuuguuagacuuaagauaugaaacaagcugggcggugguggcgcacgccuuuaauuccagcacuugggaggcagaggcagguggauuucugaguucgaggccagccuggucuacaaagugaguuccagaauggauaggcuauacagagaaacccugucucaaaaaaaaaaaaaaaaaaaaaagaaagagagagagagagagagaagaaaaagaaaaaagaucugaaacaaauucagauuuuacaguuaaaaggaaaccagugaggggugaaguacuuguguguaaguaugaagagcugaggcauaagugccacguguuuguaauccuagaucuggagagcuagagacagguagauccgaguggcuuguuggcuacccaacaaaguuaacugcaaguuucagcuuccagugagaggccaucucuaaaagcaaaguggagugugagauaguucagcugguaaugcucaucauggagccuggcggccugaguuugacuccuaggacacaugugguagguaggagagaacugacucauagauuguccucuggcuucugcaugugugugccacaacacacauacauccauguacaacacacauggauagaaacacgugggcagcuccugaagaacaacaccuguacuugcugucuagccuucacugugcacaugcaccaguaaacaguaaaccgcacacacaugaacacugaaaagagaaaaucaugguuuuuguauaacuuccuugagcuagaaacagaguuuaggaagugucgugaucuaccacuuuccagguucuuagcaucucacuuugaagauuaucaguucugguuuuaugcuuuauuuuguuuuugguuugaauuauuuguuugagacagggucccuuuaugcucugaccggccaggaacuuauguaaacgaggcguagauccaccugccuuugccucggugcugagauucagaguaugcugugcuuguuuuagagcauucuguaaugaagucguggcugguuuaccuuuuggcaauauacccaaaccacaaggaauguuucuuuuuuguugaagauuauagaagaagacgcugcucuaguggaaauaggaccucguuuuguuuuaaaucucauaaagauuuuucagggaagcuuuggaggaccaaccuuauaugaaaauccucauuaccagucuccaaacaugguaagcuggggguuuuaguugauucucuuuuguuucagucugugauucuguaguuuuuuagccaaaguaauuuuguaauuagugcuuuaccacucguaacacuaaauuuguuuugcugcacauuucugcaaauucccuuuuaaaaugauuuuggugaggguacauacaugaaugccuuaauucaaagcaucuccucuuugcugugucuagcaucggcgugucauaagauccaucacagcugccaaguauagagagagacagcaagucaaagauguucagaaacugaggaagaaagaaccaaagacuauccuuccacaugaccccacugcagacguguuuguuauaccagcggaggagaagccaguagaaauacagugggugaaaccagagccuaaaguagaucugaaagcaaggaagagacggauuuacaaaaggcaucggaaacugcaacagaagaugagcagagggagugcaaagugaaucagaggauaacuguauuuauuuuguauuccauguguaaauacuuuuaguauacagaacgagcuaugccuaauuagggcaccauuuuaaaaaacugaaaucuuuaagucgguguuggucuuuuucuaauaaagcaucuuaacucaccagcuacuuuauucuuuucagagccucacuuagcacacuuacgaguuggcuugcccuguuugcuuagaauugcagugugguuaagcugauauucaagcagacuaguugggucuguaauuacuuaccaagacguuagggacuuuagaguggauuuuuuuuguggguggcagaguggaggagauggucauuuacugaguuuucucugcugaagucacgaauucaugaagccuugagaagccgacuugugauuguuaacggauauuugaucucacugaaccaccaaauugugguguuuacugaaaaaaaccuguucuaguuguggcucagccuuugcacacaccuuuaaucccgagggcugaaauacugacacaccauuaaucccaaacaagguaacaucaguuuguagaaggaaacacccuuguuugaaggugauauauaauuacguggcagacaaagugacgagucagaaaaagaugggagagaauaggauaugcccgaugcgggaggagagaggcucuugagagcagcagagaaggcagcuucacuggcacaguugcacagagacgugcugaagaaagaaugagccagaagauuagaacagauagccagaguucauuugaggucaagcacagcaaagaggccaagagagaagucagauugaauccgucagcuuggagaggaguuugagccagaacaccugaguugaaucagcuagcuggagaucagaaaacuagaaagggugagcuuaauucagucuguugaggcugaaggcacucuaggccuggaauacauuguacagaggcuagaagcuuccaggacuagaccuagguuagacugaguaugccucggagacaacgaugacaucaggagaauacaaguuacuuugacaucugaucauuucagugccucuaccucuggugcauccaagucuuagguuuugaaaaacaagaccuguuuguaagcaguuuuaaauuuaucuuagacaacuucagauucuagagagcaguagcaacagggaaaacagcaaccugagccaccagugaugauggggauagcugacuagggagaugcaugaacauagaugauauauauauauauauauauauauauauauauauauauauuauacacacacacacacccauauauacauauauguauguguauauauauaugugcguauauguguuguaucagaugguuuugucacaucuuuucaccuaacaguguauguuuuuucacaucugcagcauguuuauuaacuagacauauauguguuacccauucagagauaguucaguuuuuguguuucuaguauggugccugugguaaauauuucuguacagaaaucccuuuguacaguacuuguuaaauaaaacucuggucaagguuuuuuucuagca

SEQ ID NO: 7684 - RNA, 13065 nt, Mus musculus
uccaaggcgcucgcuuccggucucgagguagacucucuaggcacacggcggcucgguggugacgguggccuaggugguugcguaucugaacgguggcgggagcuguuugccuggcuugcuagcuuuuuggacgcucaggguguucuuggggcugggguggcaggggcuuugaggggucggacgucacccacagccuggcgccaggggcucccuuaguggccgcugugcggcgagcgggccgaagucgcguucuccugcaagccagguugguggcgcucagaggugcuaagcaagcccgguuacccgcgccuuuuagagcuacccugugaacugcauucaguguagaauaccguaguuuugagacaugaaaauagaaugaucucgauuucggcucggguugaggucgccaguccuguccgcacugauagcgagguuuguuguuccgugucucagguuuucacacaucuuccggaagaggagcauccuucuucucggagccgacgguaccguggaccauccaugccucuccuaacccaguacaaugaagaggaguacgaacaguacugcuuaguggccagccuugacaacguuaggaaucucuccacugucuugaaagccauucauuucagagaacacgccacguguuuugcuaccaaaaacggaaucaagguuacaguggagaaugcaaagugugugcaagcaaaugccuuuauucagguaugggggagugaagacauuuuuaaagcauucccuaaugaaugaauuuggaaggacuuaauucaacaaaacucaaguuagugaacaaaaugucguuacuuuuuuuucuuuccugccaacaaauacuuuccccaucuugucucacacagauaacgauuacuagugauaguuuauuaaugacucuucucaccauuuuccucuuuuaaucuuuacacauauagacacuuucucguuugacauaguggcaccagauuuaauuuucaguagucuuacaacugauugaauuagggcgagaacccuauuuacucuuuacaguauuauugucaugcacguuuuaguuuuuccucuuauuggcuguaauuuuuccucggagcauuuucccccggagauagagucuaacauguaacccugguuaccuggaacuugguuuauagaccagacuggcuucaaguucuuggagauccgccugcuucugccuugccucugccucccaagugcugggauuaaaggcauguaccaccacugccugacacugaauuauccuauccuuaagugacuuuagcuuuaagggauaggcacaagacagaguuagggcaaguucacauagguguuaaauuuagauacagaaaugaagaugaagagcccuuacuagggggugguaacuuugugguguuuggcuuuuuaauauuuuuagaaagguuuauuuuauguaugugaguacauugucuucagacagaccagaagagggcaucagaacccauuacacauaguggugagccaugugguugcugggaauugaccucuaccucuggaagagcagucagugcucuuaaccucugagccaaccuccagcuccuggcuucuuaauuucguguguaugaguguuuugccugcaugaaugucuccaaaaggcguguaccugguuccugccaaguuccugugaaggggguguuggauccccugaaaaugguuacaaaaggauuuuagucaccgugugggugcuggaaauuaaaccugugucuucuagaagauuagcaaguauucuuaacugaugagccaucacuuaguguuccacguuuaaugauuaaaccauucaguaguauucaaguggggaaagguugaaaacuuaguaugucuuaguugggaaugagaaauacucucauggaguuggcagaguauuguuacuuucuaagcauaaagugaaauauagacgugugaauuuucauucuuuaauauaauccacuuucauguuuucauguuugcuuucucauaggcugacguguuucaggaauuugucauucaggaagaaucuguuacuuuucgaauuaacuuaacuauccuuuuagacuguuuaucuauuuuuggaucaaguccuacaccaggugaacuauuuuacuacuacaacuacugcuacuacuauuguuguggcauaaaaguauuuauuaugguuaaaaaaauagaaaauacauacaggaagguuucuagaauauaagcuuuuuaauuuuuuuuaaucuuuuuuuuuggaacagagucuuauguaucccagacuggccuugagcucccuguguagcugaggauaaccuggaauuuaucuuccugcccuugccucaagugaugagauuauagagauaggcaaccauuuauaguuuuaugugguguuggggauugaaacuggcacuucauacguguuagccaagcacucgacuacagcugagcuacggccccaagcccaacaguauuuuguuagaaaacuaacuucucagggaaggacuagugaggccccaccccuaguagagaugcuuuuggcagcugauggcagcuaggggagggaaaagucauuucuuuggaacaaguugaggaguccuagggagggaaguauuaggcccuaauaauuagggggugcauuuguauauaugaauuaaauuuuuaaagaauaaagggaaacugauuuccaauucauuuuccuccuaguuguuauaaucauaggacauaaauauuuaaacuacaaguugaauguuuguuuuaguucuuuacauauuugugaagguauuuauucauuuuaggucauccuaauaggcaagguauguuauuaccuuaccuuccuuuuugcugugaaaagaaugacugacaaagcaguuuuaggguuuauuaauuaggcucacaguuggaguguguaguccauguggcaaggaugaaccuggaagcgaagcaacagcacaaggcggcugguggcauuguguccacgggcaggaagcagagaagagcuuagguggcugucuucuuuuuauccagucuaacacagaagcucuuaaaauggugccaccugcauuuaggguggggcucccaccaccucauccugaucaucaaaucccuaucacagacaugccuagaggcuugucucuuaggugaugcuagagccggucaaguugacaauauucaucaucacacaaggcuccaagauuguaaguuuaagaucaaaagacuuuaaauucaugaaauaccuuuaacguugugaaauacguuuuaauuacauauguauucugacuuacucagaacuaacgucuacuuagaagcaggagaagccaauuuugcucacucucaguugaccauuaauuaggaaauucaguugcccuguauauaagacuagaagaauccaagaauuguuuuauuucauagggaaguaacucauggcuuugcacuggcagguucauaauuaaguuuugguuuuuguagacagggccuugaguguaacucagguuggccuuaaacuugagauacugcugucuuaacuucugagugcuaagauuacaguguacucugccauaccacguacacuagauggccuggaacuugcugugacccuccugccuuugccuucaccauccuaggauuguaacucugaggcaugaucgguagccgggucuaauuacacacaugaguaaaguaugcagccugacagaaccugaguuugagucccagguccugugguagagagagagaaccaacucccaauggauguuuuucuaugacauccgugggcaugcauggcauguguacauucauacuccugaccaugaaacacauacuguacuccauauguuguuaauuaugaauucacaaaugcgguguuucccagcuugguuuuuccugagaacauuugauuuuucauacccguuacggcucucuaaccaguaggaaggagccgagauauuuuauauuccuccucugaggggauugagguguuaaguuaugucaccauggcuauccucuauugaucccaauuugauuuaaaguaauacugucucucaacgggggacauuguauauaaggagugggaaaaucaguucagccagacaggauugauuuucuccugugucccaguuuucuugccauuauuggaaucaggugucuuuaagaggagacaugcaugcuagaagcuuggcagauaaauuauucuugaggcaaugugugugucauuuggagggaacgcuaaccccagagccauagagcuaagccccaugugccuuaacucacugcagggacuuugacugcgcuucggauguguuaccaagguuauggucacccacugaugcuauuucuagaagaaggaggaguggugacggucugcaaaauuaccacucaggagccugaggagacacuggauuuugauuucugcagcaccaauguuaugaauaaaauuauccugcagucagaggggcuccgggaagccuuuucugagcuggacaugacaggugauguccuacagaucacugugucuccugacaagcccuauuucagguacgucagugcgauuacccuucauguggucugguguggauccaacucuccacacaacauuugcuugaguugcaggguuuuuuuuuaacccauccuagaguuuucagaagcauuugauuauuccauaauuuuccaaccuugagauaggaaacuuaagccauaggaaggguaacccacaaagcauuuuauaguuggaagccgauucucauaaucuacaaacuagugguauuuuaguugcugauugugauguagaugagguuacaucuugagggaauuuaaaccgcuugucuguauuacgugguaucuguuuuuccuuacaguaguucaggauacaaaaggaaggagauauugcugauagcuuuuuuuacguaguagcuguuggugaccuaaggcacaugcccaccuuagacuggugaaggaaagugugacucagcagagagcacacaauggcaaacuagucagaaugaggagagcacucauagguucuugggaaacaguucucgaggacucagaguauuggacgaggugcaccucacugggucaggcauuuuucagcaaaaacuguucugauaggauauuucgucccagcaaaauuucugaguuuuuuuuuuucaaaauuagaauaauuuuauagaacuuaaaauuuuugaagaagugcagagaauauaaauuguggauuuuuguuuuguuuuguuuuugacuuaggaacaauuacaggaaacucuuucuugugauuagucagauaagauuuucacuuaugauauaccaaaaauuaaccaaaauguaaaccacuaacaccccaguuaauccuuuaaaacaaguuaccuagaugggucuuguaucccauuucuagaaugggaaacaguuugaugugugaaagugguugugaguuauuuuucuggcuauguuaacauuuaaaguuccuaagguacugguggggugguugcauauguggcugugguacugagggaaucagccuaggcuagaaauggaggucuggggacagucaucccuucaugauacggaagcauaaggaacucagaaguuacauuagagaagggaauauagacugacagggagcauggaggauagaccccgaggcucgggaagaucuacaggaucuauagaucuauaggacuagugacuguguuugucagcaugcuucucccauagcaaaugcuuaggcagcucuuagagacuaaacucacaauuguauacauuugcugacaguacaaaguuggaaagaccaugaaccuucuaagaucagucuaacauagagaaacgcuguaauaguaaaacguaauuuauaggcacaaauugcauguaaaugguucagcuguaaaagcuagaaaugggacccuuacaauugauuuaaagcaaggucuucuauuauaaacaguucucugaaauauauuuuuagauuuaaagauaaggaaaguuaacugucuuauacaacuguacagaguaauacuguauacucugaugugacguuuucuucaaagcuauuucuaggcuggagagauguuucaggcacuuaagagcaagcaugcucuuucaggggacccaaguuugauucccaccaccaugucaggcagcucaccacugccuguaacuccugcuccaaagugauguuccggagcaccuggacucucucacacacacacacacacacacacacacacauacacacaagaguagaaaguaaaaauauuuuuaagcuuguuacuaguuacucuuugcuccuguagcauccuguggaaaccucauuaugaugcuugauaagguguguauuaacuguguguggugcucccagccugagccuguuccauggugacgguguuauguguggucuguguguauguagcuagugcuuuuacaugaaugugcaggugaauguggccuuauguacacauuuguggccagaaaaggacaugggggagugggguuccucuauugccuugaaucacaagcuccccauugugggugagcagcuggcuacuggguuaggaggaccugcuagucuccguaccugagugauaggguugcgggcaugcauggucagaccuggccuuucaugugagauguaggauuugaacucaggucccgaggcucgaagugcaaaugcacuuaccugcugaacucuacccuuauaacuaggauuuuaauaugucauuucuugagguagcaugaauucgaguauugcuuauuauugaaccuacaaauaaaugagugacuuacuuucaacuauagguugucuacuuuuggaaaugcaggaaacucccaucuugacuaucccaaagauuccgacuugguggaagccuuucacugugauaagacccaggucaacaggucaguucucaauaugaaggcuacauuguugaucaacaaaguuaaguaccagaguuccauacaaaaacuuuuaaucuguuaaaaaaaaaaguacaucgcauuaaaaagaguagaugguuggcacuagauuuacuuggggauauuggguuguaaucgcggguggauaaggcaagaaauccagcaccucgguuaaguacuugcuacucaguacuaacuuuugucuuuacuugguguugcaugcauggcauuuaguggauccaaacaacggccuuuccuuuacucucccacagauacaagcugucgcuacugaagcccucuacaaaggcacuagcuuuauccuguaaagugucuauccggacagauaaccgaggcuuccucuccuuacaguacaugauuagaaaugaagaugggcagauauguuuuguggaauauuacugcugcccugaugaagaaguuccugagucuugaauaauucacugacuauuucugucuuuuuuuuuuuuucuuucacgagacaggguuucucuguagcccuggcuguccuggaacucacuuuguagaccaggcuggccucgaacucagaaauucaccugccucugccucccgagugcugggauuaaaggcaugcgccaccacgaccggcgaauauuugugucuuuauaguuggcguucucacucuaacucucuaaccuugaugauuucauuuuggauuguauagagagaugcauggagaaaauaggagcaaggucagucccauucuguaaaucuguaaauaguuuuuauuuugucaauaaauuuuucauauagccauaaauuauccgacuuacuguacuguccugugucuuuuguucuuuucuuuuuuaaaacuguguucaugccgggcaugguggcgcacaccuuuaaucccagcacuugggaggcagaggcaggcggauuucugaguuggagaccagccuggucuacagagugaguuccaggacagccagggcaacacagagaaacccugucucgaaaaaccaaaacaaacaaaaaaaaaaacaaaaaaaaaaacccuguguucauuguguguguguguguguguguguguguguguguguguguguuugcuuaccuuggauguauaggcaccgcaugugugccuggugccugcagaguucagaaggggcauuugaugcucuagagcuagagcuacaggugguuacaauccuccauguggguucugggaaccaaccccuaguccucugaggugacgacugagccauaucuccagcauucuccuuucccccugacaaccuucccaacuuaugggaaucagugaaucaacaugaauacauugugguuuuuccacuuaaguagauuuuuuguuuuguuuuguuuuguuuuguuuuuuuccgguuuuucaagacaagguuucucuguauaauagccuuggcuguccuggacucaauuuguagaccaggcuggcaucaaacucaaagauccucugccucuguguacuaggauuaaagacaugcaccacuaugcccagccuaacauaucuugagagucuauacaaaguuggauggagccauauccgauauguucuuuucuuuauauaauaguauacauuccagguacuagaucuuuuguuuuguuuuguuuuguuuuguuugagacaggguuucucuguguagcucuggcuguccuggaacucacacuguagaccagacuggccucaaacucagaaauccgccugccucugccucccgagugcuggaauuaaagaugugcacaaccacugucuagucagauacuagaucuuaaagcugaguggcucacuaucacaccagugucagaacugucuugagacuugcuaguggggagagcaauguuuauuuucucaagcuuccuccagaaaauucugauguuugccaaagugugaaaaaaacagcugaaccacaguuugagagacuauucuugcuuuuguuuuauuacauucaccucucucucucucucucucucucuccucuccucuccucucucuccucucucucucuccucucuccucuccucucccucucucucucucucucucucucucucucucucucucgacaggguuuccuggcuggacaggugacuucacaaaugauuugaguugaagcauucuaugguuaauuuuauuauuguugacuugguuuuaagaguuuguuuuguuuguuuugagacagggacucucuacauagccuuagcuguccuagaauuuacuguguagaccaggcuggucucgaacucacagagauccaccugccucugacuccugaguacugggauaagagguguacugcccuggccuuuguuccuuuuugcugucuaacuggccuucgaggagccaucuuagaucuaaugcccuggaccaucaggacucuuggaggacucgcaggagccugugcugucuugcucuccauugcacuuuuuccuucacaagguuggcguccauaucccccacacaaaacaagccauguuuguauuucccuggguaguuuuuacuaaaauagcuuuuguggcaauagauuuuuuuuugucauuaacaaaacauaauacuaaaaucauaugauaagccuucucaguagaaaaaauaugucuaaagugaaauuucucuuuucuaugcuagacacuaacagucacugaugguuuggggcaugauacuuggggaaauaauguuacucuauugcaagauguguuuaacauuccuaaaauuaucucuuccggucauuaugacuccuguccccaaauaaaaguacccaaggcuacugaugguugaaaacagccaguggaagaauacagguugaguuuuauaaguuuuuaguuuuguguuuuugaaguuuauaucauuuucuuuuuggaaaauuuugcuugccagaaauagguaaacaaacagccuuuuuuuuucucuuuuuuuaaaccuuguuuauucccccauuuuauguuucuaccuagaauuuauuuaacuacucaaaauagacuaaauaauuucuuaaauuauacuuuuuuaaaucacagaauuucggauguaaaguauuccuguaaaacaugguugcagcuaccugaagggguaggcuaugauccucucagcgguuuggaguggacucuuucagaacgcgauggagagcaggagguggcucaguggguaaacguggucccugugcaagcuugacgagcugccuuccguccuaggacucggagagaaagcuggaugcagugcuguggagcuguuagcccagcaccccggggccagaugggaggugaccagaaucagcacaaaguuugugguccugcuagucuggaguacacagcacaacaaacgaaagaacugccucaaaaaggggcagagggauagcccaaacccuugaaaagucugcaggccuucacacauguaccggcauucaguuuacugcagguuuuuaaaugcacagaccccgccccuuccuaccuucacauuuccuguuccucgucaccugaaauauaaaucaggggacugagcacauguugagcaacugcugagccacugagccugauccucaccuuccaguguugcuuuuaaucaugucaggguauaugcacuucaauaugcucauugauaccacaacagaccuccgucucagggaauagaugccgcagacccucugggccccuuugucugcguggaacgggucucuagucucaggugggcaaagcgucgaauaaauugacagacagaugcacacaggagagguuguguaguaucugaauguaaugucaacucgaguaucagacuuuuuauacagaagacaauaaggaaguugggugacauacaaagaaguuuggguacaaagagguuucuggauucuuacauaaaacagaggaaugcaaacacagaaggucuaacaggaaccaccugggauagaauucauuguuaacaacugggaucaacaagggcuccaccuaagauucacuaaucuuagaagucaggcucaagggcuucaugcccuugccauaguuccuauuuuagucuauuguauaguccaccuuccccuuaggucuuuagugaugguaaauuccuguguaagggagugacuagcuuuuauucaaagugguaguguaguaucagagacuauucugaaugucagugaauagcaacauuuuuacugaauuucaagcccaugaucuuucucaaggauguucuaggacuguuggaacacuggcggaaggcuuuaacuaugucagaauucaaucuuaaaaggcacuuauaggauaauacuaaaagagagcacguggauccauacacuagacuaaugcaggaauggaaaauuaauguauggguuagagagaacaccagacuccaggagcgaguuucuaugaaacucuuuugccucaugaguagcuuuuaagccucagccugucaagcugacucaaccggagagcguggcaaauagacagugcugcaguuaggaacgcuaggaguacuugaaugugcaaaucuguuauggauaggaguuuugauuaccuuugcaauauguuuuucuugugaaauuaaauagcuuauggauucguauacgauagcuauagauacccuugguaaagcuaaagaaauucaggauuguaaacugacuaaauuaacucagagaagugccuuacccuuucaugaaaaagaugaguccuaucuauuaggguuguggccugucccucuagggaugauauagaaguuugguuccuaaauagucuuccuuccuacuguuacugucugaaagguuuugcuugcuguuauuauccgagagguuugguugcuguuacuaacuagguuggaacaguauugucuggucucugaacagguggaacuuugauacgaaggagugaauugaugacucacaucuuaaguacaacgagcugauggacagguugcagaaacuuugcuaaaacugcuuaaacgucuccauaugacauggucugauuugggcuuggauuucuucuaacucgauauggagaucauaagaaaauaacuuaaccucauacaccccaaaaugccagugucuacuaacuaauucaaaagaguaguguaguucaggcccauuagcaacuguaugcauaugucuacagccauacuaccccaaacauauagaguuuagucuggucuuggaagguaggcagaguuggcccugguuagcacuuggauguagaaaacaucaagaguuugauuguggaauccacuugcuggcucccaacugauugaauuuagaaagcagcuugguacuuaccuaguuuuccaaagauagugcaauuucaaaauuagguuacguuauacucagcauuucuacuguuucuuugaguucacaaagcaauaagauuuuaaguuggugaaacuacucuuaccucuaaacacacaguuaccacagugguuugugucucuaucuuucccaaauccauaaacugucgcgcccgcucucgaccagcaagaacgacgcgaccaccaguccuucuaacagcaguuuauucaguccugauucuucuuguuuauaucucccccgaacccugggccucucacuccuuuuauacucucucucauccacgcaccgcaggccacgcccccucgccagucacgaggcuucagcuaaucagugcagcaggggcaaaucuccaccaaauuggauucaccuguauccugguacaccugcgcagcacucaagauguuugugucuuauaugaggaagucaggugcaagucauaugacuuagcugcagucccuggcgccuuugggacugccgccacacccgcuccccacaauaaaccacuauauggaaguggagacaacucuuccgaugcuacuugaggcaaucagaacuucuggaugagagcagaaguuccaucuccaggcgggacugaagcuaacaaugacaagccgaguaaccagcaaacaaucaaugauaaaaaagcagagucaggacugcaccuggggacuuugauucugacugccagacuaaggcauucuggggaaaagauggcagcagcccagagaaaaccaaccagucugugggcuagccuugauaugaaaugguauaugugugcucuggccacagccaaacacugcucaucacuuccuaucacuuggaauuguaugauuacuggauuuuacaggcugaacaaguuaguucuugaauaaagaacggaaauguucugugaguacua

SEQ ID NO: 7685 - RNA, 1234 nt, Mus musculus
uugggugcagcgaacuuuauugaugguauucaagagaguaaggagggcucccuaggacccuccuguuaugggggucugggguggaaauugugagggagaugcucaguguugggggccaaguugggauagggacuccucagcaaccgagggccucucucuugcucucaguguccuugcuggggugggugguccaggguuucuuacuccuuggaggccauguaggccaugagguccaucacucuguugcuguagccguauucauugucauaccaggaaaugagcuugacaaaguugucauugagagcaaugccagcccuggcaucaaagguggaagagugggaguugcuacaaccugguccucaguguagcccaagaugaccuucagagggcccucagaugccuguucaccaccuucuugaugucuucauacuuggcagguuucuccaaacagcacgucagauccaugacggacacauuggggguaggaacauggaaggccaugccaguaagcuucccguucagcucugggaugaccuugcccacagccuuggcagcaccagugaaugcagggaugauguucugggcagccacauggccaucacgccacagcuuuccagagggacaauccacagucuucugaguggcagugauggcauggacuguggucaugaacccuuccaagaugccaaaguugucauggaugaccuuggcgggggggggggaggggggguaagcaguugguggugcaggaugcauuccuaacaaucuugagugaguugucauauuucucgugguucacacccaucacaaacaugggggcaucggcagaaggggcagagaugaugacccuuuuggcuccacccuucaaguggguccugaccuucuccaugguggugaagacaucaguagacuccacgacauacucagcaccggccucaccccauuugauguuagcggggucucgcuccuggaagauggugauggacuucccguugaugacaagcuucccauucucggccuugacugugccguugaauuugccguggguggagucauacuggaacauguagacaauguaguugagaucaaugaaggggucauugauggcaacaaucuccacuuugucaaguggagagcagauggcagcccuggugaccaggcgcccaauacagccaaaucuguucacaccgaccuucaccauuuugucuacgagacgaggcuggcacugcacaag

SEQ ID NO: 7686 - RNA, 14885 nt, Mus musculus
ugcagggggcggggcagauaaacuguggcucgggcgccgagccgcuccgcucucacccuaaggcuggccauggugcugcguggcgucaggguuguggagcuggcaggccuggccccggggccguucugcggaaugguccuggcggacuucggcgccgagguggugcgcgugaaccggcugggcuccacgggcgagaauuuucuggcccgaggcaagcgcucgcuagcgcuggaccugaagcgcucucagggagucacgguguugcggcgcaugugcgcacgcgcggacguguugcuggagcccuuccgcugcggugagcccugcggugcugcgagaugacauucccuccugcccgauuucucccagcuucucugacuccuucuuaagacuuuuaauuugcuugauucccccccccccagauuugccuuuauuauuuggagguauugaaccguacgagaaucuagugcaagagauagacugaaaagcuucacauaggaauagagucauugacccuuugauaugugauauacccaugcucuaaagccauucacagaccaugguuaaccuuucucuaauugcugguauuuccaaguuccagcuucaagaucaccucauuuacuuugggccauaugaaaacauuguuuuagugcucuguagacaaacgaccaauuuguuaacaguaucaguuuugagcacuugcaugcuugguggcaugcaccuccauccgacuguacauugguauuugcaacugucacaaacccugaaccaaaucugaaggcauuccuucuguauuagcucagagaauccauuccaaccagccccuuacuaauauugccugguagauaccaggacgacaguaaauuugacaauaagugggacgggagugggugucuaggcauauuuauauuuaacucuuuuaguucucacaagcauaucugaggacaguacuguaacauuuaagauuaugucacaauguaaaaaugcuccaauugaagaugagggugggucagugugauuaguuucuucaguugacucuuaauucugacaacuuucaccaaaaucacaacaaacacuguuaguaucacuugcaagaguguguuuuugguuugccccguaaaaggaauuauucccaucuuugauucgugcucucuuuaaaaacaaaacugauagguuaggguuauuuuucugcgugugaaacgagccaguucaagccagauuagauuauauuaaaggcagguuuauugggaagcuccucucuagcaguucacuggcccuaaggaccagggaaguguccauggggaaaggaaggauagggaaggagagagaaagaaaggucauagggggggggggaggaagaggaagaggaggaauggggagcuuaaaaugucuggauuguauagagaagagccucuuggggaagagcagcccaggucugggauggaaaguucaggguugggggcuggagcauaugccaggaaggaacugaggggugcugcgaggaggaccuggagccaggucuauuuugauaugugauauaugcaccucaguccuugucccaggagcaaacaaaaacaacaaccacaaaacaauugauugcuuuccucuaaaggugucauggagaaacuccagcuugggccagagacucuacugcaggacaauccaaagcucaucuaugccaggcugagcggauuuggccaaucgggaauuuucuccaaaguagcuggccaugacaucaacuauuuggcuuuaucagguagguuugaaaggcuuuucuaaaauaauuugaacuggcuccaaaaucaggaaguacaguuacauugcuuaacaaggguuuuuuaaacauuuaauuauuuuucauuauguguguaugugguuauaugcaugugaguauguaugcuggugagaggguccuggaucaccuggagcaggaccaugguagguugcaaacccuucuaggugggugcugggaaucgaacuuggguccucuggaagaacaguacauauucucaaccacugagcucucuuucuagccccagccuugauuaacacgaauuuaaaaaugugaagauguuaaugcaucuggcagagagaacgugguuguuaaaacggguugauuugcuagaacugcuguccuuaagcucuguccccacccuaacccauuugagggcuaauaaucaguaguagcacugguuuccuacaauugggaagucaguuuuaaggaagccccgacuaggagugagaggcaagguaauaugauggcuggucacucuacuuagugggaaaguugauucaguuugauucugacauuccuucaccacgaaucacuuggagccaucauuccagacaucugugaacccggcucaaagcccaugguuuucaggucucgcuaucacuucguuagaaucugcauccgugaggacggguuuucaaauagccuggcucuauuauguauaagaacugcauguuacugaugaaagcaaaucuacucucuguaagaagauauugaaagguugaauauaaaccuuccugacuguccaaaguauaaaaugggcuuuccacauauuuucaaaacuuaauuccuguuccuuuuuggguaugauuauauucuuauaucucuuuuuaauaaaauucaaaaugaauuauacuguuuuagagccaggaaaaaauggguaguaauaugucuucuuuaaaacuuaguuagugaagacuuuaauaaaauauugaaaaugucgguugggaugguuuuuuaaaaucuuuuuguuuguuuguuugcuugcuugcuuuuauguaagaggacgcuuuguaaguggacucaguggauucauaguuugaagagcauugugcaccguuuucacuuagggcagugacuauaaaaaucggcuguccugcuaagguauucuuguguucacuuaaaaggggcguucaauuuguuguccauggugcaggcguucugucaaagauuggcagaagcggugagaaccccuacccaccgcugaaucuccuggcugacuuuggcgguggaggccucaugugcacacugggcauugugcuggcucucuuugaacgcacacgcucuggccgagggcaggucaucgauucaagcauggugaguaucaguugggggcagagcgggaugcuagguuugccauuugugccucaguaucacgugugacugccucaaaucuuucugagugagagagacugggucuuucuggguaggucuggcuguccuggaccucaggaagcccccccucccucugcuuccugaauguagggauuaaagauaaaugccaacaugucuggcaagagguccuuugcuuuaaaauagccucacccuuuuguaugcaucagaaugccauauugaagccaccuauggggugcuuuaaaccuuauuuauuuagugugaguguguaagaauguaucuggaggucagaggacaagguuggagagucaguauccuccuuuaccuauggcuucuggggaacucagguugucaaucauggcugcaggcaucuccaguaagccaucucuagcagcaugcucuaaacuuguaacaacucgccugauuccuguguuguauuucaauguuuuucuccaaguuaucuuuuaugauuaaacuagagcuaccaaguaacgauccuucaaaacugaguuucagcagugguuugcagccaguggagcagguucuuagagaugcuaaggaaggcgggccuuccugucccgaccucuugcugccuuucuuaggagaugcuucaguuucacguuucucugugugaacacucauuuccuccagcugaguccuuucucugugugaucucuaucuucagccugggugaauauauaguuuccucagcuucuggcacggguaugauucaagguucccauuggaugcaugaaacugaagauaacucuaaacuuaauguuauuucauuuuacccagacauaccuacauacacaguguauaaauuagacacaguaagagauuaacaauacuaaaaacagaacaguauaaaauauguacuaauaaaguuuacuuacagaguucccuaguuaauauuuucagauggcuguuaaucuaaacuguagcuauuggaagugagggggcgcguaaaaggagagagcuguacuuuguucugaagcagggacacuucccugaggucucacagauccugguaaggguaaaguccagagcucgcucaugcagucaugcugagagaucuuuggaaggcaaacagaaaauggauuugagggaggcgagagacuagaaccagagagaccaguuaacuggggguuuacugagcaaaugagggagggcgcgugcugaagcaguuaaugucagagucagacuggauuaaagaaugcugggugcaaaauugcugcagaggguugcaguggggaaagaagaaagaagugaggacagaggcagauuucuagcuuguaagcuaaggggugguaucaccagcucccaggggcaggcugaugagggaagagaccgccagcugugugcaauugacagcucccuucuuuccuccucccucugcacuuuaccagcucugucaucuccgggguuacucuacaaccucgucagauuuguaaaaugaauacuaggccaaugugucagaaugguuagggaauguaauuagucugucacuguguagugagugugcucugacuucacucugugagggucugugauugugggguuucuuuucccagaguaaaaggaagguaguuuuguucaccucaaguuugaaguagcuuuuccguacccugagggaauaaguaaguaggagccaggggacagcucuugcagucauuugggaauaagcugggagccaggggagcaucugugguucccugaagaggugacagaaugcuaauguguagcacugaguaggaaaagagcagcaugggggaagaucaguaagccuggaacaagaagggagggucaccauggaaaccaagguaacaaaguuucaagagacacuuuuuuuuuuuuuuucuagacuauguuucucuguguagcccuggcuguccugaaacucacucugcagaccaggcuggccucgaacucagaaauccaccugccucugccucccaagugcugggauuaaaggcaugugccaccacugccccggcucaagagacacuucuaauggccagagggucagaggccuguggguaccucaggauugagaauguaaauuguugugggucacagggucacugugcaaagcccuucucaaacuggauuugcucaccuugauccuugguuggcuguuugcuucucacagaugaugcuaagcccugugcugugucuguuucuugugauccuauuguggagcacaacgcaccccgccccuuuggucccucucuguagugugcuuugggagguguggugugggguuugccauuucacucuggauccuggccaugacugcaccaccucagcgugagaacgcagcagcagcagcagcaaguucacacugugccacuaagugcagggccccauggcucccaugugccuaccuuccugugagccacacagccuaaaggaguugggcucuucccaucagcuauugaaaaucuguaggcuccagagaugaacaguucucuaacagugccaucgcacaauuugauccaaagccaggccuuuaaauaucuucccucuacuauccccaugugggcagggugugccauccaaaagggaccgacuaagaacccuuguggaguuggggguuguaaggaaucaccguuuacuaagugugauugauucuucauaguuuaauguaaauagaagaugguuucacuuuucaucagaacagaucuaguuagguuugccuaguugguagacaacagugagcucucugugugugugcaagucuaaccuuucauaaggagcucauaguuguauuaggggacuaccauuguuggcuaaggacucaggucacuggggucacugagccucacuugucacuucuagcccugugagcccuugcagacacugacuuaggcaaggcagauaucuuucugacagaccaguagcuucuugcuauugagcgacagaaccugugguccuggcaggccagaaaugagauggagccuguuuucuucagugcugcccccuaaaaacuaugggguuaagguaacugcagaaauguccauuuuguuguaucugcucucuguagagaguaccccugaccucuggugaguugcaugcaggcuguugacccacugauggccaaguugggaaguugaggcuguucuugucugaguagcuugcauaacacauggguaaaagaguaagggagaugccugccggggucgucacugcugggccuccagaugaggugacaauugcuugcacugguucucuuuuccuguggccuccugugaugcucugugccucauuuaggcugacucucagcagaaacacuuuguuaugagguugguccaguauggaaucuaaaagcuuuccccacucucuggccugaaugugcuacccagcuucucaguguugugagauagcacugccugugaucccagcccugggggugggggugggggugggggugggggugggggugggggggaggcaggcacaggagaucccuggguuuccuggugagcugggcugggucgcagagguccagguucaguacgagacucugucagaaagcgacugagaaagacaucugacauugaccucugaucugagagaauaauucagugagcacccauguaccuuuaccugacuucacaaucaucaacgugucagcauuugaaaggaagauagaugaaguuccuuucagucuuaagauaucucaggaacugaagaguguacccaugguguucucccauaagccuucucuaccucagugugcagaaaugucgaagugaccgugugguuagauguaauuauccuggacuguaaaguaaguuacauaaggacuagccagcccuccccagugaugccuccuugaacacugcaucuguaacguguccugcuucuuccaagguggaagggacugcauacuuaaguucuuuccuguggaaaacccagcccaugggucuguggaaacagccucgaggacaaaacaucuuagauggcggugcaccuuucuacacaaccuacaagacggcagacggggaguucauggcuguaggugccauagaaccccaguucuaugcacugcugcuuaaagguaaguagcuagcucugagucucccgucugcuucacugugagcucuuuaaucuuguucuugagaccuuuugaaucccacgaugucuucuucuuaauacacaucugucuuuccagcuaauguagcaauagcuaucagcauuucaucugucucuuaaauugacaauuuuacuacucuauaaaauaacucaggacuugaacacauuaacaacccauuugaugggaaagccagagcuucggcugcaagcgacauggauggauguuuauccugucuugugugcccagaccuuccuuacuuuuccuaaaagcaauaugucgguucuccuggcucuuguucccucaugggcaucccuuaugguaguaugguguggaacaaagucacccaagugcagugagauuuuggcaaguaagacucaguuacacaaugucacugccccuugguaccuuggaaauuuaccugccuugagaauucuugucuucauggcacacugcuauacauuagagggaauuuugggauugcaucuuucccugugacauaguugaauuggaauuauuuuguuaugugaaauguuucagauuaaaguuugcacuacaauuaauuaugcggcuuuagauauacuccaaaguaaagcugaccaugguaggcacagcuuguaauccaggaacaacucaggaaguagagacagagggaucuucaugggaaagcauaaaaaauuccaagcuagccuuggcuacauagguaaauggauguggaggccagaggguguguacuggcuaguuuugugucaacuugacacaacuggaguuaucacagagaaaggagcuucaguugaggaaaugccuccaugagauccaacuguaaggcauuuucucagugaucaagggggaaaggccccuugugggugggaccaucucugggcugguagucuuggguucuauaagagaacaggcugagcgagccaggggaagcaagccaguaaagaacaucccuccauggccucugcaucagcuccugcuuccugcucugcuugaguuccaguccugacuuccuuuggugaugaacagcaacauggaaguguaagcugaauaaacccuuuccuccccaacuugcuucuuggucaugauguuugugcaggaauagaaacccugacuaagacagggugauuuucagcaucuuuuucuaauuugcucuccaccuuguuuucuaggucuuuuuuuuuaauauuacuuaacaauuauuuuacuguuugaaaauuuuuauaguguauauuuugaucauauuuuuuccucucuucaguccucccuguuucucccuuuccaaccaacuuuauguucuuuuugucuaaaaaccaaauacaaauaaacaaaaacaaaaacaaaaacaacaaaaaaccccaaaacccagccccaaacaaugcccaacauaaauucguacucucacgugcaugcagguguagacacacacacauacucacacacacacacacacacacacacacacacacacacagagagagagagagagagagagagagagagagagagagagagaguucauuuuguauuguguuccugggcagcaugggcccagcccuggagaguacuugauguucuucgugacacuuccuuucccugccagcaggcaucaguuacaaacuccuuccugguuaagggugugguugguauuuacuccugguccccguccccagagcuggaaucuugucugugcaugcuguuacagucucuauggggucacauguuccuguugagucuggaagaucuguuucccugggcucaucagucagcucuggcuuuuagagucuuucugcauggaucccugagccuugaggggaggaauuugauaaagauaccccauuuagggaggagugcucugagacaggggagcacugucugcacaucguucuguuguggaucccgguugauuuucaucuacugcaagaaggcagcucucucucugacaauuggcugacgcaccccgcagucccacgggcugaguuucccacaggcgagaacuuaaaugugccauuccugacagcucugaagaacggagcacuucagggaugcaggagcuuuagaagugggauuaauauccauuuggugauuuuuguucaauuauguaagaagcugguauaauacauuuaccuuccaacuuuaaaguuucauuguuugguaguuuuucaaaugcaauguacugcuacaaguuauuuguauauacuuuugccaugauugcuuuuacaaacauuuuauaaucacauauguuaacuuuaccaacucaaauauauuugauuaaacuauggaacaggauuguguagcucaaguaugauucaucucugcucaaacugaaauuauauuuaaagacuuucugcaaauacuuugaucacuaagagaaaccgugugccuauuaagccuuuauucccuuuuguuuucuauucaauaacaugguaucgguucuaacaauuaaaagaagugcauuuagaacugggaaacuauaacagcuuccaaauaaaagacaauucaacagugaacugcaguuguuucaguaaagagcacugcucauuuuuuucagccacucaggagugaguguucuaugcuacauuguuccuuuaccagacacaguaccuuagaacacaacuaggauggugcauccauagaauacucacuauuucaauacagaaauaaaaauaaaacuuagugggguggagagauggcucaguggguaagaguacuggcugcucuucuagagaguucaauucccaccaaccacaugguggcucagaaucaucuguaaugggaucugaugcugcccucuucuggugugucugaagacagcuacaauguacccauauagauaaaaauaaauaaaugaaucuugaaaaaaaaaagauguacuucaaaauucugacuuagcagugguagacaaagggcucaugguuggugcaguauguguuggucacagagcccuggggacagagggacacaucaugucagacuucacgucauacaacagccacguguguguauauauauuguuaacagaaaauguguuuauauaguuacauaaauuuuagcuguuucuugucaacauucacauuucaaaguaaagguacuuuccuugaaagaauuugaacucuuaaacacagcuucuuuugaguuaugguaacuucacugaaaguuaucuuaguacauuuccucuuauccuuugguaaacauugcauagaaauugguaaaguaacucccaguuauucagugucagcccaguuauuucuucuggaggcugaguugguaacaguuuucacauucaccuuuggugauuuuugacuaauaucuaagaacagagugaguuaggauuuaacucuuccuuuuuuuuuuuuuuuuuuuuuuuuuuuuuuuuuuuuuuuuuuuuuugcauagggauccccuguuuucucaguaucauugauugaaaaacaguucuuccuguguagaauaauacuuguauucuucuugacgucaguugaccauacauggaaggguuuaucuugggacuuuuuuucuuuugccaguucaagugauugcuugagguccucccacauggaggagaaugcuccaccacugagcuguggagccagccuuacuuuuggacuuguauuucugauggcucugucuuuauguugcugugccuugauuauuguaguuaaguuugaaauugagauguguguuuguguucuucuucagcauggucuuggcuguugugauguccuugaauuucuguguguguaauguuuaggaucacuuuaucaaugucaacaaauaagguaucugauuauuuuauuguauuuguaugugugugugugugcgugugugcaguagcauggccaugggcauaccggaguacuugugaggaguucagaggacaacacugggggccaguucuugcuuuccaccuugcuugagacaaggucucucuguucuucacugcugcauauuccaggcuggcuggcccaugagcuccuagggauucucuggucucugucucccgucuuacuguaaggacccugggcuuacagauucacaccgcaccccuggcuuucuguggguucuauggauuugaaaucuguccuuucugcuuuagugguaacucuuuaugcacugagccaucucccuuacucauagcugagauuuggacauggguucuuuugaguguacagcugaucuggggaauaguaccguccuagcaguccuaaguguuccaguccaucggugugggcugucuuccuuccuuccuuccuuccuuuucagcuguaaucuuggugaugcucugugauuggaauuccuucucugaugaguaguuucuuacauguguggauuaagguuuuucauugaguuuugggacuuuuuagauaguucuucaguaauuuucuucugaccuuucucuccugucuuuuuauaacucuccaaaugcauuguaaauuugauagcaucuuacauucuguuuauuuuucuucauuaauauggcauucuguuccucagguuagauaguugaguucucuucagguuguuucuuuauaaugauuaucucagccaacucuugguguuccucacucuguguagucacugaaauccgcccagucagcuugguccucagcuaaugccuggacaaagauggucuuacgucuugucccagugaaucucccauccaccugugagaugcuuuauuccuucucacauguacagacccuccaagcuuugcaguccaggcaucguguagaccucauuuaggugagugugcacuccuggaugugugcacguauagacuguggagccuuggaaagucuagggaguauguuagcacucauuagaguccucuaggaauuccaaaauucuccccuuacaaacuuuugaucaugcuauucuuaaguguucauauuauaaauuccucuuucacaagagagagagagagagagagagagagagagagagagagagagagagagagagagagagaaagaaagaaagggaggaaggggaggggaggggaggagaggagagauuuauaccaaccccuguaauguggccuuuugaauacacgaugugagacacuguuauaucuagauaaacccacgagcaguugaaaaugagaauuuucaauuacucacugagaaugcaucugcuaaacagaauagcucaauauguccugaacauuuacauuggaccacaguuggggaaauccucuaacccauggcuuuuguuuuguuuuguucaacaagcuguugaagauuucauauaauuuauugaacucugaaaaagagaaauaauaguuauuugacaaacuuucacaccaaugugaggccuaaaagucuucaccuagacauuggcuacuucaaaagaccuuugagcuccuaauuugccaaggaauuuggaagacccuggaauaauuugcuaauuauuccaaaagaaaggaauauuauuuauagggcuacaguccuguauguuaucaucuauccugagguuucauucuugacaauggcaagaaucaugugucaaauuacaaauguuauuuuuaaaguguuuaggaaugucauauaaaguguaggguuauguuaauuuggcuagacagauaauggcauccugaggaaauuucuuuuugaaagccuucuuaggaaauaaaccaauuucugggaacuaaaagagaccccauuuccugaaaaguuaguaagaagcucuugacagugacaaguugguuuugagcugugucacugcuacuuuuggcuucaacuucaaacugauuaauguuuuucuugccauucauuugauauagaaguucugauacaguuugucauugguuauagcuacucccuggaagaauaguaacauaagacauugcauuucuuccucaggacuuggacucgagucugaggaacuccccucccagaugagcucagcagauuggccagagaugaagaagaaauuugcagauguguuugcaaagaagacuaaggcagaauggugccagaucuuugacgggacagaugcgugugugaccccagugcugacguuugaggaggcccuccaccaccagcacaacagagaacgggccuccuucaucacugauggggagcagcucccgagcccccgcccugcaccucugcuuuccagaacuccugccgucccaucugccaaaagggacccuucuguaggggagcacaccguagaagugcuuagagaguauggauucagucaggaagagauccuucagcugcacucagauagaaucguugaaagugauaagcuaaaagccaaucucugacucaggcuuauagcucaagagaaucugaaggcugcaucuccacuggggagggaugcccacaauuguguguauggaaauguggaugaacagcaaugaagucauccaaauaucccaaucacgauccaacgaaaggcugguuacaggauaacgauugcgcccuuacgcugcuuaucagagccucugauugaggaaaauuuguguguguguacugauaguaacuuguggcagcuuucugccuuucaguucccuuggugaaguguauccauuuauuaaaacccuuuuauaaauacaacucugaucauauauuaaauaaacuauuauaacuuuaauaaauaaaacucuuguuuuccuccucaaagugagcagugguuuuaaguuguaaaagcuuuuuagaaagcccuuuaaauaccauuuauauaacauuuucuaaugcacugaaauauuggggcacuaccgggaacaaaauucagacccuuuaaaaaaaaggcaaaccuuucauccccugcuuuuauuugaacucugauguuaaugaauggucuugcgguuuucuuuauaaagcccugcuucagaucacuguucuggcugcuaugggugaggagcccugugcucuguucuccaucaccuugcagcaagccuuucccucaguagacuguccugucuccagugcagaccugcugagcucccuccaucagggucugcuucuguacugauuaugucuccaccugcuuacccucucgaaaaucccaaggaaaaggaacuugaagcaaacaaguaaguaaggagguauaggaggcaauaggagaacacgcaauacccggaagacuucguacugaauugcacaccagugacagccaugacggacagcugggaugagcucugggugccaagcgagcuucccauccugggaaaucucuuuacagcuucaaaagaugcuaauggcuuuuucaggcugggccaggucagagguucaugguuuccccugcccagugcuggaguucacauuuccauagaaaccuaaucccucaucacuuaauggcuuccuaacucuuggaaaauguccguuuuuuaaaaaauguauuuauucuuugaaguuauuaucuguguauacaauguaucuugaucaucucuaccccucauccgcccccccacaacacccaacccugcuugucucccgcccaacgguuuguuucgauucuguuugucuugacuuugaauaccauuguuuugcuuuuauuucugucauguuaccuuucugguaaaguuuuuugaugcaagacuagccuuuccagcccugcaaaauuuugcaauaguguuuuuuccccuccuauaggauaaaacucgaucuuaccaacaauaauaaauaacaguaaaucucc

SEQ ID NO: 7687 - RNA, 879 nt, Mus musculus
uuuagaaacauuuuaaauuaacuuuaauuugcaagacuuuggugucagaacuaccuuguguaauacagccuguucucgccguaaaugucuuugcugcgugaccacgaaaagagggugcagggcccucuggaccugcgcagcugcucgguucagagacgcgccucucuggucugagacuucuccacaauccuuuccacuccgucugcaucgcugugguagcugugaccaguggaaagacugggucuaccgggcaggaccuuucugggcauccuagacuaucgggcauccuggaacagaagcgcugggguuggcagacugcuuuuuagguacuuaaagauucucugggggaagaucuggggggccgggaagcgggagucccuuuuaguugccugguuuagcaaauaguaccuuagggugaugcuuuucaagcuccgcgacacuuccuggagcggaaucauuuauccaacaucggaagcaacaaguuucgcuuuucuggucucagugaccccgcggaggggcugcgcacugggacacggugacgcugcgcccacugugauucuagcgugucccagcagcccagagggaggagggcacccacgccgggugggggaaggagcggugcgacaccgugcaggccagaugggcuuaccagcucugcaaaugaauuuuccugcaccaggaccuuguuccuuguuccccgaccuugcuccagggaccagaaaggucaggugcgggacaggacugggcgcacccagacagaacguggccagaucaagaaaagaggugagagucuauggaguuuugcaaggaagccaccaauuuggagaaacauuuccccuucguuuuugcaguguguguguaugagugugugcuuugugu

SEQ ID NO: 7688 - RNA, 15670 nt, Mus musculus
aacaugggauaacacaaaggguguguuucuuguuuuuauucaacauuuaaaauauucacagguggaauaauagguucauugacaccuccacggaagauguacuaaacaaagcauacagucauuccacaauuacagagucacauacuucucacuagaugcauguuuacauuauaguuuaucuggaaaaaaauaccuuucuuaagaaaaaaaucuuuaguguuucacuacauuaauuucuauaaaaagugaaccacaaagaaauucagaaaagauaccuaaauauaacucaacgguucugaagacguucacaggcucuauggcaagcucugugcuagcguuccugucaggaacgcuuacauaacuguucaaucccuuccucccuuugcagccagaccaggaugcucuuuccccacgguuuuccccacgcugcugacuccaacacuacgcagcacagacugguuaucacagcgucuugacuagguaaggagguaguauuucucaagauuuuaggcauuugugaagcaaacaaaagaaaaucugaguuuuucuuuuucagugauuguggaaauuggccaaaggcuuuuuacccuaagaggaaaacccauuuggaagccuuacuauggagcauauuaaagggcaaaaccuggcagcagaucuaauuauuuuaguguuacaaaauaagauauuaugccuuaaaaugucaagccuucuuccugggagaaaacuuacuaugaugguuauuaguucaacagaaucuagaacuacccaaaagauaggccucuaggcaugaugucuggagaaucaucuugccugcuguggccaacuccagcuccugggcucagguuaaugagacaaaaaggaacugagcaugcaaucacagcucucagcuuccuggcuauggagccauguggccagaugucuggaguuccugccacugugacaaugcgacaacggacuggaacauggaacugugagucaggauaaacccuuucucccuuggcugcuucugucagggcacuucaccacagcaacagaaaagaaacuaagacacugaggagaaaggcaucugaacgcaaaauagaaggacuguacccuuucuuuuccaucugaaaaguccuuccucuucuuuuaacucaauuuuccuuuucaacacacaaagaaaaauaacaacaacucugguauaacauuagugaauguauuuagcuaucaaccuaacaaauuaugcccgagaaagcuuuccacauggaauuuuaugcuaagcagcuagcaaugccuagguagcagacggcagaucucugcaaucggacagcugaaauguacauauaacacauggccucaggaauuuaccuguuauucuccccucaucugcaccaaaccagucuuauguucuaacuauccuuucuuuacaugacaaauaaggaauacuuuauaaaaucaaugaaaugcaacacauuauaagaggaucaucccucaagaaugagcuaugguauauaucuuaaacccuuugauauauauguaucaauuuggaguaacacacuaaaaaguuaccuaaagaguaucuguggggaggacaguuaaccacaugaggccuggcagacuguuuuuuaaauuuaauccuuaacaguucuauaaaaugcuuagacggugggacucaguaugacagugcaauucugauauggcagcccuuaguggcagcauuuuuucacaucuauaaauuguccuuguuagcuauuauucuacgaagacccaucuuaauguuaucaccaacauaucaugugcacaacauuuaguuucaagaaaguuccuuucucaucacaggcuagcucccuucaguguggugacuuuccuuugcaaacauuuucccucagaacacuaugcccuuuucauuggagcaaugucccuaaaacaugugccugucugcuugcuuaaucaucacaauugaaaugaaaaccaauggaaaugucuaucaaaccuaguuaacaucaagucuggaagucacuuguccagauuaacuguagaacagucaacucuaaaacugcccacagaaccuaccacaguugagcucagugccacaucugacuacauagaauccacacauuauuagaauauaacaguaggccaguaaguuucacacuuuuuacaagucuaaucuaguuuaauaucugacuuuauaaccaucacccuagcacaaauguuuacugagugacagcucaucagacaucaaagucacuauguucuguaaacuaagcaacaucuacacagagcacuaugaauaaugacauacacuugcuuggaguucucauauaagucauguugccaaacagauacuaguaauuagcacaguagacuuaggaggcaacaaaacugacaguuugacuuucuaaauaagcguaaucuaucugaguaaagagugauuuaaacuugagcacuaagagaacugaagaaaagauaaguuauugugguagggagaaguccuggagaggaaaacgcaguaaaucugguuggaaagaaaaaggcugaguauacauuucacaaagcaaucuaagaaacucaauguaauacaaauccuucugaauguaagcugacucaacagugugccuaguuguucuuuuggccuuaaacaguaacuagguuuuuuugaucaaaaaaggguaccacaguuaagauuguaaugaucugacuuuauuuuacacacuagguagggggcacaaagcaauccucuuuaauaaacuugacaauuagcuucacuuagaacauuuuaauaaugcacauuaaaaaaaaguauuugucuuacaaauuguucugcaauccaaauauacaacagcuuggaaaacaacauuuagaaaacaaaagccaauguaaaaagacaacuacaacaguacagguuugauauggcucagauuuuacagcuuucuuacugcgucaucuauaucagagaucuguuccuucagcuggcuccauuguuccauguuuaaagaaauaccuaaacaagguuuaagaaauacaaggugaaaaucaagccuuuugggggauuuugauauauacaaauauuugaaucaaaacugucauuucacuuauguggauuuuuaguguugagaacaaaacccagaucucaggcacgccacauacacgcucuauuacaccagcugccuuuugaauggcaaccagaauauugaaguuuuuaugagcgaucuauauugauauuaaaaucuuaaauuuuuuagucauagguucaauuuuauauccaguuuaacuuccaacagugcaccuacauaaugccuauuuugaccaauaaguacaguaacaauccgaagauugucacaaacauauagagaaccagauuuggcauuggcaaauuuauauccagacauuggcaguuuuauauccugucucuuccaacauuuguuccauauuuccaccaaauuucaauguguuuagcucugugcugaguucuuccaucagcauccauuucacuuugggaaacuccuuagagugacucaaaaggggcauggcagagugcacaauucagauggguaugggugcacucuggaaucgugcuaucaagagugacacucagcuucaccaucccuagcugccuuuccuagacucaguuucuuaaucaguaaauaugacuuccacaucaaagggugguuauaauauuuaaaucagguacaaugaaaccucaauccaacaucccauacacgcaaacaauguauuuuucagaaaacugcugagggaccaugagaauguaauaggcagcagcaggaaggaagccugugaggcuaagucaguuccuuaggaaacauaugcaagaaugaaaucaaggauuagccacuguggaaaauccugaaugaaaucucagacagaaauaaucaguaaagauaaaaaaggaagcuucuaagacacacuugaaaacugcaucaaagaagugucaccuuuaacagugggcagacuaguacuagaagaacacauuuuuuuccuuuuauuaaaaaagaauacacauuuauucacugaaugggugcacacaugcauacauguaugggccccccugugccacagaguuuuccacaguauagguaguauccauucucuccuuuaccucauggguccuggaucauacggcuuggcaccaagugccuucaccugcugaggcaccauaccuuacuggcccaagaaagcauuuccucaacuaaaucaacccauagaacuacauaaauuuagguaguguaguguuaaucuuuuucaaaguuuuuuaacaugaccauguacaacaguuucaccugacauuuuccugcauguauauaauguaucucacccuccacucccuugcuaugccccauuucccacuccugcccaucgccugccucuucccaaccagucccuccucuacuaugugcgcgccuuugucuacgcucccuggagcacaaguuaacaguucaucuugaccaucaacucaauggauuuaguuagaaccauuaugaacacaccucugugaguguccacaaguaucuguggacagauuaaacugaugaaagaagaccugcccugaauguggguggccccacccgccuaaggccucagugacaccaagcccagccccaggacacucuucucuccacauccugacugggccccacgugagcagcugccuucuggcugggucgaauaaacccuucuucccuuaaguugcuuuuaucuccuauuuugucacaagaaaacuaaacauaaguuggugcaaaugguuucuaguuacuuuguaacagaauaaacuguuucuacaugcuaagaggcuugaacugggcaaagcaccaauacuaaggggauagagaccuuuaaggacucuguauuagagaacaucuugcuagagcugaauccaaagcaaacacuaaacccaggaguuugcuacuucucauuuuacaguuuccaaaguaaugccuaaucugccuaggaacugauaaaaaugaaguuaaaguuagugaucaauucaacgugacaauagaugcuguuuuccuagguuucauuacaaacugcuuauaagaggaucaaccaaguaaggccaauccuuaaccuguauucccuguaacauuuuaaggcaagcauucaaucaguauuaacaucaaacugaagaaauaaaaccucaccuuuucuuccugguuucauuucaccuucugaauccauccaauauucucuaauaucaauuagaauuuuuccuuugaagucccgaacacugacauaucucaucuuuccaaucuagcagagagugagaaagaaaaugcauaaagagagguuuugaauuuauauucacaacuugcacuuauaauccuggaauaaguauucaacugcaauuggaagggggggugcaugcauguauguauguccacagaaugacuucaagugucuuuaucauucucugccuugccuugaaaagaucucucacuguuaaguuggcagaccacagaguauccaggagcugucauuucugccccucagugcugggauuauagccaucugcagccaaauccaacuaccucaggggggugcugagcauuaaagcucuggucuuucuuuguacaagcauuucugcuuauugagcuaucuuucuucagucucacuuuaaaaauuaugaaauuuaauauaacacaguaaauagaauggauguccuuugacaaaaauagaaacauaauguuccaauaaucccgcuuugagggcaaaacauauacuuaacagaccggacauauucugagaaaugaauacucagaagauucuccugugugagcaucagaauguacuuagugagacaacuuacacaccaugguaccaauccuagaguauccucacuuauauguauguguucaauugacugacacuugcggcacauaacugcacauccaaaacaacuggcaguagagucucccaagagaucuuaacuauccuuaauuacacuauucauaauagcuaagaaguagaagcaacccaaaagucuauccuuagaugaggacacaaauagaacauggcuuacacaugcaauggaacacuauucagucuuuauauaggcaauccugucuaugcuauagcguuaagugaaauaacagcaguacaaucugauucaaccuaaaugaaaugccuacagccuaaugcaguaaacucagagaaaucaaaaaguaaaacaccucagaaggcagcaacaggcagcuguguucaagguuagcuugguuuacacauagcaagcuccaggcuaccaagggugugcuggcugaacagaaacagcuagcuaccaaugagcuggaaugguuggcccacaggacugcaacuauuggggaguguggccuuguuagaguucauaugaccuuauuggaggaaguguguacuguuguugguuuaaaaaaaaaaaaaaaaagcaaaacacacaaaacaaaaucacaaucauuuauuugauuuuaccaaugaagucuugggagccaggugcugggguggaaaauugcuagcucagagaggcagagaaagcacccagcugacuaaccuuccuccuuagcccaagucccaccagaaugcccucucucucacgccaugucaaacaaauuccuucaaacucaaugucccuccuucuccuuccugugcauuucuguccuccugacuccucuuguccucuacguuucuuaaugauccuaugcucacuuccugucacuugcucugccucuugaccuaugguugacuuuguuuaauccuguuuacaauauucaagcagcaagugcuuugacuaaagguaugugcuaaggcugagccacacaacuaaaaacagguuuuuccaguaaauacaaucucaggguucacagugugaucaaguaucuuacaacacuguacacacuuguagggggugggcguugaggucucauacucaaacuaugcccaguguggcucacaguagcuuuugcugccuucagauuaagauacagaacucucagcucuuccucugaagacuauaaaaccucugaaacuauaaaagccagccccaauuaaaaguuuuccuuuacacauagaguugccaugaucagugucuuuuacagcaacaaaaacuguagcuaagagacaggccuacauaccgagacccugucauuuuuaaaaaauaaauaaaaaaccuuauuuauacugguggcuuaacacaaacuaugugguuuuugaauguccccacuuucuagauucaguacauguaaggaaaguguguacuaaagcagacagacauaggacaagaauuaagaaugcagcccaaaaauagggcaugcauuuaauaaacucaccaaguuauuuaggaaagauccaaaguauucaaaggaagggccgcuguugugaugugaaugaaaauggccuccuuaggcucuuaaggagaggcauuauuuuaaaggauuaggacaccuggccuugucagaguaggugcagucuuuuuggaggaagugagagugaacuuugagguuucagaagcucaagccacacucagugucucuccauuccggcugcccguggaauucagcuacucuccagcaagucauuugccuaccugccaccacgcuucuugccauggugacaagggacuaaaccacugaacuguaagccagcuccaagaaaauguuuuucuaagaguuguauagugccucuucacagcaacagaacacugacugagacaaaagucuucauaaaaggcaaaacuguagguguacgcuacagguggaucucugugggucuaaaacuagcucuguugugcagccagagccauacaaaaaaaccuugucucaagaaacccaacaaaaaaugaaccaaagcucuuuuuuuccuagugagaaaaaaaaagucauccccuaaaaauagaccccauuucucaaaaaucucuaccaaaaaacaacuuuuaaaagucaugguaauacaugucuacagccucugcucuugaggagaggcaggaggauugcuaaaaacucaaauuagccuauucuauauagugacuuccaaguaagcuagggcuauuaaaaacaaaacaaacaaaaagacccucaauucagacuccccccaccccaucaggccagagguagaaaggaaagcgcacagcaugaugguaaaagaaagccaagauacaguuaugaaacuggauauuccaaagcccuucuuuacaaacacuacaaaauacucuagucaauuauauauuuauccugccccaguuacucgcuguacuuaagucaaauagcccuggaagaucuccaccagacuucugauaucagcaagacuucccaggcuucaaccacacaggcucuguaguucauacacaacccgagcuccuucccacuucaagguauuaacucaauuuccugcucuugaaaaugcucccuuuguccacacaccgcaccgaucacguuuuaagauuuaggugccuuaucuuuuuaaugagauucucaugccuacucucucaaucuguucacuacuucucaggacccauugucauuuuuacuaugcguauguaaucaugguucccuuaaauuccacaagguuacagaucacauuccacauggauuacuaggaccuggcaaagccugaaugaaauagagcacuguaagcauccaacuuaauauccauuugaagcaauaacagcauucuuuuacauuccucaucacauaccuucaccuauauucucuaucaaaccaaccuuugccccgaaacuauacugaagucgaagaacugaaaccuauaacuaaauaauuaaucuacauuuucuuuuugucuauuucuuucuucuacuacuuuuaguuuucuuucaccacuuuaucuacuuacauccuuucuccucucaucauucauuugcaaaucucucauaagcugcuaucgccuccucucuuugguuuguguucuuuggugguuggcuauuuggucgagcacguguaaaagccaacaagaauaauucccagccaagccccccaggcgcuacaggagauccucaguggccacauuugcuggcaggucuaccuuacagcuggucuuucuucaucaccgucuuuguaaucaucacucucucccuuaucaauacaaaugaaagucuauauaacugccuccauaaucucacagcauuauuuacuuacaaugccucaucucaccgaucaguguuugcagugaagcaaauacugaauugcuacaaacacuuuaauaaagccaagacacccagcagcccucccugggguucccaucucacuccaucuauucucuccgaugccccuuuccuuaagcucagacuccuggucuaaacacgcuaucccagcauugucuguacccauacacuauuguccccagccuucuguuucuuaugaagccuaaguuaugccauuucucucaaauacuaucaaauuuacacuuuccagucaaauacucauccuacuuacucaaauuugcuucccaaauauauaguucuaaaucuuuuuuuggcuuucugugaccuuuggauuuguaucauuuaaauauaguaaaacuagacuucuacugggcuuuuaccaauagcccagaauugaacaaauuacccucacuuucuacucuggucaagaggacuauacaagggaagacuggugugcucagaucaggaucuguccacuggacucagugcccuccgacucuaccuggaacauguugucaucucugcugcugcugcucugcuuggaggaugccagugcucuagaagucucaccaggcuucugcuucuucacgggcuucucuggaaccgcuugcuuuuuccucuuuaacuuaaaacaggcaagaacacacacuugugaaguucaaaacacuucauuaaaaaguuacucaaauuuuugacuuaugaaaaauauguacauuaaaauuuuuuaacuaugaaucuagucuucacauaacuaaugauaguauuuuuacacucuacucucaaaauccccaaagauuccucagauguuaaaacagugaucuugugaacuagaacccacacacuacucucuggaaagagaaagacaagcagccuauaacuucuguauaaacuuuuggaaaccacaaauccaccagaagcuuuccucuuauuauuuuaaguuuuuaaaaacaaaguauacugguauauccuguaacccugacuaagguugaggcaggaaagcugaagaucaaacaaaaaaacaaacaaaaccaacauauuuaugacuaaaacugacuacuuacuaauucuuugucuauuccaaaagguaucuguacuuucucaagaauguaugcuuccagccuggacuacauagcaagcuccaggccagucagggcuacauaauuuaacucuuaggaggaaaaaauaaaaaagcaugccuagguaaaggaaguuacuaucuuauaccaggcacugaaaaucaacaacucaaaaacuucuucagcacuaagaauugaugauggacaguaguaagacuaguguacucaaccccauauuuuagaauuagcacuaguauaaaaaaauugcauaugaccucauucucaaaaugagcgaaaaguuaaaaaaauaagaauuuuuaaaaacccauguuaaguuuccagcccaaacaguagagggcaggcauguuccuucuuaguggaaaggacaaacuaguuuaauauuacuaaacguauauuaaauuuguugaggcuagggcaauaauaugcuaugaaaugaaaacuauggaagcaccuaauguaaauguuuacagaauuaauaguacugugagacaagcuacacagucagcuaagcaaaacacaauccucugaguggugcacgcagcaaguaaccucagugucagugacacucacucuuagaggcuacacucuacaaguucugaaaagacuucaaguacagcuauauaugauguuugaagccuuauuucaaaauuauaaaugauacuacagucuaucuguacauuuauaggcuccaacuuuccuaaguuuuccuauagagcucccuuuucuuagggaguacagaggccaaaaaaacaaacaaaaccuaaacaauaacaaaaauuuuuuuaaaaaaaauuuuaagaagaggggggguugcugcuuuaaauaaauaaaacaggguccccauuaucccaggugaccuugaacuucugacccuccugcuuccguucccauggcuaggggaucaaaccugggacuuccugagugcuagacuagcacucuaccaagugaacuauaaaacuagcuuugccugcugcuuuuacacuuuguaaaccacaggugcauuaauuacuuauuuucaacaaagcaaguaaacaaauaagggugaauacaauguguucaauuucuaggauaugaaugucuauucagacauaaauuucuauuaagacacagcgguguggaaggaagucuugaccacaaggugaacagcucugucacacuucacugcugugaucaauugaguggaaugaaguugacaaaacaacgaucaccuaacacagaaaaagcuuauucugacaaaauggguaauuuuguauuugcuguguuggaugacuuuauuuacuaaaagcaaauaacuuuuaaaguuaaaauguaccaaaacuaaaauucaguaauuugaagaggagcaaugacugagaaacuaucaacauuaauguuuucauucaaaaauccaugcagcccaauagugacuuauaccuguaggucagacagagcuuuggaaauguuauuaccaucaguuuguauuuguugcacguguggugccuguauguggguacaugagguuacaggacaaacuugguauaauggggucucuucuccuaccauguggaagaacagagaucaaacucacacgaggcgccacagcaggcuagaucaacuggauuuuugaaugacacgaauuucuaaauaaugauaaguagugucuuuggucucauuagaauucuagugcucuagagucuaaugaagcauuucuguugacucuugguuacuagaggugcucaauggaggacuugcuuagucugagcugggucccuaauccugagggugaggcagaaggacaaaaguacaaggucagcccaacaacuuacugagacccuguugcaaauaaaaaguaagaagaaggcuaaagauauagcaaguacuugccuaggaugcacugggcugccaggcugaaccccaaguacaacacaaagaccucuuaaaucugauguaaguccugcagaugagacuagaaucuaauauucuacucaaggaauccaucagucauuuaucuuuacaaaauuacccuuguagauucucucacauucugagcccagcauugguaacaccaucccagcgucccacccacccccaccccccagggaaaucccagguguuuggagaagucuaggaugcauagcaaaaccuacuuuaaaagacugacaggccuuucccuucaaaacucaaugucagcauuauagagcaauuaaugcaccauacauuuuguucuauaaaagaacuugguagaguaaaaguuaccuuuuuuucaacuucgcuguccgaaucacugccugaagagcuugaagaaacaaguuccuuugauuuaggcauucugaaagaaaaagacaucacaugaauaauuuacaagguguuuuaguaccuucaucuuagcucucccagaccaaaagaaaaaauuaacuuccacagcucauucugccuuuuugugguacuggagucguuacacagaacacaugucuaaauugcaaacaacaagcacagccaauuauucugaacccagucagaaaaaagaaauaaaagccaugugcacauuccuucacccuucucaaagucaaugggccuuuuuaacaacugauuuuuagacagguuauaaaguuuguggguagacuacaagaaagcagcugagaauaaugaccguaaaaucaagagaaauguacauaauuccacucacauugaggggaccagcuccaacauaaacagcuugcccauguaagcauaauaccuaauuaauuuugcccuuauaaaucaucuuuuacauguucuguauacacuaguuuuuacuuuguggccacacuaucaaaacaacaggcaacaaucggaguucacaauguuauacacaauucacaauaauuuugcacugauuuucuacuuagggaaauauauaaaaugugaaggcuuuaugugcaaggcaaaacucaccagacaggcacacagugcagagccugcuguuuauuuacugcauaaaacaaagggcagacaacucgucuaacccacauuucaagaaguccuuaggcagguccuaacuacuuuucaagauacuuacaccaaaugguaaaaccagguagcaaaagcuauuuaccaaacuaucuucugcucucuccaucuaaauaaacuuacuaacuucuacauggcuuaaagguccuaaaaaacacaagauucuguaaaugcucaagaaagauacaucaauuccuaccuccuacaucaaaaaaauuauaacccagcucucuaaagaccaaacuggcauucaaugugcaaaauaggaggucaaggcaaaagugagcuacccaaauccugcccacgacucuacacaacuggccaguccguuagagguaauaccuaaacucaggagggagaaggcuccuaaccagucccuucgcuuuuccucuuacugcuccauuucacaacccgaccuccaaaaucaaguuucccaagcuagcucggucacacaacuacacaaagccuguuuuuugagagggaauugcacauaaacaaaucuuucgcuugcaaacagccagccauaucuaucucccauuacgaaaagcugucuggggaacuaaaauuacuucaaagaaccacgucauuaucuaaccuaaaucuacccaauaagaaaacaauguuuguuacugggaacuaaagccagccccguucccuacacuuggacuuuuaacuuuaaugaggcuuuacuggggugguuucuuggaggccggggggcggggggcuucguaauucgagcaaaagguaacuaaaaggggugaccguaguuuauagaccgaccagucggugcccggggcuggggaauacugaaaacaucccagagugcgaggcucucgagggcgagccggcgcguggcaccgugggggucgcggccaggaagcucccgaaagccccgaggcgagggcuggggcuacugccggccucaggaagggggcguggggcgucgagagcgugcacaagaggagggccuugcgccagcgccauuuucuccucgccccggagcccagccauguuugccgagcgcgccccccgccccucgaccccgcggggccagcgucccccgaggguggggaagggauggcuucccgagcacggugguccggacaggggugggcgagcgcagccucagggcagaccgcuagcgccuccgcccggagccccaucacccaguccgaggggcgcgcggccaucacccgccguucgccugccugcccgcgcccaccgccucggcucggcuccccagagcggccgccacacgaggccccgcggggacgcgggcaagagcggaggcccuucccccgagcugccguuuuucuccccaccggcaaggagagcgaagggggccgcgguagccuggggucggccuggccgcagccccgaggaaugggcccggggucccacgcacucacgcuccgcuccggccgaccaaaaaccucugccucgcucgcucgccuacuccggacugacagagagccggaaaugacggcagcuuagaggcccuggcuccgcccaauggcacgaaggccacgugaagggggcguggccucgccgcccaaccgccagccggcccuuuccagggccuuaaaggggccgccacagauacugaaguaaaugcuccugaaagagggagauggcaccacagugagaugccacgcagcuugggccugaucugaaggagaaugagaugucaaugaaacauaaaugacaagauccacggagcuuugcgcuugcaaauagcuuguauaugguaccgcucuauaaaugcuguacugaaaugaugggagcuacucugagaaaaaacaaugugcugacccacuugccuacagaugauuuuccguuucuaccuuuaagaucugacucaugcugcuaaaauccaaaggaagcaagccugcgaggcgcacuauuuaauucagaaagucaaagaaaucuuacaaauguccuuagccacgaaaccuuuauucuuaaaauggaguucuggggcuccaaaguaauugugguuugaauauaaaaucucccugugggcucauucauuggggaucugguuuucaacugaugaccuuuucagaagagccuggauccugagagcugugccuuaaucagugaauuaaugcucugauagucauaauaugacagcauuauuacgagguggugaaaaguaaggauguguccuuugggggcuacauuuuucccuggccccuuuuguguucccuuuccgcagcauccuccucugcagguuaccauggacuugguguuccgccucacuaccagccuagaauacaggagcuaaguacuggagacagaaaccgggaggcauacugaaucgccauaccuuugucuaaacacggauccaaagucucgcggaggaaauccacuccaccaucacaaauaaccacaagcagguggcuuagaauguguacuggaugguuuccuccuguagccaaca

SEQ ID NO: 7689 - RNA, 1044 nt, Mus musculus
uggcaugaaacucaagagguuuacugucgcuauaaaagaauccuaaggucggcuguccuaacaguacagugcgcccugaccacuuuacagccgcagucggagguaggaaaguuuuacaaacacaauucgucaauuuguuuaaccucucuacgccagagcacaguacaugaacagcuuuaaacgcccgaguguagaugacuccuuuugaaacucgggaguuucacaggcgaagagccaaguccuccccguagguagugaggacccgggcuauaguggcugauccccagggaugcugaggucucagugggguccgcccuagccuggccucggcuucugggauccaggagagaucucacuggucgcuggcgccaggccggaccuuuagagugaacugagaggcggaugaaagccgggcaggucaccgaucgcaaaccuuucgucuccagacucagggccacuagcgaguccagaagcucaaguguccgccgaagugggaggcggcuagccacgccccccgcucgcgccgcuuccggcaccccggccccgccccgcgccggcgcugccacauccuccggugacgucagcgcgcgccgccauauugggaagcgccaccgccgccgccgccuccgcucgggcuccugggcuguguggggggccacagccgcgggcugaaggcucccuuguguaccccaucgacgcccggcccgccggcuucgcccagcuccggcuccucaugaccgccuucggccccgcagcccacggacaucgccccagcuccaagaauuaacacggaagcucccggggccggggccgugagggagagccggccggucccgcgucccugucgguccggcgcggcucuugugcgggagccaugaccucgcugacccagcggagcucgggccuggugcagcggcgcaccgaggccucccggaacgcugccgacaaggagcgggcggcgggaggcggcggcggcagcggcgaggacgaggcgcagagccgccgcgacgagcaggacgacgacgacaagggcgacuccaagga

SEQ ID NO: 7690 - RNA, 30176 nt, Mus musculus
ggugacgucagcgcgcgccgccauauugggaagcgccaccgccgccgccgccuccgcucgggcuccugggcuguguggggggccacagccgcgggcugaaggcucccuuguguaccccaucgacgcccggcccgccggcuucgcccagcuccggcuccucaugaccgccuucggccccgcagcccacggacaucgccccagcuccaagaauuaacacggaagcucccggggccggggccgugagggagagccggccggucccgcgucccugucgguccggcgcggcucuugugcgggagccaugaccucgcugacccagcggagcucgggccuggugcagcggcgcaccgaggccucccggaacgcugccgacaaggagcgggcggcgggaggcggcggcggcagcggcgaggacgaggcgcagagccgccgcgacgagcaggacgacgacgacaagggcgacuccaaggaaacgcggcugacccugauggaggaggugcuccugcugggccucaaggaccgagaggugcgggcgccgcggccccggccgggguggcagccgggguggcagcgggacccggguggcuccagguggggcccgggugggcgcuggccgaggccucaccugucccugcuuccggagccccgcgccccugagcgcccucucgucccaaggagugugggagucagcccucuccggcugcgcuccgagugcucccgauccucccgguaccaagugcucgcuuggguuuucccguccucugcucacaagcacucuuaguuccgaagucuuggcgaucuuugcguuucuucuucuucgccgucugccgcaaauaauggcaacuccaacccaagacuguugagaucuaaagacucggggcuaccgcggcucccaaguauugaguuuuugcagguuuuaagacccgggagagguucgcggaucuacuugcugucggcccucuuucuuauguaaaacuugaguugcggcgcgcgguuaagaaauuagcaaaguuguuuuuacuggguauuguuuuaaaaagucaauacuaaguugauauaaaaccuaggaaguuacuuuuuggaugaacuugguuugagcgagcgaugaguuaguuuugcgguuagaucugcugucguccuuuccguuuugccauuuuaagggagggcuugugaagagcugggaggaauaccaaguuugcgcuuugaugaaagacugcaaagauuuagguaggcuuaaguuguguucugacguuuggaaaggucaccccagauauuuaggaauuucacacauauaaguugaaaaagugcaaguguccgucuuuuaaaugucuggauucuguaguuaauguuugauugauuuuauuaauacccauccaucucuaaagaugauuauuuuuaagggcagacuugcaggauuggauguuucauaaaucauguaugaugagguggcccggaaguuuguuucguuucaguguggaaacucuagacaacacauuuugagagucagacagaaagguauuggaucuuguuuuuaaauacguuuucagaauucaggaaggaggacaagaaacaaaccagaacaaaacucaguucauccuauaaaacaguuuuuuaguuccucagacuuagcagcgguagagagcugaguuuuuccagggacuguuugugguucccggauauuagauacuacccagggaagugcuucuugaugccuuaauaccauucagcuugaagacacuuaauggcccucaggcugugaaaggggcacaguaccuguuuaauuacaguuauuaugaggaaugcggugguguguguuucauuuuuaguuguggagugaaaagcuagauguuaguguguggcaaugcgauuuuagagagcauucacuuaggaaguaauuagauuuugaaagcaggcuucuuguaauacacauuuaucuuuccuucccuccuucccuacuuuggaacaaaacagauuaugagacauuucuaggaaguacaagaaaaacaaaaugaagguuacauuccugggucagcauuuugguucuguaugcuagaacucgguaaagcuacaacggaacaaaaaaaauuauuuuugguauugucacauugagaaacaaugguggaaaaauaccuuuuacuuuagaagccuuacucugaauuuuuaauauaaagcuguuaccaguuauuuuucugugauugguucccgugaagauaaucugaagaauuuuuugaauuuaaugcuacuacaacauucaacuaguuuuguuuuguuuuguuuuuuaaacaauggaaguucuuugauggcagguaacugagaccaucuguugugguuguuuuguauaaguauacuucauaagucauggccaagguucagccaggcacuaauuuguagcaugugggggugggcacuuguuuuuaaaaaaauguagguacauauuuuuucuuucaucaaguguguacacaguagugacuaguccuauaaaccuaucacccagucuauuugggggaugguccccuugucuuuuuuuuuuuuuuuuuuuuuuaaaagacaaagucuugguuuccuggcucuguuuccguagccacuuaagcuuuguucaauuuguuauuaacuuagguucuagggauugggaauauacagcucgguugauagagugcuuuggaugaaguucugaauuugauuccuuccucugcacagacugggcuuggaagcccaucaugccuauacuuccacuugggaggcaagccuaucagaaguucagggucaccuucaccuacauagaaagucagaggccagccugggcuacaugagaagccauuggcuucagauuauuuacauggaguuuuguuuaaagucuuuguuaggucucaaacucaggaaguauagcugcuagccaaggugccuaucagagcagacacuggcuaccugucucagcaucgccuauaccuguuaagaguccugacucuucuuagcacuuucauccagcccuccuacccucaaccucugcagccccugagcuucacucccuucccucagcugcucugcucucuauaacccugccuuuuggcuauguggucucuuggccucuugcucucuuugucuccuggcuuacuccagccucuuggcucuuguuucuucucuccagccuccuaucccccucacaugccagguucagaguggaccuuuccagaugccuguuuauccccucuacacuaaaccuuccuacuucaaaccuaggaacagucauguccucauucaguccugacuauaguuuuguuuuauuuuauuuauuuuuuuagguucgagguagcuuuucagguuuuuucuuuucuuaaaacauccaagggcuggagagauggcucaggaguucagagcacugacugcucuuccagaggguucaauuccuagcaaccacaugguggcucacaaccgucuguaaugggauccgauguccucuucugguguaucuggaguguauuuauuuguauacauaaguaaaucguaacaaacaaacaaacaaacaaaacacacacacacacacacacacacacacacacacacaacaacagcaaccgaaaaacaaaaaagcccaagccuaggcucauucauagguucuggguacuuaaucugggugaagugucagugagugauauuuagaggccacugcuagaaugucagauagguucacucaugaauuccaauuaaguaauuggcaagauuucuguggaugguugggggcagagcaggacaaauaguaaauauuuucucuucauuauuuauuuguguuuuuuuccauugaagccuugaguaguuucaggauacuugagaaugaccauaaauaaccaaaaaguuauauuaaaauauuuuuuuaagaagacuaaacugaagggucucacacauauuguaccacuaacuguaacaaugacccccuuaaauaacuugaauuauuuuauuggugguaggucuaaauacuuaaggugagaucugaucaucucauuuacuugccuauuuaaagguuuauuuauuuuuauuuucuguguaugaaugcuuugcccccauauuuguauguauguacaucuaguuuguguauccaaggaggccagaagagggcauuaggucccugaaacuagaguuauaggugguuggaagcuuccauguggguacuuaaaauugaaccugggucuucuggaagaacagccagugcucuuaaccacugagcugucucuccagccucaguuugacuacuuuaaaugaccaauuuaaucuaguguuugguggcuggguaagauuguuaaagugcuuaccacacaaacacgaggccuugcuucccagcucucucuggaaaagcugggagugaugucacagguugaugcagagugaagcuccuggaccagccauccuagccauucagcaagcuccagaccagugugagacucgccugaaagccaagaugguuggcaucugagggcaacacugaaguugacugccgaccucuacacgaucacauauguacagacaccuacagaaacagggagaaagaaaauggccuguugaguagaagugaggcuuugucguccuucucuuuacauacuaugcaagaguuucagaauucucacaaauguggaaaauggucacuucacgugcuuggggggguguacuuuuguggcacuuauugcuaacacuuuacuguacuuucccccuuugucuuugcgaagcccuagaauuuuagcuuuuuauuauuuacuuauuuauccauucauuuacuuauuuauuuuugagucucaggguuuaucuacguaguccuggcuguucuggaacucuguugaugaggcuggccuugaacucacagagguccuucucccucugccuacagagugcugggacuaaagggggugugccaccauugccugauaggauugcuuguuuguuucuuguguuuuagauagggucugaugaaggccaggcugguuuccuugaccucucucuggguccucuugucucugucucccuaauguuaggcuuacugacagcuuuggaauggcuucuugagguauccuccuauuguuuuguguuauaguuaagucuuguccagucaguugcccuccacugaggcuuuggaagaaaaagaggcugaaaggaaaccuuuucagaacagccuucuuguguguacuguacuccugaauguuguuguuuuguuugguuguguuuuaguuuucucccugucuuuuucuagugugguuuuuuuuuuuuuuuuuuuugucaucugauuuuucuaagguuuaauagcuuuuaguaacaucuucuuuaaagauacauuucuaaaguccuaagagcucuacugcaguaacacuugaauaguauguagugauuagguggguuuguuuagagaaaagaugguauuuggcaugccucaaauuuccuggcaguucuugaaucugaagucuucuugaacuggugauccucuccucucugccuccccaagacugagauggcaggcuguguggcaagacuuaggaaguuuaaaagaugaaacugacuuuguuguuuucacacugucccccaaaauuuguucauuuugaaauaauguuuagaacacaguauuuaucaagauguauaacuguuuuguaaacauuuuaccucuaugaaguuaauguaaaauagugcuauucuuaaaccuauaagccagauaguuauugagcucaguuuuagaauuucaagguguguuaaaaguuuguaguaauuaaaaaaaaaacacacauaaaagcuucaagaguuuugaauuuuguaauuucuuuucuaauacuaacuauauucuuuugauauuuuugaaggguuugaauuuucaucucuuuaagccaaauauaaaauuuagagccuauaugaaaaauaagcuguaaagauugcaaccuguuggcguacuacaguauugcaauguaaccuuguguauacacuauaguguuauaauguggcaugcacuaacacacacacagacuuaaaaagaaaacagaauauuuuucuucuuguuucauaaacauuagauugacaggggagaugucccaggggugcugguagaggaucucaguuuggguagccagaacucucauaaacugggucucaucaaggcccuucuguaauuccagggcucuugaaucaguaugggugcuggagacagcagaauuccuggaagcuuccaggcuaacuagccuggugugugcaacagugaacaacaaagacccugucucaaggaguccaguugaagauggcuuggcugaacugacuccugcaaguugugcucugaccuacaaugaaguaguguguguguguguguguguguguguguguguguguguguguaugugucuccuguaugaugaacaaacauacaaauaaauguagcaaaaucugggugguagaaagcaagggcugaacuuugagguugguucuguaauugcacaaauugguacagccacauucacacaugcauacacaugcacacaggcauucauacaugagauagagcaauagagaaugguagaaucuuacuagcauguuauuguccuucauuuuaguguuuugauggugcuggggauuuaacccaggccuugcacccgcuaaccaaguagcacucuaagccaaauuacauguccguuguaaaguuaauuuagccuuagugaguuguguuugguuuacaugcuuuacuagagaaacuguccacuuggugucaacaggugcaguuuaaaacuuuugcuucuacaguugacuaucucaccuugacucaguaaauagucuaaguacaucauacacucacugaagguaacauuauucccaagagaaugaacacugauuuuuggggguggucuuggaaaaaacgucuuccuuucguguauagagaggugagacauccagaauguccaucuuacauucaugaaggaagagauggggggggggugaaaacugguggagagaccgaggcuucuuacauguguuugcauuuagaucaccuuagaaaccauuucugguuucugugguggaaaucauauuacacuuugguguauuuggcaaugaggauggcacccggggccuuggcacccuaccuacauggucugaacuacaucccuucccuagaaauuauuuucuaugaaaggggggcaguggaacaugccucugacaacuugggaggcugaggcagggggacugcugaucucagcccuuggaggaggccagucuggacaacauagcuccuuucucaaagaacagcucuguugauagaaauuucauuuauaacagaauuugacugagacuaguaugaauucuagaaaguuacuaguuaacauuuuaguaguaauuuuuagagagcauggaagauaaccuguaucuguccaucccuggcuuuuugagaaagacuucagauuggagggcuuacagucagcuuuuggugauuacugcccccuugggauuuuuuuccuggucaggacugaacuugggaccuugugcuggcuguggauucucuuuaaguguucuaccucuaaacgaccauccuugcccuacccuaguuccccucccucccucccuuccagauuuauuuuaugugcaagaguguuuugccugaauguaugcauauagcaugagcaugccuggggcccuuggagaucaaggcaucccaggcuucagagccucuaaaaccagaguuuuguggaugguuaaugagccagcauguugguucuaggaacuaaacuugggucuucugcaaaauccggugcucuuagcuacuaaucccccaaccccccaguuucaguuucuuauacaauuguuaaauaauuuuauaccauuuaaaacaaaaaacagaaauuacauguauuuaaauuuaguuauugaguaggauuugccaguuuuugagauuaaacaaguuuaacugguaauucguauuuucaguuaaucaaaauaugucauucauguaucaguuccuuugcuaagugcugagguuucuaagauuuuuagcuuuuuuuuuuuuaaagauuuauuuauuuauuuauuuauuacauguaaguacacuguagcugucuucagacccuccagaagagggagucagaucucauuacggaugguugugagccaccaugugguugcugggauuugaacuucggaccuucagaagagcagucgggugcucuuacccacugagccaucucaccagccuagauuuuuagcuuuuaagggacaaucaguauacauaggagacagcacuccagaugauuuggguaugauuggauaccaacuucagagaaaaacagaagguguagacuagggacuagagaagaacccucagaucaggagccaugggacuauuguccuaguuauauuucuguugcugugauuuaaacaaauaaacaucacuaaagguaauuuggacaggaaaggauuuauuucagcuuauaguuguagucugucauaaaggaaagucaagauagaaaauguaaccaggcaccgaagcagagcccacagggaugcuggcuuguuccuggcuugcucaguuacuuucuuauauaugcaagaccaccugcuggagacggcaucacccauagugggauggguccuuccacaucaaucaucuaucaagaaaguacccuacaggcuugcauauaggauaaucuuauggggaccuuuucucaauuuagguucucucuuguggcuguaguuugugucaaauugacaaaguaaccaacacaaacuacccaugguuuugacuuguagcuuugucuuuuuugacuccuccuugggagaacuagacuaaauguuuuugaauuuuuagaccucauuguuuccugggcaaaacagaccucuauuuguggucugucucauaaccuguuauaggaccuaagggcuaaaaaggauuuagagccgggcgugguggcgcacaccuuuaaucccagcacucuggaggcagaggcaggcggauuucugaguucgaggucuacaaagugaguuccuggacagccagggcuauacagggaaacccugucucgaaaaaccaaaaaaccaaaauaaauaaauaaauaaauaaauaaauaaaaauuaaaaaggacuuaggcugaaacaaaugcuguuggcuggcuccugauacucccucuucuucacucucuuucagugcugagggucaaacucugaccuugagcauacuaggcaagugcucugccacagagcccagcuuccacuauugccguaaguuccugaccauccuggacaugauaauuuagugaauauuugacucauucagcuacuuaccuaugccuuuucacugaaucaaucugucucugugccucucucucucucucucucucucucucucucucucucucucucucucucucugugucugugucugugucugugucugugucugugucugugucugugucugugucuguguguguaaaaaaguaucccccuccccucuguuuuuuuguaaucccagaccaucugggcuaggaaaucuggaaaccucaaguauuuugguuucuuuucccuagauguaagcccagagucugugguuguuuccauuauuucucuucucuggaauacuguucacucucuggagguaucagaagccccaaacuucaaaaucagugacuucuauggcagcuguguuguauaaagugaugggugugguuggcaggcaguaagucuuauuuccuuaugccuucuguuuccagaagagaaagcuugugaggagccuggccucuucuggcccuuguuguaaucaguucuucccacauuuugaucaucuuauuuccucuuuguuugguguuuuauuuuuuagggaaagaaaauaaucuuuauuacuuuccaaggccagaaucuucacagaagguggcuagggcagguuucuacaaccuuuaaaaauuauuuaagaaaauaucuucuguauuuauuuguauguggaugugggggguggggugcugucuggaggucagaggacaacuugugagagcuggcucuccuuccaccaugugguuucuggaguuacuauauauugggguagcaaguacuuugacacacuguuuauuauugggacagggucuccagcacccuuggcuggccuccagcucuguggcugagcguguccaggaacuuaucaugauccuucugcuucuacuccuagagugcagugccagguugggauugcaggcacuuccaccauccuugguuuauguuuguacaucugggauaggcaaacuucccaguugagcuaaaucucuagcacugguccacagaccuauaaaaguauuuugucauuaaaaaaauaaauauauguauguauuuaugcauaguguaaauaacagcaguuaaugaaaaaaaaggccauguguuugaaacagagcaaggggaguguaugggauggcuuggagggagggaaaggaaagggggaaagauguaauuguauuguaaauucuaaaauaauuuaaagaauuaacguaauuuuauuuguguguguuguggggagggucauaugccuggugaccaagcucccaggauccacugugcugggguuauaggcacacauggccgucccuagccuuuaugcagguccuagaugauugcacuccagucccggugcuucacagcaagcagugcuacgcacugagccauuccccaguccccacauucuaucccacccccacccccaacccaccccuauuuccaguuuuaaagacaucuuuacaaugccggggauugaacccagggcguuaauaugcuaggcaagucccugucauggaacugcauccuuagcuccucuucuaugucuuauuuuguagcccaggcuggucccgaacuucuugguucaagugauccuucuguuucaggcucucaaguguuuuuacuuucaggcucugugcuccuguacuuggagauauuugagcacagugaaguacaggcugugacuuaacagacgagaaacgacguuuuagacaggacacaacagcuacgauggagauuaugucugggauaaggaacaugaacauuuauuggcacaagaaguuaaaagcuggguugauauuggaagcaguuguagguuuuaaagacaauauucuacagagaauuuuuagaagaugugaguguagaaaguaguggacaaacuagagagagcaaagucacuggucuugggauuacuaaaaauguuuauaguuuauuucucuguguguacaugccuagaggucacauggcaacuucugaaaaugggucucagggcaucagguuuguaaacaccuguaucacucacuggccugaaauuauuagaacuugcaaaaugaguugccaguccuggaugaagauuaagcgauacuuauuuuuugaccugcauuuaagucuguacuauaugcaugugaugcuucaaaagguaaauuuagggcuggagagauggcucagcgguuaagagcucugacugcucuuccaaagauccugaguucaaaucccagcaaccacaugguggcccacaacuauucauagugagaucugacgcccucuucuggagugucugaagacagcuacaguguacuuacauguaauaaaucaaucaaucaaucaaucaaucuuuuaaaaaaagauaaauuuaaaaaauacguaauuacuaagauuuuacugucccuauaauuaugggagaaaugggguagacuuuaaggcaugagaauaguagaaauaugccuuuuaaaccacaaggagccuguauauuuaggaaaguauaggcuaccaaaaaauagggacuggaaacauggcucagcagucaaggguguuugcugcuuuuccagaggacuggaguuaaguuuccagcucaacauugcuuguaacuccagucccagggcauaugacacccucuucuagccuucucagguacccgugugcacacacauacaccccuacaccacuuaggucuuaagugacuggcaagaguggcuccaugauaaagacucuuggugugugagauacuacuuauuucuuagugcuggaagaaaguaaaaccaauuuaacaaaaauggaagauuuaaaguccauaauugaccuuuaguuacucaaaauucuacuugugcaauuguuuuaugcuaagcauugugcuaaggaagacagauacauaaauaaacaaagauguguguacauguauauaaguacagauugugauaacuaugcugaaguaugcugaagacaguauuagaggacucugugugagaaugacuggggacugugcacaguggaguccuuucuaagaaaugcuguuuggugggaccugaggauugggaagagccaggcuuggucauggaugauagcguauauucaaagguuuguguuggauuugagaaacagaaaggugguucuuagguauaucauuugcaaauguuuuaguguuucuagugucuuuaucauguuacugauagcaucuuaauuauuaccuuauaaguuugaauaacuagucuuuuucuuguuuucuuguuccauuuuucucucacaucuauacagaaaagucuaaugugaagauagccagucagucguuauuacugcuaauacuuuccuaaccuacuuuaaaaaguguuauaugugaaaacauacauauaugcauacuuauauaaagaugaauugguuuucccuguaguccuggcuauccuagaacugucgaccagacuggccuugaacucagagaucuuuccaccugacucugccucccuagugcuggcauuaaggcuaugugccaucacugccuggcugauuuccccauuuucuaaucaucuuugcacugggaugguuaaaagauguuuuuauuuauacccccuuccuuacuaauacagcauuuauugucuucucucuguggaacuuugagccagcuacuucaccacacuuuggggggaggggguuguguacaaaagaaaagaacaugcaggguagguaaggcacagaagagccaugggagguggaagcgagacagcugcuucucuugguuaggaggaaggccaaggcugacacuaggcaaaaggaccuacugugucugagaaaugaaguccagauaugaggaguccccaaccagcuccagagcuagcuaccugaucccagugaacuuggcugcuguguugauggccuuugaaauggugcugacugguuuggaagcuguggcuagggaugagucaaguuagaggacaugaggcugucaagcuguugaagcucuuaagugucuggucagucaguuccgugucacugcagacaccaaggagacuguggggugagcccagaguaggcuugcguuuuaggguugagagaccacggcaggaaagcuguuccuagggcagggaagaaggacuucuugcuuuuugagucucacuuuguaacucuggcugacuuggaacuuguuauauaggccaggcuggcucagagucguggagagccaccuuacucugaugucauaaugcuguuauuaaagaaauaugcccagcaccuggcccuuaguuuugaaugugugugugugugucucuguguguuguauacauugagugcagguaccuuugcgaggcuacaggaguuggcuacuuuuggaacuggaguuauaggcaguugugagugggaucaagcucaaguccucuuaaaaccugguuccuagaaacuauauucaguaaguuguuauaugcguacagagugauucaaugucaaaaaguucggcaaacgcugaauuuauuuuuauuuauuuuuagguugguucuggguguuugguuuguuuuacugugacaagaucagugucuuuguccauacauuuuucuaugcauaguauucuguaauguaacuuaaagucuauagaacugugucagagaacuugaauuucuuuuucuuuuuguccccaccucaccuuguuuacaauugagaggcucucacuguguuacuguguagcccuggcuggccuauaauuuucuguguagaccagguuggccuugagcucuuggcuugccucugccucccaagugcugggauuaggaaaugcacauugaaaaauagaaaccuuagugcuggagagaugguuagcacuugcugcuuuuucagaggaccgagguuagguucccagcauaggcucccacccaaggcucccacccagucauucacaaccaucuauagcgccaguuccaggacauucaguguccucuucuggccucaucaggcacgaggcacacauggugcagacauacauguaccugcaggugaauacucucauauacauauaaaaauuaaauauuuacaauacaagccuguauguauuuuuucauauuauuuugaauucaggucuuacuuauuauauuuuuauauuauguaaauuauggaucaaggacauuuuuccauuuuguaugucuuuguauaauacaugaaaugucuuugaacaucugguuguuguauccuuugacuaaguagacuagaccuucagaauguauuuacacuguauuucauugugaguggccaacucaaguuccuucauuuuaaguaagagaucuggacuacauaguguggcucuucacccucauggugaauccuucuuguuguuggcacuuuugagggcuucuuuucccauucaagucaagccacuugauaagaggaaagaaagcaggcaguuggagauccauacaagugauggucauugcugagaaaaaccgggguggagguuuuccuagaugcagucuugucuccuaauguuguccuugaaacugcccauggugauggugauuguguccccuugcuucaucuguuacuuacuguacaguucuuucugcuguacucuuugacugaaugggaaagacaguuuauuucccuugaguuuuuuuuuuccauuuuuauuagguauuuagcucauuuacauuuccaaugcuauaccaaaagucccccauacccacccacccccacuccccuacccacccacucccccuucccuugaguuuuaugcaacauuaugaggucugcccugaagauugacuguuuuugccaggacccacaguagcagaggauugaucugcaucggaugcugcagucucauuaaccuagcagcuggugaucuguuagaacgguugcugccuaucagggaacuaguagucuuuacaggcgacuggagagugcccugagcuguguaugcuggcacugcagugcauccccugaccaggacagcagauuagggucucuggcucucuggcucuguuguugcuuugggcgauuguggacccaugccaugucuggauucuuguuuguuggggauaguacuuaaccugcuugauucuggaaugucugcacuucccgauaaaacuuuuuagaacauagggacuuuuuuuuucuuguuaaauaacacuuuugaaauaaugccucagauuguuuguucugugguggucuucugcucuaacuaagguugggguugucucauacgcugugagugaggugagggacacuaucuuagagccacugguucuucuggcuuguuuugcuucccuggauguaucauugauucuuuauucucucagagcuguguaugcaaacacaacuaguuaguucuaccucuugaacuaaaacuguagcugcuugguaccaccaguuuuuuauuagucuuucccauagacuuuagcuaccuuauuaaaaguggcugacuggcuuuguuagauaggaaagauuuguugggacacacuuaaacaucccgugaguauguacuccuccaguaggcucuuggaauuguucuugagaaacaaggccaacguuuucucuaccuccugacugagcacuucucugcuaacuugucuaugccauauugugucauggauucacuggagaaccaggcugacuaagguugauuauaguccuuugguacaguccugguccauuuggccucaauuccauauggcauugguuuuuuuguuuuuguuuuuaaagauuuguuuauuauauguaagaacacuguagcuguuuucagacacaccagaagagggcaucuaaucucauuacagaugguugugagccacugugugguugcugggauuugaacucaggaccucugguagagcagucagugcucuuaaccgcugagccaucucuccagcccccaauguggcauuguuaucuggucaguuauaucacccccucucccuuguucuuuuggaucaguuuuacucaaccuaaaaacaaaacagcaaugacgacaacagcaacaacuucugauaauuccugaucaugcuuuuguacauucaugauaggaguuuuacuaggagguuaucaaaacacugggcuacucuguugcuugcuguuucucuuggcuucauccaucuugucuuuucugauaagucccagaaaccuuggcacagaauuguuucuuuuuuuucuuucuuucuuuuuuuccucaucuauuuuccacaugaguuaucagguuuucauuaaacguaacucugaacucuguaguaaagaccuuguuuugcugacaaaucucuggucgagucauaacaugagaauaguuggaacaguauuuagcccucuucuguacgucaucagagguaaacugcuaaaaucugcccagcuagacagaguuucagacuuguaugcuaaccauacccauuuuacuuuaugaaguguauauucugucuacauuuugguguuucaaauaggaaacccauuuguguguucaggccccugagaaacacacagcuguaacaugauuucauguggaaucaauucuggaauuaauucccuugcuuccuaagucuuuaauugcuccagaucuugauuuuccucuauuguuuuuuuuguuuguuuguuuuuguuuuuuuguuuguuuguuuuuaaaaaaagauuuuauuuauuuuauguauaugaguacacuguagcugucuuuagacacacuagaagagggcauccaaacucauugcagaugguugugagccaccaugugguugcugggaauugaacucaggaccucaggaccccaggaagaagagucagugcucugauugaccacugagccaucucuccagcccucuacuauuacugguuuuaauaaauguuguuuaguccgacaaucuuuucauuuuagcaaaucucaaaacuaaucugcuuccuugauuucacauugaaauuggccuuuuugauaaauaugaaaccuuuuaaaaacuuuuuagacuuguuuuuaggucucucuguuauguaccucugguuauccuggaucucacuguguaaaccaugcauauagaucacagagaucuacuugccucugccucuugagugcuggaauuaauaaccaggccugacaaaacuguaguuuuguuuauccccuuuaguuuucuuuaucuaaaugcucucccaacaaaagugguauuuugaacuagagaaggacccagauuugauuuccagcaccaacauggaagcucacaacuguccguacuaccuacacacacacacacacacacacacacacacucucucucucucucucucucacuauguaggcaaaacaccaaugcacauaaaauaaaaauaaauuauuuuaaaaacuguuaucacuuuaaaguucuuacaucauuagugaaguuccaugaccucugauggucagccauccucuuaaauaugggcuuaucccauugacuuggguaaguaccaggaagccuucccugaguaguccaggcuggcuugaaugcuggagguaugagccaccauuuuuuauuuauuuaaaauuguuaguuuauuuuguauauagggguguuuuguuucuauguauuccuuaacuauauguaugccuggugcccaaggagcccagaagagggcauuggauccugggaucugcaguuacaguuuucagcuaccauaugggugcuaggcacuuugguuuaauguaagggcaguaaguacucuuagucucugagccaucucuccagcccuguccuugaacucuugagccauuagaauguccccauauucccauugcuagaauuucagguauguacuacugucccagcuugaccucugaaguuuguuuuauccauauguaagauaccugguaaaaggacgacccuuccccagauccuacauuaacaacauacuaauugugcauuuuaguguuuuguuguaagaagacauauguggcuuuagcuaaagauauuucuacuuuugacucaagguaaauuagcuguuuuguuuucuuuguucuuuuuaaauaggguuacacaucauuuuggaaugacuguauaucaucuggauuacguggcuguauguuaauugaauuagcuuugagaggaagguuacaguuagaggcuuguggaaugagaagaaaaagucuuuuaaccagaaagguaagaggacuucuaaauaauccccucuuuacaaggauuacuuucuguuucagugaugacuauuucuaauagcuuuauaauauuuaaaucguuuuaaauuguccuuauuggauugcauucuugguuuuucuggguuuugcauaugcagcaugaugcuccucacuguuaggguugaugaccgcuguaccuuagggcgaugcccagcuuuaauuguuucugaaaaagucguaagccugaagaccuugauaggacuuuaaaaaauccgagaguuuuguagaaagaacugaauuacucggggcauuaaucuuucuguaaaagugugauugaucuuuaugucucuugccaugguggagguggcacuucuguggcagaucagaaugcauaugcugguguguggguuuuuaacuucagacucaguucuucacucuucuggucuguuuuuuaugcuuuggacaugguauuucaaaaccauuuuuucuuuuguaguuauauuuguaaaucuaaaagauaggccagaaccuuguuguuauuuauuuuuuaguuuaguuguugguuuuauguuuuuguuuuaagacauucuuugcuuuuuaaccaacgcugaccuggaacucacuagcacauguuggucuugaacuagaguuccucccacccgcaccuccagagcucuaagaugacaagccuaugccuucauuucuuacucugaacacuggacuguaaaaccagagugaucauuuuauaagaaggaaagccauuacuguguuaaugaaaagaaauaauguaggcaguaauagaacuucuaaauaauagaaguggcugguuguuagucagagaaaauuuguuuccuagccauaugggcuuauuaaugucccucuaguucugagugacguagguaauguuggaagaauauucuaugugauuuaauaaguuaaguuuuaaaaguauuguugguucaguuaagauaauccauauaguuagaagaccaaauguagcuguuuuccuuguucuuuagcucucuucauggaagccaacuauugcaguguuuggguuuuuuuggagauagauucuuucuauguaguuucauaugaccuggagcuugauaaguaaacugcacuggccucaaacucagagauccuccugccuuugccuccugagugcugugauaaaggcgcacaccaccacuucgggcugucuucaguucauuuuaaagccaucuuaacaaaugaccccagccuuagugguuuucccuuuggaggccaguuaggagguguacuaggguuauguuuucuugauggcuugaagggagagucugucugcagccucucaccuuuuaguuauuuuauucuugcuccuuagcuucuguccacauguccuuacagccugccucgugccacauaacugaccuugggccucucauaaaagauugccguuuccauagcacuucuuuuaugaaucuaauguuuucuguuaaaccccugaggccuuuuugaaauucuuuuuaucuauauaaugcaguuccucagaggucuuguuuuaucuucuuuucaucccuucuguguuggagauagcaagaauuuauugaagcauagcauauguauuuggaagccacacauuuuugaaauuguuaaaggaauuagcacuugcuugaaucuuguacuaguuuugagcaggaacaauggagagcucagugugcagccagggcugaaaggggccagagggcugcacucaggcacuuagagacucacagcgccucugcauacuggagaagugaggccaggcagcaccccgguaugggguacagaggccucaugaggcuccaucccuagcugaggggcaacugauggcugcugggggagguuggguacguguggccacugguuggcugccugcacucugauggauggccucacaugggcagcacgaguaagaggcagugguuguuaagugugugggggcauggaggugagaggagaacuguuaggaagaagggaauguggagaauuugaguuggauauaaacaaguuacauuauaucuaggcuaugaaauuaucaaagaauuaaugaaaguauucuuaagacauuaaaaaaguucaaggccucuagacaggagaccaauuauuacaagagaaagauggucagacugguagacuaaaaucauggcaaggauaauggaggaauugccaagugagaaaggcuuagagcagaacuuaggugcagucaaggugugugagggagguggagggugaggcagauacuggucacguggagagagggaaggggugggagggagaggcaggucccauggccacaccacagacacaagauucauuuuccugaagaucuuuuucuccccauaaacccuggucuaacuagucaccauggagcaaauguucugaaugguguuucugaaucuguacugcccaguacaguaaccauaccacuuuuauaaauaagcugugcugcaaaacacccuggguuuuuaaaaacaguauugauaaaaccugagaagggcgaccaugagcuacugagugcaugcugggaacaaaccugacuccugggagagcagccagcaugcuuaacuccugagcuuucucucaguauagguuuuaauuacagauuuagagucuguccuugccuccccagccccaucccuguaucucuguuccucuuggugcuggagguugaguaauuuuacauaaucaaaccuguugaugguuucauuaaggcuucugcuagcgguggcaguuuaaaaagucguuguuguuccuaaaacuauauucgccuucauaucuuuuauugagcauaagcucaagggagccaguuggaaacaggguuucucuguguaagccuggcugcccugguacucacucuguagaccaggcuguagaucugccugccucugccuccugagagcuaggacuaaagguaugcacuaccaugccugacucggggggagcuaucucuuaucuaucuaucuaucuaucuaucuaucuaucuaucuauaucuauuuuggcaaaguuuucuuaauaacauuuauugagaaaauugguguuguuuuuuuuuuuuaaacuauaugaaaugccuuuaguauguugaauucuuccauauuguugggccuuucuuuguccaagacuuuaaaaauguaugaauuucuauauuaaguaccucacgguuaagcaucaaaugacauuauaguaagugcaguuucuaagcaugagauguuugcauugauuuguaugcagugguaccaguggaucauuucugaccaauguguuucaggugaucuguaaaucggaugcuccaacaggggauguucuucuugaugaagcucuaaagcauguuaaggagacucagccuccagagacaguccagaacuggauugaguuacuuagugguaagcugauguauuaacaagcaaacauugaguuguguuuagagaaguuuguauaguuaccuauacaaacguggugaugguagggaugauacguuuuuaacaauuuuaucucuguuuacaggagagaacagauacugaauaaaauggauauucuuucuucaagcucuuauguauguuuguuuguuuguuuugagucacuacguagcccugacugaacuccaacucagaucuaccugccuuuuccgccuaagugcuggaauuaaagaccugcaucaccgugccugucuucagucauaccuuaucuaaauuaauugguaccguuuacucuguuuagagugggccaugcugugaggaugucuucauaaacuauaaacucucuugacguuauguuuuguacaccagugggucauuugccuuauccagucugguggucagugucuugaucaccugauuuccucauauaccccaaaaggccucaguaagggguucgguugauaaguuaacuaguuaacuaguuaacauugcauagcugcugacugacuaaaucuuacuagugugaguauugacugaacuugguuucaacuugaguugcuguuguauucuucuucuucuucuuuuaaaauuuauuauuuauuuauuuaauguauaugagaacacuguagcagucuucagacacaccagaagagggcaucgaaucccauuacagaugguugugagccaccaagugguugcugggaauugaacucaggaccucuggaagagcagucaguucuuaaccacugagccaucucuccagcccuguuguguucuucuuauuggagugaacauugaagagauaugacugacauuuauguuuucucccaaaguauugaaguacaguaacuuauccauuggauuaggccagaauucauuaggcaaguauuuagaaauauccuaaaugauuggcuacaaaugccagaaauauuuuuuuuuagcacauacaauuguuaggucuauguuagugaguuaucauggugucaugaaagaaggggauccagcuuaggaggagaaaacagagcgcaugcuaugcuagugugggaauucuguuggaacuuagugaaggaagcgguguuugggaccauacagaaggcccggcauugauucccaguccugggaaggagaaaagggagacagugacccguucacuauugagcagacauugccaguuaauaacugagauuucuaucagggagucaugguuguggcgggcgggggcuguggugaucgugaccgggcaugggaagaggaccaucaauaugcaagagucaguucucuccuuccaccaugggagcccaucugucaggcugcuuucccaucccuuaggagauuuuaaguauauaggacgguggccaacuuggagcuuaaagcaucuuuuucucuuuuuucuuuucucuuaaauuuuaguuguuuuaaaacugucuucaguagugauauaguccuuaaggaucuagaguguacaaagcucuggauuggacuccuguccugcacuguagcuagaucgucagcagaaaguaugugguggacugucugagugcuagugcuacaugguauugacacaggugcuaugaacuuaaauagagauacuugcagcuugaaggggucucaaaccuaagugugcuaacaaucuaauauuuaugguucugaaguuuugguaguucagaaaaaacugaggacacauuuagaaauugaaggaggaaguagaccucggauuaaacuuuuaacaggcaacagugcacacacacagaaggaaaugucagaaggguuaggaagggccagugagaaggcucagcagaccaggcacuugcugccagcuugguuaccugagcucaguagauggccaagauguugucuagagugugagccccguccuggcugacggauuguugggacacaguuguguuguacuguaguucugugaaaauguagguguagucagacaguaauaccuaaugaguuaguguugcuaggggauaguacauuaauaacuuacagauuaguauaugcauaguuaauuguagaauuauaggguagauuuuagaauaaguaguuauauaaauguggcuauccuccgaagauguauuaguuugaauucgccguagucagcuaauguaucucaucugauucuagcucgggguuguuugccuuccugacaguggcguugggaagcaguaaacgcagaccccacacugucaggauugaguaggcacugugggagacaguggaugggacaguugaaaguuggaagucaucaugcuaugcgcuugcgcuguuucuccuguucuggaugugacuugugaucccguccccuauaguguccuuauacagagcucuuaauaguaaaucauuucuaaugccucauuuuguucuuagggccacauuccaauuuuauucuagccaguaaauuauauuaugaaggcuucucucacuuaauuguaaguucuacaggauaaguaauaaaucuuaagauguuucuauucuugguccuaugguuucuaagaacauaguaccuuauuaaguaacuugcuuuuguguccuuguauaugcgcacuugcucacauacuuacacaugcuuaccaccacugauauuuuguuuaaaugcuuccucaaauacuuaaauggccuuaauuaugaguaauucauaguaccagccuuuuaucauuuaauuucuuuuccaaaguaaacuguaaaguuuuaaugguugcuccacaggccagugaaacacuucauaggguaaaggcacuugcuaacaggcaugcaggccucuaguugaguuugaguccacaugauggaaaaaagaacugacuucugcaaguugcccucugaccugcacacuuguagcaugagucacauacauguacacacacauacauacaaaauauuggaaugaaaaacugccucaguuaauuuauccuuuauaaauaacagcucccucuuguuucuucguuuugugcacauguccuuuaaguucuguaugugucacacuagcucucuucaaauccuugucgcuggcuuucucaccuuugcuauccuuguucauggcugcuuugguuggcuguuuccauuccccauuaguuugggggcacauuuucuucuuugcaaaucuaauguguuuuguugcuauuauugucuuaauugaauacucagcauugugaauauuauauuaagugcugaaccuugaagucuuugucuaaagaguguugaaauuuuagugugccugcccagcauauggagguccugagcucaacuuuaguauugucugccuuccuccuugugggaaaaaguauuggcuuuugcuucgguagguagacacuuaaguuauuuguggaucagcaugcuuuaaagcuuggauagaguaguuuucacuugugacuaguucagccuuguuuuuaaaaugugcucuuucuggauccccucaugucccaggugcucaggaagccccaagccaguuggguuccuugccucucuaaaaacucuuggcauuguccaguuuuuuaguuggauguuuucuuuauuuacauuucaaauguuauccccuuucccuguuuccccuccgcaaacccccauccccuccccucuuccccugcuucuaugagggugcuccuccacccacccacucccaccucacugcccugguauuccccuacacuggggcauucagccuucacaggaccaagggccucucuucccauugaugccagauaaagccauccucugcuacauauguggcuggagccaugggucccuccaugaguacuacucuuugguuggugguuuagucccugggagcucaggggugccugguugauugauauuauuguucuuacaggguugcauacccccugagcuccuucaauccuuucccuaacuccuccacugggguucccacgcucaguccagugguugacugcgagcguucucaucuguauuugucaggcucuggucaaggcucucaggagacagcuauaccaggcuccugucagcaagcacuucuuggcauccucaauagugucuguguaugggauggauccccaggugaggcagucucuggauggccuuuccuucagucuuugcuccacucuuuguccccauauuucuuuuggacaggagcaauucugaguuaauuuggagauuagugguugagguucucccucacuuuguugggcauuucagcuauuuucauccccauuggguccuaggagccucuuccuuuccuggcaucugggacuuuccccaagcauuguccaguuuuuuugauauuugucuuuuugcuuagcuuugcaguuucucaguucaccuuguguguuuaguauucugagauuuaagaauaccgugcaggcuccaguuuucugccuugcaccuuucagcuacuucaguucuugaucucugaucucagacuugggcagggugacugagccaagggugacugcugugcugugcuugggauugucucugcucccuaggauaugccuccauccugggggucauuagauuuugccugagcaucauaguuuuagaauucuuaugacaaguaucuaaaaacagucacuuucaauucuuuuuuuuucucauauuucuaacaacagugaggauucuugcagucuacgauagucuuuguuuuuauuuuaugucuuugaggcuccugagugaauguaugugcaccuugugccugcaaaggccagugggcauugcuuccccuuggaaauuggaguuguagguggcuaggaggcaccugauguggguacugggaauugaacucugguccucugcaugagcaucauguacucucaacgcacugagcuccugucaaggauauucuuuacuguugaugaugcaaguaaaauuguuucuguggccgucugaacaguaacauauuccagggugccacagaccacuagcucuuccuggauaauagcaguguucugugcuaucuagugagaaauuaauacuuaaaauaauacuuaaaauguagcuuguaaaacugaggagcugaaaauuuuaguacauuuuuaaauuuauauugcuccauguuacuggauucaguaauucugcuuaagguugauucucuuaaguguuccaaaacgucagccuuaagagucuuuacacugacuaaaggugcuugugguuaauuuucaacaugcucuaguuuagaaaaguacuuugguuuuuuuuuuuuuuccccuaaauugcaaauagaguugucauuggugauuauuuggaaauacaauuaaacuuguuacauauaaucugaaagauacuaaaguuauugauacuacuaucugauacuaauuuuuuaaaggaaaauaaaugauuuuaauggaaaaugcuuaguuuaauuaaauuuuugucucaaaaagaaguguuuauagaugccaaacuuaagaacugugaaaauaaugcuggacagugguguacaaccuuuacuccucugccccugggaggcaggcagagucuggguucuaggccagccugguagcugaugauuuccuggacagaaagggcuacguagagaaacccugucuucaaaacagaacaaaaaaaugugaaaauguuuuauuaauccacacaaauuuugcuauauacucugucuuuguggcaguuucaggauuagcuuauaaucagagccauguuuuccuucugucuguugaagauugguauuuguagggacuugacuuuucugcuuuuauaguguaaagggguuuuauuuuuuauuuuuuauuuauuuuauuuuauuuuauuuuauuuuauuuuuuaguauugacuauuggaccuggagccuugugauguuuuuauacuguagaacaacagucuuuuaccauguaggccgugugcuuccacacuugagcgccuccugccucucuaccuggugcacguuugccccuccacauucugcuuuacugagugcuucuugacagcagccagagcuucauuucccuuguagaucaagggugacuguggcuugaagauuacuuucaguuuagacuuuugagugacugcugugucugagaaugugugggcugccuagauguuccccaaaugucuggacuccaugaucuaguguggaaggggcaagaauaaaaguucuguugcuuaucuaagacuguguguguacaauuuguugcuguuguaauuuagcaaauaauacccaccauuccuaacuuuuggaauguuuuuauuuaggugagacguggaauccauuaaaauugcauuaucaauuaagaaacguacgggaacgauuagcuaaaaaccugguagaaaaggguguacugacgacagagaaacagaacuuccuccuguuugacaugacgacacauccucucaccaauaacaacauuaagcagcgucucaucaagaagguacaagaagcuguucuugacaaauggguaaaugacccucaccgaauggacaagcgcuugcuggcccucauuuaccuagcccaugccucggauguuuuggaaaaugcguuugcuccucuucuggacgagcaguaugaucuagccaccaagagaguacggcagcuccuugacuuagacccagaaguggagugucugaaggccaacaccaacgaaguucucugggcugugguagcugcguuuaccaaguaacugucagaauucaauguuuccuuuuucucaugugaaccaguaguuuuucuucuauugacucugguuuucugcaguuuguacuuucccacacuaauaauuggcuuuuguucuacaaaaugguggguggauauuucuuuuuguauguacgcaggauucugcugguacgagaggccuuccucuuucuguuuguaaccaaccuucucgccauauuggcacccuacccccuguugccacucucacuguuccuguuuuggguuucugguguacugugaccuucagaguaccuccagcccccaccucaugcacagcguucuauuaccucagcuugagucucccacaugugcuuauucaccuggccuucugccugcaguucagacaagucacagccaggccuucaacucaccaaaggcaaacaucuguaucuauuaggacguuuuauacacaaaccucaguugagauguauacuuagcaaaauuauuuuucaauugaaacagcacaguaaauacauaauauaaaaugccccuugaauuuuugcuuccuuuguaaaucuguugugugauuacaguuguuauaauuuuagcuguucaaucauaaugguccaauuguuucacaaagccaguuugggaugggcugcauuccacuaaugcuguauauaguuugaauuauauaugaaucgccccuucuucuggccaccucugccucauuuuaguauugaauugugcaucuggugccccucacuugcuucauucauuguuaucugauggcaaaauagagcucucauuauugaaggagagagaugugugacccuuucagggcucuuuaugagcuaugccccucaugauagucuaccugugcaucccuuuugggacuuuuuuuuccucaacuuuuccuguuuuuuaugauuuguguaggaaagaggcuugugaccaguacuaaucuugaguacaguuuuuuuguuuuguuuuuccacuuuucuguccuuaaguaaauuaaugucugcucugauauaucguucaucuacucaucuucucuugagaaaagaaaaucagauaucaguccuagcagauguugcauguaaauugguagcaaguaacgacuacaacucaagacgauuaagaauuuuguaacagaaagcucugcuauguuuuaauuuuuauauacaauuaugauauuagcauaccauaagacuacaaacaucugcuuuuuaauguugauuuuauucauuaucauuguuuauuuacuauucguuucauaauguaaauacuauacauugaacaaauuaaaugucaaauuuuuauuauuauaguucauguuaauaguggggcuuucaggugucuagaaacuuuugguuaacauuugaugcaaaaauacuagaugcguauaacuuuagaguugaauuuuaagggacucccuaauauguauacuaucuuuuuaucuggaguaauaaauaaacuaugaucuugaaagugccugaaucagagcaagcaugccauuugauuuuugugcucucguucucuuugcuuuaggugaagguuauuuaguauggcacgguaacauuucagcugcaaggcuugggaaacugucuuaaaagaaccagauaggaaauacuuuaaacuuggcaugccacauaugguguuuguugcagaaacucaauucugcugaaugaaagcugucacugacgauacaaauaaaaggcggcagaacacuagagaagcaggcagcguguuugccaccaaauggguuugcccuucccuuuauaaugauguauagggaaauuaaagaauaaauuaagaaaauuuaauuuuguuauuuua

SEQ ID NO: 7691 - RNA, 30176 nt, Mus musculus
uaaaauaacaaaauuaaauuuucuuaauuuauucuuuaauuucccuauacaucauuauaaagggaagggcaaacccauuugguggcaaacacgcugccugcuucucuaguguucugccgccuuuuauuuguaucgucagugacagcuuucauucagcagaauugaguuucugcaacaaacaccauauguggcaugccaaguuuaaaguauuuccuaucugguucuuuuaagacaguuucccaagccuugcagcugaaauguuaccgugccauacuaaauaaccuucaccuaaagcaaagagaacgagagcacaaaaaucaaauggcaugcuugcucugauucaggcacuuucaagaucauaguuuauuuauuacuccagauaaaaagauaguauacauauuagggagucccuuaaaauucaacucuaaaguuauacgcaucuaguauuuuugcaucaaauguuaaccaaaaguuucuagacaccugaaagccccacuauuaacaugaacuauaauaauaaaaauuugacauuuaauuuguucaauguauaguauuuacauuaugaaacgaauaguaaauaaacaaugauaaugaauaaaaucaacauuaaaaagcagauguuuguagucuuaugguaugcuaauaucauaauuguauauaaaaauuaaaacauagcagagcuuucuguuacaaaauucuuaaucgucuugaguuguagucguuacuugcuaccaauuuacaugcaacaucugcuaggacugauaucugauuuucuuuucucaagagaagaugaguagaugaacgauauaucagagcagacauuaauuuacuuaaggacagaaaaguggaaaaacaaaacaaaaaaacuguacucaagauuaguacuggucacaagccucuuuccuacacaaaucauaaaaaacaggaaaaguugaggaaaaaaaagucccaaaagggaugcacagguagacuaucaugaggggcauagcucauaaagagcccugaaagggucacacaucucucuccuucaauaaugagagcucuauuuugccaucagauaacaaugaaugaagcaagugaggggcaccagaugcacaauucaauacuaaaaugaggcagagguggccagaagaaggggcgauucauauauaauucaaacuauauacagcauuaguggaaugcagcccaucccaaacuggcuuugugaaacaauuggaccauuaugauugaacagcuaaaauuauaacaacuguaaucacacaacagauuuacaaaggaagcaaaaauucaaggggcauuuuauauuauguauuuacugugcuguuucaauugaaaaauaauuuugcuaaguauacaucucaacugagguuuguguauaaaacguccuaauagauacagauguuugccuuuggugaguugaaggccuggcugugacuugucugaacugcaggcagaaggccaggugaauaagcacaugugggagacucaagcugagguaauagaacgcugugcaugaggugggggcuggagguacucugaaggucacaguacaccagaaacccaaaacaggaacagugagaguggcaacaggggguagggugccaauauggcgagaagguugguuacaaacagaaagaggaaggccucucguaccagcagaauccugcguacauacaaaaagaaauauccacccaccauuuuguagaacaaaagccaauuauuagugugggaaaguacaaacugcagaaaaccagagucaauagaagaaaaacuacugguucacaugagaaaaaggaaacauugaauucugacaguuacuugguaaacgcagcuaccacagcccagagaacuucguugguguuggccuucagacacuccacuucugggucuaagucaaggagcugccguacucucuugguggcuagaucauacugcucguccagaagaggagcaaacgcauuuuccaaaacauccgaggcaugggcuagguaaaugagggccagcaagcgcuuguccauucggugagggucauuuacccauuugucaagaacagcuucuuguaccuucuugaugagacgcugcuuaauguuguuauuggugagaggaugugucgucaugucaaacaggaggaaguucuguuucucugucgucaguacacccuuuucuaccagguuuuuagcuaaucguucccguacguuucuuaauugauaaugcaauuuuaauggauuccacgucucaccuaaauaaaaacauuccaaaaguuaggaaugguggguauuauuugcuaaauuacaacagcaacaaauuguacacacacagucuuagauaagcaacagaacuuuuauucuugccccuuccacacuagaucauggaguccagacauuuggggaacaucuaggcagcccacacauucucagacacagcagucacucaaaagucuaaacugaaaguaaucuucaagccacagucacccuugaucuacaagggaaaugaagcucuggcugcugucaagaagcacucaguaaagcagaauguggaggggcaaacgugcaccagguagagaggcaggaggcgcucaaguguggaagcacacggccuacaugguaaaagacuguuguucuacaguauaaaaacaucacaaggcuccagguccaauagucaauacuaaaaaauaaaauaaaauaaaauaaaauaaaauaaauaaaaaauaaaaaauaaaaccccuuuacacuauaaaagcagaaaagucaagucccuacaaauaccaaucuucaacagacagaaggaaaacauggcucugauuauaagcuaauccugaaacugccacaaagacagaguauauagcaaaauuuguguggauuaauaaaacauuuucacauuuuuuuguucuguuuugaagacaggguuucucuacguagcccuuucuguccaggaaaucaucagcuaccaggcuggccuagaacccagacucugccugccucccaggggcagaggaguaaagguuguacaccacuguccagcauuauuuucacaguucuuaaguuuggcaucuauaaacacuucuuuuugagacaaaaauuuaauuaaacuaagcauuuuccauuaaaaucauuuauuuuccuuuaaaaaauuaguaucagauaguaguaucaauaacuuuaguaucuuucagauuauauguaacaaguuuaauuguauuuccaaauaaucaccaaugacaacucuauuugcaauuuaggggaaaaaaaaaaaaaaccaaaguacuuuucuaaacuagagcauguugaaaauuaaccacaagcaccuuuagucaguguaaagacucuuaaggcugacguuuuggaacacuuaagagaaucaaccuuaagcagaauuacugaauccaguaacauggagcaauauaaauuuaaaaauguacuaaaauuuucagcuccucaguuuuacaagcuacauuuuaaguauuauuuuaaguauuaauuucucacuagauagcacagaacacugcuauuauccaggaagagcuaguggucuguggcacccuggaauauguuacuguucagacggccacagaaacaauuuuacuugcaucaucaacaguaaagaauauccuugacaggagcucagugcguugagaguacaugaugcucaugcagaggaccagaguucaauucccaguacccacaucaggugccuccuagccaccuacaacuccaauuuccaaggggaagcaaugcccacuggccuuugcaggcacaaggugcacauacauucacucaggagccucaaagacauaaaauaaaaacaaagacuaucguagacugcaagaauccucacuguuguuagaaauaugagaaaaaaaaagaauugaaagugacuguuuuuagauacuugucauaagaauucuaaaacuaugaugcucaggcaaaaucuaaugacccccaggauggaggcauauccuagggagcagagacaaucccaagcacagcacagcagucacccuuggcucagucacccugcccaagucugagaucagagaucaagaacugaaguagcugaaaggugcaaggcagaaaacuggagccugcacgguauucuuaaaucucagaauacuaaacacacaaggugaacugagaaacugcaaagcuaagcaaaaagacaaauaucaaaaaaacuggacaaugcuuggggaaagucccagaugccaggaaaggaagaggcuccuaggacccaauggggaugaaaauagcugaaaugcccaacaaagugagggagaaccucaaccacuaaucuccaaauuaacucagaauugcuccuguccaaaagaaauauggggacaaagaguggagcaaagacugaaggaaaggccauccagagacugccucaccuggggauccaucccauacacagacacuauugaggaugccaagaagugcuugcugacaggagccugguauagcugucuccugagagccuugaccagagccugacaaauacagaugagaacgcucgcagucaaccacuggacugagcgugggaaccccaguggaggaguuagggaaaggauugaaggagcucaggggguaugcaacccuguaagaacaauaauaucaaucaaccaggcaccccugagcucccagggacuaaaccaccaaccaaagaguaguacucauggagggacccauggcuccagccacauauguagcagaggauggcuuuaucuggcaucaaugggaagagaggcccuugguccugugaaggcugaaugccccaguguaggggaauaccagggcagugaggugggaguggguggguggaggagcacccucauagaagcaggggaagaggggaggggauggggguuugcggaggggaaacagggaaaggggauaacauuugaaauguaaauaaagaaaacauccaacuaaaaaacuggacaaugccaagaguuuuuagagaggcaaggaacccaacuggcuuggggcuuccugagcaccugggacaugaggggauccagaaagagcacauuuuaaaaacaaggcugaacuagucacaagugaaaacuacucuauccaagcuuuaaagcaugcugauccacaaauaacuuaagugucuaccuaccgaagcaaaagccaauacuuuuucccacaaggaggaaggcagacaauacuaaaguugagcucaggaccuccauaugcugggcaggcacacuaaaauuucaacacucuuuagacaaagacuucaagguucagcacuuaauauaauauucacaaugcugaguauucaauuaagacaauaauagcaacaaaacacauuagauuugcaaagaagaaaaugugcccccaaacuaauggggaauggaaacagccaaccaaagcagccaugaacaaggauagcaaaggugagaaagccagcgacaaggauuugaagagagcuagugugacacauacagaacuuaaaggacaugugcacaaaacgaagaaacaagagggagcuguuauuuauaaaggauaaauuaacugaggcaguuuuucauuccaauauuuuguauguauguguguguacauguaugugacucaugcuacaagugugcaggucagagggcaacuugcagaagucaguucuuuuuuccaucauguggacucaaacucaacuagaggccugcaugccuguuagcaagugccuuuacccuaugaaguguuucacuggccuguggagcaaccauuaaaacuuuacaguuuacuuuggaaaagaaauuaaaugauaaaaggcugguacuaugaauuacucauaauuaaggccauuuaaguauuugaggaagcauuuaaacaaaauaucaguggugguaagcauguguaaguaugugagcaagugcgcauauacaaggacacaaaagcaaguuacuuaauaagguacuauguucuuagaaaccauaggaccaagaauagaaacaucuuaagauuuauuacuuauccuguagaacuuacaauuaagugagagaagccuucauaauauaauuuacuggcuagaauaaaauuggaauguggcccuaagaacaaaaugaggcauuagaaaugauuuacuauuaagagcucuguauaaggacacuauaggggacgggaucacaagucacauccagaacaggagaaacagcgcaagcgcauagcaugaugacuuccaacuuucaacugucccauccacugucucccacagugccuacucaauccugacaguguggggucugcguuuacugcuucccaacgccacugucaggaaggcaaacaaccccgagcuagaaucagaugagauacauuagcugacuacggcgaauucaaacuaauacaucuucggaggauagccacauuuauauaacuacuuauucuaaaaucuacccuauaauucuacaauuaacuaugcauauacuaaucuguaaguuauuaauguacuauccccuagcaacacuaacucauuagguauuacugucugacuacaccuacauuuucacagaacuacaguacaacacaacugugucccaacaauccgucagccaggacggggcucacacucuagacaacaucuuggccaucuacugagcucagguaaccaagcuggcagcaagugccuggucugcugagccuucucacuggcccuuccuaacccuucugacauuuccuucugugugugugcacuguugccuguuaaaaguuuaauccgaggucuacuuccuccuucaauuucuaaauguguccucaguuuuuucugaacuaccaaaacuucagaaccauaaauauuagauuguuagcacacuuagguuugagaccccuucaagcugcaaguaucucuauuuaaguucauagcaccugugucaauaccauguagcacuagcacucagacaguccaccacauacuuucugcugacgaucuagcuacagugcaggacaggaguccaauccagagcuuuguacacucuagauccuuaaggacuauaucacuacugaagacaguuuuaaaacaacuaaaauuuaagagaaaagaaaaaagagaaaaagaugcuuuaagcuccaaguuggccaccguccuauauacuuaaaaucuccuaagggaugggaaagcagccugacagaugggcucccaugguggaaggagagaacugacucuugcauauugaugguccucuucccaugcccggucacgaucaccacagcccccgcccgccacaaccaugacucccugauagaaaucucaguuauuaacuggcaaugucugcucaauagugaacgggucacugucucccuuuucuccuucccaggacugggaaucaaugccgggccuucuguauggucccaaacaccgcuuccuucacuaaguuccaacagaauucccacacuagcauagcaugcgcucuguuuucuccuccuaagcuggauccccuucuuucaugacaccaugauaacucacuaacauagaccuaacaauuguaugugcuaaaaaaaaauauuucuggcauuuguagccaaucauuuaggauauuucuaaauacuugccuaaugaauucuggccuaauccaauggauaaguuacuguacuucaauacuuugggagaaaacauaaaugucagucauaucucuucaauguucacuccaauaagaagaacacaacagggcuggagagauggcucagugguuaagaacugacugcucuuccagagguccugaguucaauucccagcaaccacuugguggcucacaaccaucuguaaugggauucgaugcccucuucuggugugucugaagacugcuacaguguucucauauacauuaaauaaauaaauaauaaauuuuaaaagaagaagaagaagaauacaacagcaacucaaguugaaaccaaguucagucaauacucacacuaguaagauuuagucagucagcagcuaugcaauguuaacuaguuaacuaguuaacuuaucaaccgaaccccuuacugaggccuuuugggguauaugaggaaaucaggugaucaagacacugaccaccagacuggauaaggcaaaugacccacugguguacaaaacauaacgucaagagaguuuauaguuuaugaagacauccucacagcauggcccacucuaaacagaguaaacgguaccaauuaauuuagauaagguaugacugaagacaggcacggugaugcaggucuuuaauuccagcacuuaggcggaaaaggcagguagaucugaguuggaguucagucagggcuacguagugacucaaaacaaacaaacaaacauacauaagagcuugaagaaagaauauccauuuuauucaguaucuguucucuccuguaaacagagauaaaauuguuaaaaacguaucaucccuaccaucaccacguuuguauagguaacuauacaaacuucucuaaacacaacucaauguuugcuuguuaauacaucagcuuaccacuaaguaacucaauccaguucuggacugucucuggaggcugagucuccuuaacaugcuuuagagcuucaucaagaagaacauccccuguuggagcauccgauuuacagaucaccugaaacacauuggucagaaaugauccacugguaccacugcauacaaaucaaugcaaacaucucaugcuuagaaacugcacuuacuauaaugucauuugaugcuuaaccgugagguacuuaauauagaaauucauacauuuuuaaagucuuggacaaagaaaggcccaacaauauggaagaauucaacauacuaaaggcauuucauauaguuuaaaaaaaaaaaacaacaccaauuuucucaauaaauguuauuaagaaaacuuugccaaaauagauauagauagauagauagauagauagauagauagauagauaagagauagcuccccccgagucaggcaugguagugcauaccuuuaguccuagcucucaggaggcagaggcaggcagaucuacagccuggucuacagagugaguaccagggcagccaggcuuacacagagaaacccuguuuccaacuggcucccuugagcuuaugcucaauaaaagauaugaaggcgaauauaguuuuaggaacaacaacgacuuuuuaaacugccaccgcuagcagaagccuuaaugaaaccaucaacagguuugauuauguaaaauuacucaaccuccagcaccaagaggaacagagauacagggauggggcuggggaggcaaggacagacucuaaaucuguaauuaaaaccuauacugagagaaagcucaggaguuaagcaugcuggcugcucucccaggagucagguuuguucccagcaugcacucaguagcucauggucgcccuucucagguuuuaucaauacuguuuuuaaaaacccaggguguuuugcagcacagcuuauuuauaaaagugguaugguuacuguacugggcaguacagauucagaaacaccauucagaacauuugcuccauggugacuaguuagaccaggguuuauggggagaaaaagaucuucaggaaaaugaaucuugugucugugguguggccaugggaccugccucucccucccaccccuucccucucuccacgugaccaguaucugccucacccuccaccucccucacacaccuugacugcaccuaaguucugcucuaagccuuucucacuuggcaauuccuccauuauccuugccaugauuuuagucuaccagucugaccaucuuucucuuguaauaauuggucuccugucuagaggccuugaacuuuuuuaaugucuuaagaauacuuucauuaauucuuugauaauuucauagccuagauauaauguaacuuguuuauauccaacucaaauucuccacauucccuucuuccuaacaguucuccucucaccuccaugcccccacacacuuaacaaccacugccucuuacucgugcugcccaugugaggccauccaucagagugcaggcagccaaccaguggccacacguacccaaccucccccagcagccaucaguugccccucagcuagggauggagccucaugaggccucuguaccccauaccggggugcugccuggccucacuucuccaguaugcagaggcgcugugagucucuaagugccugagugcagcccucuggccccuuucagcccuggcugcacacugagcucuccauuguuccugcucaaaacuaguacaagauucaagcaagugcuaauuccuuuaacaauuucaaaaauguguggcuuccaaauacauaugcuaugcuucaauaaauucuugcuaucuccaacacagaagggaugaaaagaagauaaaacaagaccucugaggaacugcauuauauagauaaaaagaauuucaaaaaggccucagggguuuaacagaaaacauuagauucauaaaagaagugcuauggaaacggcaaucuuuuaugagaggcccaaggucaguuauguggcacgaggcaggcuguaaggacauguggacagaagcuaaggagcaagaauaaaauaacuaaaaggugagaggcugcagacagacucucccuucaagccaucaagaaaacauaacccuaguacaccuccuaacuggccuccaaagggaaaaccacuaaggcuggggucauuuguuaagauggcuuuaaaaugaacugaagacagcccgaagugguggugugcgccuuuaucacagcacucaggaggcaaaggcaggaggaucucugaguuugaggccagugcaguuuacuuaucaagcuccaggucauaugaaacuacauagaaagaaucuaucuccaaaaaaacccaaacacugcaauaguuggcuuccaugaagagagcuaaagaacaaggaaaacagcuacauuuggucuucuaacuauauggauuaucuuaacugaaccaacaauacuuuuaaaacuuaacuuauuaaaucacauagaauauucuuccaacauuaccuacgucacucagaacuagagggacauuaauaagcccauauggcuaggaaacaaauuuucucugacuaacaaccagccacuucuauuauuuagaaguucuauuacugccuacauuauuucuuuucauuaacacaguaauggcuuuccuucuuauaaaaugaucacucugguuuuacaguccaguguucagaguaagaaaugaaggcauaggcuugucaucuuagagcucuggaggugcgggugggaggaacucuaguucaagaccaacaugugcuagugaguuccaggucagcguugguuaaaaagcaaagaaugucuuaaaacaaaaacauaaaaccaacaacuaaacuaaaaaauaaauaacaacaagguucuggccuaucuuuuagauuuacaaauauaacuacaaaagaaaaaaugguuuugaaauaccauguccaaagcauaaaaaacagaccagaagagugaagaacugagucugaaguuaaaaacccacacaccagcauaugcauucugaucugccacagaagugccaccuccaccauggcaagagacauaaagaucaaucacacuuuuacagaaagauuaaugccccgaguaauucaguucuuucuacaaaacucucggauuuuuuaaaguccuaucaaggucuucaggcuuacgacuuuuucagaaacaauuaaagcugggcaucgcccuaagguacagcggucaucaacccuaacagugaggagcaucaugcugcauaugcaaaacccagaaaaaccaagaaugcaauccaauaaggacaauuuaaaacgauuuaaauauuauaaagcuauuagaaauagucaucacugaaacagaaaguaauccuuguaaagaggggauuauuuagaaguccucuuaccuuucugguuaaaagacuuuuucuucucauuccacaagccucuaacuguaaccuuccucucaaagcuaauucaauuaacauacagccacguaauccagaugauauacagucauuccaaaaugauguguaacccuauuuaaaaagaacaaagaaaacaaaacagcuaauuuaccuugagucaaaaguagaaauaucuuuagcuaaagccacauaugucuucuuacaacaaaacacuaaaaugcacaauuaguauguuguuaauguaggaucuggggaagggucguccuuuuaccagguaucuuacauauggauaaaacaaacuucagaggucaagcugggacaguaguacauaccugaaauucuagcaaugggaauauggggacauucuaauggcucaagaguucaaggacagggcuggagagauggcucagagacuaagaguacuuacugcccuuacauuaaaccaaagugccuagcacccauaugguagcugaaaacuguaacugcagaucccaggauccaaugcccucuucugggcuccuugggcaccaggcauacauauaguuaaggaauacauagaaacaaaacaccccuauauacaaaauaaacuaacaauuuuaaauaaauaaaaaaugguggcucauaccuccagcauucaagccagccuggacuacucagggaaggcuuccugguacuuacccaagucaaugggauaagcccauauuuaagaggauggcugaccaucagaggucauggaacuucacuaaugauguaagaacuuuaaagugauaacaguuuuuaaaauaauuuauuuuuauuuuaugugcauugguguuuugccuacauagugagagagagagagagagagaguguguguguguguguguguguguguguguagguaguacggacaguugugagcuuccauguuggugcuggaaaucaaaucuggguccuucucuaguucaaaauaccacuuuuguugggagagcauuuagauaaagaaaacuaaaggggauaaacaaaacuacaguuuugucaggccugguuauuaauuccagcacucaagaggcagaggcaaguagaucucugugaucuauaugcaugguuuacacagugagauccaggauaaccagagguacauaacagagagaccuaaaaacaagucuaaaaaguuuuuaaaagguuucauauuuaucaaaaaggccaauuucaaugugaaaucaaggaagcagauuaguuuugagauuugcuaaaaugaaaagauugucggacuaaacaacauuuauuaaaaccaguaauaguagagggcuggagagauggcucaguggucaaucagagcacugacucuucuuccugggguccugagguccugaguucaauucccagcaaccacaugguggcucacaaccaucugcaaugaguuuggaugcccucuucuagugugucuaaagacagcuacaguguacucauauacauaaaauaaauaaaaucuuuuuuuaaaaacaaacaaacaaaaaaacaaaaacaaacaaacaaaaaaaacaauagaggaaaaucaagaucuggagcaauuaaagacuuaggaagcaagggaauuaauuccagaauugauuccacaugaaaucauguuacagcuguguguuucucaggggccugaacacacaaauggguuuccuauuugaaacaccaaaauguagacagaauauacacuucauaaaguaaaauggguaugguuagcauacaagucugaaacucugucuagcugggcagauuuuagcaguuuaccucugaugacguacagaagagggcuaaauacuguuccaacuauucucauguuaugacucgaccagagauuugucagcaaaacaaggucuuuacuacagaguucagaguuacguuuaaugaaaaccugauaacucauguggaaaauagaugaggaaaaaaagaaagaaagaaaaaaaagaaacaauucugugccaagguuucugggacuuaucagaaaagacaagauggaugaagccaagagaaacagcaagcaacagaguagcccaguguuuugauaaccuccuaguaaaacuccuaucaugaauguacaaaagcaugaucaggaauuaucagaaguuguugcuguugucgucauugcuguuuuguuuuuagguugaguaaaacugauccaaaagaacaagggagagggggugauauaacugaccagauaacaaugccacauugggggcuggagagauggcucagcgguuaagagcacugacugcucuaccagagguccugaguucaaaucccagcaaccacacaguggcucacaaccaucuguaaugagauuagaugcccucuucuggugugucugaaaacagcuacaguguucuuacauauaauaaacaaaucuuuaaaaacaaaaacaaaaaaaccaaugccauauggaauugaggccaaauggaccaggacuguaccaaaggacuauaaucaaccuuagucagccugguucuccagugaauccaugacacaauauggcauagacaaguuagcagagaagugcucagucaggagguagagaaaacguuggccuuguuucucaagaacaauuccaagagccuacuggaggaguacauacucacgggauguuuaagugugucccaacaaaucuuuccuaucuaacaaagccagucagccacuuuuaauaagguagcuaaagucuaugggaaagacuaauaaaaaacuggugguaccaagcagcuacaguuuuaguucaagagguagaacuaacuaguuguguuugcauacacagcucugagagaauaaagaaucaaugauacauccagggaagcaaaacaagccagaagaaccaguggcucuaagauagugucccucaccucacucacagcguaugagacaaccccaaccuuaguuagagcagaagaccaccacagaacaaacaaucugaggcauuauuucaaaaguguuauuuaacaagaaaaaaaaagucccuauguucuaaaaaguuuuaucgggaagugcagacauuccagaaucaagcagguuaaguacuauccccaacaaacaagaauccagacauggcauggguccacaaucgcccaaagcaacaacagagccagagagccagagacccuaaucugcuguccuggucaggggaugcacugcagugccagcauacacagcucagggcacucuccagucgccuguaaagacuacuaguucccugauaggcagcaaccguucuaacagaucaccagcugcuagguuaaugagacugcagcauccgaugcagaucaauccucugcuacuguggguccuggcaaaaacagucaaucuucagggcagaccucauaauguugcauaaaacucaagggaagggggaguggguggguaggggaguggggguggguggguaugggggacuuuugguauagcauuggaaauguaaaugagcuaaauaccuaauaaaaauggaaaaaaaaaacucaagggaaauaaacugucuuucccauucagucaaagaguacagcagaaagaacuguacaguaaguaacagaugaagcaaggggacacaaucaccaucaccaugggcaguuucaaggacaacauuaggagacaagacugcaucuaggaaaaccuccaccccgguuuuucucagcaaugaccaucacuuguauggaucuccaacugccugcuuucuuuccucuuaucaaguggcuugacuugaaugggaaaagaagcccucaaaagugccaacaacaagaaggauucaccaugagggugaagagccacacuauguaguccagaucucuuacuuaaaaugaaggaacuugaguuggccacucacaaugaaauacaguguaaauacauucugaaggucuagucuacuuagucaaaggauacaacaaccagauguucaaagacauuucauguauuauacaaagacauacaaaauggaaaaauguccuugauccauaauuuacauaauauaaaaauauaauaaguaagaccugaauucaaaauaauaugaaaaaauacauacaggcuuguauuguaaauauuuaauuuuuauauguauaugagaguauucaccugcagguacauguaugucugcaccaugugugccucgugccugaugaggccagaagaggacacugaauguccuggaacuggcgcuauagaugguugugaaugacugggugggagccuugggugggagccuaugcugggaaccuaaccucgguccucugaaaaagcagcaagugcuaaccaucucuccagcacuaagguuucuauuuuucaaugugcauuuccuaaucccagcacuugggaggcagaggcaagccaagagcucaaggccaaccuggucuacacagaaaauuauaggccagccagggcuacacaguaacacagugagagccucucaauuguaaacaaggugagguggggacaaaaagaaaaagaaauucaaguucucugacacaguucuauagacuuuaaguuacauuacagaauacuaugcauagaaaaauguauggacaaagacacugaucuugucacaguaaaacaaaccaaacacccagaaccaaccuaaaaauaaauaaaaauaaauucagcguuugccgaacuuuuugacauugaaucacucuguacgcauauaacaacuuacugaauauaguuucuaggaaccagguuuuaagaggacuugagcuugaucccacucacaacugccuauaacuccaguuccaaaaguagccaacuccuguagccucgcaaagguaccugcacucaauguauacaacacacagagacacacacacacacauucaaaacuaagggccaggugcugggcauauuucuuuaauaacagcauuaugacaucagaguaagguggcucuccacgacucugagccagccuggccuauauaacaaguuccaagucagccagaguuacaaagugagacucaaaaagcaagaaguccuucuucccugcccuaggaacagcuuuccugccguggucucucaacccuaaaacgcaagccuacucugggcucaccccacagucuccuuggugucugcagugacacggaacugacugaccagacacuuaagagcuucaacagcuugacagccucauguccucuaacuugacucaucccuagccacagcuuccaaaccagucagcaccauuucaaaggccaucaacacagcagccaaguucacugggaucagguagcuagcucuggagcugguuggggacuccucauaucuggacuucauuucucagacacaguagguccuuuugccuagugucagccuuggccuuccuccuaaccaagagaagcagcugucucgcuuccaccucccauggcucuucugugccuuaccuacccugcauguucuuuucuuuuguacacaacccccuccccccaaaguguggugaaguagcuggcucaaaguuccacagagagaagacaauaaaugcuguauuaguaaggaaggggguauaaauaaaaacaucuuuuaaccaucccagugcaaagaugauuagaaaauggggaaaucagccaggcagugauggcacauagccuuaaugccagcacuagggaggcagagucagguggaaagaucucugaguucaaggccagucuggucgacaguucuaggauagccaggacuacagggaaaaccaauucaucuuuauauaaguaugcauauauguauguuuucacauauaacacuuuuuaaaguagguuaggaaaguauuagcaguaauaacgacugacuggcuaucuucacauuagacuuuucuguauagaugugagagaaaaauggaacaagaaaacaagaaaaagacuaguuauucaaacuuauaagguaauaauuaagaugcuaucaguaacaugauaaagacacuagaaacacuaaaacauuugcaaaugauauaccuaagaaccaccuuucuguuucucaaauccaacacaaaccuuugaauauacgcuaucauccaugaccaagccuggcucuucccaauccucaggucccaccaaacagcauuucuuagaaaggacuccacugugcacaguccccagucauucucacacagaguccucuaauacugucuucagcauacuucagcauaguuaucacaaucuguacuuauauacauguacacacaucuuuguuuauuuauguaucugucuuccuuagcacaaugcuuagcauaaaacaauugcacaaguagaauuuugaguaacuaaaggucaauuauggacuuuaaaucuuccauuuuuguuaaauugguuuuacuuucuuccagcacuaagaaauaaguaguaucucacacaccaagagucuuuaucauggagccacucuugccagucacuuaagaccuaagugguguagggguguaugugugugcacacggguaccugagaaggcuagaagagggugucauaugcccugggacuggaguuacaagcaauguugagcuggaaacuuaacuccaguccucuggaaaagcagcaaacacccuugacugcugagccauguuuccagucccuauuuuuugguagccuauacuuuccuaaauauacaggcuccuugugguuuaaaaggcauauuucuacuauucucaugccuuaaagucuaccccauuucucccauaauuauagggacaguaaaaucuuaguaauuacguauuuuuuaaauuuaucuuuuuuuaaaagauugauugauugauugauugauuuauuacauguaaguacacuguagcugucuucagacacuccagaagagggcgucagaucucacuaugaauaguugugggccaccaugugguugcugggauuugaacucaggaucuuuggaagagcagucagagcucuuaaccgcugagccaucucuccagcccuaaauuuaccuuuugaagcaucacaugcauauaguacagacuuaaaugcaggucaaaaaauaaguaucgcuuaaucuucauccaggacuggcaacucauuuugcaaguucuaauaauuucaggccagugagugauacagguguuuacaaaccugaugcccugagacccauuuucagaaguugccaugugaccucuaggcauguacacacagagaaauaaacuauaaacauuuuuaguaaucccaagaccagugacuuugcucucucuaguuuguccacuacuuucuacacucacaucuucuaaaaauucucuguagaauauugucuuuaaaaccuacaacugcuuccaauaucaacccagcuuuuaacuucuugugccaauaaauguucauguuccuuaucccagacauaaucuccaucguagcuguuguguccugucuaaaacgucguuucucgucuguuaagucacagccuguacuucacugugcucaaauaucuccaaguacaggagcacagagccugaaaguaaaaacacuugagagccugaaacagaaggaucacuugaaccaagaaguucgggaccagccugggcuacaaaauaagacauagaagaggagcuaaggaugcaguuccaugacagggacuugccuagcauauuaacgcccuggguucaauccccggcauuguaaagaugucuuuaaaacuggaaauagggguggguugggggugggggugggauagaauguggggacuggggaauggcucagugcguagcacugcuugcugugaagcaccgggacuggagugcaaucaucuaggaccugcauaaaggcuagggacggccaugugugccuauaaccccagcacaguggauccugggagcuuggucaccaggcauaugacccuccccacaacacacacaaauaaaauuacguuaauucuuuaaauuauuuuagaauuuacaauacaauuacaucuuucccccuuuccuuucccucccuccaagccaucccauacacuccccuugcucuguuucaaacacauggccuuuuuuuucauuaacugcuguuauuuacacuaugcauaaauacauacauauauuuauuuuuuuaaugacaaaauacuuuuauaggucuguggaccagugcuagagauuuagcucaacugggaaguuugccuaucccagauguacaaacauaaaccaaggaugguggaagugccugcaaucccaaccuggcacugcacucuaggaguagaagcagaaggaucaugauaaguuccuggacacgcucagccacagagcuggaggccagccaagggugcuggagacccugucccaauaauaaacagugugucaaaguacuugcuaccccaauauauaguaacuccagaaaccacaugguggaaggagagccagcucucacaaguuguccucugaccuccagacagcaccccaccccccacauccacauacaaauaaauacagaagauauuuucuuaaauaauuuuuaaagguuguagaaaccugcccuagccaccuucugugaagauucuggccuuggaaaguaauaaagauuauuuucuuucccuaaaaaauaaaacaccaaacaaagaggaaauaagaugaucaaaaugugggaagaacugauuacaacaagggccagaagaggccaggcuccucacaagcuuucucuucuggaaacagaaggcauaaggaaauaagacuuacugccugccaaccacacccaucacuuuauacaacacagcugccauagaagucacugauuuugaaguuuggggcuucugauaccuccagagagugaacaguauuccagagaagagaaauaauggaaacaaccacagacucugggcuuacaucuagggaaaagaaaccaaaauacuugagguuuccagauuuccuagcccagauggucugggauuacaaaaaaacagaggggagggggauacuuuuuuacacacacagacacagacacagacacagacacagacacagacacagacacagacacagacacagagagagagagagagagagagagagagagagagagagagagagagagagaggcacagagacagauugauucagugaaaaggcauagguaaguagcugaaugagucaaauauucacuaaauuaucauguccaggauggucaggaacuuacggcaauaguggaagcugggcucuguggcagagcacuugccuaguaugcucaaggucagaguuugacccucagcacugaaagagagugaagaagagggaguaucaggagccagccaacagcauuuguuucagccuaaguccuuuuuaauuuuuauuuauuuauuuauuuauuuauuuauuuugguuuuuugguuuuucgagacaggguuucccuguauagcccuggcuguccaggaacucacuuuguagaccucgaacucagaaauccgccugccucugccuccagagugcugggauuaaaggugugcgccaccacgcccggcucuaaauccuuuuuagcccuuagguccuauaacagguuaugagacagaccacaaauagaggucuguuuugcccaggaaacaaugaggucuaaaaauucaaaaacauuuagucuaguucucccaaggaggagucaaaaaagacaaagcuacaagucaaaaccauggguaguuuguguugguuacuuugucaauuugacacaaacuacagccacaagagagaaccuaaauugagaaaagguccccauaagauuauccuauaugcaagccuguaggguacuuucuugauagaugauugauguggaaggacccaucccacuaugggugaugccgucuccagcagguggucuugcauauauaagaaaguaacugagcaagccaggaacaagccagcaucccugugggcucugcuucggugccugguuacauuuucuaucuugacuuuccuuuaugacagacuacaacuauaagcugaaauaaauccuuuccuguccaaauuaccuuuagugauguuuauuuguuuaaaucacagcaacagaaauauaacuaggacaauagucccauggcuccugaucugaggguucuucucuagucccuagucuacaccuucuguuuuucucugaaguugguauccaaucauacccaaaucaucuggagugcugucuccuauguauacugauugucccuuaaaagcuaaaaaucuaggcuggugagauggcucaguggguaagagcacccgacugcucuucugaagguccgaaguucaaaucccagcaaccacaugguggcucacaaccauccguaaugagaucugacucccucuucuggagggucugaagacagcuacaguguacuuacauguaauaaauaaauaaauaaauaaaucuuuaaaaaaaaaaaagcuaaaaaucuuagaaaccucagcacuuagcaaaggaacugauacaugaaugacauauuuugauuaacugaaaauacgaauuaccaguuaaacuuguuuaaucucaaaaacuggcaaauccuacucaauaacuaaauuuaaauacauguaauuucuguuuuuuguuuuaaaugguauaaaauuauuuaacaauuguauaagaaacugaaacugggggguugggggauuaguagcuaagagcaccggauuuugcagaagacccaaguuuaguuccuagaaccaacaugcuggcucauuaaccauccacaaaacucugguuuuagaggcucugaagccugggaugccuugaucuccaagggccccaggcaugcucaugcuauaugcauacauucaggcaaaacacucuugcacauaaaauaaaucuggaagggagggagggaggggaacuaggguagggcaaggauggucguuuagagguagaacacuuaaagagaauccacagccagcacaaggucccaaguucaguccugaccaggaaaaaaaucccaagggggcaguaaucaccaaaagcugacuguaagcccuccaaucugaagucuuucucaaaaagccagggauggacagauacagguuaucuuccaugcucucuaaaaauuacuacuaaaauguuaacuaguaacuuucuagaauucauacuagucucagucaaauucuguuauaaaugaaauuucuaucaacagagcuguucuuugagaaaggagcuauguuguccagacuggccuccuccaagggcugagaucagcagucccccugccucagccucccaaguugucagaggcauguuccacugccccccuuucauagaaaauaauuucuagggaagggauguaguucagaccauguagguagggugccaaggccccgggugccauccucauugccaaauacaccaaaguguaauaugauuuccaccacagaaaccagaaaugguuucuaaggugaucuaaaugcaaacacauguaagaagccucggucucuccaccaguuuucaccccccccccaucucuuccuucaugaauguaagauggacauucuggaugucucaccucucuauacacgaaaggaagacguuuuuuccaagaccacccccaaaaaucaguguucauucucuugggaauaauguuaccuucagugaguguaugauguacuuagacuauuuacugagucaaggugagauagucaacuguagaagcaaaaguuuuaaacugcaccuguugacaccaaguggacaguuucucuaguaaagcauguaaaccaaacacaacucacuaaggcuaaauuaacuuuacaacggacauguaauuuggcuuagagugcuacuugguuagcgggugcaaggccuggguuaaauccccagcaccaucaaaacacuaaaaugaaggacaauaacaugcuaguaagauucuaccauucucuauugcucuaucucauguaugaaugccugugugcauguguaugcaugugugaauguggcuguaccaauuugugcaauuacagaaccaaccucaaaguucagcccuugcuuucuaccacccagauuuugcuacauuuauuuguauguuuguucaucauacaggagacacauacacacacacacacacacacacacacacacacacacacacacuacuucauuguaggucagagcacaacuugcaggagucaguucagccaagccaucuucaacuggacuccuugagacagggucuuuguuguucacuguugcacacaccaggcuaguuagccuggaagcuuccaggaauucugcugucuccagcacccauacugauucaagagcccuggaauuacagaagggccuugaugagacccaguuuaugagaguucuggcuacccaaacugagauccucuaccagcaccccugggacaucuccccugucaaucuaauguuuaugaaacaagaagaaaaauauucuguuuucuuuuuaagucuguguguguguuagugcaugccacauuauaacacuauaguguauacacaagguuacauugcaauacuguaguacgccaacagguugcaaucuuuacagcuuauuuuucauauaggcucuaaauuuuauauuuggcuuaaagagaugaaaauucaaacccuucaaaaauaucaaaagaauauaguuaguauuagaaaagaaauuacaaaauucaaaacucuugaagcuuuuauguguguuuuuuuuuuaauuacuacaaacuuuuaacacaccuugaaauucuaaaacugagcucaauaacuaucuggcuuauagguuuaagaauagcacuauuuuacauuaacuucauagagguaaaauguuuacaaaacaguuauacaucuugauaaauacuguguucuaaacauuauuucaaaaugaacaaauuuugggggacagugugaaaacaacaaagucaguuucaucuuuuaaacuuccuaagucuugccacacagccugccaucucagucuuggggaggcagagaggagaggaucaccaguucaagaagacuucagauucaagaacugccaggaaauuugaggcaugccaaauaccaucuuuucucuaaacaaacccaccuaaucacuacauacuauucaaguguuacugcaguagagcucuuaggacuuuagaaauguaucuuuaaagaagauguuacuaaaagcuauuaaaccuuagaaaaaucagaugacaaaaaaaaaaaaaaaaaaaaccacacuagaaaaagacagggagaaaacuaaaacacaaccaaacaaaacaacaacauucaggaguacaguacacacaagaaggcuguucugaaaagguuuccuuucagccucuuuuucuuccaaagccucaguggagggcaacugacuggacaagacuuaacuauaacacaaaacaauaggaggauaccucaagaagccauuccaaagcugucaguaagccuaacauuagggagacagagacaagaggacccagagagaggucaaggaaaccagccuggccuucaucagacccuaucuaaaacacaagaaacaaacaagcaauccuaucaggcaaugguggcacacccccuuuagucccagcacucuguaggcagagggagaaggaccucugugaguucaaggccagccucaucaacagaguuccagaacagccaggacuacguagauaaacccugagacucaaaaauaaauaaguaaaugaauggauaaauaaguaaauaauaaaaagcuaaaauucuagggcuucgcaaagacaaagggggaaaguacaguaaaguguuagcaauaagugccacaaaaguacacccccccaagcacgugaagugaccauuuuccacauuugugagaauucugaaacucuugcauaguauguaaagagaaggacgacaaagccucacuucuacucaacaggccauuuucuuucucccuguuucuguaggugucuguacauaugugaucguguagaggucggcagucaacuucaguguugcccucagaugccaaccaucuuggcuuucaggcgagucucacacuggucuggagcuugcugaauggcuaggauggcugguccaggagcuucacucugcaucaaccugugacaucacucccagcuuuuccagagagagcugggaagcaaggccucguguuugugugguaagcacuuuaacaaucuuacccagccaccaaacacuagauuaaauuggucauuuaaaguagucaaacugaggcuggagagacagcucagugguuaagagcacuggcuguucuuccagaagacccagguucaauuuuaaguacccacauggaagcuuccaaccaccuauaacucuaguuucagggaccuaaugcccucuucuggccuccuuggauacacaaacuagauguacauacauacaaauaugggggcaaagcauucauacacagaaaauaaaaauaaauaaaccuuuaaauaggcaaguaaaugagaugaucagaucucaccuuaaguauuuagaccuaccaccaauaaaauaauucaaguuauuuaagggggucauuguuacaguuagugguacaauaugugugagacccuucaguuuagucuucuuaaaaaaauauuuuaauauaacuuuuugguuauuuauggucauucucaaguauccugaaacuacucaaggcuucaauggaaaaaaacacaaauaaauaaugaagagaaaauauuuacuauuuguccugcucugcccccaaccauccacagaaaucuugccaauuacuuaauuggaauucaugagugaaccuaucugacauucuagcaguggccucuaaauaucacucacugacacuucacccagauuaaguacccagaaccuaugaaugagccuaggcuugggcuuuuuuguuuuucgguugcuguuguuguguguguguguguguguguguguguguguguguguuuuguuuguuuguuuguuuguuacgauuuacuuauguauacaaauaaauacacuccagauacaccagaagaggacaucggaucccauuacagacgguugugagccaccaugugguugcuaggaauugaacccucuggaagagcagucagugcucugaacuccugagccaucucuccagcccuuggauguuuuaagaaaagaaaaaaccugaaaagcuaccucgaaccuaaaaaaauaaauaaaauaaaacaaaacuauagucaggacugaaugaggacaugacuguuccuagguuugaaguaggaagguuuaguguagaggggauaaacaggcaucuggaaagguccacucugaaccuggcaugugagggggauaggaggcuggagagaagaaacaagagccaagaggcuggaguaagccaggagacaaagagagcaagaggccaagagaccacauagccaaaaggcaggguuauagagagcagagcagcugagggaagggagugaagcucaggggcugcagagguugaggguaggagggcuggaugaaagugcuaagaagagucaggacucuuaacagguauaggcgaugcugagacagguagccagugucugcucugauaggcaccuuggcuagcagcuauacuuccugaguuugagaccuaacaaagacuuuaaacaaaacuccauguaaauaaucugaagccaauggcuucucauguagcccaggcuggccucugacuuucuauguaggugaaggugacccugaacuucugauaggcuugccucccaaguggaaguauaggcaugaugggcuuccaagcccagucugugcagaggaaggaaucaaauucagaacuucauccaaagcacucuaucaaccgagcuguauauucccaaucccuagaaccuaaguuaauaacaaauugaacaaagcuuaaguggcuacggaaacagagccaggaaaccaagacuuugucuuuuaaaaaaaaaaaaaaaaaaaaaagacaaggggaccaucccccaaauagacugggugauagguuuauaggacuagucacuacuguguacacacuugaugaaagaaaaaauauguaccuacauuuuuuuaaaaacaagugcccacccccacaugcuacaaauuagugccuggcugaaccuuggccaugacuuaugaaguauacuuauacaaaacaaccacaacagauggucucaguuaccugccaucaaagaacuuccauuguuuaaaaaacaaaacaaaacaaaacuaguugaauguuguaguagcauuaaauucaaaaaauucuucagauuaucuucacgggaaccaaucacagaaaaauaacugguaacagcuuuauauuaaaaauucagaguaaggcuucuaaaguaaaagguauuuuuccaccauuguuucucaaugugacaauaccaaaaauaauuuuuuuuguuccguuguagcuuuaccgaguucuagcauacagaaccaaaaugcugacccaggaauguaaccuucauuuuguuuuucuuguacuuccuagaaaugucucauaaucuguuuuguuccaaaguagggaaggagggaaggaaagauaaauguguauuacaagaagccugcuuucaaaaucuaauuacuuccuaagugaaugcucucuaaaaucgcauugccacacacuaacaucuagcuuuucacuccacaacuaaaaaugaaacacacaccaccgcauuccucauaauaacuguaauuaaacagguacugugccccuuucacagccugagggccauuaagugucuucaagcugaaugguauuaaggcaucaagaagcacuucccuggguaguaucuaauauccgggaaccacaaacagucccuggaaaaacucagcucucuaccgcugcuaagucugaggaacuaaaaaacuguuuuauaggaugaacugaguuuuguucugguuuguuucuuguccuccuuccugaauucugaaaacguauuuaaaaacaagauccaauaccuuucugucugacucucaaaauguguugucuagaguuuccacacugaaacgaaacaaacuuccgggccaccucaucauacaugauuuaugaaacauccaauccugcaagucugcccuuaaaaauaaucaucuuuagagauggauggguauuaauaaaaucaaucaaacauuaacuacagaauccagacauuuaaaagacggacacuugcacuuuuucaacuuauaugugugaaauuccuaaauaucuggggugaccuuuccaaacgucagaacacaacuuaagccuaccuaaaucuuugcagucuuucaucaaagcgcaaacuugguauuccucccagcucuucacaagcccucccuuaaaauggcaaaacggaaaggacgacagcagaucuaaccgcaaaacuaacucaucgcucgcucaaaccaaguucauccaaaaaguaacuuccuagguuuuauaucaacuuaguauugacuuuuuaaaacaauacccaguaaaaacaacuuugcuaauuucuuaaccgcgcgccgcaacucaaguuuuacauaagaaagagggccgacagcaaguagauccgcgaaccucucccgggucuuaaaaccugcaaaaacucaauacuugggagccgcgguagccccgagucuuuagaucucaacagucuuggguuggaguugccauuauuugcggcagacggcgaagaagaagaaacgcaaagaucgccaagacuucggaacuaagagugcuugugagcagaggacgggaaaacccaagcgagcacuugguaccgggaggaucgggagcacucggagcgcagccggagagggcugacucccacacuccuugggacgagagggcgcucaggggcgcggggcuccggaagcagggacaggugaggccucggccagcgcccacccgggccccaccuggagccacccgggucccgcugccaccccggcugccaccccggccggggccgcggcgcccgcaccucucgguccuugaggcccagcaggagcaccuccuccaucagggucagccgcguuuccuuggagucgcccuugucgucgucguccugcucgucgcggcggcucugcgccucguccucgccgcugccgccgccgccucccgccgcccgcuccuugucggcagcguuccgggaggccucggugcgccgcugcaccaggcccgagcuccgcugggucagcgaggucauggcucccgcacaagagccgcgccggaccgacagggacgcgggaccggccggcucucccucacggccccggccccgggagcuuccguguuaauucuuggagcuggggcgauguccgugggcugcggggccgaaggcggucaugaggagccggagcugggcgaagccggcgggccgggcgucgaugggguacacaagggagccuucagcccgcggcuguggccccccacacagcccaggagcccgagcggaggcggcggcggcgguggcgcuucccaauauggcggcgcgcgcugacgucacc

SEQ ID NO: 7692 - RNA, 2274 nt, Mus musculus
uguacauauauuuauaccauaaaagauuguagaauuaaaaacugaaaaccaauaauuaaaaauuagggugauauauuagcaugagauuaugaacuagaaaauuaaacauaauaauuuaaauaaauuaugaagcacaaauaaaauacaaaagacgaugucccuaauauaagaaaaacauucucacacugacuaaaauuuuauucuugagucaaugucuuuguaaccaccagcaugugaugguaugugauagacagaauaaguuaauauaauguaaaccaagaaaauguuauccuugaaugcaacaauaaaguuacagaugaaguuaagucauuuauauucaagauuuuucaggucagaauggauuacugacuaaaauaucuauuaauaucuuuccauuuucacaugguguaaaaaauguacagcacucuguauuucauaacuuuuacuuguauauuuccaggaacuugaacugugugugugugugugugugugugugugaguguguguguguguagaaguaucuauaaugcauaaauauauuuacauauauuauaccuaauuacguaugucuauaugcacauauuugcauguaguaagaaaggcauaaaaauguucuagcugucuauucggcuugcuuacauuagaguuucugaaacauuccuuaugauugcauuucaucagugaaacugaaaacccucacaaugauagaggcucuucuauguggcacucuuagacuuacacugugucuugugcuuuaucucugguaauggacuuuacuaaucugcacauuuuuauacuacauccuacuauccugugucugucauagauguaaugcuuuucuaaauugcauaaagguguucuugguucucucucuuagcuaguaggcaucuugaccuuuguacuaacaaugggacacuguuccucuaagaguuugauuauaauauguaagugacuuggagugaagaacuauuccagcacuuagaaagcuuuucacaaaaggacagacuuuuaugaaaauccugaccuuugcuuucacauuaaagacaguguuuauaaugcuggugcuuugauucguugcaugucugugcuacauaaaauaaaaacucuaaucauuuagauacauuuucaaauauaaaugugacacacgccuguauggaggcuucaugagaaaggaagauugggagagagauaggaugggggauugagauagagaauggcaugagagaggacaugaaugggauggagauuggaaaggagggaggaaaaaagaaaugaaaggaagaaagagcaugauuaauucauaaaauccagcuauauuuuauccuaaaacauauucacaaaaauuguaaaaaguguauuauucauuuguuuacccagcuagaauauucauugaauauugaauguauauaauaguuuacaaguuuaguaaauauauagaauaggcauuaaaguaauauaguuaaaccaauaauuuaaaauaaauuucgaugaaugaguuucucaauguccaauguagauaagaacuaguuuaaauacauaauagccauuaccuuugcuuguaaguacuuuuuuuuuuuaauuucuccugguuaauuaucucauauguagaggucaaaaugagagcuaaguuaauaacacccuaucuugugaagaaauuaucuacauuuacaaauguaaugagugaagggauuaagcuuacuuugcaagauacuaaggaggaaaaagaccaucuuggucagcaauauuuccuuggaucaagaaugcaucucagccacgugugcaucuuccacaauaguuaucauuacauucgucucucuucuaccaaaucugucuacacacuacucugacacagggucuuauucacauaaaugaagucaaauagaggcauuugcaggugguaagggauuuuugaaagaauauuuuguaucaauaacuuuaauuuucuauaauacuguaacaugccaaggcucagucaagaguucggugaagaaugugacucugugguugaggcuuucagggaacaucauaauaacaaaauguaauuccuauguucugugcaaagcaaugguagaucccuuuaugcugcaacucuuucugguagaaaauaucaugauuaguucauugauuccuuuauggucuuauugucuugaaucagcuucuacaauaaaguguccauggaaggaaauuucaacaggucuccaugcuguuaauuuaaaagcaauaugaguugucuccaucuuauuaauucuaaauucagaagacaagugauuuucu

SEQ ID NO: 7693 - RNA, 985 nt, Mus musculus
uaaaggauaggcucacaaccaaaaauauaaagugcaaugcucccugauucaagucuugcuuuagguuauuguuuucuccauaacaaauaaaacacaacauggaaacaaacaaaaauagacuuuuuuaaaaaacuuacuagaauguacauuugaauaaauauuuuuucuuuucuauuaucauuauucucacaauucacugagaaaaaaauuaucugaacuucuccacuccaaauaggucaagaccaacauggauggcuuucuguuugauuugugcauaauauucuuuguaaaccuaccaagacaauuaaauaaggaaaacacuuugaauuuugaugauguauacuugaggaaaugccuuaucuuauucccucuuucacacucuauagucaaagacuaauaauuugcuuguuugguacagaaaaauaaaauaaguagaucaaaaguucuugcaucaagaaacuuuuaucuuccacagcucaaugcuugccuauuggaagaaaccccaaaugcccuugcaucuuucagcaaagcauuaauaccuguugugaaaaaccuuuacgagugcuaacugcuccagcaagcagugaauggggagcagcaggccuagggauuguauguuacuaucuacaauaaaaugaaguucuauacuucaugggcuucuaagcaugccacaaacccuucagaugacaaaaggcacaaagugccauuaaaaggcaccaaguuuuccugaagacaauuauaaaagcauauaccaucuguucucaaucaugggcaacaggggagaaaaugugcaccacaugacaugcuacacacacagagaagucaagcugggagaagaaaagcauaugaaaaggcccuggccaggaaagaacauugcaaaguuggcauuguguaaugauagggucccauggagaucucuuugaggaacucuguagugccaagaucaguuugucuuuguacacuaagagccaccugugccauccuc

SEQ ID NO: 7694 - RNA, 2009 nt, Mus musculus
aaauccacugucuccuguuaugugagauacguuucgacccggagcucugccauuaaaaaaccucuuguuguuacaucaagguguuguguucuauucgugauucuugggugcacgccgaaucgggagcugaguggggguuuccccacugaguucuuucauuuggaggucccaccgagaucugcgugacacccaggaaccccgaaggaccccuuggaggugcguuuguuugugugagucuuguuauguugucuguugucuaagugucuaaguguggcacugcugaauuugugucuuaguuuuucaguucugagauuguggguuugagccccaccuguguuaccaguucugguauucuguauucuggcagcugccacuguggaccguaaggacccuaguggcugugggaagacgacggucuauuuccccacaggcugcacccuuggaagacauuccgagggagacccuggagugaccgggguacggaacagucaggagaaccuggcuguugucuggcagagugaagaagagugagugcucuuccugccagaggaguggagcggaaucccacuccaucagagguagcguuuggcugguuguguaaguccagacgcagacgagugugcuuggaugucuuaguguuuuccgucucugucauuguguuguguuuacucuuauucuucacuaugggacagaccaugucuacuccuuuaucuuugacuaaggaccauuggacgaacguuagggcuagaggacaaaauuugucaguaaaagugaagaaaaagccauggaugacuuucuguuccucagaauggccuguuuuuggaguagguuggccagcagaaggaacuuuuuacuuacccaccauaagggcugugaaggccauuguuuuucaggaagggccagggucgcauccagaccaacaaccguacaucaugguaugggaggacuuggcaugcuacccacccccguggguucgcccauuccucccgccucucugcccuggcaccaagauucuagccauccgagaaaauggugagaaagagaaaccgaaaccaccgcucaggagagaugaugaucgcagcacaccagugacgaaaccccccaagaucuauccagagauugaagaacccccugaguggcccgacaccccucaacccccacuguaugcuccccagccccaaccuuuagcucccucgggaccccugccucaggcccggccggaggagggggucccuccacaggaacaaggagucggcgaggagucaccccugaggggccugcggauucaaccguggcgcucccccucagggcuauuggggcucccacugccgauccaaauagucuacagccccuacaguauuggccuuuuucuucuucugaccuuuauaacuggaaagcuaaucaccccccuuuuucagaaaacccugcaggacucacuggguugguugaaucauuaauguauucacaccagccgaccugggaugacugccagcagcuugugcagacucuauucacaaccgaggagagagagaggauucuccucgaggcucggaaaaacguccgagacgaggcugggcgcccuguccaaacuccagcugagauagaugaaggauuuccacuaacccggccccaaugggauuauaauacggcaucagguagggaacgacuguccaauuaucgccggguccuaguggcgggucucagaggugcugcccggcagcccacgaaucuggccuagguaagagagguuaugcagggagcgacugagccccccucagucuuccuugaaaggcucauggaggcuuauaggagauauaccccauucgaccccacgucugagggucaaagggccucaguaauuauggccuucauuggccagucagcuccugacauuaggaagaaguuacagcgaauugagggcuugcaggauuacaccauaagggauguaguuagagaggcagagaaaguguaucauaggagagaaacagaagaugaaaaguuagagagag

SEQ ID NO: 7695 - RNA, 2394 nt, Mus musculus
ggcaccuuggagaccggagccuggugauagauuuuuaagcucucccuaccuuuagccauguuguaguuucaacuggggcgagucaaagggaaucccaugucgaucucauuuuguagcuguguagaccgcccguuggcucccaggcuauuuuuuuagccucuaacagaauucucucuugcucuucgguuguuaaaggcaucuguaaccgcuguugacaguaaucccaaguaggcugaugagagaacauaaggaacuccgccaacccugugaggcguuggggauccugagaaagggggugguuaguuuucuaguuauaaauaccagcagaggaaaaugaccaguacugaaggguuuaaaguuuggguggguccaccagaguccgcccggacucugcucugcaggucccuguggcuccauguacucacagcggucugccucucaacgccccgagggguuugggguucccuuggcggcuggggucaaggcuguggauaaggggaagguuauggacuaggccacucaggaggcuuuauagauuuuagaggagccgauuuagcugguggcuccaauuuaggagaagccuucaauuucucuuguaacaugagagcacaaccacaauuuugagaagcaaaacccaauuuuaacaguguaaacaaucuauuuucuuuaaaaaugaacucuaaaaacauuacuugcuacaaaguuuggcugucuguuccugcacacaaacacaagaagguguagccgccaauauaucucaaagacacuacccuaaaucuuaucuuuuauaaaucagauuucuaggauaagaauuacacagaauauuacccaauucaggcguaucuuuagagaccuguucccauggguugucucaugcugcauguuguaguucuaaauuacucuaacccagaguuaccaguuuuaagucaacuuuuuguuaccaauguuacaaauuuuuaaucauaaccaauaacuuaugagccacuaaucuauaaccaagacauauaaaacauauuuauacuuuugaaacuauuuagaaacaaaaaugaaauggccauauacauuugcucauuuaaaccaaacaaaauucuuaauuuuucuagcuguaauuucaaaagaggagcaccuugucaccugaugaauccaauuuuuguaggaaaaacagccaucuguucccuuaccauagaacuuugagaagcugcuggucccuauaagaacagcauuuauaaucagugucuagcagggcuucucuagccacacuagauuccuaacuacaggugcaggguuucaaagaccaauuaauacuguuuauuuuauuuuauuuuuuuauuaccaaauuaucuccagauagucggagaguacugcuuuucucaaaacccauuuucucacaucucagguguaaacuaucucuagucaggguauaaagcaccuaugagaauuaccuuuguuucuguagauuuucacauagcucuaaacacguacacaaaaacacauagaacagaaaccaacaaauccagacacacucgacccuuucuuguccuccacaagcaggcaaaagaauuagacgauguuggagggggaagcuuccgcuucaacagaacucggucccucugaccgaucuccggagacagccaggcgucccugacucucccuaccucccagggcgucccccagggccacagccugugguccucuuagcacgucugccgaccacaguccuccgguccuuacggcccaaaaggacagcugcaaauacagacgcgcgcauuucagaaaaccccaucaccccaucgucuacaaacaccgucguccacuuuuaccuagacaaccaaaaccagagaaucucacuuguuucucacuuugccagguguaaaaccaaagcacgaggaggugggacucgaacccacgaucucguaacccugaaaccaaagcacgaggugggacuggaacccacgaucucacaacccgaaaaccaaggcacgaggugggacucgaacccacgaucuuguaacccugaaaccaagacacaaauucaauaaacucagauggauccaaacucagacuuugccgugcuucagaaacauaggacaagacacaaacaacccaacauaacaagcacauguucuaauguucguuuuagaaaacagacacucaaaacagauacaccggccggcacacacacaagaggggauccccauaccuccaagucgguucucgggugugagggguggucgcguuucccggccaacgcaccaaaugaaagacccacaacgugaggacucccccacguucugacucaggagaggcgacaccccaaaaucaccaacgagaaaacggucuuguuguaaauugcaagaggauuuuuauucaagagcgcucucgggcccacgguca

SEQ ID NO: 7696 - RNA, 2394 nt, Mus musculus
ugaccgugggcccgagagcgcucuugaauaaaaauccucuugcaauuuacaacaagaccguuuucucguuggugauuuuggggugucgccucuccugagucagaacgugggggaguccucacguugugggucuuucauuuggugcguuggccgggaaacgcgaccaccccucacacccgagaaccgacuuggagguauggggauccccucuugugugugugccggccgguguaucuguuuugagugucuguuuucuaaaacgaacauuagaacaugugcuuguuauguuggguuguuugugucuuguccuauguuucugaagcacggcaaagucugaguuuggauccaucugaguuuauugaauuugugucuugguuucaggguuacaagaucguggguucgagucccaccucgugccuugguuuucggguugugagaucguggguuccagucccaccucgugcuuugguuucaggguuacgagaucguggguucgagucccaccuccucgugcuuugguuuuacaccuggcaaagugagaaacaagugagauucucugguuuugguugucuagguaaaaguggacgacgguguuuguagacgauggggugaugggguuuucugaaaugcgcgcgucuguauuugcagcuguccuuuugggccguaaggaccggaggacuguggucggcagacgugcuaagaggaccacaggcuguggcccugggggacgcccugggagguagggagagucagggacgccuggcugucuccggagaucggucagagggaccgaguucuguugaagcggaagcuucccccuccaacaucgucuaauucuuuugccugcuuguggaggacaagaaagggucgagugugucuggauuuguugguuucuguucuauguguuuuuguguacguguuuagagcuaugugaaaaucuacagaaacaaagguaauucucauaggugcuuuauacccugacuagagauaguuuacaccugagaugugagaaaauggguuuugagaaaagcaguacucuccgacuaucuggagauaauuugguaauaaaaaaauaaaauaaaauaaacaguauuaauuggucuuugaaacccugcaccuguaguuaggaaucuaguguggcuagagaagcccugcuagacacugauuauaaaugcuguucuuauagggaccagcagcuucucaaaguucuaugguaagggaacagauggcuguuuuuccuacaaaaauuggauucaucaggugacaaggugcuccucuuuugaaauuacagcuagaaaaauuaagaauuuuguuugguuuaaaugagcaaauguauauggccauuucauuuuuguuucuaaauaguuucaaaaguauaaauauguuuuauaugucuugguuauagauuaguggcucauaaguuauugguuaugauuaaaaauuuguaacauugguaacaaaaaguugacuuaaaacugguaacucuggguuagaguaauuuagaacuacaacaugcagcaugagacaacccaugggaacaggucucuaaagauacgccugaauuggguaauauucuguguaauucuuauccuagaaaucugauuuauaaaagauaagauuuaggguagugucuuugagauauauuggcggcuacaccuucuuguguuugugugcaggaacagacagccaaacuuuguagcaaguaauguuuuuagaguucauuuuuaaagaaaauagauuguuuacacuguuaaaauuggguuuugcuucucaaaauugugguugugcucucauguuacaagagaaauugaaggcuucuccuaaauuggagccaccagcuaaaucggcuccucuaaaaucuauaaagccuccugaguggccuaguccauaaccuuccccuuauccacagccuugaccccagccgccaagggaaccccaaaccccucggggcguugagaggcagaccgcugugaguacauggagccacagggaccugcagagcagaguccgggcggacucugguggacccacccaaacuuuaaacccuucaguacuggucauuuuccucugcugguauuuauaacuagaaaacuaaccacccccuuucucaggauccccaacgccucacaggguuggcggaguuccuuauguucucucaucagccuacuugggauuacugucaacagcgguuacagaugccuuuaacaaccgaagagcaagagagaauucuguuagaggcuaaaaaaauagccugggagccaacgggcggucuacacagcuacaaaaugagaucgacaugggauucccuuugacucgccccaguugaaacuacaacauggcuaaagguagggagagcuuaaaaaucuaucaccaggcuccggucuccaaggugcc

SEQ ID NO: 7697 - RNA, 3222 nt, Mus musculus
uaggauauggaaccucgcuggugcaaguccaucccugagaucuaguuuugagaguguauagccuugucccacuucugaccagcccccucugcuucuugugugcugauacaguaggauccaccagcuuccugcacuggucauauguggucaugcccgcccuguuguuauggacucucccuguggaacgguaagcccaaauaaauucuucucuguguugguuuuggucaugguuuuguauuagcacaaaguaagaauccuuuauuuuaugaaguccaaguagugaaugacugucgcagacagaggccaaagccuagaacauauucaccuaagugcaauuuuuacuaaauucaccaugcagauaggcauggcggccucuccuaucggcucaaacuccuuuaggacacagacaaccagggugcaggucauuacaaaaagugaggcaaaaaugauguguguguguguauaauuauacaacugacgugucaaaaucacuuuaagauuuuuuuccuaccugagaaacaaaucauucuuaaauugggaaaagaauguagcaaaauguguguguguguguguguguguguguguguguguguagugaucauaaugucuaacuagaugucugaugaggucugacuuaaccucaacuacacuuuacugguuccuauuguguauggcuuucaaacagccucaagccuguagcauucagaacucagccuucuuaaacugcuuuagaaccugaacgugugauagaaaauaacagacauacaucuuugcuccccagugugggcuagacagugucucuugauuugcuugugacuaugccauucaugacauaucaugguauugggaccaaaaguuucauagagagagcguagguuuagaguuagagagcuucagucauguuuguaguuguccaaggucuuagguugggcauuucuucucccaguucugagauaccagcugaaugaguccuucuaacagacaggcucccacaaacauugcuuuagggccuuugcauuaggguggguucuguuuguaaacacagauaauucuauuuaaaucuaauauauuauuuaaaaaucaagcauuaauuuuuauuuuauuuuuuuaaacauuuauuuuuaaacuaaauacauuuaauuagcacaaaaauaauaacccaugcguuguauugcagugugauguuugaauagcuggguugugcagugaucaaauuaagauaguuuauaucaccauuaucucauauauuuauauuuuuauugugugaguauugaaaauccuuuuaguuauuuggacaaacacuauuuccaaaccagugucaccuugcugugagcagaaaaccaggaauuauucugucauucgcagcauaacuuuguaaauauugaccagucuuuccgcacggcuucucuaggcucuguucugucauucucugugcuucuccgagaucagauucuucaaagucuguguaugaguguaauaauguugugcuuguuuuucuguaucugugcuucacauaguguucuuuaaauucauguauguugcuguaaugaugaguuuucauccuuuauaugacacaauaacauuccauugcaucuguguauguucauacacacauuucaauuacuguacauucauugcuggguacuuaaguugauauuucuuucccaaugguacuguaauaaacauuggcagaguagguauuucuucugcauauugaguuuguuuuaucuagauaaauuguaguaggaucgguagaacacaucauucauauauauacauuuauauacauauauaugauuacacacacacacacacacacacacacacacacacacacacacacacguaauaaaaacgcaaugguuuggguuuugauuuuuccccaaagguccauguagcaauggcauuuacuagauuuuagugaucaaaccuuuaggaagucccugguggcagcuuauucuuauuuggaggguuuccuuacucugcuggccuaaagaacagagacagccgaccauaggcugaaaccagaagccacacacaaggcauuuauuuuuuaauuugaauaacuucagugcucugucagaggauagaagacugaacaaacccgaaacccacugaaggccugcauuaccucugauauucugaucuccuguauaauuuuaacucucuaaaccaaugacucagauggauacuuuaaguuggcauuauaaaguugucacugcaacaggucacauuauuucaaguaacgagcacauuaaauacacacaaauuccauucuaacacaauagucuagggauuugaugcucuuaaauauucuuuuauuaauucuguuuuccuaagucaaaaugaugcuuguuuuuaugaaacacaguagucuuccuguugauuagcuugcugacacuugagaaucuucugaaugacuggcaccuuuuguggaccaugcauuagaguucuuauguuuugagcuuuaagacuuaaagaacauggguguuuaugugaugaaauagcagccagcauacaacagagauagcugcauauacaugcuuaugauagcauguuauuuauguuaaauguauauauuuaauaaauuuuuaaaaucaugcuaagacauuucaaacaaugagaucuauugaaguggauccuuauaaugucaauuuaacauaaacacuuagggugcuugugaaaguuuguuuuugcuugggccagggaguagaacuaucaggagguauggccuuguuugaguaggugugucacagugggcgugggcuauaauacccuaguccuagcugccugaaagucaaucuuccacuagcagccuucagaugaagauguugaacucucagcucugcuugcacuaugccugccuggaugcucucauguuccaccuugaugauaauggacugaaccucugaaccuguaagccagucucaauuaaauguuguccuuuauaagacuugccuuguucauggugucuaacaagacaauguuacaauuaugaauaauucuagaacauagaagguguuaagauucuacuucuuauguuucagcaucagugaguuuuccauugcagugaggauagcucaccauucauagugaccaucuuguagaaucaaccuagguauucaccaagacguaaacagaugacaugaauguauauguaagcaaugcaaucugauuaagcccugaaggacaaaauuauaucauuacaagaaaauggaugaa

SEQ ID NO: 7698 - RNA, 14158 nt, Mus musculus
caggcgggccuucuuaagccagcugccaagaguuuccugugcgagucggaaguucccucacuuagaacucggaaguucccucacuuagagcccggaagcuggugucuggugugucuuuuccuggcugugggcgaaggagguucucugcguuugugggacuagaaggcggccggucaggcuuagaagguucucggcugggucgucucugucuuccgggcccggggauggcggcucucacgugcaucaccugccggguggcguuccgcgacgcggagcugcagcgggcgcacuacaagacggacuggcaccgcuacaaccugcggcgcaagguggccgccauggccccggugacggccgagggcuuccaggagcgggugcgggcgcagcgcgcgguggccgaggcggcggaggcgagcaagggcgcggccaccuacugcacggcgugcggcaagaaguucgccaccuucaacgccuacgagaaccaccucggcucccggcggcacgccgagcuggagcggaaggcggugcgggccgcgagccggcgcguggagcugcugaacgccaagaaccuggagaaggggcugggcgcggacggcgucgacaaggacgccgugaacgccgccauccagcaggccaucaaggcccagcccuccacgucccccaagaaagcgcccuucgugcccacggacgagugcgggagggcggcggcgggcgcacggggcgucccggagcgagacccgacggagaagccgccccggcuccagugguucgaacagcaggcgaagaagcuggcgaagcagcagugggaggacggagaggaggagggagaggaagaggaggaagacgacgaagacgaagguagguaaggguccugucgggguuggggcgagcgggaggcuccgggagacaucgcgauggagacgaagggcuggguccacguucagcgaugucgcccuccccugaggcccccagcccgagccuucuucaguguuuaccuuugcgacauccauucccaggcuggacccugacuuucuucuuauccuuuuaccgcagccuuugagggagugggguuccaggcccagggcaucccgccuggauuuaaagauguuuccugguuuaugacuuuuaacuaguuaagcagauggauuguaggccuccauacuuuuuugguguuuuuuugguuuuucgagacaggguuucucuguguagcccuggcuguccuggaacucacucuguagaccaggcuggccuuaaacuuuagaaaucccccugccucugccucccaagugcugggguuaaaggcgagugccaccacugccgggcuguagaccuccauucuuaugcuugcucccggacgcaccaaacuucguguggacccgaaagggaacaguauuuggggauuucuauaggacauuuuagagugagggcagaagugguuuaaaugccucacugcucuucauuuccacagggcacuuugucugucugcgucucugugguggauccaggaccuagggcauugauuaaaaacagaauaaaagaguagaggcgcauucuuaacgggcaaaacauucuuuuaguuuggaucaggaaggguuacacuggugcacagaaagcuaugcuguuggcacgcugcuguagaaugugugguuagaauggcuuaggauuuuacauuucacuuaguugacuaaaacugagugaggguuucguguugccugcaagccugacuuguggggcuccagccagccccaagguuccuuacuuugugaguucuuuauucacccccacggcacuguugauacugacaguguuuguguucaugucuuggucgguuuauacuucuguaaccaagcaucuuaagccugguaauuuauaaacaacaugaacuuauuuugccacagucauggaagaugaaguaaaaaaugaagcuacuggcacccugacuguuuagugagggcuugcucuguggagggguauuuuucuaagccuuacuuaaugauggaaaaggcagaucuaggguguguacucauggagggggagcaaaacacaaaaaaggagacuugccaguucauuuaaguccuuuucuuaggacaucaacucacucaugagguuccuagaggucccauguguuacauuggugacuaaguugaacuugcauggacacauauaaacagaagcauucauauagcagcccugcacacaccaaaauauacacuaaaguauuccugugaagugcaaaugguagacagcuacugaaccagauaggaauccaauuaacuugguguccaguacugggcuaggugcaguaaugcauaggaaagagguuagcaacuauuuuauagagcuuccugcuggaaaagaaagauuaaagagguuuuuaucauuuaaacuugucuggggguauuugaucucugauugugcuugcuuuaucacaccuuuaaaaguaaauuuauuuuucaaaacuuuggcuuaaagauugggaagauauugauuccgaugauggauuggaaugugaggacccuggaguggaggaucaggaugcagaagaugcagcggcugaggagagcccaccccuaggugccaucccaauaacagacugcuuguuuugcucccaucauucaagcucccucgugaagaauguggcucauaugacuaaaguccacagcuuuuuuauuccugauauagaguaucuuucagauuugaaaggacuaauuaaauauuuggguaaguacaaugauuuugcuuuugaugaagaaauauuuuucaauuugugagaguaaguagugagauuuaaccugacuucuaaagauugauuucauauuauuuccacaugaccaggagagaaaguugguguuggcaaaauuugcuuguggugcaaugagaaagggaaguccuucuauuccacagaagcuguacaggcacacaugaaugacaaaagccacuguaagcucuucacagauggugacgcugccuuggaauuugcagacuucuaugauuuuagguaagaugaguuugugaggugacuugagguuauaguuauacacuaguggauaauaaacgauauuugcccccgucuucugaaauuggguugggcucgccgugcagugaguugagauagcaccucagcuuugccaguaaauuccucacccgcauuacauguuccuaagcuacaagcucacuugaacacauuagaaaagugaggaccucuggcccagagugagugggaaugauuuacuuuugcucuuugugauucaauagucagaacuuuaauuuugcuaauuacuuuaugaauagaaauucaaaaguuagguuucacauucugggcucccugagagacuuugaaucacagaugaucuacuaaagaaauugaacugcuugguagucuauaccaagucuuuggcauuugguagugagguuauuucauagauaauucagcucgaauaggaaucuugagcaguucauacauaugcaacaaguagguuagguguucaugaagaaguaguuucuuuugucagaauguaugugaaacagcacaggaauguacaagcacgcauaaguaccaugccaaacagccacaacccacgugaucuagguggucagaaaauuucgucuuuuagaacuuguguugccuucucuuccugauuuuguaguuugcaauugaggguggcggucgaauugcauaauuaggagguuagaggcauacaguauaggagacagauuugaaucuccgccggagacagaaagcaucguccccaagcaagagauauuuaucccuuucuaguucccugccagacagcaguguauuugaccuucagaccgagugucaaauugggauuaggcuaagcaaacagcagagagaagucaagagacuauaaccuuaguaacuggcuugaaauacugaaguauagacuuucugauuucuuuaucuacaucugcuucuuauauauuuaaguuccuacucugucuuguaaauuucaauaccuccuauaggcuuugacuaccaauuuauacccucugaugcaaccaucucaacaucaauccuagaaguucucuuuuacauuugaauugcauucugcuauucaaccuaaccucuucaucuuagagaaauggucauucucuccuucccaguaaugcaagccaauaauuuugcagucauucuugguauucuauauuaugcuugcauuaauucuuaaaucuguuuuaucugccuugacaugaccuuuaguaugugccuucuuuucccuucuccaguguccaggucuaggucaccauccgcugucauugaguacugccugcuugaucuuacuuuucauccucacucccucugugauagucuccaaagcuagcuugagagaucuuuguauagcauuaacucguguuaaugcugcucagaauauuucaagggccucccuucuuaaaguaaaagccaaaguuugauggccuaugauguccuuggcauucugacucuagccaugauucugcuguuuagauuccuggauauuuuccuaaagauagcaauuuuguaaauuugagaaguuuuuuuuuuagcuucggcucagagaguccaaagacuugagccuuuauuuccugaaugacucaaauuucaccaugccaucgugaccuccaugacuaucauucauaaaacagcaaugccuaccuagucauuuuugucccuuauuauccuuauagcccuuauugccauuucacgcaacauuguuacuuauuguuuguccucuugauggcauauagcuccuuuuauugcacuguuacuguuuacugaguguguugcucagacuauugcuaucaauuaaaauugauuacugauguaaauggauaguucccugaccagggaugucucaguaggaaaguacuuguguagcuuauuuaaggucuugacuuugguuucuaguacuaccaccagcaaaaccucaacaaaagaauagaauucuccuuugaguguuuuuuuuuuuuuuuuggacuugauguauuuuggcuccaaaaaugaugaaugguaugagcauauauaaaaaugaacauuaaaugauuuauuugcuuuacaaagcaaaacuuaauaauguuuaauaagaaaccuuggaaacaaggccgucauuaauuaagugcuuacuaccugccaggcacuucacugaguacuuugugaauuuacugguguagaggaaagaacaaauuauaauuccacccuuccaagauaacucuuguuuugaccuugaaauuucccuuggguguauuuccaggaaucagcauuauauaccuacauggguaggucuuggguguauuuaaacuuuauugaaugaggguuggaguacauguuuuugaacuuuacauaaauagaguagcaaagagacccuucgggucuagcacccuuuguucaacuguacuuuugggaaacucauccauuauguuuuugguuuguuuuuuaaaauugaguguuuuaccugaauguuuguauguguaucuucugugccagugcucgcagaggucagaagagggacucggaacccuaggaacugaaguuacauaguugugacccaugacauggguguugggaacugauccuggguccucugcgagaaccaauauucuuaaccucugagacaucucuccagacccacuuuguuuuauauaguuacagauuuuucuuuuuagguuacuagagugaauauucucuacuucuuaucuacuguagugguuuauaugagugguuucuaguuuugagcugauaaaaacaaaugcugcucuaccauccugcuaauaucuguaaauguguauauuuuacccacuauguaaauucuaguagcuggcccauaggagucgcacaaacaaaaagaaacaaaaagaugugagugugggcacauccccuccuugcguguguucucuauauaguuccacaguuagugggggcaaguguuucuuuuuagccauauggcuggauauauagugguuuuaauuuuuuuuuuuuuaugagcaauguaauugugaacccuuuuacaucuuaaauuagcugcucagagguauuuuuguuucugauuuagucuuuuaucuauucccuguugguuguuuagcuguuaauauuucaauguuuauuuguccaacuacuuuuuuaaauuaaaauuuauuauuuguguauauguguaucugccuuuguuauguaugcacauaugcacauaccauguggaggcccggacuugguauuccgaugucuuccuuggucauaucgcacuuuauuuuuugcaacaaggucucauugggaccuggagcucaccaguucagucagccuggcuggccggcaagcuccuuagacacucuugucuucacuccccuggugugguucuaggcaggcaggguugggcuugguuuucaugugcaugcuggaaggcaggcgaccuuaggucugcuugcauggcagguacuuuacccacugagcaucucgccaucacuaucuauaguuacuccucuuuauguccauuuaaauagcaaauuuuggauauauuuagaaacaguuuuauaacuauaccguccagugugguaauuacuaggcauauccuguggcugcucaaauaaaauaaaagauacgcauuagaaauucagugcuuuagucacauuaucugcaguuuuaaaaauucaguucuugaaaaacuuuauuuauaucuaaaguuaacaugugaggcacauagaaauuuguucuucugucaucacaaaauucuguuaggcugcagacuuguggaacuugacuguauuguaauugaggugugacugcguguccagcacuguauucauaucuucugcaugguucucugugcagcccuggcuguccuggaacucacuauguagaccaggcuggccucgagcucagaaaucugccuaccucugccucucaagugcuugauuaaaggcaugcgcugccccagcuugguaaucuuucuagagaggaaaaauguccuuuuaaggguuauucggucacauuuguuggcagaaaaauucugacaguaauuuuuaucacucaguucuuguagugggcauucccuggaaucauuugguagcuuggccacauuugccaaugcaggucucccguuuaguuaagucuccuuauuaguguuauuucacucuuacaggaguagcuacccagacuacaaggaggggcaggauccugcugagcuugaggccuuguccacagacaagaucuuggaaugugaugaugaaaccauggagcugauacuuccuucugguaaguguguuuguccaaacgaaguugcuuggugccaguguauaguggaagaagcaugucuuccucaguuaccugcugcgcugaaggagaaagaacgugaaccuuuagugugugugugugugugugugugugugugcgcgaguuuccucaaguaguuguaaacuuuaaaaguaguuacuuagcucuagguugacuguuucauuaaaauuggguuauuguuuuuccuuuuuucuuuucaaauuuacaguacuuugacuagguauuuaauuaauuuuuuaaaaaaaaauguaaacuaauagauccaucacacuaucucucccucuuucuuccuucuguguauguguguaugucuuuuucugagagugaauucuggaaccaguauccuuacaaguaucaagggcugugcagauguuuaguugaucuuguaagacaaaucugcccucauuuuacuaacucucagcucuuacccagagaaucagauaacaccuuaaguaagcugaauauggugauucuuaacaaagcagugucugacauguagaacacuguaaucuucauuucacuguaguauauuauaaagacauuacugacaggcaugauccuauuugaggaucaugcucuguuugggugaaguuuucaucugggcuuuacauuuuuaaaaauugguaaggaauacuuaauuauguagaaagcacauuucuuagggucacugaguguucuaaaguuaaucaaagccccaaauggguaucucuuuaggaaaugucuucucccauucagauaauuaagcaaccccugacugccuuuugaauguuuuucuucuuaagcauuugucuguguggccauuuuguuugugucaguuuuccaucuggacaucaucuguccgguuccuuuauaaccaccagccccuucuuucuaaagcaugcuuuacccugugugguuccacacugggagccauuaccuucaagguaucugagagcuucuucuggugccuguugccaaauacugcucucccgggucucuguaugaguggugcuucugguacuccacuccaccacaagacuccuugcuuuuacaccuugggagaagauucaugaauaucuccugugcuccuagaauacuggugauucacuaugcucuuguaaucauugucuugcuuguuugucuucccucauuuccuuuuaaaaacauguaaguauuuuaaguaaaugcauauuaauuuuaccuauuuauaagauacaguguggcauuucgguacauguauauaauauauaaugauucugccaaggugacuaguauauuuauccuugcuauauuauucuuuauguugguaacacuaaacuucucucuguugacacuuuugaaauaguuguccuccaucaucauuaagguauauacauacagugcuauaaaacaguagaaguggcuccuccuccccaagcucccauuacaguugagagcagacuguccugucucauuucaucguaguacugggucucagauacuuaaaaaccggauaaauauuuguugacugcuaugguggcagugacuuucaaagggaaggcaaacuuacuugagucuucggucuguaguaauaaaggaaaagugagcagaggaggcgggcaggaaguaagaacuguacuugaucuucuccugggccucauuacacauuugucacaacucaggaaguagaaaucucugaacaaaccuuguauaaaaauguaguggcagcguguggauccacuaauaguuuuuugaguaaaugaccucugaaauuucuggguaagcucaauuugugugccagcauuagcauagcuguuaguguaaaaccaauuuuggaagaaucacacaccuaagaguuugcucuaaacugguuucaaaagcaucaguugugguaccuuaaguguagauaauacucauauugugucauagucaaaucagcagcucuacgguuccagaaacagugaagaaaauaaccaguagagggcgcucggagcauuucuuuggaagacuggcuugggucaguuccuuugcacuuccuucauucuucaguucauaugguggaaauuggugugaaauacacauugauuuaucugccagcuggccagaugaagcugauguuguaucuaugagaaauacacaguucaucuuagaaagugagguuuggagauacucucguauuugcuaucaguugcauuggguguuccacgggaauggacaguuugaucaacaguuacaugaugaaagguagauugacaggcaccuccuaagucagacauaacuuguuacuggacagucacagccuucuuaagcuaaucuguccuucccaaggccuucagcuugagcugcucucgcaccauauaugguguuaaugccagguucucauuguuaacugacagcaagaauagcccacuucucuucuaccagcucucagaagcuguaagauacucuuccaaauggugcuuacaaauauacauguugacuuacuguuuacuaauuacuaacuucaucauuuccucauuuagggauaaucauccuugcagaucuguaccacccuggccuaccauuguaauuugaaaucccaguaaaucuugagguuugcugauaggaccuucacuuagauaugugucuuuucccuauuagauuuaucucacauggauguucagagaucauguuucccugaguugaaccacagguacaaaccaaggucuugccaugaaaauguccaacacaucaaauagcugguucuagagagauaccuuuuaucuauccauacugguauccaaagaccacaagauuaaauuggaaguuucuuuuugucaagaccugagucugaucacaaaacaucacauuugggugacaaggaaauacuuuccaagcauacaggagcucauaaauaacuugacacucuuuuccaugucaguuacaggcguagauguuaaaagcaaauauagccuucuacagcuuaugugauaaacuauucauauuugcuuauuugucaauuguuuuauuuacauaaguugaaaacuacucuggguacuauacccaggguuuuacccuuauguguuucuauuuggaaagguauuugauugcuuauaucuuaauuaauauucaucuaaaaaacauagccugcuuuuauuaguaaacccacaggugauguugaugccacuggccuagggaccaaucucuuaggauaguaugggagaauuaccuuuugaaaaccauuuuucugguggagccuagaauuagccaucccagacagagcuuaacauauuuauuaguuucccugcucagaagucaagccauaugauuugguuacuucucuauaaauggccagaaagcaaugauuuuguguaccauucugucuuuguguaccauucugucucuaguaauuguuuagaucugcuuuguagcucaaaagucaguagagauguaggugaguguggcuguguuccauuaaaauuuacagacuaguggaguggauuucagaccucuaacagacagacuuauacuuauaggaaccucaaauuguucaucuaguaaauaacuuuacuuauggguuuuauuaguguaauuagagaaguugcagacuuuacauugccccuuaguuuucguaauuugaaauguauauucucuuuucuuuguuuugaaauuguauuuacuaugguugugaguggguggcggguauuugugugcauaugccauaguacauaugggaaggcuagagguaacucugugggcuugauucucuauccaccuuaaugugcuuucugggaauugaacucagauugccaggucagcacagcuuacccagcucucuggcccucuuuccuuuuugcuuaguguauugcacuauuaaugguaagccugugcauugguguauacaaccauauucguaaugacaucaacauauauuggaaauuaaaguuaagaauucauuucucaaaguuuuuuuguuucacuugauuucugcaaauaaccacagguuuaaagagaauuuagcuuaaucuuuuugagauaucacgugguuuuucaucauuuaggaaggaguguaucagcuuugucaauguagcuaaauaauacuuugauguuguuaaucugccugugcauuuuaauaugugcaguagcaucucuguccuucagccacuagaugccaguauuacuccauuuguaacaauaaagacaucuacaguagguaucagauuucccugugugguaaaauuuacuccuguuggaagacgacuggaagagaaaacugaaccagaaaaaagaugguuucauuuuuguucugguucaguuuucccaauauggcuuguagaccugaugucagaguuauucccugcuucaucuucuuucucuuggggcuuuuuagccuuuauauauuuuccuaauauuggucuguuuuuccuguaguguauuccugcuuauuucuguuuuccuacuaggauuccuaaggcuuggugccauucaagaucuuuugggaagccuuugguuuauaacucugacuugaaagaccaguguuuaaauauugcucuucucaaaacaggugccagagugggucaucgcuccuugaugagauacuacaaacagcgauuuggcuugccaagagcugugacaguugcuaggaaucaaaaggcugugggcagaguucuccagcaauaccgagcccugggguggaugggcagcacagguacaccauucuuauaugcauggauuucgugggcgcuugggugacagguuaucauucgugcuguccgucugacuccuuuccaggggaagcuugagucuuacuucugggacucccauuaucucaggauacuuagaacacuuaaguccaagacuccaugacuuaaaaaauuaauauuccuggucuaguaacuuaguaugcaucaugaaccuuuccagaagauaauaucuauaaaaaaucuuauaaauuacaugcagaaauuaucuggagauaacucagaaauuaaauaguaccuuaguggagcuguggcgccuaacauggcauauguaguuucacauucuaaucucacgucaugaacauuauuaaauuucacuucugcuugcucauuugugcaagggaaaugauuaagaggacccaccuuagaguugagaggcuugucugacacaaugcaugugugagguagugcacuuacuacagguagcccagcccccuuuggcaguuuuucccaauagaaguagauugcaaugaguaaaucugacagcugaaguuauuaagcuuugaaacuacaaugugcuguuauuuaacucucauagugugcugugcaaaacugucuucucugcucuucugggaaauaaaguccaaauggagguagugaagauaauuugcuccuuucugaugucccagaaagccuagagccuaaaaacguagcaaacaucacuguuuacaaaguucugauaugcacaguucuuagaugcacguagaucucugagccccauugcuuggaauccccacauuagauucugucuuuaaauaucagaacccacuuauccuaagccaacuuugggaauucuaagauuugacuuccucuguuaguaaauaagagaucagagccucauugcuuaccauccucccaaccacaggagcagcucucaugcgugaacgggacaugcaauaugugcagaggaugaaaucaaaauggaugcugaagauaggaaugaagaacaacgccaccaagcagaugcacuucagggcccaagugagguucugagaggcugaaacagaugcaucucccgcugcacuucccuccuugucugaggacagggaagccagauugccgaaugguuccuuugcugcuacuucauuuguucugaucuaauaaagucaaaaucaugguugucuucaaugucguauuugagcaguguuuaaagcuuucaaguggggacggaugugaagcuugggcuugcuuguugggcuccaggaccugcaugaccuccugacaguugcuuuccugccucagcuuucagaugcuuucuggcugucagcauaaggugggaaacgcaagcgauuugucuaguccaaaauuaguuuaaaauuuggaauaacucauuacuucuugucuaagggaccuucgucaggggcuuugaggauuauauaagagcaaaacugaaugucacuugugaauguauguggcuuaggaaguugcccaugucucuggguguguugauaaaaugcagaaaagaacagaacauguuaagggcuugguaugcaggguuuuuauuuccaaauaagaacgaagaaugacugccagcuuuuaaguaguuuuuaggacugccucacaguuaaaucucugaagagauucuuaauuuagguugcuuaggagaaggcacuaauaauacccuggcagggaagcuaagcucauucauugagcuaccuuugggacuuugagaaagugauacacuuugugcauuuuggggggugguucuuuuaguccuuuuaucucacggcuugugagugcuuaaugaaacagaggacccaguccauacuaauauauacuucccagcaguaggcuugugaauaaacacucuuucaguauacaaagugccauaucaaggucaaagcuaggacguuccugugacacagugccuaaggaucccauaggcugagguugccuggacccugugcuaaaugaccuuugccaaccuuuuauuaugacacuuaggguacaagcgguccugauguagaauugaacccugugucacucaggauacaaauucacuauuguuuaaaaaaacggggcucuuugguuugaauucuauuccuucaucuuuucuauagccuccccacagaaauacugggucuccugacaucucugacauauuuaaaucuguaucuuuauaguguguuucaggugguguuuucaauuuacauucuauuaaauauguauucuaauuguguua

SEQ ID NO: 7699 - RNA, 8071 nt, Mus musculus
aaaagggaauaagggcacugugucucuuaagcugcuuccuguuaucuagggccgucaucaauuuugggguguagcugacuuuuaccaucaggauccacuugguaaacauucacaucagguuccucuguggauagcaaaucuucugugggcaguggcugguaauccuauaacaggagcugguuaauaguuugguuagaaauuuuuuuuauuuguuguugaaggaauguagaaacaagauuaaugaggcagggagcaaauaauaacaccaggaagaugacuaggaaaaguauuaugaaagggaguauccacuuccauauagaauuuucaaaaagaccauaacuggaggucucaugguuucugaaguucuugauaucugacuagcuccuggauuuuauuucucacuaucccggauugguugauguagaaacagcauucuucuuugaggaacaggcaaagaccaccuucuuuagcugucaggacaucuaguccccauuuauucugaagcaucacagcugccaaagaaucgaucaagacaacucuugucucccaccuggaaucccauaagucuuguauguagaaaaagugucuugcaguguugauagaagaaaugauuggucugugaucuuagcguauauaucugacaagaccaauaugggcaucccccauacuaaucuggccauuuucuacaauaaucuuuugucugaucaaagagaaagcaaguauagagaucauaauauuuagaugggauaacagauacagggaugauagcaauuugauugguuccuggcaucuggcuauggagcaguuuccugacccuauuugaaaagacuguuguuaucuguggggguuucuuggaccuuuaaucuccagauguaagggcugcccuggguggaaaugaacagcaaggggaggaugagaaacccaugucuaaugcagugaggucaagcuuggcugcaggaguggagucucauuuucugggauuggggauaagauggguggucucagugucuucuggaauuuaacacagcacaguccuguuagggucgauguguaugaagaagagucauuuuuagguggaggaaugaaagguuugaggugagacaaguggaccaaaugagagagucccucaaguuuagcagcuguaggggucacaaggauuaccuuaaaagggcccugcuauuuaugagagaggggugacagccaauaaucuagaggggauagaaggacuuggucuccaauguuaacagacagugaacaggagacaguuuuuggccacaguagaugguggucagcaaaguuccauaggagagaacagagauggcaaaguaauggggugaguagauggucugggaggggagauaauuuaggugaaagaccaggaguuaggacuggacauccauacagaaguucaaagggugagaugaagagaggucaguuggagagagcuuguagcaugaaaagagucaaagguaggaguuuuaccuauucaagaugaaguucuugugacagcuuaacaagaguaguuuuugaagagcuguugguucuuucuaccuuaccugaagauugagggugguagggaaugugaaaaugccaggggaugucuaggaccuuagauaagauaguguuugagauacuugggaaguaaauucagggccauugucugauuggagagaggcuuagacaucaaacuaggggaugaucucucugaggagagaucagagauugucugagccccgugagaaaugccucuacccacccugagaagguguccaccacgaccaggagguacaaguugccagucaguuccucuagccugauggguaggaaaaggggugcuaugauaccuugaguuggagucagacaucugucagauuuugcaagaagcagugguagauuauagaaagcuuaaguccucuggaguaggcuguagaugggucuuaacaaaagaagacaaugcuuggcuguuaggaugaaagaguugcuaaagauaagacagaguuuggcagaugucaggggaugaagguggagauagagguuguaguguaagaauguccuggggaaaaaugagacaagucuaggccccuaagggccacagcucuagcuaccucaccaacucaggagacaauauagucauccaacuggugggaucuacaguggacaaucccaauagcuguggggagaugggaggccuuuagcauggccauaauuugguuugcauuaguuacugguccuccuuuugugguaacccacacuccuuccguauagcagcauggaggagaugaaaagcuuauuuggaaucugcauagauguugggagauuuucccugugucaguugaaaggcacagguaaguguuacuagugcagccuguugauuggugguaugagcaggaagggccugugccucuaccaccucugugucugauacuauggcauagccagcuauucuggccccuucauguaaaaaggagcuaccaucuguauaccagguauaaauggccugaggcaaugugcccuccuguaugugugaaggaugagguaauaguuccucuaaaguuuuagugcaggagugagauagggagugguuaguauuuggucgaggaagaauauuggaaauauuaagaggugggcaugauuggaaggugagugucgggucuucuauuagagcuaccugaagagaaagaacccuggagagagguagaaucuguaagccuuuauaaguuaggagcugugacaaguuaugagaaaaccgguauaggugacccaaagguuagcuuuuuugacucucaaauaaagaguucaguggcugcuaaaguacgaauacaaggugcccaucccuggaugguuagaucuaguuuuuaugacaagugugcuacagguacaaaagaaugucccaguuaaugaccuaagacucgaagggcaaauccaucuuuuucaguuacauagagggaaaaaggaugagucaggucagggacauguaaagcuggggccuuaaagcaagccuguuggaaccuuugaaagggcuuuguaauaggauugagaagagguuccuggguggguccuaacacugcuuccuauaagagacgagaaaggaggggaaaaagaaggaacccacagacauaaaaaacugguuauuccuaggaaugauaaaaaucccuuuauauguagaaggaacaguuagagacugaaucagauucuuucuaccaaagguaauagccuuguggguuggaguaauuguuagccccaaauaggugaccugagggguggacaguuggacuuuagaaggugagacccuguagucuuggcuagagaggaaauuuggaagagcagaggugucagcuuggcuaauuucuagagagggucuacagaggaggacaucaucuacuuauacuauaugcauuacgguguguuugugugugugugugugugugugugugugugugugcacaugcacacguaucugugauauuauauucaaucuagaagcaaaggcaaugacaaacaugucaguccuucauacuugucacaucacuguacaauucagaguaaugaugaagauguuuuguuuacaaaucauaaaauaugauuaucagucacaaaaaaauugauuuaaaucucugugacagucuauauagaaagucaagaaagaagaugugcagccauugaggaacaaagacagcucucccaacugcuucagguggugagagcugaguagggagagugccucaucucccuuccccucccuauccucucccccaaccuauacacaccaccuggaggcagacacacucccuugaccagggccagcauuacuggcugugcagguaaggugcagggccagcucuccugaauaucucauuucuuaaugauuaucauuaauaucaaguacacagaaauuaaaauacauugagaaaagucuaauuagagaugcuaaaaauaugugucuugcguuauuuuuuaauuuuaaauacacuguuaaauaguaccugugagcucagaccuagauccugcagcucagaaacccugauuuggcuuguagaugacucugcuuucuuaucugcugucgaggguugaacuguauuccuucaaaauucagacacugaaguucuaacucccagaaccacgugauguggcuguauuuggagauaaaguaucaacaaaacuaauuaagguugaaugaggucauuggagcgggccuuaaucaaaugugacuugguucuugcaggggagauuaagacacaaauaggcaccaauggguggcugagugggacagaguggaagcagaaccugugacagcaagggggggacaauucaaaagaaaccauauuugcucacuuugauuugggguucccauucugcagaaaugugagacauugacucacauugccuggacagguuuucagggcagucuuaacagacuaacauaugucagaggacuugggacaacaauagacuuguaagaggcaagaugaacacauguuuguaaucccaauaacugagagacugagugcagaggaaucaaaguuuauggccauccuuggccauccaguguaagugcaaagccaaacugaggacaccccuucucaaaacaaaacaaaacaaaaacaaucgaacaauucugacuagcauuaacugcccacuacugagaugaaaguucgguguguggcugcugccugaucaacucacuuacuauauguuuuuacuucauuuuaagucaagaguugcucagccggacagaaugauauugcaaccauaacuuucgauuuggcuuugaauauuaacuaccgacuguucaucugccuuccuaacacaggcagccagccaccuugaugaauggcaggcccgugcgguuucucauccacaugcgguugaauugcagauugaggagugcuggugauucauuuaaccucguauaguuccuuauaucaguuaagagcaggggggaauuuaugcucuuuugugugucaggcaauaacucacuguauuaaacaagauuaucagucuuaaccaaaacuuucccccuucacagauccuaaccuaauucugucuuuacuuggagaggaaggaauuggcauaaauucccgagggcugucagaagagacacaccauuucacuggggugggggcaggggguagagacagcuggaauaaaaagaugguuucaaaagaggcacagaggaagcaaggugauccgcuaguaaauuuguccggauugcucagagagugaagacaagaagguggauuuauuaagugccuggugacaaccuaagaaguuuaaugagcauuaugauacaaugauagaugaggucggguauguuuaguggugauguguaagaaucacugagaagcaaauagccuuuaaagcaaaccuggaaaaccuaaaaauauuaugcagugaccgugaaaggguuacucagcaagcaagcaucccauaaggaaggucuagggguucucuucucguuccuguagaaaugucuagaucacugaaauccagaacuuggggaagucaaccuggaacacacauguugcucccauccaggccuacagcagacuuccuaaagucaagguugaaacacaaauaaacauggagaaagcaaguauagauuucagaaaauuucaaaaacuuguuuuugggugauauuuuucuuggaacccaugcacacaugugcacacacuuauauuugcauguauguacauacauacacacacacaugcaugcacaggcucauugugaguuuuccuugcuuucucuauuucccugaauaaaucugucuauucuccuuuuuuaaaaaaugguuucuguuuuucagagugugcugaguccucuguggcugcuauagaugggacaaugugacacaguucuaccuauggagcagagcuagcaaggugugggcuuccaugaguguggacaguugcuaguuaugaaacuugcuuguauaacaguguacaugauuuacuuuguguuccuucuucggcagauguucucccugccaacguuaccauggaaugcucucucugacaagguugauggcuccaugacaauuagaagcaacacaaaucuggaagguggggguguguccaguguuccucagcaaaaaugaaaagaccuucaggacuggccuuauggcugugggaaaaaaaaacucugaaaacaugaguucaaaaauauauaaacaggguuucucaacuauguaaaacguaaggaugcaauacaaauuguaugaggggcuucacagauguaagagaacagaugcagcugcacuaacuagccagcuugucagaggcuauuaaggaaggcgauaaagagauuugggaaguaaggcaagaucuuacccagcuaaguuuauuguuugugcuuacaaagguaggcaaauaucugagaucaaggucagccugggacaaaaaaguuuaggccuaggguggugggaauggugaucucagagcaagaucccacccagcuaacuuauugucugugcuuacaaaggcaggccacaucucugaauucauuugcaauauaucuuuuuuaaaaauuacuugcugucuuuuccuaagaguagaggagcuaaggucauaaaauguugauucuugggguaaucaaaagagaaccuggaguaaaugacuauugauauauaaauaacagacugggcuuuggucuacaagagagugcuacccaaggaauuuagaauuuuucuaacaggguuucugacuuuguuuggagagcccaugaauuacuuagagagcuaacauagcucuuuaaggauuuuucuucuagaagcuuuucuuuuugaaauuugucugguggguucuuuggcucuggcuggaaaucccaagaauuuugucuaacagauuuccuuaguuuaguugggaaacccaugagcuaaccagggagcgcuuagaaauguuccuaguaugagagaacugacucugacagagagacaguucugucuugaguagggagcuaucuuagacagagagcugucucuagcaaaagcuaucaggagagucaucucaaguagaacuuagagcugucagcuuguacccacaauugaccucaagucaauuucuuuugcagcuccugagagacccuaaggacuuuaucuagucccaugcccaucuuacagcuucccccuucuagcuggggucaagguuaggccacguuccauucuccacccacaggaacauucuugaguaaaaaaaaaaauucucagaauguacugacugauaguuaccugacccucuggaaguucccagguaguguucaaauacaugucacgcuugcuagccaauacauuuaaaggucaauaugcuuagcuaauaaguuugaacuguaaccuugcugauguaaccugugccccuaaaaaguauaaaaacugcuugcaauagccauucaggguugccuucuugucacucaccuccagggacugauuaaggguugacccacuccugaaaauaaaccucuugcuuuugcaucauucugcaucuccauuuuucacuugaggguaucucaaaguaaguaccacugaccaagggucggggucuuacacucccaaacaccccuucuucaggaacaccuuuccaagccuagguuuguccuuggcaaggaugguggcccaaucacuagaucaacacaguucaucuuacuuugccugaaagaccaaauagaaucacauguaaugacgauauuaagguaugcauguagacugaaugcuuuuguucuuuucaauugugugaaaauggccaugguguuccuuaccauaguuaggaauccuauaauuacuguuugaugauaaaauucaacuuagccugaucauccugcauucuguauuuauuacacuaaguuacuaaacccccuuguauuguuuauuuuccagccuguccuugauccagauaucccuccucaggaagacgaacucuccauaggucauccuccagcugggaucucucugcucuauguucugucucuucuucuucuuuuuuuuuuuuuguaccuucuuaauauacaguugaguuuaacuuaauauaguaauucaguagcuaugugccaagcuuugaugacuuuuucucuucuagcccca

SEQ ID NO: 7700 - RNA, 88074 nt, Mus musculus
agugacgcuuacggaagcgcucugcggaccucgcggggugcggggcagcgcagccacggcuccggacggcgggacggcagggcccggcguggccgcggaugagucggggaaccaugccccagcccggagcguggcccggugcaagcugcgccgagacgccggcgcgcgaggccggggccgcggcgcgggacggcgggaaggugacggccggcgcgcagccccgggccgcgacgcgaugcccggccgagcagugagugagcggggcgggcgugggagcgggcgcgggcgcggggcugcguggguucccucgguuucaggucggcuacccagaccgagcaguagagagucgggaguguggacccugucacagcucggucacccaggccgccacacucccgcuuugacaacuguccaauccugaaguuagggaaagcgcuaggaauuugggaaagaaauccagagaggccccuuuaaugauccacugacucccuguagcucuuuuccccuaaccuagcucggaggaagugaguucgccccaguaacagccacagaauuguccugcgaugucaccacuugaagaguuucccaccuguuggacagacuuuggccacaggcuggcccucuccguuuuaccccgucagacccuggcuagguauuccuaccacucuuugcuuuuacacacacacacacacacacacacacacacaggcacacaguuuuagagcaguuccuuauugacugugaagaaaaacaguaaguuagaagcgauuucacugugcaggguuuggaggugucuacugaguucguggcacaguucuagaugucuuuggacuuagaaaaucaaaagcuccgacagucaguuuucuuaugauccaaaaguuaaagcauaaggugugucuagauggaccuuuagagcucuuucaauuuccuaagaaggggucuuuugaagccuuguuaaggaagacgggauauaauagcagcucaguugugaggugcuuugcggugggcuuugaccgcuuucguuuauugagcgcccgagugugaugguaauuauuccuguaaugagcuagugguaacaggaaagguauagagugggaagccuuaaccuucucuaagagcuaggcugccaauuagcguuagugacauugucuguuagcuuugggacuuggggagcuuuuagcucuuuauuugggucagcauuaucuaagcuucagccauaguugcuguagucaaugaaucuagauagccugguuuuuuuaaaugaaauguccugauucuuaaguagggacacuuauuuuucuuucuauugagcuccuuuauauuacagggccauguuugaguuggucuagucugugguugccagguugaaacugucuagguuagagaugucucuuuccucugcucuuccucugcuuccugacggcucugccuuucagccugcuuuccuaguccauuccuuuccuggaugcccagccuuuuaagcccugcaccucagucuuacccuagcaguuucacaugccuugaaagauaccugagccuuugaggccagaaccacauucuccaacguacacacaguuguuuggaagguuuucugguguggugguucucacgaacaccuuggggaacggaccucaaagggaaggagucuucacacugcuguuagucuuaaagcugaaaccuggguuugucaucucacucuugaggaaacaggugcggauuguguuguuaggcagggagaaacagguaggagauuuuaagaccaugguucuugacaccuccccccccccccccaacucccuaccccuuacccccuucuucuugaccuccucagcaacacuggacagagaggcauggcuuauaaccacgccuauguuuguaauuugaauguuauuagcuguuucuuuuuuuccuuacugccuguguuggcuuuaauugacccauuuucucuugacucuucagguguggaaaugaggcuaguguauaguguaacucacaaguauuacugguuaauacaccacacugcuagaccauuuugccuuucugacucagccuuacaugaguaguggauugggcucuuucucucuguggggcuuuucuagggucccguaucagagaaacaguaaauaguugacaguguaauaugugcguaugugauauaagccgcuuaauaguuuggcuauaaauuuaaugcuguuaagaaugugcguuuaaaucuguguuaggcucaggggucagaccucuccacucagaguuauugaaaauauuuuuaccuuaaaauagggaccauggugagauuggauaugauuugagauaugcuauagcguuauuuuuacuacauuugagggagauugguuaugaguguaaguccuaggcagccuacaggugaauuaugaacuugggguuuggcucuaguagcucagcuguucugauuucuuuuuaauaagcucaccgcauuucacaggggaaaggacuggggaagagggacacccaaaccacauguauacacugccuccugcacaagccccaagggauggucacuguaaagcugggagucccauuugaagaggccugacauuagaccagaguaacugaccuugugcagguuccccggcugcucacaucacaggccuccuuugcuccaucuucccuucccuucauccuuucauguggggaacccuuagacagucauaccacgcuauccuccucaagggcgugaccaaaccggaagugguuagggaagucacagacuaccccgugcgccuucucagucuacuugaggaugggacugggguuuacucugagauugaugcuggguaugcucuuguauggaggcauaccagucgucugggaagcccgaugaaauugagugcaaacuuguguuucuaagcuaagguauucuucaagggucugcgagcacacuccucuauguguuaggcuguuugcagggauugucaacccucguuuaugcuguuuucuguccuugcccagccuagcuuccagagugggguaagaaggcguguagcuguggggauguaguggacucccucuccuuuccucacgcaaggaagaccccgcuugaggagucacccaggauguuuccagaccuccuuguugcaggcagcuguguuguccuuaugcgcuucuggaagucacauggagcaggaugagcugacauggaaaguccacuugcagaaguggguggaauuuuggccuaggugcugguacuuuccuguauguguucuguuguuuauccucucugcagucaccagacuagacaaaggcuaggccuaguggucuuuacguuucugggucuggguaggaagauguguggugucacauugguugacuccaccuuaccaauacugcagagagggcuggaaaaauggcuagugguuaagaguccuugccgcccuuguguaggaccugguuuaggcucucacucagcacuuacaguuaccacccguaacuccaguaccagaggaucccgcccccucuucuggccucaggaucuaggcacacgaauggcauacagauaugcauucagggaagcagucaugcacauaaaguaguaaauaccaaaauaaaugcugcuuuuuaauaacaagaaaacaguaguguuuguaagcugugcauagacguuagaauugguuguuuucauuucaugucuugaaucagaaauugaaaauauggcuucauagaaaucuguuucacugaccucugccuuuaauuuuacaguuuucuuggaaauaguauaauuuuguuugcacuaguaagcauuugcaaacaagucuuagcuggauuuaguacuucuuuccuguaaugccagcacuccaaaggcagaguuggagaaggaucaggaguucaaggcuggccuagcucaaucucccucccacaacacacagacacacacacauacacacacacacacacacacacacacacacucuuaccuuuaaaauuuguugauauggaaaucugugagcaaaggaagagguacuaguuauaauuuagcauguacuggagcuuacucaguuuggcauguuggauucagaauagaguagucuagcucaugagaaaauggguaaauaguauuuauugggaacuugaaaacagauccuuucaaauaaugccaggaugcgaaacuaggaaauuucuaguuaggaguuauuaucauuuugguuuaaaauuuaacuguacaguugaaguguaacuagcaugucuggacauggagucauuucucacccuacuguuuuuuggcugucaugguuuaggagagaagucuuugcuguggugaucaucugagucugagguccuucccagaguggacaugucuuucccaguaaaaguugccauucuuucagcucugucagcauugaugacuuuaucuuaauauugcccccuuccuugcauuguuucauuaucuuucccucccauuacaaaagagcucagcccuccaccagcuccacauucccagcguggccaacgccgcuuugcaguuguuggcggcacagcauuugucaguucaagacaguagagcaaagcaaaccugcacuucagccccaagacacaaguucagugaagccauugucguuuuuuacuuuccagugggugagagccagaggcuggggcaugcuagccacgugcuccgucccuaggguucucuacgcauaguuuuuccccuguuccuuucugguuuccuuagguggaugcacaguucauccuggcucucacaugcuuuccuuucugacuguguggaucuccaugacuuaaagguggccaucuguucucccaggacgcacagcuuugggcucaaauucgaagucucacauugcggcucaccuuugguggccagugacauuaacaaaauacuggugcaaggaucugggugaaauguaugguugccgaagugauggcuucugcucggcuccucuugugagaaccgcguccugagucacugcucuuccugcccgcccaccgagucggugcugcucugucuugcugugcacgcagcucuccugccuguucugcucuucccuucuucugguucuuuuccuguugcccugugugagcauuugucuuuguaaagugaccauuuggauugcccucucugggcacuggguugugaggaagaugaggggagccaaaagcucauccaggcuagccacagaauuugccugcaaugcaaauuuaucacaggcgguuaggaguuagcuggaagaggaaccgcagcucacacagccuucucacuuaagcugagaaaagugagggcgagauuggggaagugucaucugaagacagcuucugagaauuuaaauauauuaagaaagugauuuguuucaaugacuauuuuagagggucagaauuccucugauaggcgucauuguugguugacagaaagcuguuauuaaguuuaugagagaaggaugagaacauguggucauauuuuauuuuuggccuuugaucugugguccccaugcaucuguuugcuuuccacuugggcacaagcucucugagugacaucaugccuuuugcuugaaaugucacugcaucauaugauacuugcucucuuaccaucauacugcuaacacuguacauacacacuagagagaagaaagcugagcaaugaccacugggcagauuuuccauuaguacucuccacauuggauauaugaaaauuaauaguagccagcuuuuuugaguacuuguuacuuuaaaccugucucucucacagcaauccugugaaguaaauacuccaggaacugcugcacguagagguaaugaggacuaggauacagagcagcuaucuucucucagucugacuggguacccacaguaacuguugcucucuguagagugugugccacaaagcacaugucaggauguguuagcaaagaggcgggucacgauucugaauccgcugggacaagagaaugccuggagcgagucccuguaaaacauguaggguaguugugaguaacuguuuggguugaacucugaguagugcauaggagaauaaucagagcugugcuggagggaagggguggguaaggcgcauucauauauauuuacauauauauguaaaugacaaggucuugcuauaguccaggcugguuuugauaucaagaucuccauccacagcuucuugaguacugggauuauaagcauguaccaccacgucugcaaggggcagauuuagacauuuguucucucauacgugggaaacacuggaugaguucaugagguucugguuagauucacucuuaccuccguucuuugucuuucucuccugagacucuggucuuccucccagcucugucugcuaggccauguccaagaaggaagagaucagaagcaggaguaccuugcuuacuugguuaguuauaucugagccuggcaccucugccuuccuggauuccauuguguuugaagcuccucuuucuuccgucugcugggaggauggagcagugucaugggaaguacagggagauggaagucugcacacuccuaguguggccucuccugauuuuaagcucaguguguugcuauuccuucagaugaacuugcuucuucuaguuccugagccucagacucccuagcuugccuugcauagcugccuuuccagcuaucccagaacuuccuuguuuguaccauuuccccucugcucccuucuggucuuucacauacacaguuuguguucuguccccuuuauugucauuuuggggugaauauuauuuucaaggugcugggauuaauacuaaaguuggcacaugcagggcagcucuagccaagccucuaaauuuuuaaggaaagggagguguuuucaaagugggagccacauucauuaucuuugccuggaauuuuacccucuuccuaauacuuacuaguuacugaagacaccuugggaaguggauauauucuuaaagauguuguucauuaguaguagucauuaaacuaugugggaacauagugucaucugggugguuggcugguggcuggugagggaacaagagaaucuuugaggaagauuuuuagcuuauggggcuuuguaaugauucucucuuuucauguucagaguuaguugccgucagauuuacucguaauauguuauaaaagugggcauucuguguaaaugcuguguacacagcacuuguuuuuguucucagcacauggaggagccauucaggagagucccugacuuggaugcaugccuguagauuuuaguucgguugaccuuggagucauguaaaaucuccaugucauagcauuucguaagcagcuguauauugucacacagugggaaaugucagugcaacaagaguuugaaaauaucuacuuuggugugauuucagcgaggaggacauguaccgugcugcagaugaaauagaaaaggagaaagaauugcuaauacaugaaagagggauaucagguauguguggaacuguuuugucuguagacuuucuugucauagauaacuaguuagaucagcacgcccgcguucaugaaaugcggccuguaauuccuacaaguccucucauacauccagucucuucuacacgaacuacucacuuggcugaaauagacguagggaagacucugccccgcgucucuuuagucugccgucucucagcuuggcucuuuacauccuuagaagaguuuggauuugaacacauuggucauuuucaguugcaagauguuuugagaaguuagccguacacuuauccuugacgagggcccggugccucuaaugacuguggcacaaugaccaugugcuugagaacgccggccacuguguggcucugccgucuguagcucuuccagcuugcucuucucauuccuggugugacuccaagugaaguguggccuuccucugcaggucggccugugcagaggcugaggagagaucuccacagagugccuaugaaugaauggaacucucacugcuugugugauucucaugcucugccucucuauuagaauggcuucugucccuguggcuaacaaaaguguuauuguaauuaggauacguacgguuugguaaugguuucugauucuuccuccagagcugaucccuaugaagcagcagggauguuuuguagugacccuccuuagaacuucauaggaugcucagucuucauggcugccuugcuccaaaucacucggcuuacauagcaucguuugauaaugcuguagacccucuguuuuccucuuccaccuccggggcucgguuuugauuugacccacccucccucuuucuuucuuucuuucuuucuuuccuucuuuccuucuuucuuucuuucuuucuuucuuucuuucuuucuuucuuucuuucucucucucucucucucuuuccuuuuuuuuuuuuuuuuuuuucucgagacaggguuucucuguucccuuggcuguccuggaacucacucuguagaccaggcuggccuugaacucagagaucugccugccucugccuccugagugcugggauuaaaggcgugcaccaucaccuccuggcugacuuucuuuuguccagcauuguucccacacagugcccaacuauuuagugaguuuggugaaguguguuuucagucucacgguacuccucauagcucacugcccuuccucaguguccuguaggcgcucugccuccuccauggcagggcacagugcuuacugcgaccuguaagaaagcucucaugcuuuuguaggugaauuuagcucagugaaggcuuuccacaccuugaccuguccaguuuuguaaaugcaguucuuuuggaacuuauaagcuuauguuugauuugggagcuuucaugcaaacugaggaguugccaaaccaugugccccuaaaacccuggugauuuucuaccagacccauuguagaagaaguuugagaucccagugcuagucuguccugaauguuccagguuccuggaggagucccaguuuguuucuuauccuuugaggucugauuauuguauuugucacguauguggugcuugcuuaucugacugccuguuuuccacucuugagguuuuuuuuuuuuuacuucccuuacuuauuauuguuguuguuguuauuauuauuauuauuauuauuauuuucuuuucuugguuuugucaaaagaacuagucuucuuccuugaagcagcaauggaagccuguguaguuuaguuagauggagggaguugugcucagugggcugacgaggucaaacacugccuccuccugugccuccauccccuagcuuagucagcaugugggaccugcugugccucccagacacagaagccugcugggauucagguaacauuauguuguagcuaugcaaguacuuaaguucuccaagccucuuaccuuaugcugaccucugauucaggacaggaucgggcuucuggcuuguucuccagcuuuuauaagaccccugggccagccuuaacccugugaucugagaugguaggacuccccagccuugcccaggggucagucuuagugugucugcaagugaggacagcaguggaggagacaggaaggaagacuuauugucuggaagcccguccucugcuggugaaguaccuucuucccaggcguacagcccucccugacaagaacugauggcccagaaggguccugacuguguaauagcaguucuuccugucuggggggcaugugaguggggaggcagauacaugugaguacuuccuuauucuaaguagccuccuaaacauuaucucuugaauuucacagaguaacagugguuguuuucaugucuagguuaaucacuauguacuacacacagaacucugucugugcauggauuaugcaaccuuuuguaaaagguuguuuuuuuuuuuucuuugagaaaugaacaaugaggugguuuuuuugaauaagcaguuuuuacaguuuacuuuaaaacaaauuguacucccuaaacucuagggaggcuucgguguuccugggucaguggcuuccaccaugcucuggcuuguaagugcuugugguccuuuccucuuccaucucugaugcccacuggggcggaguccuggccucauucccucucagcuccauuccuggcacagugcuuggcacgguuagaccuucagggacuauuuguugaauugagugaaacacguauguacaagacauguagacucuauguguucuagguucauuuccuaaaacaauugcuaauaucucuauccucaaaaguuuuaaaaaggagccaagaugaaccugaaaauugccuaauuucuuuuugaaaucacaaauugucauaugcauacauauacauaaucauaggcauauaucaagaaaucaaaccucauccacuaaaucaagaaagucuuacugaaggcccuaaauucaauccccaguacgcgcacacacacacacacacacacacacacacacacacacacacacacacacgaacagaggagaagggauauuagggagagaagugacuuuaaaggcauuuuuuauaaacaacaacaacaaaaaucuauaacauguguuuaauccugaguuguacuaguuugggggagacauuuaaaggaugucuguggauuagccaacacugagugcucugauccuuucugguuuauaacaaaaacuauaauauuagguaaauagcaaauggaauuuuuguuagguguuaucucugucuaauagauaugaaacaaaugaugagcuauuuuucaugguuccuaugccugcaucugauuauuaaaguguacacacacacacacccgugggucaggugagugagagccuggagguuccugcagcucucugaggcugugaggaaggacugccuccugacucuggaguuaaugagcaaccugacugguguguggagugcaggcugugugguguggugacgagggagacccauuaagagagcacucugguuuauagagguggcaugggcugaacgcaugggcaguagugagauugaggaauuuuuaaacuagagaaaguaagguguaaggagaggacucccuccccuaggaaggcagugucucuauuuccauuacucuugcuuucguugcuuauguguuucauuucauuguugccauuuugauuuuucaacagaacccagguuaaguguggcuccugaaauggauaucauggacuacugcaaaaaagaauggagaggaaauacucagaaagccacauguaugaaaaagguauggccaggguguacccauugaaggucuucaaaccgucuguccugagcuacguaucauaggaugcuuuuagacagugguuaggacaacugcuauaauaagacaaugcuguaaauauugguguucuaauuuuagagaugaggaaacagacugcaaagauaaggacuuguuuggagucauaguacuaauauagaagcaacaucaguucuuuaguaacuuaauuucuuugaagaacacagagcugugcuguugagaguagacucagccacugcugcuucucuuugagacaguugugaaugcucuucuuaacuggugcuguaaaggccucaaggauaggcagaggcgauuuuacaccucugcccaugcgucuaaguccuagguauagauuccuccuguacuuucucugcagaggaauuugaaccauuuccuucauuuaaggugugccaggagcugccuucacuucauucuguuguauacuagcacuccuagacuagccucugagacugauagguauuggaacugcaguacgcccugugggcucugcuuacagagugcacuccaucugucuuuccuuaucaguaagggaaaccaugugacacuguuucuguuugaccguuccuaagcuagugguaaacuucuaccuacuacuuaagcuugugucuuuugauuccuuuuuuuuuuucuuucuuggauuauuuauauuuugaauauacuacuugugcuuuagaaauacugaccagucuuuuguauuuuuauaauuuauuuguauguauauggguguuuugccuccaugcauaucuguauuaugugugugcagugucugcgaggccagaagagagcacuggacucccuaagacuggaguuaccuaugauugugagccuccauguggaugcuuagaguggagcccaggccuucuggaagagcagccagugcucuuaacuaugguagaauuggauagaaucauauugaaaaggguuuuaaauucuuuaaauuuuaauuucucucauagcagcagcagaagcugcuucuucuccccccuccuuccuccuccuccucauuaucaucauuauuauuauuuuagaaacuuacucgucuuuagaguucaacucaugucuucaaucugaaagauguccaccuuagcccuaauucuuacaaaccuguguucuaggcccuucuguguggccucagucacagaauacccugcuuucugguuccugcuaaaggugacaggccuguuuucucagaggccgucugcagccgggcuuccauccacucugggucucccgcucuccacccagacucugcagggagucacauccguauuuccuuaccugcucuaggaaaggcuucacuaacuaaugauuucauucuguugucuuagucucuuccagagaucagaucuguuuuaauguggcaugucuaaguccaauacugaagacacucaguuaccuagauaugccauauuuuagaacuuaugggaaaaucauuucucuaugggcuugcacgcaaagaaagguuugaccauucaguaaucagauuaaaacaccccauuuagcggugcagcuccuuagcaaucugagcauugccuguuauaaacuuugagucuugauuuuauuuuaguucuuauuugccuaauuaccuguguuucgauucggauauucuuuuggaaguguuuauaaauccagaauaauuuuuuuuuucgagacaggguuucucugugcaguccuggcuguccuggaacucaaucuauagaccaggcuggccucaaacucagaaauccaccugccucugccucucaagugcugggauuacaggcgugcgccaccacugggccagauuaauuuuuuaaaguguuagguucaucucuuaaauaguacaguuacagaucuguaggauuaaaauggaccugcagcuuuuggaucuccugaugacauagcugugauguguguguguguguguguguguguguguguguguguguguguguguguuuguggugcaucacucuagugcuugucaugaggcuguuauaaacagaccuggacugucagugaaagugcugugcaugcagucaugucaucacugcacgugauagcuacccaugccacggcucuguguacaacgugugcccugcugugucagcagcaaccugauacaucaucucauguucacuuuaccucuugauugugguguugugucauacuugauuuaguaccuuuguuuuccauuguggcuucuuagcauacuuccccugcuaauacucaguaagagccugauagucccaggauauaguaggauauaccagcuagguuugugcacguguacucagaugugugcacaaugaugacguugccuagugacauauucucagaguguauuaccuuugcugagugacuucugccuguauguguacacacacacuuuggaaacucgggauuuauggacauuuuuaaaacuggagauagaaauauugcauaccccccuuccuggucucuuuauuaaagcauuugggaaaauuaaccacagauuaaaccguucgggaugugagcagugagugagggcucccucagaugacugggaagggacucugagggugcauagagcuggacagcugguuuauuuuggaugucaggucuguugcauuuguuauagaucagugguuucaaccugugggucacaacucccuugggggucccauacuagauauccugcauaucagauauuuacauuacaguuuacaacaguagcaaaaugacagcuaugaaguaacaaggaaauaauuuugugguugggggucaccauaugaagagcuguguuaaagagucauagcauuaggaagguuaaggagcacuguugcagaugcugagauuucauaaagaaagcaucaguauuuuaagguaaauugaauuguaaucagagauuggaaugccuuacuaagcuauccuuucuuguuugccauuucccaauguuuuaggacaauuuuuucccguagggauggaacuuuucuugcuaucucaagccaguaacuaccaucuaaacucuuugauguuuucucccaagggcuaugaggaagugucucagaaauucacuuccauaaggcgaguccguggugauaacuacugugcacugagggccacacuguuccaggccaugagccagcuggccgagcugccccccuggcugcaggacuuggagcucauacugguauguuguugcaugaauuugaaucacaguguuucaggaaguucuucucagaagacuucuccuuucugcucauguugccugaagguguuacaugcagugugauuucagcauauggauuuguucaguuugcaucuguaagaugaucuuauauguauaaaaaaugacuagaaauaaucaguauuuucaagaagagaaagaaugacaaaacuuaauacacuuaagcugaguuaaagaccagauguuuagaauucauaaaaaacacauagaaaaaaacuugacuuuauuuuaguguuucucugaaguaaguuauauaauuuuuacuggaguucauguggauuuuaggggcaguucaaaaacaaauauacguuucaugaugagaugcuaguguuacguagagaaaccuuuucuggaccugacuauccuuagugcuuuauuuaagucaugggagagagucccugggaucuaugccugcaggugucuugauacaaagaaggccucaugcugaugauuuguguagcggauaaaaggaaauucuguaaacccuggcgcuagugaacgcggcuuugcuauuuucuguuggcucgggaguugaagggcuuuggguggcugaggguggacaaucuuaacugcagcucgggcugacuucaaaccuguggcaauccuccugcuucagucucgugagugcugggauuacuggugugauagacacauggcaaagcuguuacuucuguguggugucugcugcgcuccuguguuagagaguagcuaacuuguucccgugacacugggcuucuuacacagcauggacugugugcuuuaacacaccaguaaagggaaugaauguguuuuacaacuuacuaaagaaagaaauggaaauuuuaauuuauuuuuagaugguauuauucugagaggauagacuuggccuacaguacucuuaaaaacaaaagaaagcacuuugaaaauuauuacgaaaucugauacuuuugagucuuuuccuuugugggccuuuuuagauuucugggcuuauuugacacuaauuuuaaauuuuuauauuuucuaagaauuuuuggugcaaauacaguccuaaguaguuaaacauacacauuguaucccagaaaaguaaagcaacggcuccugcuaacaggugcauucggguuacaucaccuaccccaugugaaaugggucagcuaagagggugggcuguugcaugccuggaacugcagcacuuucaugcugaggcaagaguccugugacauuuaagcugcucuggguuauguagugcagccuuuucucaggaguguuggcuugcauuuggucuuggacaguaugaaaaugugucacuggcaggagugaugaggugauggagaggucuuccuggccuacuggagugaugcacagagaacuguuaaauucccagugggcuccucuuuuccauagcauugcauguuugccuuccgagggccccgucgcugagaucaguauucacacugauuggauuuugcuucugcucaauaucugcugaagaaacuacuuuccugcucaugcccucagaaacguaacaugguuuggaccuuucuugacaguuuguuguauguuccuaagacuugagugaaacacuugccuccagcucugcguuugaggagcagggugggggggagggggggagggaggagagguagacacacagguacuggagagucacugacugagcaagggugcuagcugucugcuuccaugugcagacugugagcccagugccgcuagagcuucagagggagacuaggcacaguuagugcucagacggcugugcuugcuugagaaugacuccugggcagggccuucugcucugcucugcucagucucucugccuagcugcucuccugcuuaggaguugagcucugucccuuuugaugugcagcuguccccuuuucucuuguccugccuaggcuuucugauuguucuuacuucuguccagaaccagcccguuugacugcaggcagaucgucugacccuagccccaaccuggacauagcuggccaaagcuggaucagccccucacuugugaaaagggaguauccuuucuauuaggagcuuuuuaguucuuaagugcacuguauuuguaaacaucugugaauggauaagaccugugacagcacuuacuacagaaugacccgaaagcuccuugugacuucauuuugagguugaugcuuuugauacaugcaguugccauguuaucaagauuauagauauuuguuagagaaaacaggcugggcucuaggccagucacagauaaugugcuuaagcuaccgagugauccuuaaccguuaccaucgucauuucuugcuucagucuccuuccuccucuucucuugcuaucuuuaguuuucuuuuuuccaagacaguuuucucuguaauccuggcuguucuagaacuugcucuggagacuaagcugacuucaaaugcacggucugcuucuugcuugcucuuacuccaaaagaaggcagacuugugugccuacuagaaaggaauagugauuuauguggaccccaugugugacccaugagagcauuuaaaguuguauuaacuucugaauaaauaaguccaacuccauguucuuuccuaauaguucuucuaaacuuuuauuaucaugugucugugugagugugugugugugugugagugagccuguguguguauguaagugagccugugugugugugacugagagugugugugugugagugagcauguguguguguauguaugugagugugugugugugagugagcgugaguguguguguguaugugagugagcaugugugugugugugugugugugugucugccugccugccacagugaguguacggagaggucugaggacagcauuguggaguuuacucaccaucugugcuuacgugggcuccugggauugaacucuggacagcagguuuacauggucagugcuuucuccacagagcugucuuguugguccucuaacuugguuucuuuucuaagucucauuuuuuuuaacuuuuuucuaagauuuccacgcuggaccuggauaaucacuuaaucaacagacugaccaaugagugacugagaugagcaaacuaacuuguuucuaccaaaaguaacugaguugccuguuguacuugcuccuuagguuacuguccagugcuacagagccacagcucuucccgggcugccaccugccuccucucagaccuuauagcuuuggaggaguauuuucucuugaguuguacuucuuggagccaggguguaauuucauguugcugccacuugagggcacaugagguucuggugauaagucugagacuaauuaaacugccugugcaugucucacaagugcagggcuugugggaacaguggggcuguugcagcuuuaggugaaaggucauuuaucacaguacaauacgaugacuagauggcuuuuccgcuugacugacacagagcacugucacugugauuuugaguuuuguagagacaagucaucuuaguuacauaugauugccguagacugagaaagcacaaucagaauuauuguuuaugaaggcgucucagaggcuuagguucuaguggaacugagcaugcucuguucugaacugccuauuacuguuaagcaaguucagcacacgguguuaggauaggacauucugacuccagggaugaaaucucucuuuuauagugccaguuaccccuauuuauuuauuuguuccucccucccucccucccuuccuuccuuccuuccuuccuuccuuccuuccuuccuuccuuccuucauguacgugugugugugugugugugugucugugucucugugugugugugugugugucugugugugugugugucugugugugugugugucuguguguaccucuguugcggaaccaucucaguggaccucaggugaaaucuuagcaguguagucuaugguuuucauccugacacacccaggacucuugagaagauagaguuucucaugcugucauggcuugaauuguggccuucagauuccagauucuaaugcuguguagggacaaaugaaauaguccaggaacaggaacaggacgugagggccauaguaguugccuguggcucucauuagaaaggugcugcucccacccucccgcugcugugggccucauuccucuuccccaucuugugcuguggauuaaggaugugugggaagguugucaggaguuaggcuucacugucaggaagagcagcagccuuugacucuaccguggaccuuccgugccugcagucaccuugcugagccauguaauguaugguaagguugccguaguccccagcagccacaggcagugaggaccgcugugaagacccaguguggauucuuccuuagcuuagccucagaucugcgccuugccuguccuugccuguguuaguucugcaggcuggacuccuguagauuugaaccaacagcauuuaaccuugcagccuucucuguggcuaugcuuugagauugugacuuccauauucagauucuccauccucaacccauaugauccucucgcaggaauuaauuuuugaaauaagguagguuuuguaugaaggcuuuguggugucuuccuuuucgguugucucagcuaucuggcaacacugacacuucuuuaucucuguuucuugauauuccaguuaccagagaagcugauaaacaaguauaccuggaucaagcaguggaaacuuggacugaaauuugaugggaagagugaggaccugguugaaaaaauuaaggaaucccuugcccugcuaaggaagaagguuugacgcacgaaauuuucugugucugaucggggugcaaagcuuucucuuuuguugucccagcagauucaguguucuaaucuuauuuauuuacucauauuuauuuuuaaguuuauaaggaagaagguucauuuuagcucauggucuucauuaggggucagaauuugcugguuugagacaaaauaauuuugggcugggggaacugugcagucuguaggugcaugacagggaacugaguuugguucuucagaacuuauauaaaacugguggcaugugauugccaccccagcaauggagagcaggggauaagagggucccugagggucacuggccauccagucuagccuaacuaaucagugacagucaccauaugcacgcauauacacguacacucuuacacauguguacagucaccauaugcaugcauauacacguauacccuuacacaugugcacagucaccauaugcaugcauauacacguauacccuuacacaugugcacagucaccauaugcaugcauauacacguauacccuuacacaugugcacagucaccauaugcacacauauacacguacacccuuacacauaugcacacacauacuuacacacacauugaaaaaggaaacuuuaaaagaacauuaauuccucucauuuuuugggggguaaaauggaaaaacaccaacauucuauuuucuuggaggugaugcuaucuacaagugucucagauaacauuuaauuuucuuccaaagaaaccuuaauaaauaaaauuuuuauuuuaagucauauuuguagguuuuaggguuaucauuuaauccacauuccuuuuaaaaagauugauugauugauugugugguguacguguaugugcacacaugugcacuggguaccuguggaugccagaagaguguguugguuuccuggggcuggaggugcagggguugugagcaccggcaugggcauuaucugggagagcagcaagugcucuuagccgggagcuguggcuccuguccuuuaucccacguucauauucucaguguaucucuguguauuuauuaaggucuuuccagguauucuuacauuuuaaaagucuaucaauacgugcuauaaaaucuuucucaauaaauagauguagcaacuuuggaaaccauccuaagaguagucugaaauaauucacgggauuaguucacggauagcuuggucuucuaauuuccugugggcuggugaauacaagucuccuuccugugguagagggcacuguuguuccccuugccuauuggaguguaaugcuuaggggcuagaagccacuggccugcuggcgugaugaaggcaggcugcagcucuuugaaggacagacuggcaaguuugucagcuuaguuguaagguguaguuuucuuuucagguuuuguaaggggcuggugaggguguuaguuuuuuuguuuuguuuuguuuuuuguaaauuuuaucucucucucucucucucucucucucucucucucucucucucucucucucucucccucucucucucucucccucucucucucuauuauuauguaugucaacuguaguuagacccuccucugggggaauguguauaugaugccaauuuacagugacauuaaaauugccaguaauccaugugggcagcugucagcacuucucguugucacacuuggcacuaagaguugcuuggguuccucuaccuuucaaccaagaaagugggauggcuguggucaucucuguucuaaagauaagggaacugcagccuggagggaaaccuugaaaaaccacaucuuaauugcaucuugagucucugacucuauagagucgugcuuguagccagcaccauugucugcuucuagaaaauaugagacaugacaccgugguccagcuguuaaguccuggggaguucuguguagacagaaucacuauacuuucucuccgguuuaaaauucagacugguguuugaaagcagugcuaaugagugcuuauucauaaggacugguauuuaaguugacaucucuuuuuucaugguagauugauuagcaguacauauuuacaauguuuucuuguuuauuuaaagaguuauguuuuuauguguguuaauuaugugaaccuugauuuuuuuaauuaguagucaauaauuccugauuggaauuuauugguuagauccucauguauauuuuuaagacacuaugggguaaguuuaauaaacccauagucaggagacccccacagucuugguuggcagucuuccaguuuggaagucuguguuuauggguuuucuaacccuccagguguagcacuuccagcuguuugacagcucucacacaggcucuguuagcugucugguuguggguguugcccuuguggcuuggaaggcugaggaucagcauccgugucacauccccauaccuccccuugcugggucgcacuucacauuaacaagagaagcagcuaagcaagggcuccauggagucugaggaacacuguugucugaggugagagagcuugaagcugcucacauuggcauguugcuuacgguuccuucuuuuggaaaccaucuuguaaucaugguacagaaguaugaaguaugccagggauccucagaacagaaacucuaauggggacaccuuuguuauuguaguggguaagccuggcugcaaugaaaacugcugaagcgaggcagacagcuugugaugagcuguucaccaacgaagaggaggaguacagccucuacgaagcugugaaguuccugauguuaaacagagccaucgaacuguacgaugacaaggagaagggaaaggaagugccguucuucucugugcucuuguuugcccgagacacauccaaugacccugaacagcuccugaggaaccaccuaaaccaggugggacacacggggggccuugagcaggugaguuguggcuuugagaguaucuuaccccuaggccagccaucaagggguccuagaacuuguaggugaguucaggaauaaccugucugggugcuucugguccagcacuuccugagcuugcagccagggcauugaaggcuacaguauggaugggguggaggauuuccugcaugucucaauugcauaccucuuuguugguggccagaggggucauucaguuccucacuguauaggccucuccucaggucugcucuugguuuguuagaagcuacauauucucauuuauccuguauucuauuuuuuauaagcuacucacuaaaucuguuacuuacucaaggggguagugaaguucuaccuuuuuaaggaagacauuucuaagacuuauggacauaauuuauuagucucacccuuacaugguccuaggauugcuuuugcaaagugauggauaagauuaguucucuugccucucuuggaugcuaauauaauuuguaaaauauguuguuagcacucugugugcgugcuugugauuagcuaccaacuaaagugaccuuaagacucuggaucuaaccugcugcuuucuacuugggcuccugugccuaccuuuuccugaaaaggcccgaguaccaggacagaugcuucaagaaauagagagccaaguuggguuucuaugagucuuucuggcagauagaaaucuaugaaaccuauucuguuguuuugcuuaaggaguaagaaagagcaaacgacuggugguuauugcuaggucagaaauauuuaugauuacuuaagauaagucuuuguacuuagaauguagacugcuugacuccugaacuguaguaaaggucuuguggcaaagagucuaggaggacuugcgcuauacacuagacugaaauuaguccguucuaagacugcaacaguaugcaagcucugcugcaauggagaauccucuuuaaaaauagcuccuuuaaaaauacuacuuaaucaccauuaacccaucccuuuaaaccaccaguauagucuuaaaccauguuggaucuccauaaugaaauucaaagcucguuagugaucaggcuuccuuuuuuucaaccuuaggcaguuguacucugauuucuggguauagauugccuguucuggacauucuuggaaguggaaucauacguuaugugguauuuuauaaccaccauuuugauuuagcauaaugccuuaggacccaucuacguuuuagaauguucugggacucccuuuuucuuaccagguaaaguggcauugugugacaguguccuguugugugcacucaugugcuugauguguuuggguaguucuugcugaccgcugugaacauucauuggcaggguuguguguacauguguacgagguucguauuggguauauguccaagaacggaacugcuggggcagaugguaguguugugacguuuugaagaccacuauacaggucuagaguguaucucagugucagacacuugcauagcauggacgaggccuauguuugauuccuugcaucaccaaaagaagaauagagaagcagcugucccacuuuauacucccacacuucaucacuuuuccaugucuucaugaugcuuucgcuaucuuuuaaaaacucagggacguucagaacauagaccagccguuuaacugugugaugaauuaauuaacguuuaggauguucucagucuccauacguuucauuacucccaagggaaaccccucauucacggucacuccucugucuuugauuguauacauucucacagguaugauguauucguggcuuggcuuugcucuccucuaagggcuuaugacuuaauguggucaucggccacucauuuaucgucuuuggagaaaugucuuccaaauacuuuguucaauuuuaaacugaugucuuauuguauacuuuauuaaauuaacauuaaauuuuuuauguuccaaauauaagucccuuuuggauauguacuccauucuuuauuauccuucuugacuagguucagaggggaggagacuguuugcagcuaagcuguugccacucauugucugggauagugggugcagcucgguguugggccaucuuugcccguggcuucccucagaacacucauuugcuuuuccuucccagguugagauguuccuucuugccuaugcuguccgccacagcauccggguguaccggcuguccaaguauaacacagaggaguucaucacagucuaccccacugauccccccaaggacuggccaauggugacccucauagcugaggaugaucggcacuauaacaucccugucagagugugugaggagaccagugugugagggacacacaugugacugccaagagaugcgcaugugcagcuccuccucugggggccucagaucugcaggucuccaaggacaaucugggagaacucucgggccccuggagccaacuuuggaccauuauguucugaagacuagcuguugauaaugagaauuaauuagccaagccuucacuccuuguucuguuaugcaguguguuccacugggggcuucagcacgugccuuuggaaggugcaaacuaugucuccauaaggcggaugcuuuugggucaaagaaaacuguuuggaaaggaaucuguccaaugaaaguucugacgguaaacugguuuuacuucucuuuuuaaaacaguaguuuuguauuugauuuuuauucccuuuuugggggggaaugguggugauggcucucauucauggucuuccuaugagauaugcuuaaaugguaguguccuggaaugaguaguuacaauaucuuuugauagccucaucugcuuuuggagggaugagcaauaugccaauuacuauauuuuaaguagauugucuuagaagacaaagaaugggguccggcuggaagagguucagaagaaaguguggaggagucuagacuucauuugcugaggcuuugugcccuggcauugggagauccucuuugcacacgugcucuaguguugggguuguggguuucagugauuccagugucacucaaguucagaggugggugccccuuuuccugcuguugaugaugcuguguacugccgagcccauguaacucauccugugacaggauguaacacagccagcuaucugggaugucugcuaagcaagucagagcagaggugugugcuaagcaguccaaccugugauggagcugcucugcagcuaggaggcagacaggccagccaggguaggcauaagccaugcuccugacuugggcaagggggacuggggagauguucucaacguggcuugccuuggggccuuuauuucccuuaggggacauagccugugaccuuuguucauggggaccagacacaugcuucuuuaggguuccaucguagcaccugaaucaguuaaacauuuguuggugguguuauccugauuuugaacugauuuuaugauaguucaaauucuuaauuugacucccuuucauagagacgauaagcaauuaagucuuauguaugaaaacucaggauauaaaaagcaaucaggccuugguaauauuucuugcauugccucaugaguaaaaucaccacauuucauuaacuguuuauugaauagagugcuggcauccaaugcuguucugaaugugugugacuauguugagaggcauugugcugucacugugaccaccuaccugaggaggccccgagcaguaguuaaaauaggaauagugacuuaucguggacuuugacacuuuauguuguuccuuguugcuaaauagugggcaaugucugccauucauguuuaacaguuuuggaagcagaacuugaaauguuuagauaauucccagcaggagugaucucugcccuuugaagcugaccacugggcuuguaucacuguugaaguuuaguaaugcucuugguaacaccaugguuaucugcauuuuaaagacaaugcgaccuuagugaacuugagcugcuuucuuuauauuucauucuucuuucuucuucuugucugugauaauguuagguacaguuucccuguguuauaucccaagucagagcuucuugcaaaccugcacuagauuguguauguacaauacccaugggcucacucaugcaugcguucgugauggcagcauuagugccuuucacuuagacuuugggucugugugaauuugcucugagauaguugcacucaucccguucuccuguacagccacagacgcugucauuauccuacagaguaggaaugacuuaggagcuuuuucuugaaggaagauggcuuguccuuuuguuuauuuuuccuuccaaucuuaggacuuaucaaguaaaaucucauacaauaugaauugauaaggcuucuguuggcaggaugucuggauuuuuguuuuguuuuuaauugaguugauugguuuugacuuuuugagaccuggccaucucggacuuugaccugagugcugugauuacagguaugcgccacuacacuagacgaguucucacugugcgcuugugagcucuuauguguugaagccuuguucuuuugauucccuaagugacuuugugcaaucuuccuguccccucccacucacccugugaaacaguggucuuguuuuugaaggucuuuucgauguuucugaggugacagcacuaaugaugaaccucuaaugguggacacaugcaggcugccauacuuccugccaugucaucuucuguguaaagauuuaguugaucaguuuccuuauuuauuuaucuaucuucuuaaguauuacuuuguggguauuccccuuuauauauauucugaagggcagaaaauauuuuagaagcaaaaaccauugaagaauuuugcuuguggauguauaaaauagauaguguugcuuuaagauguauuguuucuuuaaaaagcaauaaccacaguaaaaauagaaacccuucaaugugugcaguucaucucagagaaacaccagaucaccagguuggcagaggcagagcacagugucaacuuuuaagaaagugauaaacugugaggggugagguaaaagguaagguuaaaacucucagaugauguauagcuucauuucuuuuucuguuacuauaauaaaagucucagacagaagcaacuuaagggaaaaggguuuuuagcucacugaucaaggauguccaccauggcaggcaagucaggagcagagagcagugagugcaagcuccugccugguuccuuugucucuauauacaguccagcaucccagccaggacaaggugcugccacuggaggcaggcgcacccaagacauucauuucccguggaagucuaguucucuuaagcuggcagcuaccacugacugccacaccauaccaugcaguggaugcccaacagaccugugcuuaaauggaaaagaggaaaacucugagugaaugugaaagguuaaugagaacauagucuaucaauuccuguccccaauuuuaaguccauuauuuuaaaauagguguaauauuuaacauuuaacuuuuaaaaaaucucguuuucauaucuuuggaggaacagggggaaucugguuuuagcugugcagcaguuucaugaaugugugaaguaaagagagacauucaugaaccacggaaggcaccacggucacugguuuaguguauaguuguccacccuccugcugguuuccccaagucaguaauacuaggagccaggagggauagacucugcuugugucuguguugggucggggugagcgugcacagcagccugcaguguccauacagcaugccuuugugcacaugcccuguagcugcacagcuugggaacucaccauuccgagaggauggaggcaaacugaucagguagcuguguaaacugacaacuugcuauuggagaagauggaaugaagcauauuuuuaauuccacauagaaugaccuucaaguguucaccguucauuggauugacugucacaucuaggucaucucuuagauguccuccuacagugugacuacucuaagagcacgcuggaguagucacgcugacuguuaguuaggagcacugacugaggaagacacugaccuggguucuuccagguuuaucucaguuaauuaacaucuugcuaucuuggguuuagguuugcaucaggaauuaaaucgucaaaacuuuaguuagucaagaaaagagcauugagcucaaaagauccagucuuuaucaucauuuuccuaauaaccauggguacuugagucuuaauguugacccucaaaaugcauuuuugugauuaguuaaaacuaggagaauccccuugaucugcauucccauaaguggugcuaaaacucugguagucaguccuacgagagaccacagcagccaucagaggcugcgacucgagguuccccgggggagugcaggcaaugaacuucguuuccuuucugcucugccuauggaaggccuuuggccuugucaccugcagcuuaguaccuuggggaggauggcagcccaguuuuagauucugccuaugggaaggugcuucccuccccuccccuccccuccccuccccuccccuccccuccccuccccuccccuccccgggguucaucaugaugggcgauugcacuaugaccucgcugugcucuugcugccuugaguagcagagccugcucuaaucucaccaggacauggcagccuuggucagaugcucacugcccugaaagcauaaccuugcgaugugggcgcuuuggggucuugcgucccacugugaacucaucucagaugccuggcuggugcggugagagucuccugucgucuguagugucucucgucuucaaggucuuucaaggucagaggcugagccuacucugggucuuugcuucugaucccuuuaacauacucagaugcgaaggauuauggaaagaacuaaaaauaaacuuagaaaauaaaacuuagaagcuuguucugcugcugcaguuaaaugucuacuuuuaaggacugugacagacugagacccacauguuaacuuuguagcaucccauuguaggccuguguuguccugagacccacucugacaucuucugccucuguggguagagggguuaggauuugguguguuguugguagcugaaguuagucgagaugaugugaccagcacagcaccuaaagguguauacgcugggcugugggucuggguugaaggacaguucuacuaccuacucuaagcaugaugagcugggcuuaaguaaguuacugacccucccuaaaaucguucuuuaucucagucgugcaguccuucucaggugugguguggauggcaugccucagauuuggagaaagacgcccucugccugcaaaacaggcuuccaacaacaguccuggugaguuugcugaggagagagagaccugcugugcacagaacagcuugcuuuuguuccagcugcuggaaaugcaccuggaagguggauagcaaggacuuguguggggcucucacagacagaagguagguaguggagaccaggaaaugacuuuuuucaugccuccugacguauaggaauggagaaaggggcuggagagauggcucagugguuaagugguuaagagcacugacugcucuucugaagguccugacuucaaaucccagcaaccacaugguggcucacaacuaucuguaaugagaucugaucugaugcccucuucugaugugucugaagacagcuacuguguacuuagauacaauaauaaauaaaucuuaaaaaaaaaaaaagaaggaauggagaaaggacaagcuccaguggcgaucuuguguagccgaggaacaaguagguuuuauaguuuuucagaaggcaugagcagugcuaugugcuaauggggaacaagacaaacaaaaagaaugacaagaguauuacucaaucuccugaguacgagagugcuauaacucgcugcugagcucugccucucuaaaguuggaaucugaggaaggagauggagccagggaucuuaacuuacauguacugcccuaaaccagccucauucccugggcuagaccaaggcuuagcucacggucuccuguuggaaugcauucagagaucccucuaucccucaccuuguucacaguucagggugucucaucaacugcuagacagggagggaugucauggaaaugggcgagaggugcaaauuuacccuguggugccugccauucuuccccaaggaaagccacuguuacuugggccagcgcaucucuguauugccuuuaggauagguagccaggugacuaagcucaccuugaugcuagccagauaugaagaugccuauaucccacauaccuugguggaaacaaagaacuugaccuccuaagguuucacaaaugcaaugggcaugaugauaaguauguauaaucagcauauggaaaguggaggcaggaggauuaugagucucaggccaucuuuggcuaguuagacuauuucaaaaggcaaaacaauaaagcaaggaaaacucccaacauaagcagaauagauguaaucaaaagaccaggaaggaagaaaccuccagucuuaaaguggugggauggucguaaccauagggauuaugggucugugauauuaauaaaacaacaaaacacgaggaauuugaacaacuaaucuuuuggguuauaauggcacaucuugaaaagcagggcuuuccugggaaagucugcaggcagggcuacagaugguaggaguuacagacucuucucagaccuggcugacauugggauuuccauauucugagcggggcagagaagcuggggaaggcucaaagaagacuaugcccaaagugguaggaaguaaaaagcaccauaaugcagaaaaacaauguaaagaauaaguuauuuagcuaccacaagaaguuuggaggaagaaaaccgcucgcucaccuagauuuuagcuacugaggguaaagggcuaaacuuaauauguaaaucugggaaacggggagaucuuagugaagguuaggaaaugaagcgacuggugaguaaaagacugguuaggauaagaggaccaagacacugagaacagccucacuuaaccagccccucaucacuucuuagacacaaagcuggagugugcagccugcucagcgguauuccggguaaaaucccccaagccucacaccaaaaacacgcggaugcuaguagcaacaaaaccauaggcaggacugucgaaauggcuucuauauggacuuccuuaggacaggauucagccaggaaauggaaccgacagcugcugcacaugugcaggaauaacuuccagagggcuucguuucaccaacgcagcagggaaaugcggguugccguuaacgcucugaacuugcucauuuucauuguguucuaaaacugguucauauauaaaaucagcguugcacccggaaggagccuggacuauuugagugggcagugcccagaagcgagaggugugaaaggcccugucauaggcccgggguuggagagcucucuuguguggcagucaggucuuugaagcucugacacuuuaguccuaccagcuauagacagucaucuuaagauaccacauagcaaagcaaaauaucauugauuaacuacaaggaacaagguacguccauaaaccuugugacagcccugggguaauacaccugccucaugguaacauggcugacacuguggagugccagccccugcuguguguacccugaaucugcucugugacaugaaggugauguggacuucauuuucagaagcuggcucaugcaaaccugggucuuauacugcagggaaccaaagucgaccuggccuaauguucucccguugcaaaagcugccugucuuggacccacgguuggaaaccuguguuuugggcuuuuauagcaaucaccacugugcaugacacaggauuucugugaaguuauacacaauucauacugaguaggguguaggaauggguucuucccccccccccccccccggucauuaaagaauuaaaaggcaggagaguuugaaagucaaaaccacaguuuauuugacauacaaggaccuggaggaacccucuugggguucuuagucucauuaagaguuuuauuaaaacaucaaauggaagcucaaggauaauuuuagaagaguuuuaaaagaaaaaucccagagcaagcaagcuguaagugucgggaguugccuagaggagaggggggaagaaggaaaaaccauguuacucugcagcaggcagccacguggugggaagggagcguucaggauaaagcaaggaacccccagcugcuaggaacccccagcugcuagagaaagcauacuugggaacaaaaaagggaaggagucggaccuuuuggcauagggagcaagcugagcuccauggcagcuugggcucgggcauaggaauucuggggagcaaaaguaucuccuuaaaggaauuuauuuugccuaucucuucaacaaggcugaaguugagucugccucccuaaaggugcucccaccucccugcuguggucccuuggcccggugguugaccugcugggucacauucacuccucauguuggauaacuuaguguucgauuuuugcccagaccagagauuuuuuacccucuugagcagaaggaagaguuuucucuuagugaguccucacggcugcuggguuggagcaguucugcucucauccccucucuccuuguacacuaaggacuucuuuuucaaguagaaaggcuuucgguucuugucuguggucucagcuuguauauugguugacauuguuuguacagaaguagaugucaagucuugcuaauaagugcauuuggaguuacuggcccaggugaaaagagguacuguauaaaagcuaacucuguccaugugugucuccugcauaaaccauccaguaagucuauccacgugugucugacagucaccucuaaaagcgcaucucccuagucagguuuugagagacccuguuugauugauugcaaaugcaggagagaaagauuaucauuggaccggaaaggcagcuuagugauucagaagguuugcugugaaaucacaaggaugagaguucugcucccagcauccacuuaguaagccccagggggcauggggggugucaaaggccagauucgugggucuugauggcuucuaagggccuccaucucaaaggagauaagacuacuacucgacaggacacuuggucccucuucuggacucuguugugugcacaguuugugaaucuccacacuaaaguguauauacgcaaagauacacacuaaguagaaauucugaaaaugaauuacuaaguuuuuguaagguacuaguuacaagucuggcaccacuugcacuuggcagagaauuuguuuccuuggauuuaggugcucuuccugguagggcaccacaucaguuaacggagcuaacgaccacccuucugucuugugguggggagaaugaaacuuaagguuuccuugucuucucauuauuuuccccuuugagaucagacaguaaacaaugcagugaguuguuuccugacuuguaaagugggguucggguuguugauuacaguccuguuugccucuuguuuagcuuugguguguuaauuuuagucaccagccuuugagcagggcacccaggccuuucuugagauuuccacuacauccuguuucaugugugguuagaucagcugaugagucaccugauguuuugccacuucgaaugacaaaaauagaggcucagaauaaccacacagagaagcagcucucaugguuuccagauacauugcugaaaaccgugcuuuuugaugcuucaagcuuuuuauaaaagagccuugugugaggcucuuguggaaaggcagacaagacacuggguuugcacagcuaacacugaagucaccucaccuucccaggucccaccagagauagcauuauuauacuuuugguuauaaaagugugugacaggcagcauugaaaacaacccucuccugguggagcacagaaggcuuagcuugccugcaguacccuaaaccagacacaaagcagcacaugguguucuggucauguucuauucagagcuuuacugaagcagaaaaaaguacaaggaaacauugcucagguaacaucauuucauuagaagaggccaggugugguggugcacaccuuuaaucccagcacuugggaagcagagccacauggaucuccgugcguucaaggucauccugguccacauagagucccaggacagccagggauauguagagugacccugucucaaacuaaaaauagauaauuauaagaauauuaggauuuccuauuuugcagcacaucucuugcucucgcuucaguauggagagaaaguugcugaaucuuggaaaauguuccuuucccuuugccuauuucagaagaaaauauuuucaaacagagcaguuaggaaggugggagauuggggaacuagaaucagagggagucuuuguuuccucucugaaacaggcacacacacccacucaccugcacuaagggagugguaaaacuauuuauuaaagauaaaaugcagucacuuuccccaugaccaaggccauugucucaguccugccacauccaggaggggcugcauugcaagaaagcaauaggguccacggaguuuaaagugcuuaaguacuuaaguaauuacugcagcucagaauaaguguuuucauuucugaggcccucucugaacauuuccaagccaaagcaugagcgaaggccaagaaacagauggucccaaccgagagaagagugccuuugacuccagaugcccaagcccaagcccaacacgggcagcagggagacacugaccagcuccaacccacagauacaaacaaggccuucgcaguggaaggaucccuggugaguucccaccaagccaaccgcaagccgcucacacucccggagcccugcagugggcaggcuuuguccuuccugagucacagcaguccuguuuacucaguuccagggggccuuagagagggccugugugccagcacccaguaaacaagggcagagccagcagcaggucaggugugcacuuagaaugacccucgguugccccucagauaaacaggcuucucuaguuucucggagaaaacccucacucuagaaaggccauccuaacucaguauuuugaggaaaacuugucuccugccucugcaacuuuagguuguauuugucgcuuaaccuugagaaugaucuucccacaguccuugaggauuucacagacaugguccuuuucaguuuguuagcugagcaauauguuuaaaaagaacacucagcugcugagcuagaaaggcugcccuuaaugcuuguggaaagaggagaaaggcccuucccaagucuaggccguggaauucuuuguuugaauacaacaguauggcagcugucucagggugucaggugacaaaacaggcccacagaauguguguggaggagccuguacuaggaggggaaggucagaacaaauccccccaaaccgcagcuccauugcagaggccugggccuggcacugcauuccaggggcucgggacaucuuacacagcugauguccagucauccugaugaaggcggcucugggcucuaagcuacaugucccaagugcacaauaaagagauacuagcuuuucuugacuuuaaagggaaaggauuucgaauuugauauuugguauuuaagcuccaaccccagaagcaugaaaauagccacacauuuuaaaaaauauugcuguuuaauuuucuagucauguacuuuaaaaagccaauacaauuaagacuuucaguuaucuuucagaucugccccugacgucacccacaagcagcuacggaagcacauaggauuuguucccauggugggcacauaugagggacacuggguaucuagaaauggaaaugcgagccuguguagcccugacagucuuaacaugagguuacacaacaccaaaauaauaagcacaagaggcccgccuuccgcccuuuucccuccgcccuucccaccuuugccugucuacaguaguggauccauuuccucccgagguugcccaucaauuggaucuguaggcccuuacauucauacacaagggacguguagaaggcuguaacauacagcggucacugguacaacccgaguaagcuguagguauguggagcaugaaggcaaucacugaauuguauuagagacauuuuauugaaaaugcgaaaauaggaaauguauuauagccuaaaauaaauuacauaacauauacagcauauauuuauaucuuuaaaauauuuguuuuguuuagguucuuucagucuaguuacuuugacuaaaucaggaauuuagugaacuguguccauaauuuuuuuuaaaggaaaaaacccgcuuuccaaaacuuagaaaaauauacugcacuaaguggauuuccaaugcauuauuuccgggguaucacauagugaccuugauacuguuuauaaaaugucuugcuuuaugguguggaggggaguaccauaguacacucgguuaccuguccugcagaaauaggcggcacaucuacaucagaaguuacgagacaagacccuggcauuaggaugcuagauuacgacuuaaagcuuugcucacugugaaaacgaaauggacaguuagagaaauggacaguuagaacgcuccacuucucgcucuagugccaucuucagggaaggcgaguaaacgcaagccuucagggaaacucaugcggagggugcugacacuggagcugcacuugcgggacagcucugaaaagucagcucauguauauacacuguggggugcggcaacucagugaaaccaggaaaacaaugggaugcugacgaucaagucaguuggugacugacccaauuucuacaggagauuaaauucccacuacguuggcccagcagggccaccagcccuuccucugggaacagggagacugugggcugcagccuggggcccaccaguaugugcggcagauaguucaugacuccagagccacaguguuggggagcaagucaagagaggcugagcuucaaccuguugauucuuaggaggaggcaaacaugaacaggaaaagucuggcccaaguccuuugguuccaaaguggagauuguccaagggaguagaaacguugaccaagaggcagcucuaucuuuuggguuuuaugaagcaggggcgugaagucagcgauucugaguuacaaagcgacaguaaagaccuuucuucaggucccugcaucggugagcauacccaguaugcuagagaauuuauacgaaaccucuaaaucaaggccucuuucauaaccaagaauaaaaauuaaacaacagaaaacaacuugaugggaggaggaggaggaaagagacgacaguuguuguccugacugucccugcgguggcccccagcagccugugcuuacucauuuucuucucucaucucuacgaugucugugaccuccucuguuggaggcaugucggucauggccgagucuucucccucgguggcugacucauucuccaucuucuuuuucuagauuaaaagaagacacaucacaguggggaugugggcaggacacaccacacacugcugggggcgggaggccacuuuaugguccaggcugaaucuagcucaguacgcuccuuucaccguggcuguucuuauaccugcuguaugcuggguacuguggggaacucugucccuuauaccuuugcugacaugcuuuggaaugcugccccaaagccacacgcuuucucuagaguaguccuuucaccugugguuagugggugucccgccccucugacagcucuggcuucccucugcccuguggaccgcguauccugauuccugguggccucacugacgagcugcucagcagucagccggcacucgggccuccccagguccaugcagaccuuguguucucgaacucuguggcucuuccagcacguuccuuucaggaccugauucccaccaccgcucugugcuucuccuauggcucagccuccugaagccucucacccaucccacauugguuuaauuguaaugcucagcaauuauagucaugucuuuccuugcuuuucuugaguccuauuuacaagauuaaacccagaccucagauagguccaacucugucucugcuggaaauugccagcauggcugaaggacccagaagaaggccugggcugagcugcccacugcagggagccggucucucuguggcggggcuuccacacccugcucuucccagcugcuuggucuuccgccuggccucuggccuccucugucuucuagccuuccucauggcccuuccuccggggcagcuugguuuuccacuuaauugaccgaagcauaagcaagcagauuucccaugacuauuccccacauuuaguggaggcucccaucucccaucuuaccugcccacucucuccagucuguacuuggccaguuggcugugcugugcugucccuucucccacuagugucccacucacugggucagucuccagugcaguggagcuuuaccccccuuaacuaguuuucugaaguuuccuuuauagcccucugcccuuuacuuauggucuucaacauuuucacccuuuucuccugaccuccauggccccgaccccucaagucuacccuucacagugaauuccaucaucugucugucccugggcucuccuucccuggucucuuagcaguuguguuguuuuuauguacccugcagcacaaaaguauacacauccaggcucugccuuaggcccugucaucucuguugguuuccucucccugguuaaucucaucuaaguggauaauacaggguuucugaucccagagaacucacaaaucauggagaggaaggaaaaaaaaaaaaaaaaaacaaacaguuucugugcaguuugaaaacuccugccuucaggacagacuagcucugugcugucagggugagggccuguaaugggcuggguaugguguagaagggacaggguggcugugcagaauuagaacagacuuccuagaauagagcugaugagggacauuauuugcgaaggcagagagagguuccgauuguccccaaagcugucgccaucauuucucaccuguuuucgauagacauagcaugcugcaagggcaaccaugguagauucucccacaaacccugcuagaagggagcccacaccuaguguggcuccgugcacccugcaaaggagaacacaggcauguuuagucuguuagaaucaagucugacauaauuaagcugaugauauugcuuaauccugagaacaaugcagaucagcaagggauggcacaguaguccagccauuggccucaggacaguaucugaugaccacccaccuuugaaggagaccugugccgccuuccuuccauuguccuacacauuccucaccacaggaacugaaccuguuuccaagcuaguauagaucucagagacucacugguaugggccgacaagcuuccuucugaauuuccagucuaauacgcuuggggcuuucacuuggcuaugcagauuuuaauccucugcauaggguauuuuacuaagccacacaucuaugccaaaugcugcgaacacgcaccccagguacggcaggaccacaaggcuggugaugaggacgaugaugcgcagcacggagcugggcgccagcacaaagguuuucuucagugucaucagccauccagugagaugagcucucacagucacugaggagagaagggugugucagcugugugcccugcuuccacccugcccccucccacccuuagucuggcccaggaucucucagccuagcuacagggccccagguauggucacuugucuuccuguuguugcucaucccuacuuuggaggcuaaccggggucaggccccauuccuccucagcucccugccuccccagucucaugucgaggaggccaucugcagguaagggccuugcugcaccaugauaaccaccauucugguggcagacgucaucacccugcuguugucugaggaaacggugggaaaugcgaaugaccuuguccccauugcccaccacaccuugagucaaccuugaccaccucacucuuaggcauuggugccacugcucauucuguaugucgcuacugcacaacgacagugcacauauuucccacccugccccuuaccuggcacugggaagaaggagaagauacgcagaggaaugacacagaguucugcaaaggcaaaguccacuccaaugauaucuaucagaaucuucucagagacguuggggguccagaacaugacaaaacagagcugcaggguggggcaggacaacagucaaccagguuguaaagaaagggcauaaaggacaugacguggucccugcguguucuaaaggaugguaaaccugcucacugggugucaccggcaucccagguuugcaucuauuugccaguaucacggguggggacuguggguggcaucuauccgugugcugcacuugccccauaggaauagccaguguggcaguccacuguggguggugucugagugggugauuggacuaggaaaggaaaccaccucgcuuucacugaggcuuagccaggguccuccauggcuuguucggucaguucuggguagacauguccguuaaugcagcuuuuacagccuuggcaaaauacuagacuguaaccucaaaguaucuggaugguauacgccacacugacauguagagucaacugcagccugcugauuuuuaguguuaggaggguaagggaagaaacaacagccgcagaacccagaacuuggggaaagcagacggguaaguauggaagcuuagcagacucuagaaauugcaaccuuaaucugacagaugcagaacucacuuccacuuccuuucccccagauuaggagguggggaagcacagcucugggaagcuggcuagaaucugccuguaagcaguucauacccuugacagcuugggauugugucccuuaagcugucaucagacucucaucucugcauaaggaaaguuggugccugcaaggcugagggcagaguucugaggaccccaggcagugggacauguuguauauccucucgccucagcucuaaaaacacaggaaacuaggugagacccagagguuagagaccagagcagcuugucauuggccaaagaaggaucuggaauuccugaaagucuugggcucccaaagaagccgccuaagcaguaagagucauacaagugacagagcucagacagauuagcugugcuaauguucacagcucuacuuauaaacgugaauacacaaucagugguccccagacuuccacaacagcuuuaaggucgaaacaaaaggaacuaaagacaaugcagaaagaaggaaaaauaaaaaaccuuucuaucaugcugacauucucagaugggcgaagaaacuguauucauggaucaggaacagaauagaaauguucuagagacaugcauggaacacgagcgagcgagccagggguuaggaggaugaagcuacaucugagaaagacauuggcugacacggagucagaagucagccacaggacagagcugacaacgauagagugagacuagaucguuuuucuuuugaucaaauaaaucuaauauucugauacuaacaguuccaaaaagagggaacagugacccuuucagagcugaaagaggaauuucaagacugaaaggcuaccuuuaagaggacaguggauggaugagaagagacccagcagggcacaucaucaguaguacuggggggcagagcuggcaaagcccuccaagagcaguugucaaggcgaguggauuucuccccuagcauucgcaauccaacugucaccgagugacauuuagaagaaagaccuuuucacuacucaaggccucaagacagucgccuucugcauugguuacuuagcuucaguaaaaccugacagggacgacuuaagggugggcuugucuuagcucaguuugaagguacagauggucgcuguggggauggcaugggagcgaguuugaggcagcugcugccgcggcauccagugagcaggcggagaugaaugccacgagcagcuccacuucucuguaguucagccaagggucccucagcccacagaaugggaagacacacguuuagggugggucacuucagcucaacuaacaauguagagaaucccucagaggcaugugcagaggacucccuuuccacggauccuagauuaugccaaguugacaauauuaaccaucacacccuccauacacacuuuuccagaauguuaauuagggcacaaucugccaaaucaggagagccagggaaagagaaaaauaccuugacaggaacaagggggaaguugucuggggaacuccagagaaagauacagagcaggaagugugaggugcacaggccagcaaguuacacugcaggugggacgaaagacaccugcugcgccugacuacacugcaagagcuuuacacagacacaacauggagcuaaacaagggcucaggacucagaaagcugaggaaaaggauaauuacuaauuguuuaaggcagggaaauaguauggcauuuaaugacuuuaaguaucaggacuuggcuauuauaauucaucaaaagaauuucuuauaguaucauaguucaucaguuacaaacccaccaggaggagaaauggggcuggguugggguggguggcgugccuauaagaggggacagggcuggaaagaggauggaugcgcaguagcuugagacauguuaacugggagcaauccuaauuuaacuuuaacuuuaauccaacuuuaacuuuguguugauuuuaaaagccuuaauuuaaaaacacaaugacauaacuuuagaggguaauguuuaaaacaggccaguuccauccaauacuuaucuccuuuuccuaaacuacaagcaagucuugucuaaaauaaaacugaauauauuggagagugaguugcagucacgugaaaacagaguaccaaugcauuguagcaccuugguuuaaguuucauggaauuagccuggccacagcgagucguuacaacaacaacaacucuuagcagaucaacacaaguguuuuacuuuauacagucaauaggcuuuuuccggugucucaucagcaucugggagcagagucaaccggccuguagcagcaggugcuagguagggauucauauucaugccguucugagucccucagaucuagcaacuuggagcuugggaacuuuauuacuugaauaacauggacaaguggccugccaccuuuccccauugcugguuuuaaauagugugauaucacuugugucuacaucgcagacaugacagcaauuuuuaauaacucccaaacagcacuggguauggugcugaagacaauuuaucccucugucuauaccacaucccagcaucagauuaaagaucccucuuucggugcugcuucguguuaggcccuaaauauuucccacagcaguaaagcuauaaaccaccccucaagucugccauggauccgugcauuggaucuugccuagaugagccauucuguguuuccuuaguggguagaaugugucacaggggccauauucugcacaaaacucagacuucccagagaaucauuucugugcuuuuuuuuuucaacuagagaugauaugaacaugagacaaugccucaaauacaaguugcaagcucucuaggcuuugcaaaggucauuguaaaguggauuuuaaaucacaacacaccaagggaaaggaggguguaacugcaugucagauguaugguagaaacaugcuugugcagcaagugagugagggaauuccccacucuggccuuuccacguggaagaugcucaccuugaagucugcuguuuuguaagaagugaucucucugggggagggcaguuaauaggggggcagauaaggagcaugacccuagguugucaaccauacacacuugcagggucuagcucucugucuuaggaacacugaaguuaaaagccauuguuccagcuagcagaaggccaucgaagagcaggagcuguacauuugggaggccucuuucucccucucucaagucuccgaagccagaaacuucaggcuccuacuaagaaaauggugcauugcuuuuuaaccagucuuccacaagggaauauuugccgaacucuccaaaaggggacauguaaacaacugggaagcaaagaguguuugcuaaaagcuaggacaccaaccuucaggucagguuucaugcucuagcguaauaaucagacccaguguuucggaaaacuagaacgggaagcucacucaacaagggguauuuuaggaaaugucauuguaccgaguucaacuaguguagcuguaacucagaacauguccuccugguugaccaugacaugcugugcucaucaaauaucugcagaggccacugacauugacuuuuccacaccagaaugaaaaccuaaugaacuacugacaacagacaugauuugugugugcccuggaguagcugcaggguuggguucgcuucugcagaguuugcugucaguaucaucucauuaggaaggagccuuggguugucuauucguugucuaaccaaaggacccaaagcuccuuaagaaaacucagucucugacuagagcagggaauaagacuaucauuauccuggaagaucuagagugcuaggaaggaaggaaggaagugcccagaaugaaaacaauaggacaugucaagaggacagcagagccacuggaguccccaguggccaagacaggaauaugagcaacacaauaaaauagcuuugauaugaccucaagcauaaauugagcaucuaaagcccauguugacacacacaaguaagggggagaggggacuaacccgugugggauccuacacagccccuuaccaguucucuccgugugggcugaccaaggaccaaucaugucauggcacacagagagggagagagcugccaaacaucaucacugggccacgugaucagcaauggggaggucuggcuaauggaguuuaagaggccagcuguucccuuagccugucaguucagagaacacacaaagcuaccuccaggacaagagaggugcauuccuuguuggguguccucagggcucugcucuguagacaguauggcuuagugacauggcuuuugaaguucccuaagcugaugguucuacuuuugaggaauucacaaacuuuucuccauggcccagugguuaaaaugagcagugaaggaaagauucugaucuuuagaagcuagaaaaaaguaaaaugcaugcaucuguccuggaguaaaauaccugcuccaacugggcacggaggcacacacacacuuuuagucguagcacacaggaggcagaggcaggugaaucucucugaguucaaggccagccuggucuacagagcaaguuccaggauacccaaagcuacacagagaaacccugucucuaaaacaaacaacaacagaccuggcccaaggcaucacuguugucuagagcauuuaucagaauugcagugcagcauguggugggguccucccacuaggaggaccauacuucuauacacagaucagguguuauggugacucgguguuuccuguaacuagaagaguccugcccgccuggggugaauuccugccacucauucuucauauuuugcuucugggcaagaaugccucucauguucuagaugggaucuugucccuuacaggacuacugugagcaccauccuccuuagagguaccuguguguggaguugggacugguccacgcugucauaaggucuaacugaggaaggaaaucaacgagaaaguguagccaacgacuugugcagcucgccaccccugauuggucaaugucugcugcuaugguuccuauggcuuacuggggguccaacuggcaucgauaguggccucgucuagauacacgugggauuaggauugauuucauuucccuguugauaguuuccacaaagaguauugaugagaaugggcgguagaauuugacuaggcagagauauagauaaaaagaccauaaauaaaaguaaccaguuuauuucuuagccuccuugcuguaaacuaggcaugccaggaaaggaaugucuauagcaaaggucuuugguucugccauggccagaggcuuucgagggcaguaaggggccuguuauuuccuuaucucuuuccccuaaaggagugcucuuuccagaaaagcacacuaacgucaggugcccagcuauucccaccuccauccgcagcaguguggcugguggcccuccccucccaggguccuccugcccagcucugccacccccacccccuucagcucccuaugauaaacuccuucuuccuaaaaucccuccauguggccugggaacugcauuguucaaguucacaagacaagaacugggcuuccuggacucucaccuccaacuacacagccaacgauaccucaaguucaaagacaccaugcuauucccugucaauccccgccacccuguuagaaacagcuuuaaauacaacaugccccuguuuaugucuuugcagaaaaaaccaagugggucuucauauauguuuuaucagggacaugagaagucauguuugggagggggcagacaucaaaaggaagcuaagggcucagcuccaacagccagcaucuugugugaacaucucaguugagaaggagaaagcaaugcugucuuccaguguggaaauaccaacagacaacaguguaugaaacacgccaagacggaguguacaucagcgcugucagaaugacgggagcgaggcuggagugagccaucugcuaaagggugaucucaugaaaagccaugagaggcagcaccugaaagggcagugagagaagguggcuuugguaggcaccccacugggaaagagaaggacacaaggaagaaaacccagguagggacuucuuauguaagaucaggcuggcaaacgucagacugcugaaaauaauggccagcuguauacaucauagaguaaacaggucuugguuuucuauucugaagcacuagaaaagucacaugauaagaugugacgugucaccugauauucuccauccggccugcuggcaagcaugguuauuacacauuuaucgugaauaaucuguaauaaaugcuaccauuuucuucuaaaguguauccaucgugaagauaaacaccuucagauguaguuuuagcaucccucuuuuucuacagaguaaggagaugaaagucagcccuccgauugagguuggaugggaugaacucauucuucuugagagcccuguugucauuucugcuaugaccccagauuccugauaagucacagaacacugcuuggaagcaaggcgacauuucaaacagcagggggugccaugcaccaagcagaagaggagcuggguguccggggccugccagcuccacaggagguaucuacagaauguuccauucuaguccuuaacaggucugaaggaugucuagaaagguccacaugcuagcuucaguguagcuuuucaguaaguagcuuuucagaauuuggaacuuaggggauggggccuaaugaaaacacauucaguugguugagaguucuguggaugcgaggagguaguacaaucaaccauaggaccguaccucacuguaaagucgcaaugggcaagaugcuaaguuuguauuauguguauuugacuacgacuacuauguuuucaaagggagcugaagaaauggaucaggauauaaaguuucugcuaugcaagcccaagggccagaggucagauaaccagugcccaccuucgaugccgugaagacuuguuggcuaccaggagucucagcccuugggagcaaagacaagggauuucuagugaaagcugaaaugaacaaaccccuuuggggguuagagagcuggcuuaaugguuaaaaauacuggcugcucuuccaaaagagccaaguucaauucccagcacccacaugguggcucucaauuaucugugaguccagucccaagugaucuugugccaucuucuggucucugaggguacugcgugcauaugauguacagaaauauauuuagguaaauaccaacacacauaaaacaaaaauaauaaaauaacuaaaguauccaaaguggagagcuauggagcaggacaccuaacaucaaccucagcgugaacacacaugauuaacguguaucugcauacacccaugaccacacacacacacacacacacacacacacacacacauaaaugccaccaaauucugagaaaaggggaaaaugauaacaauacaacaugcuugaucaucuguuuucucacagcacauguggacaugcacagucuauuacgaggaaggcauggagaccaguuuucauuguuuggaugccuaagucucuccagcccaugagacaaacucucggcucugcaggggcugcugaauuaacaagcccuacccugacagcucccagagaaccgggcgggcggggagggaaacagcucugugcaacagacucugagcaguuaccccaggccaagaacuuuccauguuuuuucucacauaguccuuauacgauucugggauggugccucugucacagaugcucuaggacagggcccucuaccaggccccucucccuauuuccaggaugccccaaggcacuggaaagaaccgcauccugacuuggucugagaacgccuggaccucuguccauuuaccuucuaccccuuccccucccccucacacaagggaggcauuuucuucugcuggauaauggaacagugaggaagcagucuccaccucaugguucgagggagggaccacagcagaaacaaaggcugacacaggcagccuuuguucuagacaaagggucagcaugguaccaaggcuaggacaggccccagcagucacccuggaaggcugagugacagcugcccaggaggguaguuuagcaacagggagguaagacugggucauucaugggaacucaacagcuaaucuggacaaagaggccacccgaacagaaccucugauaguggcuuuuaaccuuuaacaacuuggguguugacauuuucuaguuugugggguuccagaagagacaagccucacugaacugcagcuucccugggaugcuggggugacagcaggugguccugcugcagccagcgcgggcacaugcugccucuuaaacaagaguagcagacaaaaagggagucaagccaggcagcccuugaauuacagcaagccacucugagauggggaaacugaggacgugggaggccuugcagacccggauuccagcuucaagccccuaagaugggcauuuuugauccagugucucuguaucaaccaguacauggcucuccuagggaaucagacacuaugaauaccagcauguaggugaccuugcagcuuuucaaagguggaggcgaauccuuggagcccaccaauguuggaucacaccaaaccuaucagcguuggcagggaccugugacucaaaagagggauccugugucaaaggaaggccugauagugaagauuucccucuggacuaagaccuucagaguaccaaauuucuccuccacagggcugggugggccucugcugggauggcacucacgugccuucugacaucagggcuugacagaccaaccagcuguggaaugagcacaggcuuggauuggcagggcccccagcaagugccugucuacccucuccucuccagaggcucccauaucuaaaauuauucaggcccuggcauccugcaguagcaacacauaccaguuuagggcacagugcugccuuaaagccagaaagagugcacagacugcaugaagagggucugaaggccucaccagacaggagggaugccgaacaugcugugauaauuagauguucggaggcucagaucaugcugccaacuugcggaaagacgcccaagugacagccaacuuuaggagaugccagaagcaggaguccaguaggaucccaaacgaggacuccaggagggaccggcuggaauauggcugccugggucuugcugggcuuggccuuagucugguggcccauggcuaauuuauaaacaccugcucuuccacauucuccuggcuguuguguggucuucacagagggugcucugugacaccccgaacaugggagaaaugucaagaugagccuugacugucaaacacgagaacauuugucuuaggacaaggaacuaaaucuuuguauuuaccucaucuuguaagacuucaugcaaauggucaauccuccucacccaguaaaacauuugcuuacacaauuucuauccuaggaacuugacaggagccgugacccuuuucccuuugagcagugacucucuuccuauuccucuuuccugugcaccaacucuuuccacacaagccaagugaguaagauugugagauuagaccuaccagccaauggggggaaggcucagccaucaccugaccagccaacgggguggggguggggguggggguggggguagggaagcucagccaccaugaccagccaaugggguagccaccugaccagccaaugggggaaggcuuagccaccaccugaccagccaaugggggaaggcuuagccaucaccugaucagccaauggggaaaggcucagccuauguccucaagggauacacacauaguacuaaguccuauguacacguuuucuugugccuagauaccuaacauaguacaauuuauaaauauaaacagcaggcaauuaacaacuaauaaacuaguuagagucuauugcagcaaugcacuauaaaaauuaugucacgguggucucuuucaaaaaugucucagugaacugugcucaccguucgugugaugaugugggauaauaacgugcuaaggugaagggagguaagugaccgaggccuugaggcaccgugcuacgauaacucaggaauaugguauguacaaaaucacugccauaugauauagcacuggccuucaaccgcacacacgagacagccacuacuaaaggaccaccuagcaugcucacgugcugcuaugaucaaauaccagagagauacaacucgaggaaggaaacauucauuuuggucacagcucuagaggaucgggucuaucauggcuggggaggugugcaggaagagcaacucccaucacaguggccgcggagcagagagggacuccuacguuccagagauuucucucauucuaucugcggccccagcccacgucacggugaugcuuaaacucaggacaggucuggucuuucucccucccuuucucucuagagaaacauacucccagacacacccagaggugugcuuuaauaaccacccagguguuucucaagccaccgaagcugacaagauuaaccccgacagugacuaacacgccuguagugcaugcagggugguaacacuggacaaaggguagauucauguacugggcaggaauaaacaagauggcacgggauuucacucugcuauucagaacuguacuuauaaacuuucuggaacuuuccauaucgugcuuuugcucugugguugaccacagguaacugaaaccacagaaggagaaucugcggcuaaggagggcuacuguacuuuauuuuuucucuaaaguaccuguuagugccuguaguuagagguauaaggaccacccagagauaauacacaccccuuaauccccucaacuaguaaauauacuuucucugguaacaggugugauuaaaugaaggccugugaagcaagacuaucuggguggauccagaaugcuucagguucuagcugagggccaaugcacuccacagcugucaguuaagaucccucuccacacagaagggcaggccucuggcagcucucagggacuggcaagcagguuuucuugucauuugccacauaggcuguuucccaauacugucauucucugggggcucagaagagacgacacaaucccuaagaacgauuugguggugcuguucagaccucuuacuugagucugaaaaaguggcccaucugauccagagcucugagaacagcacccauggaacaaagcccagggcaccucccucuccagccuggguucuaagggcagcugcacggggucaugcugaggcccuggcuguucaagccagacaccccgucugcugacccaagacggugcugaguacuucacauugucccugaccaagagaucucucaccgcagcaaagguuccccguggcaucuuagccuuuggaccagaugcccagggucuuuauugagcuggcuuuaaccuaagcagccgaggaugagcugaguuucugauccgaucuguuucuaccuccgccaugcuaggauuauaggcauaggucaccacucccaguuuguguagugcagggguguggcucugugucgcuagggaagccgcucaccaaguaaccauauccccagcccugcauuuccugguuucuauguagacaggcuggcuucaggcucacgaggagaucugucauuucugcaccaccaugcccaacaaguuaauaugagagagagacagacagacagacagauacugacuuucaguuucgcuggguccucaccugcucugagcaaggaaaucaaucuguuucaggcuuccaaggggaggggcaaagcucuuaccagagcagcggccaggcacagcauccuguggucucucugacaguucucgggguuucagugggguuggucccagucccuucuuccuaauacuguucucuuaucugcuucccgggauggguuugggguuuguauuuaaauuguucuaauaacauauuuuuuuuuccucguagccacagaacaucuucaaacaugcuuccuggaaguauauuaauuaucuuuccgcuuccucacucucggacaagccaaaggguuccuggucuagcuacuuuucucuaggauuauucuggucuucaguauuaaguugaggauaccugugcagucuugguaggcagugccaugccguggugggugaugugcugaaacauaaccuccacugggagacuuuaaguggguggauguauaauuugaacaguguuucagguggggcuucaaggaaguuauugguuagaguggacccugguuggggaaagaccaaacccaagcauaaacauaccuccugucuccugcuauuugaggaccuugaccacagaauucugagccaaaauaagucucuuuucauuaaaacguaccaaauuuaugggccauguuauuagcaauuggacauauucuaauacauuuuguaaguuucaagacaggaggcaggauuuugcaaggacccaguggaaguauacuaaaagaauaaaaacuaagcaguuaccuaaaucuaaucuuggggacuguugcucucagauuuacacaaaccaucagccaugacacaaugaagcucccaagggcaggccgagugccuccugcaggcugagugcagccccuguagaggaaggugcagagcugccugcagucugaguacuuccuaacuaagugccaaagaugucauauguaacuaaagagauggaagcuggagaguggaagucugaugagucaaccuuguggccucaggugaccacaaaaagauugcuuucuuggaggaacaucaguagauuaaauugccaggguuacagugaccaaagauuuacaucuggauguuuuagagcaauaggaagggacaguggcccagguguaaggauacaauuaggaugggugaggccaggccucuacagcaggagaacucaugauagccccaaaggcuucugagucugcauccacauguucccuuuuauaagaacaccagccacacuggauuuggggccaagcuugcccauagaaccugaaccccauuuccaaauaagguugccuucugggacgggggucaacauugcagcauaugaacagaugcacgucgucaacccaugacaaauagaggagaaaaucccaggcauguucauggucucccuccuuuuuauuaacugagagaguuaacagauaaacuacagcucaggcaaguaaccuaacugauaccaguuccugcuucaggcccucgucuucaccacggcuccggcaggucagagugacaucgauuuuaacuucguuuuguguacacgugugugcgcaugugugugcagccaggaguguaugugcagacacgggagccacugguuaacagacacugucucucaucacucuucaccuuggcuuuguccucucugaacccagagcuggcccauuuggcuggacccgcuaggcaguuagccccagagaggugucccugccuguccuucagaccacugugagcgccugugcauggcuuucaugugggugagaucaauaacuucucuuugaagaaccagacccuaaauuccaacagguccugagcucagaugcccuuguaucuacuauggcauuccaacgggucugcuucuuccucugucguagguggcagugacauacucagcucacaccugccuucuuccccaagcagcucugacuaguugaagcugagggcuugguucucaugugaacaaugggauacaguguggaggccuggcaguccuccaaacuuggcaugacccaagugccuuugcauuccacacuugcauucuuaacaugggucagcucaccaaaacccaaccuuagccaaaaaacauuaugucuaauuuacugguuucuaaacuauacaucugcagaaauucaucugacguucacaaccuguacuggaaaggcucacagcaucccagggagugggggagagcuuucugguuugggggcuccucacccugcuguuuuaugcacaccuauaccucugucauucuguccgucuucccguggcaaccucccgucucugacaaaucgaccguuccucccucucaccaucuuacccucuccacugucuccuccccaugauccuugcuuucuaagugucugacuuucauggggucuggcauucaggggguguugggauggcugcguagguuguccacugcccagaagugccuugccagcuccaccugccaagauccauuuggaucguugccucucuccacuguguacaaaggggccagagaaggcccccaagucagccaagucccugcuuugcauagauucuuuuccacuucuccuggagaagaggggcccuguucuuggcaccagcuccccaaaacuaaagcaguggagaaucuaaaaagagaaaugcccagugcucuuaaagggccauuugugaggucagauggaggccagucuacuguuagcagccgaagcuguuagagauccucuguucacccacgauuuguugagucaggaagaguucaaaggagaagggauccccaaacgagauuugaauuaaugagaagaauucuguaaauuuagcagccauaucuacuggcuuuuauggagcuggccuagguuguggaaacaggugcucugacaucuguuucugugacaccugugccccggcaguaugacugggaagacaugugccacucuggugagugauuuuuuuuuuuacuucagccccaaaucuagagcccaucaggaaguaugacaagcauugugggcaugcgugagggagagcuucgugggcaugcaugugguaaaagcuuugcagguaugcaugugggagagcuucaugggcaugugugugggacaguuucgcgggcaugcgugugggagagcuuugugggcauauaucaguaaggauuuucagcccagguuagccaguuccuuccccagcaagagaagucucccucauugccugcucgagacuauccucuccucaugcucacaacauagucuaucgagaugaacagccuucuaggacucacuaguugucacaggacuuaauagucacaaaugugaaagcaacuguggguucugacaaaguggcaacuacacacauggcuaccuauucuuuguguuuggcuccguaucuggaccacuaguuugcacuuuaaccccuccuguauggcuacuguacagcauccucacaagcaaacauccccuugauacaguucuugugaauuuuuguccucuuuucuuuagauagcagcuuguggggauccagucaaguugcuaaucccagucuauucccuccuuguucuuaggggauuaauuaucuggcaaucuacucuuuuggacugggccuuugagacccaccaaagauuccaaaccuuucuuuuaucucacugaucagguggucugcagacuagacuguucuccuaugaggcaugaucggaagcaugaacagcaggaugcuaacauguuacagcagcaaacgcuguuucccugccucacucuccuccugaauucacuuccucacacagagcaggccccauagugagagguggcagcugauuggcugauucguagguuaucauggauggguaauguagcucuagguuauguagauuugcuugugaauggcaagagagucagacgaccaguagauguggaagaauuaaugugucaugugauauuacaaggcacacacacacacacccugacaguuaaagguucgguuuagaacaaccuaauuuuacauuuucuacauaaauuuuuacauagaaaauuuagcgucaacuccuccagccaagauguuggaucaacagacugaaccgagccacaaauucaaauacugucacuuauaauguaaaaaaaacucugugcuuggguagagucacuuauucuaacuuguuucuuuuucugaaaauuaaaaucuuuuaaauccucaucuccaaaucuccuuccaauaagggcuucugcauccuuaugucuaagguggucucacaccgagagaucugggauuaaacauaagaaaucaacaucugccugggagagaguuauaaguauuucuccagauccugucauuauuuuaaacuugcuaaagaucaaguuuacagagguucaaauuauuggccaugaaucauagugaggaaggcucuucuccucucaggggcgugggguguccuccaucacucaagcccagcuaugagaagguauguccacauaagagaagguagguugagccuucgagccccgaacuguuggcucugagcagauuaggcucagucccaaaaucuggcuucaagucaucuuuugacuccaagucauuuaacagucuccaaaagcugaggucuguuccuggaacagaaacuucucugguuuuuuuccuaaaaauacccuuuugaguaguuucaaaguuguucaauguuuugcuaacauuuuagggaacuauggaaaaacuggcacaccauaggaagaaagaaaaaaauggccaacaggagaacaggucaccuggggucacuggucaacuccaacuacagauguagucagaacuuucuuccaagcuaggagacuuggguucagugugugucaccccacuucacagggacagguggcugacagguaguguugguggugauggggcuucagggucugauguugugacuaagugguuccaaaggcuuucugugauuauaugucuuguguugucaaacacgauucagauguuggaccagacuguaagcuauagguugugaguggccccuggagguuugaagcacacucagggccugcuucucaaggacagucaagcggaacaguucugagggcuauggugaacggggcagucacugucuaccuguucccaggaagaugccucagcccuugguccucugugugggcuguucacgaugacugcagaacgcauucaggcagucaguguacaguauacaguauacaguauaaauggauguuaaguuguacaggacuucaggaguaguauagccaaagcaacaaaggaaaacugagcuaaguucaaaagauuccuugaucccuuaacaaucucacggcacagcugcugugugaguuggcuuguuguuccuugccuuucgccaguaguaagcgguuagacugucagucuuagauuguacaguauguccuuugacuucuacagcauguacaccuucccucacgcuuucugaaaauugucuuuccacgugggggcuugguaaagcuaggauguguuguuuccuuaagaauguacauccagacuccugggaggcagaggcaggcaaaucucugugaagucuagguuagccuggucuacacagugaguuccaggccgguuugugcuacauaguuagacucugcuaagaagaggaggaggaagagcaggagggggggaggaagaaggagagggagaggaggaagaagaggaagagcauguauauccagacaccaacagcucccuguuguccacucucagacacagcuguguccucuguacuuauacagacuugauggggcucaggagaggcccucauaauauggccaaguaagucagcuguaucaguacaauguaauuaggaaagccauuucuagagaaaauauacuaauucaauuauggaugggggcaauggcaucggcagagcugacuugaaguuuuaaagaugaauuggagauucuauagcaagagaauagcaccagcuggagguacagcucccagagaaaguuugccuagcaugugcagugcucuagguucaaguccuagagacaugcaaugccugccggguggcauggucugacagaaggucuggagucccagcacuugggagauggagcgaucccauagggcaggcugguuagcuacaguagcugaaucaucaggacccaggauaaaugagagacccugacucagucaauaaaacagaaagggguccaagaaggggauauuuauacaaacaaauauuauucaaauuuaagcuguccccguugaucaugucugugggccugauaagcaauguaaauacuuccauuccuagaguccauggucuugaacgacagucaugaauuaagacagccagguaucacacugugggauacaggauucuuuccuguaagaccacacucucccucuuugugagcacacccacucaccccgagacagagagagcaggggcucuuccccauccccacucucugcuuaccgucagcgacagcgccaugcagacaaaggugaacuucuugaugugggcugaggugaccguguugcuuguguucgccaguuuauugcugggguuauucugggggaaagagaaggacagcggugacaaggcgggcuuauccucagcugagcccccagaucacaaagaacaccuuguuuuauuugacgugccuugaguacugauuucaagugacggcucggaagauggcugucacgcugggucucugaagcggcugucgggcuccugcccagaaacauuaaccagaggggacucugggcucuuucaguccucugcccuuggcaccaggcugccaccucacccugaagggccuuggcucugaaggcuguuuccugacucauguguccccuuuuuggcuccagcagacccugugccuggcuaccagaguuggugucuccuuaaaugccauggcucacugaccucuggggauccucucucuuucccaaaggaauaaaacucaccuugagcucguacaggcugcucuguaccccagagcauuauucccaccugcaccccaaacaggcucccacauccaggccuuugucucccccccacccccccguuggauuuucagguuuucagaauacaccucuucugggugcacauccccuucccagccaaucugcuuuugaaagucucucuaaccucugacuuagauagcuucuuggucucccuacugauggugcaggagcugccuauguccauggaccucugcgauuaaauaccgcaugucuggcccacucucuagcccagagaugcuuugcagagucuuucuuaugcagaacagaauaucaagggguguuggcuacacugagcuguaagaaaagccuguaagcaggugauucauguauccucucacaugacaccaagaaucauagugagaggggaaaccugcugccaaccaggcucuaacuaagaggagcuuuacgcggagaaaaucagagaagcacccugccucaucauagaucaaguuagcuccagagccaaggaauggaagcuauccaugacaccuggcuccacagcaguugaaugaggggaagggcugaugguguugguggugaggcaaccucacucuaacacaugacauaacucacagcccaugugccggcuggugugagaacucuucaugcauaugagaacaacacauccacgucucugcagauguagcugaagugagcugacacagcaguaccugacuagaguuucauuuuacuugccugaugagcucuuugagaggcaacagcaaaaaaaaaaaaaaaaaaaaaaaaaaaaagaaaaaaaauagagauguugcacacaugaacacaugguucauauuuagccagaaccacuacaaggcaugugaaacauuuuaaaucucuuccucuggagcccacaaagagguugaaaacuacaguagucaagacagggaacguugaggccacacagagaggucugagguacuggaagccagauggccuucccaaucauggcuugugacugcucacuggaaugugucgcaacaaugggugagguuuuaaaaggauccugaguaacuccaguuucuggccagagguaggcucauuaagaaaaaaaaaaaucauagcuuguaaccugugauuaaggguaagacaauguuuguauuggguguucuugcuaaagacauacagggugguauuguuaaguuuuauuauuauaagguagccaaaaccaacuucagaugggacggccccagccaacagcucaccauuucagugccugcucucuugucuguaaguugcauuaaauaaucuuaccuacuaaagggagaacagaaauuuagcaaagauggccggccgaguugguuuucuaggacucacuacacauguguuccuugaaaugaaagcggcaauccuaucuauagauugcauuaacucccuaacacaaggucuaccucugaaagcaacucggacccucauagucucaggggucugugugaaucaaccaaaaacacuccccaggagaagagcucuccaugcgugugcugcauccagauguguauaacugguggugggugggaaccaacagacugcugagggaaggccucagcagcacaguccugcguaagaucacuagcccaucucauguuaggacaccuggaggcccugcaggugagaggagagccagacuuuaugaugaguguguguacccaagagaggaaggggaaagggaaaggaagaauaggaggagccugggcagugugaaagaaugcugugugcccgcuugcaugcaugugcuugugcacugagugugcauguucagguugggggugggcuggcugacaguggucuuugucuacacuuggggaauaccugggacauagagugugauguugggauggaagcaguuggguaccucucuaggaagcugugcucuacaagucuggccuuugaaaaggaggccuauccgaagaaggcauugugagcauuccaaaguggguguugugagccuggccuaguuugcaugacuucauggguuguuugugcccacaaaaaguuggagugagggcuaggggaggauuguagggggcggugcugaugcuaaccuguuccccaauugguuuuugaguugucaguaaagaaagcugggggccgauugcugggcagaaaguacaggcaggaccagagaaaaaggcaggugcaagagaugucugccaugcucuggagggaggagaacacagugaucauguuaggacucaggaggagcuggggccuguggccacugcuauaguuggguagucaaggauguuuggcaggggcuaggugggacuagcuacugaagucuagggcagguggcaggagcagagauaaaaacauuauuaagggcacacuuuuccagguaggagauaguaacaccuagcaauugugucauagggcaaguugaaaaauaacaaccuguaugcguaugugucuuuugucugauuauucaagggaagccggguggaggcugguagcaccaucaccucccagaguaaaggagggcagagcuuacaacuacacgcaacagaggagagggagcaggugcagugagaguuaaguagcagagcccagcugcccauuuugagcugcuggagagcauggcuggaggccuuucuccccauagucacuaggggauaagagaaaacauaaguagcaacggcucugagcgacugcuaggaaaaaucagggcagagcucgcuacaagugucaagcugguugcuccucuuccaccuuuuucuuuuagaacauuauauaccauuauauauaaauaguaugccuugcuagcuauuuguuucaauaagagagguguaauuaaguagacauguauuaaaugacaagccggacaguccccaccaagccaaagaugacaucagaugaugccuuccucagagggaccaucagucacaagaggguggagaugcuggccacugaggguucuggcuaaacuggagaguggagguacgaagcuggagagaagaaaguugaaguugugacuccaacuccaaggggucugauggccucuggccucugagggcaccuguauauaucuggugcacauagaugcacacagcacauacauauacauaaauaaauauaccuuaagaggacgcccaagcaggagacaaguccugcuacccagacacugugcacaucucccugcuacagaaagacaggcaugugaccucauaggaggucaagccccugccucacacauccacaacuuuggccaucuagaacagcacccacaagguaugacacagacuagacaauaauaagccacaggaacaaaguccaacaagcuucauucagggguugcuuacuuucccucuugaaaaugcccacuaagaggaccaaugugaccagaggaagcccgauuuggaaaagcauuacagaaugcgcgacaagagaaagcccacuuuccuccuucuccgaggaaagcgcccuuggagaccccuguccaucaagcggcagcauuaugacgaguguuucugacaccgugccauagaggucucaccuugucaaaagcaggguagacagcccggauuucugucaaccagccauauggcauaugacccacgggguagguggcugucagaauggccacugccuguaaggaaaaaacagacagcguaagugugggcaccagcaggaaguccuccaggaucugccagggcacgugacaagccuagagguacaucaguccauguauccacuagucacucgacgguccgacacagaguggaaaggauaccggggagaugaugccucacacuacucugacgaagaacaggccagauccccugcugaaaaagccaagguuucgauccagccuucucagacccuagaaccuuggcucuuuccauccagcucccaagucacucacaaucuuacauaguguucugcaugcgugugcaguacgcauguguguguucacauauguguggguacauguguugcauguguguggugcaggccaggcugacacuggcuaucuuccucaguugcucuccaccuuacguacuaagggagggccuccgguucacuuggcucaucgagcuagcugacuugcuagaggauccugcguugggauuacagauggaagcuguugaugcggacucggguccacaaugagcucuccccucaagcccuauauggguccccaaacaacaccaggagcacagucguagggcagcuccgcuucuccaccuccaugcugccccucagcacggcacacgugcuugucagugacuccgugccacugucccuccaacgcaacacauuuaaggcugcuugguccuacagguccaacucaacauuuuuacucagugaaaucaauauauauuucauauaggaaaggccacuaacagguuuccaugcaaaggguuuucuucuccugcaugaaugaaaaggagaaaaaaaaaaucaaugucuggcaucuacagcuacccucuggcacuugguguucuaacucuguggaagaggaagccaggcuucauuugcuuuagcggacagagcaacugcacaguacacaagaacaugauacaggccacagcuaugugaggaaacuuggcguggcguggcguggcauggcauggcguggcguggcauaacacaagagagcaucaugguuaggcaggccuagauccaaaccuccccuuugcuccuaugugagaugggaacuuagacacccaugucaguuucuccgcagaagcggugcugguaauauuaaccacccagggcugaugggaaaugacuaaaauccacaugagcaccugcaguguaagcacacagcguggccccaucagcucugguccccaugagcugagcuucugugccauagcuggcaauuuggaaaugccuaacacagaaucuguccucguuuguuucauccacgggaagauggaauucuaacgaacaaucaauggggguuccauaggcuucucuuggaaagucaguauuugacugacaaagcugccauacuguagcagccacccaagaugacaucugugacuccgauaccgaaguccaggaacaaacaggggccagagaaagcauucugcuuuugauuuauuacaggcaucuucuccuggccaacaggagcucuucccaggacauggaaacuggcaccgaugcucugggcuggggagcugcugacggugcagucaaggccagguguaaacaagaggccuuaaugagaagccaccagccuuccuaaaggaacagagaugccagcuacagaauuaauucuccagaaggcaauggaggaggaaacaagugagcucacuccguuugaucccccucucgaaaaaaggaacggaugagucaaccuucuggcggaacggcagccaguuuccagacccacuuccagagcuuugagugaauacacacaggggacccucgucaggaggaauugauugucaaagagcccauagguggcauggcccagggacagagcaggugaggcuagccugggucacuguggaagcucugggcacugcuagaauuccuacaggcuugucccgucauccuuugcagcaacagugaaguagcugcaugcugacagcaauggagugcuggaagggccacgggaagcaggucagggagcuagaauggccucaccaucccagccucuagcagguucuguccugucuucccuuucuuucuuuuuuuuuuuuuuuaaagauuuauuuauuuauuauauguaaguacacuguagcugucuucagacacaccagaagagggcaucagaucuuguuacggaugguugugagccaccaugugguugcugggauuugaacuccagaccuuuggaagagcagucggguguucuuacccacugagccaucucaccagccccugucuucccuuucuaugccucaguuccucaugugcuaaaugagaaggaugaaggcacugucuuccauagucacagaaauggaaaauuucaaaagucaccuaaucauggcuuccuuugucauugugucauaugauuuagaguugccugagcucuugccgugaacuggaaaggaguagguaucuuucuaucuccccugacaugugcccacgugcucacagaguucccuaccucuguagcagcagagcugccaccaaggucccgggacacgaagagguugacaaugggccgacugauucgcugcguggccaggaucagagccaggggccaccagaagcucagcaucuuucuuaugguugcaucacccuguuuugggaaacagaggucaaagcucguuagguuccagaaguggaacagaaaacagccuaaaaaccaaagccuguccuucguaugccaaucaauagcaacuccauuacgccucacaauaacauacagaaaagccucuguagacaugccaagucgaauuaaaauuaaguguacagucuuauuagaaauuaauucagacagcuggugagcuacugugaaaucaaagcacacaguagaugaagccugguggauccugaccauuguuuuccauaugcagacccagccucucuacaagguggagcccagcuccagggccccagaaagcagguuucagaugaggcucugugugugucaucacaguggcuggcuugaagccacaucagugggaguagcucugagaaauaaaaagcuauuauaaucuaguuuggaaucagucaauauauauacaaaugugucuaauuacuguagaacuaccuagcucagcugcagagacucccgccuccaaacccuccacaggagccacacacacugagcagaggccuaaguggaacaaaagcacacugaagcacaaggcaggccucaagacgucuacagccaaggugugcgcuaccuuucaagcucagcuucuguugugaaauuuagguuuuguuucuuaagaggguaagaguuacgucauggaacccucucaggcauuuugauuucuuucucuuugcuggaggcagaagaugaagggaggggaggagggggagagagagagagagagaaacagagaggcacaaagagauagagacacagagacagagagauagagacagagagagacagagagacacaaagagauauauagagacacagagacagagacacacaaagagauagacagagagacagagagauaaacagaaacagagacacagagagauagacacagagaaagagagacaggaugauaaacagagacagagagagacagagacugagacagagauagagagauuaguccuaucaagauaacuguggcuggccaagugguagaaauaaccagguaggauuucaauaacaccuugaccuagaaugagguacacagucaacacaauuacuguugugacaucaugaaagcauugucugguuaagcuggggccuggggguggcauguggucaggguuagacaugacccuuccugccugccuuagagcuaggugguaggagaaguaugcgugcacacaacugcacaugacucgugaugggaaagcucgggcacuccuaacuugacucuuaagugaccuuuaaggcccgaacuucuccaaagaggcuuccuagaccacauggccagagugggaggcccuuagguuuuuugcaaugcggauccuguuuugaacucauuuaggucuguccauccccccacccaccccaccccuaccucugcaauuguugcuccuguguuggccuuacuuuccuauugaguuagaggccaugucuuaugacuucacgacacccuauaguaccucaagcucugccauugcauacacuagcaagauuuugcugaaaggacccagauuacagcugucucuugugagaccaugccggggccuagcaaacacagaaguggaugcucacagucagcuauuggagugaucacagggcugccaauggaggagcuagagaaaguacccaaggagcuaaagggaucugcaacccuauagguggaacaacaauaugaacuaaccaguacccuggagcucuugacucuagcugcauauguaucaaaagauggcauagucggccaucacuggaaagagaggcacauuggucaggcaaacuuuauaugccccaguacaggggaacaccagggccaaaaaaaugagaauggguggguaggggagugggggggaggguaugggggacuuuugggauagcauuggaaauguaauugaggaaaauacguaauaaaaaaaauuaaaaauuaaaaaaaauaaaccaguccagaaagucaaacggugcacgcacccccagcucugggccgcuccugucggggaugaugucguggauguuccuguaguagcccaggcacaguguggugcagcgcacaagcgcacccauguacagagacaggauggggaugagcagcgguucucggcauuccaggugacugugaagcaaaauggcuacgaaaacaaccugcgagagagcaaacagggcaggucagcagagugaaagcacgagguucucagaggucaggccacccugcacccagaaacugaugcagagagcuaacuccauucugaucuccugggacccagaugcaaagcccccgggguugacuggggaucgcagccaugguucuguuagaucuaccauuaagagucuuuuaaggcaguggcacuucuaguuaagauuucuuaccaacuaagaaauaccuagaaacuuuggccucuuagcuuccuccccaccggaggcuuuuuccacaccagaggaaaaacccaaggcagucagugaaacacaaggggggaugggcaggaacaauuauaggauaaacacccuuaaaugccguuccaaacaccacugggaacgacgauggaacaaccugaauuaaaagauacauaaaauacuaagcaaggaaaguuauuaacguauuaacuacaugugacuacaaugccugcuuguggguccaguuagagcccuggauguccuguacuuggaaguagcaggcuucauauuuaccauccacaaaacuccaaaccacaguggugaugauauucagagguugaaaauggguugugcgguugguagaaguaagugaccguagucagaggagacugaagucaugaugaaguguaaaucucucucuuggauggcuccguccugaaaacggaguuuacagugcauccugcagacgccagaaauguggccaacuucaacacugcauccucagaacauagaggagcuccauggauacucagguaugagcaggcagcugagagcaugggcgacuugggcagacacaagcuggggagguguucacugucucauucacccagcgucacccacauuugccaugccaagaggacaugcuggggugugauggaaguaaggacccccaugguguccccaugcuguuuugagauggaccaaaggcagugagcugaaagauaugaagaccagcaagaggaagccuugcugggacacagugaauggaugccuaacuacuugcuuugcuaacuagacaggccucccucggaugcccuuuuaugcaugcuucaaguaggcuauccauagcaagcucuacauuuuugccauccacauaaagugcucuguaaacccuaguggugguguguagagccugaaaccugauugcauggggggagaaugcagaacucagcauguccuccaauccuuagcugucagaacagaaaccugaggagcagggcuguggaggagggccuggaccagagggagagaugcaccagagaggaguaagcaugugggggugacuagagagcagcagccccaugcaccacaagggugacaggugaaugugguccaguggagcucccaaggccaaggugaagcugcuauaucagccucccucugaaacuguaacagacugaagcaugcagcccagcaccagccucaagccuuaucucuucauggaggaccacaccauuuaccaacucaaauaacaccuguguacucugcauucuagucccgaaccaaaagcgugucccauuaugcucaggaggaaccugccguguuaauggugaggauacucuucccagugaaaucguguucuggccccaggcuagccccgguacucagugagagagagagagagagagagagagagagagagagagagagagagagagagagugagucagucccagagugacuucacagggcugacagggaggggaaggcagaccugugcaggagacacgcugaaaaggaaguagggaaaaaugggggcagcgaggggaaaccguccuuccaagaaguggcugugugauaauaaagagaaagacagaaugcagcucaagagauacacggggcuccagagaaagcugcuugcugcccuuguguuuucuggguauguggauguguccagacaaucguccaaggggacagagggucacugagaacuaacuaauaacgcuccugagaaagcagcugaggugcagguagagagggcagccuugaaagaccucaccucuccgaaugaggggacauggaggcuggagguuuaaguuugcgggacaguggccacaagaaaagaauguggucgcuucaguuuccucugugaagugggaaccgaggucaucccgugggaaguguaccgcagcuccccagggucagcucaagucaccgagcccguacacuuugcagccagagcagguacaagggucagacaagguuaggguguugccaaaggcuaugcugaaagccagcuaugcugagagguucucagauggccucagaaggcaagagugagcuucagcagagggugggggguaccaggaaggacaaaccgcuucaggagaacucucacuucgaugcugaacgagcaaagaaaaccuggguggucauggaaaaaaacaaaccaguagcauuuucaucaagucccuggcauugucacugacugggacagcuggcacgagagucccguguggagguggagagcagaucacgugccucaacuuguacaauuggguggacccaucaacucuggggcaauuuuuguuuuuguuuuuuuuaauauugggaguugcuaguagaguucuuaauauuauucagcaguuuucucacugauuuauuuucucacucguucacucguacuaugaaggauccugggaagagcuguuccuuccauggaagcuucugcaagucugacuagucagugagauauggagaagaugaacgaccacagacccggggccuaauuacaauuuauccagggccaccuuuagccuuguaauagccauuccgugucugccucucucugguccugauguccugacacuaacagauaaaaccauuuggaauguauuaaaacaaacaaacaaacaaaacaccacuaacuagggcaucgacggcuuguagcugagucccccacuucgcuuugcugcuaccugacugcacaccuguucccaccaaugcauuuagaaagcaucuugguuuaugaucuucucuguucuguuacuauaaaaacaucuucaaacuaguaccacacccggcauggaauuuaggguaaccuaaaucuguauuccuccaccaugguggcccauauuuagcuucagaauaaacuaucucuagcccuuuggggaugagaguuguguuuuugcauuggcagcggcaagguagauaguucaaagugcuuugcaucuggccuguuuacaaacgaucagauuaguuuccagggacguuuucugguaaugagccgagauaagcauguuggggugggggacugggaauggggggcagaagagaagacuuacgaaugaaaauuauauuuauucucccaaacaaacuguggcaggaacgcaaacaacaagguuuaaaauaacuaccaggaacagcccggggccagacagcaucugaaccuccuucccuuccccuaaccagacuguuguuuccaauaagcaggggccaggaucaaguuggaaaugaaggaggaaaacgacuguaggcgugggguaaagucuuuuccauaagcaaguguuuuuguuuuccuguuccuggaugcuuacuauauuuaucucaggcagagcuaaauuccucucccccacuuuuggcuuucuuuugucuuugcgccuuugaaauaauacacaucuacacacucccgcugaacggcugcugcuguuugaaaggcgagccguuucucucacuucaaauuaaauaacgaguggguaagacggcuuaguccagcucucagaggaugcugagagcaacacugggacaaaucucuaauagcuguacaggaaaauuaacaagauauaucaaagaaugaugcuagcugguguucgggcgcacacccccacauauguuagcaggaaucauuuucaauuacuuuuccuagugaucuauggaguaaaugcaauuaauuuggaaauuuaauucuccguccuuagggaggcagaccuagcaguuuaaccagaugauuuccaagcaguggcuuauaggugggguguacggccgagaggaaugcaggcacugccuuccaguaggcggaaugggggaugagaugauagccuaacccucccuccagacacacauuauucucaagccccaccccaccugcauagcugagcugugcucauacugauacauuguagggcuugcauccucuucccagagauguaagaaagccggggcuagugucagcccugagggcugggacagugacggguaacacgagccuuccucucagacaaguggucagacaguggaaucaacuuccggcuucauuuuuaaaaaacguggacaugcuggcuaguuuuaugucaaccucaacacaagcuaaagucaucugagaagagggaacgucaauuaagaaaauccccgcauaacaucuggucugcaggcaagccuacagagcauuuucuugguguuugauggggagggccuagcuuauugugaaggguaccaccccugggcugaugguccugaguucuacaagaaagcaggcugagcaagccaugaugaacaagccaguaagcagcaccccuccauggccucugcaucagcuccugccuccaggauccuacccugaguuccugccuugacuuccuuugaugaugggcuaagaugugcaaguggaagccaaauuaacccuuuucuccccaacuugcuuaggucacuugcaugguguuucgucacagagagaguagcccuaacaagacaguggggaaaugacgugugagagacagaacuucaugguacccacacaagaagccauguugaagaaucaucccagugcuuuugcagucugaggcaggaggcucaggguguucaaagucggucucugugugugugugugugugugugugugugugugugugugugugugugugcgugcgcgcgcgcgugugcccucacuuguguauucacaugugggggaccagagguuucugugaauauccuucuccuucacccuccaucuuccauucugagacaggucugucacugaaccuggagcucgcuguuucagugagacuggcuggugagaaggcccugggaucaaccugucucuacacccccagugcuaggauuacagacaaacaugcuuacacauuguacccaggacuggcguucuauacuccgguccucauccuugcucagcaggugcuuuacccacugagccaucucaccagcacccuuaccaaucacugcauguucccacaccucggaaacgaugguucaggucuuacagacauaacuuagauccgaacaacuccauccuagugagacuggacauacucugaucacaccauauuaccuucccucgcucaucaagcaaccacgggaauccauaugggaugcgagcugagugcugggaagcaccccacagacguaacuguaaacaugauuccacaccucaguuccauccagccacacggucacucugagaagcugggacagacacacagaccauaguuaccugagcuaugacaucugagauugaggcacaucccaccaggaaacuguauuuguguuuuaagagaaugccagcaugaguccacgccugccggaaaaaagagaauuuucagugagacacagcuuggauuaugguguuucuggcauuacggcuuaccagguauuccuaaaauacucucuaccccuaagggucauagcaguggguuugccaagccuuuugcugauauaaguaacuucaucuggcggcuagcuucgugcuagaucagaguggaugauggcacacacuuauucaguagcacugauggggagguaagcugacugguuggguuggguuggucucuguggcuggaagcugacugacuaacaagaggggaggacacuagagcccccggagcacccuugaucccuaaauuagcucuagauuagagcuaagguuccaaggugguucugagagacugacgucauugggucaagagcagaucagggcucugaaagaauguggucuccuggaucugagcugguuuugugugccugaaggaggcuaggcagaagguccuaaaacaggcaacccgcagcucagccagcagcagguggggagggugaugcucgcuuacaacagcaucuguguaagaacuuuacgucuuaccucaauggccaaguagaccgacagacugccgguuagauuucugucaccuugacacaagcuaagguucaucuuacaagagagagucucaaaugaggaaauagcucuauuagaauaugcuguaggcaagccugugggggugggggcgggagaauguuugauugaugacugauacagaacgguuuggcucauuauacaguuccacuccuagacagguuggccuagguuguauaagaaagugggcugaacaagucacaggaaguaggucaauaacuagugugccuucauagucugcuugguuccugccuccagcuccugccuuggcuugcucagugauggacuacaaucuggaguugugagaugaaauuaacccuuuccuccccaagcggcuucuguccaugaucuccaucacagcaacagaaagcaaacuagaacacagagacaugugauggcgccugagcagaacaggauggacaaaucuccaugccuagguugagaauuuguguagcagcggcugccuuuacucccuucuccagcuccgaggucccaaccugucaaaugguuuuguuuugcuuugcuuuuuaaauguagcuaacauuuguaauagcauuuuauagguugucuuguugucuuaaugccaucuggguggaaagcugcaugacuucuagcaaauaucuccccaacuguguuauuaggauagugcugcagguauauacacgugcaugugcacauguacagaugugugucuaggugaaugagggagagagguucuuauaaaggcucauuauuacaaaucuauaucuaaggauagcuagacauauagguaguggauagguaguagauagauagacagacagacaguuagauaggucuagaagaauucagcuagauauagauaucaauagauugguagauggauggauggauggauggauggauugguagguagguagguagguagguagguagguagguaggucgguagauaacaaagccuaggauaacucagauagauagauagauagauagauagauagauagauugcagaccgauagauagauagauagauagauagauagauagauagauagauauagaugaaggauggauggaugaauggauggauggauagauggauggauaagguagauagauaacuagaggucaggaccaaggucuaaacauaaaauuuguaguucuuauacaaagaaucugaaguaagucucucuauauaguauuuaaaauauuuuuaugcaugaaucaguuucucacacaugaaauuggguguaugauuucccagaugugguaccacucagggaacuuuuggauuuuugagaucugggucugggguuuggagugagagaugcuuaacuugugcugagcuuuaaaaaugcuguuguggcaaauaaaacagcuggcaggggccagaaggcaaagcaucuaagagucugcgacagccuucuacgacaagucaugcguucucagaauucacuggguaguuaccacucucuguuuagauccucucugccagguuucaggaaggacagagugacaucacaggcucagucuguccagcucaagcuuaacccguucagcaucgaggccugacucgagaagcuccaggcuccugugcacaagugugaggaccauaugcugccuugccucugaccugcccucggguucaccucuccaucagcucucaggggcaacacagcuggccaaaguagcgagaggaaaccucucacuguccgcugcgcugcccacugguggcccaagccucccaccaacaguaauuaacaaaggauccaauggaagacuuuauuauuagccacuacauguuguuaacuuuguauugucucuguauagcuacaccaaaaugaauagaaauaagccucaucuucacuaccauggacacaggauucauuaagguucuuggucucuaugauaagacugguaaccuagugaugacaugucccaucaggauguccaggagaagcacaccgugaaacccauguguucacaccacacaaguggcaaguguagcccccaucaccuggaacugaaaucaaccaugaaaaagcacgugauaaccgaaucagaauguucaauuguguuuucuugcugucugcuauaauguguggcaaauauauauauauauaucauaaauugaugagagacacuggcuaagaagcccaaggaaccccccuacacuguagguaaaaccgauaaacugccgagggaaugagcuuaaugguuccucaggaaaaaaauuaaaauuaauuaaaaauuaacauauauauauauauauauauauccccaaagaauuuaaaguacggacucaaaaggguauuuguacacuuguguucauaauuuuaaucacaguagccaaaaauggaaacuacaaauggguagauaggcaaaauguauuauaucuacaccaggaaacauuauucugccuuacaaaggaaugaaacccuggcacauucuguaacagagagagaacacugacaauaucuaaaaugaaaucagccaggcaggagagaacgaacaaugucugagucccccgugcaguacuuuaacauagucaccuucacagaaacagaaaguagaacgcaguuucugggauagggcguggaacgggaauggcugucacaugcagagaggcccuggaaacugacugcguagaaacaugagugcucuucuacuauugaaccagacacaccaaaaaacuuagaauagcaaauucuaugauagacgcacuugccguuaagaaggaaagcccacaguuuccuccacuuaccauggcauccauaaaagggaaggcagcgagauacaggaaggcccuucguguuuugcuccccacagacucauccacaugaugcagcuuguugaugauguaguacccuaagucacuguaggcugcagggaccaaaacaaacaugguauuuagaaaaaggaagcuuacaugaauuuugucuagaaaacuuaaaguaaguuuaaaugucuuaucugccuuguuguagaaaagucagaaaagcuauaagagaauuauguucaaucucauucaucuacugggggcgggcguggcuuacagugacccgguacuuuuauuagugugugaggcaagcauaugaguuucaccacgcagaggaggucagacuauaugcucccuauaaaccucagauaucccugaaugauauuguccuacgcacugaaagauguuuagugagcugauuuuccucuggaccugcuaagucuugauuuacccaacuuuuuauugugcaccugugauaguauuuggauauuaugacggaaugcuggaugggaauaguugaaaauaaauacuuaaauacuauuagauauuuaccaaaagaaaacuuauagaauuuagcgugugucuuccucacaaguuuucaagugagcuuuugacacuugccagucagugcucagugccacuucuugggaggagggugaccaaugcuagaauuguccuaugcaguagaaagugauaugcaguugguauucuaggaguccugugucaagacuugucauggugugaggcugaaagcagagaacauccaacacacacauguguggguuguauacaaacccaacaagcaagagaaagagaggcaggacuugaggaccugacuccucaaaagggcaggcugugcuagcuuugaucucacugacucaggcuaagacaaagcgaauccaagcucugcaaggcuuuccacaugcuaccacguggaaguuacgcucuacagcugugaauguguaaacaugugacacccagacaggaaucugacacaagcgagcuaaagggaaaaagaagagccaccccccaugccagcauuugaggggcaaccuaucuccccacaaacuagucagcagagauaaugcuccaucaucaggaucagucuugagucacaaggcuuuugugauacugcaaccuugaaaguggccuuuaggaaggaaccugagacgugucacugggaacugcagaggucauaccggacaagagcuguguucaggggggggucucauguccagagagcaaggcaggguugaggugagaaucaagagacagcuacagaggugaagacaggcgucaggaugggagaguggcaccucugucaaggccacugaggugcaagaaagggagcccagggagaggacauccugaagcagacaaggagcaugaggagaugagacuacagcgaggggcgugaaggaggcagcugugcucccagcugucauuuggaccagaagcucugacagagaugagaagcagacagguggccugaacugacccuggaaggcagcaugagagcuuuagucugagucuguagugagguaagacgcacauucagaccagcgcucagcggauggaaacucaaagcuuggaugcaagaguccugcaucucacacacagucuacgcuggggggcagagccauggucucuuaaucacggacacuauuuacuuguguauguguuucuaugcaaucgacagaugcucacuugggcagggucuuucaaggagaccccuacucuggcagaaacgccuguaauaaaggcagcgauggcccacgcaagagcacggggcugcuaugaauagcugcgaguggaaaucccugguaaagguuacgguccauggagcaugccagcugacaggaccugacuaucgagcugauacugaggaucaugggagaggggaaggcugugggccagaacgguggugacaugagcaaaccaugucucccugaagcucaaacaucaaaauccuaaccccuggaccucagacugugaucuuauguagcuauagacuuauugcagauauaugauaaggucauauaggaguggguggguguccaaccccauaugacuagugaccuuguaaaagggagagauuggauucaaagacagcuauguauggggugugggugggguggggaggggggugggaaguccuucugagggcagagacucaaugacacagcuccacaccaaaggcugccaggaaagucucagaaccaaggagcuggcagagggcaagcuguuccucaacgugcuuagaaggaaacaggccugucuguacuuugaucgcagacuuguggccuacagaccugccagaccguacauuucucuccuuuaagcugcacggucuguaggauuuugauacagcagccccuacaaaugacugcagguugguuccgagcaaggugcuuuuguuuuagacucuggggugguagaugugugcggcucacagcagggcaugugaucugcaccuguugccuggccauagggaaauuggcagaugugagcauccagacacuugcaaucauguauuuucgauaaagcaacaagauggagcuuuuuugguagggucccugggguaaacagaaagaugaaugacgacauaggcccgugggcuucuuaagccuuucucucagcucugucucuggaauguagguaccgcauuauucuuccaguuccagggccugcccagcucccugggcccggcuucaggagcaucugggauucguggguccaaggguuaguuuucuagcuucuacuuuagaaccuuccuguuucagcugcugaagagaaaaccugggggccaaagacagcuuuucuuuuuuuuuuccagauuuaucuuuucuaugguagaggaaucugauuguaccucaguagcuguuuccacccuagacauuguguguauaaaaucccgagaccuguuugcaucccauuucuccuguuccacucucucgugccagcuguugagcuauuuccaacccagcugaagcugguggcuguggugauuuguguaagaugcuuugcauauagagucucucucuggugacugcucuagcugccuuggcaauguucagugagcuucagcuucuaaccacugccuuaccgagaguguuuucuaaccauugccuuaccgagagugcccuguaacaauuaaacaacgcuuuggaacagaugcaagcaggcuucaugacugcaaacagcagcgggacacuugcuugaccuaugcccuggucggacgcuuuaaaccagaucaaacaaagggaggaaggcccuaaaaacuuauagauccaauaaccucagccaacggaggacagcccauuuugcaaucaguuguucucaaaccagcagggcuaauaguuacugguacuuauugcaaacuauaaaauacucacuucaaugaaaggcaguauacaaaagacaacugaggccccaucuacuugaguaaguuauaauccgcacauuuccaagauguuaaauucagaacaccugaccuaauucaaguuccugagguaucaguguguaaaagccucucuaggacuauuuacugacccuuugaguccuacuuaugaggccuuuguaggagcgugcaaguucauccuggguuucuaauguauguauugcuuccagagaguguguacuuacuggcugauaaaucacauuuaaaucucuucgacaaauacguguugaaugacuuauucauaugaggcaccgugccagucacccagcugugcaggggacagcuuucugcaugagggcugggacacugacauauaauuagaucccacuacuaagcucuguacugugaguuguuuaucuggaaagcacagggacgacggggguggggggguggggggggacaacgaacauaugaacaagaccuuggagaagaaagauccuggaaccaugcauaauaauauaagcaaguaaacaugagaucauaacaugggcacccaagacuuacugguauacuuggcaaagugggacucacaagucacuauggccgccggcuucucaccagaggguacguuguauaacugagcgaacaggauauaacccagguugugauaacuacagauuaaacacauggauggacucauugugcccaaaagaagugauuguauacgugucuugaguuccuccugucucuauagcaacacucugauuucucaguuuccuuuaccacacacuaaauaguucaugugcccaccccucggcccugggcuggccagcaauguguuccagucaguaggcugcaaacagugugguggaguaauaccucugacucuugacuucaggauacuugugccuccaccugccaccuggagucuagccacagccaucucaaaaaggccaggcaauggggcaaagcgaccgaccgaccggcuggacagacagacaaggaaggauacagagugaggauaagagcucagcagaggccacucggccacgcccagagggcucccucagcaccagcacacccacauccugauuucaacugacaacagggguguguguggguccagaaaaguccaaaaggaucacccgcccagugaucuggagaacaagagaaacaaacauuugcuuucuaaaucacggagaguucugcgguggcuuuuguuugcugccuuguuuaguuuuuugguuuaagacaaagucccaggaggugcgggcuggccucaaacucacucugucaugaggauguaauugauauucuggcccccucugcaucuaccucccaagggggaucacaggugugcagcaucacaucuggacaucagauccagagcucugggcaugcuuggcaguucaccaacugagaggcauccccucccugugguggcuuuucagauaauaaauggaacugauuauucuuaacacucugaccgguguggcuuuccauguagaucccagcauggcaacuuagggugagucugugauucaugaguaagcgggaagucugaaaagguaagguaagacagacagacagacccaaccuagaaauuaguagagaucauuuuaguuccccaugguaagaguccacgcauauucaguucccuggcuggcuuccuuggcuccuccagagcaugaaucaggcucccacugggaacaaacauacugaaagcuaaacccacagcaacaggucccucugucccuaugaacaaggaagucgcaagccucacaauguccuucgaggugaaaauagcaugggcucagcagacacuaacuacaacaucaggucauugaccuguccucgagacagguugggugucaccuguaccgugacuaccaggcuuaacucaaggauggugguagaaaaaccugucucucucuggugaguccaaggaagaagucacggcuaugguuaaaacuccagggggaugaugcuaaguggcagccacccaacaaauaugucugaaguuccugcaagucuagcuagagccaggcugugggugugcucggagcugacaggaacuugacagauaaggaaucuucuagauuuaaagccugccaaaucugacacaguuccagcugucuacucuugcucccauggcaugaggccugaguugcucaggugucgcugaggaagaacagggaccaucauucccugacgagcuuuccuggggaacggccuaugugucggguggaaucugcuccagcuauguccagugaugagaagacaaaagaaacagaaaacaacaagcaggacacacaaggaagaaggcgauguuagcuacuguacaugcaaugagaaggacccauggcagguucuuuccuuuacugggacaagaacaauuaauaacagauggugcuacaagagugucuagggaccacagucuuguagccacuaacuggugcacagagaugacaucggguugaggaaccuaaggugcuacaucuguagccagcuagucagauacagacaugguuaaacuugaagccccucccagugaagaugauccccagggaucggcagaucaucagcaccaguacugcaaagacuagcauguuccaggucacucagcugaagucaacacuaguugugacgggguucugcagucucuggaaacaucacugagugacacacaguauuaaaaaaaaaaaaagaccuuagagaccugacuaaacaaggcaucaguucacaccaaggucauaaugcauaguuucaaaacacagcugauuuuucuaaaugugaaauaggauuuuuagagaccaugaaguuuaaaagaugcacauuaagaacauagugaccucuguugguuaaagcuauauugaacaaacauuagaguaaacacggauaaccuugaggcgucacaaagguguggagggugauaaagacauacggaguauugggcacccuaucacaacacuucccuuaauggcguccucucucuuuacugaucuuccccacugccugaugaucucccaacacgcccccaccccccugcuuuccauucuuccagcagaucucuucccaggcucaggcccuaagcucugcuaccucguuauauggucuggcuuuagcacaugucagccacccuccaccuguuacauucaggucuagacucggauugcccuguguccucuguguugcaaacccauggcagugcccaccuucucuucauuuccuuuacaagcgcuugcccuuuguguuacggcuuucagguccuaccucuucucaaaucucagguggggacggucccugcuuugcuuugguuuacucugucaucuuucaaugcucucuugggcagaaauuggcuuaugcuagagcuuuagaaauggacacugcucucucucucuuucucucucucucucucucucucucucucucucucucucucucucucacacacacacacacacacacacacacacacacacacauacacacagacacaaacacaaacacacaccccuucccacuggcuacaccuacuuagggaggucauacagcuggccuuugugucuuuugcacacauuuccuucuaguuacuuaagguucuggaaugcuagcaugaucugcccagcacacauuccauugggcaccaagaggggcgaucuggucacuucgaagugaaacagugguaagccuaauucccguucuucuauagucccgggaggaucauuuauggagugccaucucaccguucaaagaggaagacagauaccggauauacagaacagugcauuucacacagguaaaaugucccacauuccguucuuagcauuaccacguaggaaaauggaugaacucugccagcaagaacguccauuuaguguaaagaaggccuuauguuggggaugucuuaaagagugaaaccaacucguaaagagcaaagcaaaaaggaagcacaaauucggccauuaacugaaaacagagcagaaaagguauggcagggcuaaaacugugaaucaaugcuacacagaaauaguagacauuaauaggcaagaaaagugacuaacugggaaccuauauacagccagacagacagcguggagacugggugagagcucacagacuccugaaagaagaacaaggaaagaaaacgugcaaagaugccugaagcacaagagcaggcaugggacagaucaacauuuugguugccagccgggcagcagagggaaaaucccgagaaucuaaauguaggcguuugaaaccaacugcugugugcuucccuggaaagcgggauggguguuuguuugaugggaggaagagaaguauuagcuauaaaacaggucaagaguaauaaaauaauuauuuaguguaagugguauaaagagcaccuuugauuuaauuuuaagaucauaucauuuuaaaauuucauuucuaacauggagaaaccaauggucagucaggagaaugcuugccugccaugcuugugacucuguagucuagcccauugccuuauaaccuguaauaccagaguucagaagggcaagauaggaaagucaggaguucaagguuaaucucugcucuagaacacaucagaggugcuuuguauuccagagaucuucuuucaaaaauacaaucuaauacaaugccaaaucuucgacucaacauuuuccuuaugacugccaauaacagucugcucagcuuuucucuuucuugguaguugucagauagucucauccaacugggccaaaacagggaaagcuggauuuauuuaggguacagauaaaaagacuaaucgcaaaaagaauauacuuuacucauuuagacaagacccuuguguugcaauguacgccgucucucaguacaugcaccuucuuuggaaauggcuccgaugcagcagcaggaauguuuccuccuaacagucaccacgagggugugugauguggauagaaagaaaggugcugucaccacucccggcguccuuaagcaccacugaaauggccaucucagggcccggcuggguacaccaucagccagccucucuucugcacuccucuuacaacaaaauccccugccgucuuagaaaggaaaaccaccaaagccuuuccccuguugacuuucugauucacaauucugugagcaaacaccagcuuucugcgaaugaauacacuauaagugguuugguuaauccucuggcuccuuuacuuugugacauucacgcuucucauacaaccagcggccauuuaaggcacacaaugggccuaggaagcaccacucgaagggcucugggcaaccagcuaccauacaugagcccugcuaguuuuaugcuaguuagacagagcuauuuuaaagucaggauacucugaaacugcaccucaugaggcucuagggucaccaagaaggccccagaggaaguccugcucugauacaacgugcuuuuccuaggucuucagaaaccuguacacaaccgcuguagcuagaaccuagcuuucuuguuucaggguuuuuagucaugcuuuugaauaaaggagcacccaggaacccaggagcaaauuaauuucaaaaccugucauuggcugguucucaauauugauaagcaugaguucacuauaacauccaccauaccuuucuucuugaguugcugccaucuugucuaccuccuagguacaggcacccacugauaaaaaaaaaaaacacucacucucugacucugguaucagaggcacaaaacuacagcauuccagggaaggaaaauuguuuuaaaauguuacugaucuaagaguacagacucuauuccuucuucuaucugaagucuucaugagaaaggcuuaauaauugcugaagacgccacuuagccuacaacaauauuuaaagcaauugagaagaaaaugaaacgaccaaaccgaaaugcugagagggcaggagccuuaccuaucaggguguggaagacggcagcgauggcaccggccaccaccaugcagaggacggcuuuggcccugucucucuugcuguucacgaacaccaggcccacauuuuugaagucacucaugggccccgugaagaacuucaucaaagaauacgccagcccguagcuggccagcauuucuacugcauccuccuugacugcagcgaugccccgguucaaggccugcgagggagagaagagccaaggcaaacauaagacacagaaccacaucuccgcagagucccaccaccaacaugggacuuguguuucucggggaaacggcaggcagugugcggagugaaucuacuccuaaguuuauagaaaauacuggcuuuucugguuuuguccacauuagcuucaguuugagcuuuuggggaggugauauuugcccauugggaaaguaaucgacccaacaaguguuuguuuguagcaaaagauaguucuaagagguaucacuuaaaagguguuguuuugaaacuccuagccugguguaguaacucaugccuguaaucccaacacacuggaggguuuugaguucuaguccagccugggcuacucugcuaauauucaccuguccacacguucaucugaccccuuuucucugguccucauucucuuccuagaauaucccuguuuugcuuuccugucacaugugugcgugugcaguuacaucuggauccacauaagagaagcauguuguauguaauacauuaucccucuuuucucugucacccucucuugcucccggcuauccccucccuccagaccuuucccucccuucccacagccacuacccauuuuuacaauagacgucacuguuagaucagcuuuaaguucuuggaaagaugaguggaaaaugacagguuucuccauagguguguccccacaucccacaagcacagcaaccccccaaccaucagcauccuggcccagagagggacccuguauaagugaugucccuguauugacacacagccaucacucaacuucagucuguguccuaaagucuaaugacaugcauccgccaucacagagucaucacuaaugacacccuaaagcuuucacccguuuuguccgcucuucugacaaacagacacacagacacauucauaacaacgauguucaguccgcuggcucaaaacagaggugcauuuuucuggucugcuccauuucuacugaacagauagugguucauaauuuucuccauaaacagccuaagugccacuuugcaauacuccuuagagauggcgucagagaacuaaguggaccaacgacuucaugaaagaagcaaagcuggaccugccuaccaaauccaagauggcucuacaaacauauaauauuuaagaaucacuacaccaaauguuuaacaaagcaacucauucaauguuuuacuggcucuaaggcugugaauuguaaaauaugcaccacuaagcagggaugagaccccuccagguacgauugaauaucaacugcuuauaaaauguauucagacugcagacaugcuaugaugagugaguaugugcauucacgcacaugugcacacacgcacaugcugggucauuucgugagucucuacuauaacacacuaucuguuuaggcuucucaggaggacagaagaaaugagcaagacccaggggcuccgauuccuggagacauugcuucgucaucuuuacuagagaugcugccgagucagguggcggacgcuuauggagcaaagcauucaagcaaggcucuacugggaggugggagccgcacuugcugccaaagcuggaauuauaaagcuagcuuuugacaacuguu

SEQ ID NO: 7701 - RNA, 807 nt, Mus musculus
ggaugguggcgggcugcuccccgagagagggaaggaagaaagaaaggaaggaaggaagaagggggagggaaaaggagagagagcguccugaagaguccagcaacuagugggacacaugcagagagagcgcaacaugccacugcaguguggggcaaaaauaaaccggcagcguggcggaagaggcugucaccggggagaaaaaggaaagggaagagaaggcacgcugcccuucugcagaggcccagucugagcaccguggaaacaccgagucacucggacaacaggaacauccgucaucgagcacagaggcgcuugcucagagaccugacuccugcuuuggucucagcagagguacgacacuucacuauuaagccaccagucagacacuggugcuucaggucccucgaagcagagcagagaacaccagguuaaacuauuccccaccacagcugcgugauggagaggaccguacccaggaccagcugccugucacgcagcguguucauccuacuaugggaagacagugugaucacagugggucuuggcuccucccaucuaggauuuggaaccugaauucuaugucuauauuuuccaaaacagaagagcuuaaaacaucaacucugugccugcucauuggauggcaaguaccacauauauaaaauauguucuuccuguuacaauagauguuuugaaucugguaggccauuuuaaauaagaaaagugcugauaaaguuuuuauuucucagccaaguuacccauggugcuacagguuaauuuuacuaaagauauuaaauaucuguuaacugu

SEQ ID NO: 7702 - RNA, 1200 nt, Mus musculus
uuccgguagcaggagaagauggcggucuccacaggaguuaaaguuccucguaauuuucgcuuguuggaagaacuugaagaaggacaaaaaggaguaggugaugguacuguuagcuggggccuugaagaugaugaagacaugacacuuacaagguggacaggcaugauuauugggccaccaaggacaaacuaugaaaacagaauauauagccugaaaguagaauguggaucuaaauacccagaagcuccuccaucaguuagauuuguaacaaaaauuaauaugaaugggaucaauaauuccaguggaaugguggaugcacggagcauaccaguauuagcaaaauggcaaaauuccuauagcauuaaagucauacuucaagagcuaagacgucuuaugauguccaaagaaaauaugaagcuuccacagccuccagaaggacagacguacaacaacuaacuuuaguggaucucaaacuugucuuaaaucagcaaccuucuccucauguuaaugucuugauuaaauaucaccaugcacaacacccacacaauaaguaaaagaauugcagcuuguaaacaugaccuggacaguuguaagaauauauuuaauauauguacaccuauuauguuuucagguaacaagagacgugcagcacaauuuuucuuucuauuaaagcacugucauuuaaacaugaaccugaaguacucaaaauggaguucaggcuuucaagacaaaagcaugacaaaagagugucauguggccauggaaacauuuguuuuucuggaaaguaaagucucaagaaggaagaacagaaauggcaugcuuuaucauauuuagagcugcaguuggaauuguuuaaaguagcagauacaaugacuagucaacaauuguguuaauucuugaagcggugugggugcugacuacuauuaguacaaacauagguucaggauuguuuugauaccuguauuuauaauaaaagguguugggguuuugaauuucuguuaaaagcuguucccguuuguuacauguaacagacauaauaauuuguuuacagucuuuguuuaguaaaacaugcuuagauguuuuaagugaagucaacaaaaaggaaauagguguauggauaugugauuuugagaugaaaguuagucuuaaaauguaaauaaaauauggaaugugucuuaaaaaaaaaaaaaaaaaaaaaag

SEQ ID NO: 7703 - RNA, 1169 nt, Mus musculus
uuauuuuguuuuguuuucuuuaaucuccuuugcuuauacaaccgugccuaagacuuucuuucggcucguucauuuaugcuuuaggauguacuuggaggaggaaggagcuucuugcucaggaaccacacccauuuugcuuagguggccauuuccuugccauaguguaucugguaaagcagacacuuccguauguauucaguggauuccacacaacggggcauggaugcugaaauuaaaaaaaaaaaaaaagugaaguauuuggacugguaacagaaugaaaagcaaacauucacacuacagauacuguacaaacgaacuaauaguaacuuauguagggaaaaaaaaggucaauguaggcuaggcucacuuuuuuuuuuuuuuuuuuuuuagauacaacagcaaaauauaauucacuuaagaaaacaaaagcugaauugucacaauuuauaccugagacuuuuaagaauaaaaggaacagacaccugcacacccagauuguuuuacaaucuuuuccgcuucaccagucaugugguggugguggugguggugguggugguggugguggugguggugguggugguggugguggugguggugugggugggaacagacuuguugcuucuugaagcgcuaaauguugcccaggcuggucuccaauucccagcucaaaugaaccccagccuugcgagucucgcaguccccacaucagauuuuaacucuguugguuuuacccgauuguguuguuuuucuuuggagaccaugauagagguuuuaauaaaaguuaaccuaccaagcuacauaauaggcauuauuauuuacuccuuaugccuauccccccccuuaggauaaauauugcuaagucguuagaaaauccuguaguccccagauaaacgcucauuucugucaacagugucugagaguccuuguuuucccauucuauuaacuaaauguuuuuuugccaagcugcuuugguuuggaaauguguauucauacaguggguguguggaccaaauggagucacacgccaagccgagacccuggucgagaccucuugggguucggauuagcgcaaccuccgcguuuuaggaaaacaagcuguuuuauggcgcucuccgcucuguggucacucguuggucacagaggccagccggacguccgccccuuguuug

SEQ ID NO: 7704 - RNA, 15601 nt, Mus musculus
cacuguugaaaaguaagucgcggggucugcacugcgcaugcgcgggauucugcguccucucgcgagagggaggugcggugugucucucuucccgagugguccccgcugguuacuggaggagcgcucguucuaguucguccaccauggcguccguggggacccucgccuucgaugaguaugggcgccccuuucucauuaucaaggaccaagaucgcaagucccgucucauggggcuugaggcccucaagguaacggcccggaacgcgaagccgcgggaugaagggagugggccggagcgcuugugcgccugcgcuggcgagagagcagcucggccaugugcuggcccgaaagcucgagaaucuccggugccggggagccccuuugggcucuagggucacauccccgcucuggcugcgggagagggcguagaggccuucgucccacggugggguagggagagcgauccgccgcuucagagcuggguggggucgcauccccagcucaccgggcgggcgagcaggccugcgccggugcaucuguaacaucuguaagucgcuugucccuuagaagcggggcugucccgaaagggagaaaacuagugagaaacgugcacaggacagaccgaauggcugcuuguaggaaagggaccguaaagucccuugggccagaaaacgcaugguggugacuuuuggaguggaaggagagaguuucaguggagcacaguuggccgcaauugaggauaguuuccuaaagggaaacaaagaaguuacccugagggaaggcagagccgaaguguugagucggaaggcaugucucacagaaggagaggaauaagaaaggcuacccaagagccggugcuaggcccccagaggagaaaggagugacagucacugguguugccacaaaaagcucagaggaaggagggagccccauuuuagguuguauugugccagucgugccuccagguuugaggugcccugguugaccugguguuagggaaaucccucggugaguucucuaucaaaccgaauuucugacagguguuuuggaguggcugcagaaguggacauagcaacugaggccugguagaugcuugguucucuuugccuucagcuugugcgcguuguguguugacuuguguacuggcuaguuuugugucgacuuguguacuggcugguuuucugucaacuugacacaggauggaauuaucacagagaaaggagcuucaguuggggaaguaccuccacgaaauccagcuguggggcauuuucucaauuagugaucaagggggaaagaccccuuguggguggugccaucucugggcugguagucuugauucuauaagagagcaggcugagcaagccaggggaagcaagccaauaaguaacaucccuccauggccucugcaucagcuccugcuuccugacuugcuugaguuccaguccugacuuccuuuggugauuaacagcaauguggaaaguguauucugaauaaauucuuuccuccccaauuugugucuuugucaugauguuuugugcagguauagaaacccugacuaagacaacuucaacccccuuuuuuuuuccuguuucuggggacgugccaauaacaaaauuccaacagacagaaaauugaccaguauaacucauguuaacaguccuguugugccagccguuuguguuaaccagauggacuauugcaugugguccucacucaggauggguccugcuuacagaauuagauucuuuagggacagagucauagagaaauugccgaguagagaagggucaugacuuauuccacuuccaccugagucaaagcuagguccagagccgugagguuccccuuggcguuagaccagagcaucugugguuggaggccugucuuguguauaguguugggcugguucuuuggccucugcuaguacauaccaguuuagccaaccaaaaauaaguccugguguccaguaucuuugggcaccccaagagacauuucccugugaugucucuugagaaacuauguuaccaauacauacuuucagguuacauuuuaagagcaccagaguuugcaaagaccaaauguacuugcuuugucaccugucuuggugacaagagaaguuaaugaacguguacuugcacagcucugaaaaugcccaguauuucugugcuugcagaaguuuaucuaucugcaucuugggguucagaagaugaguuggagaaaccaucagagaacauggugacccagggaaagccuggagugcucugaagaaaaggcuguugauuugguauuaagacccuagaguggcuuugaaccuuuagaaucauuagagucacuagaaaaugaggaaauuagcauagcgaccaagaaauggagagcaugugguuuuggaauucuucaggaugguuuugaccugaguuagauggugauggcagaagagcaugcguugaaggaaaugagccaggcauguauaggagcagggaggguccugucaggccuggaccgaccuuuacugucuuaguaguaagucugugggaagguucacaggaauaucaugaaagcuaaugagccugagcagugugcuguggagcugggaguuacauucccaaaguggggcugagguugcaggccuacugggauaguaaguagcaugagucuuguuaagugucacgugcucuggaucagccccucugaauaucgagguucuucuguuucagggccccaaucucauagagcuucugggagugagggagccaaaaugacaaaaaagcuaaagacagugguaaaaguguugagaccauaugcuugccaugggaggaucacaugaccauaaugcugauggguggucacacuuuccuccuaugauuuuuauaugacacgaggucuagguggaaauaaaaauagguaaacauaucaaaccuuuacugagaauaaaucauaaagaacauuacuuccaaacaacauuugucauauauaaaccuuugcuauauacuaaacaugaagucauguuugcauaauaaugagauguguguguguucuuuuuuguuuggaagggguuucuuagauuucgugugcgugugugcauuguggugccguuggaggccaaaagagggcauuagauccucuggaacuggaguauaggccaauuuugaaagcuucgugugggugcuggaaacugaaccuguaucuuccagaaccacaaauguucuugaccauugaccggucuccugugcauacuaggcaaucacucuaucagugagcuguaguuccagcccuuacucugguagcuucacagcuaguuuuggucugucauuguuacuaggauuucugacaagaacacuuuuaaaaagagagcagucuccggguuccaugccugauaggguuacuguuacuagauucuuaaccaucuuucaaaacuuuccuuuugaaaauaauguuugcuaagaacgucaacaagggugacuuccauguggguugaugugguacgauauuucucuacaguaaaccuugguaaacugaagguguuaaguguuuaugguuggauuuuguguuuucagaguucaaaaugguggcagcauaccuccuuccuguaagagacgaaauucacuugacacugaagcuuguaguugugaauguuacugcucuagucagcccucucuguugauguagacauuucuagauuuuaggaguuacauccuaaaucuuuuuuuuuccccugcaaauacaaacguaagugcauuugacuguugggaugacauguaacugggucuuugcuuuucuguuccauuuagucucacaucauggcugccaaagcuguagcaaacacaaugcggacgucacugggaccaaacggugagagaaccauugauaguuuuaauaaaaguuugaagauaccgugccucuuuagaaaugcaguggaugguauggccaagauguugagugucaggcucuucugauaccgugugcucacaauuuugauuagaggcuuuuccucacuucauuaguacguuccagagugagccuguacaucuggaacuaguacuguuuuuaauggcacucugugugugaugguugaucacauuucucugguugagacgcuuagauuguuucccauguggaguuggguuagcugguggguauuuauuucauguguacuggauuauuuguugcuagugaguuuugugguaggaacuagugagaugguccgacccccuauaguucccaguacugguacacuuuauuuugcucaacuuccuucugcacucuugucuuuuagggcuggacaagaugaugguugauaaggauggcgaugugacuauaacaaacgauggugccaccauucuaagcaugauggaugucgaucaucagauugccaagcugaugguugaacuguccaaaucccaggaugaugaaauuggagaugggaccacaggagugguugguaagaaacaaaacagccuuucuaacuuauuuguuguuuaaaacugucagaggagcucuaauguuucugccuugcaucaugaaggcagugggggacugacugaaguuggggaacacauuauagcacaagugggccagacuuuaaaaaguaaguguugaggggaauaacaggagccugggaggauugccaggaagauggaacagccaguugucgugugugcuuuugaucuguuugguuuuuaagcugcaaauguugaguuaacuaacugaacuaauucuccacaaaaauaagcaugauuuuuaauugcuuuacaaaucaaaggaaaugaaaauauauuaacauaugcaggguuacauuugcugcagcuaauuuaaaauuauuuauucaacacucuuggcaguaauuucccaagcacugucguaggguauacuuggagcacagcaguuuuaaauuagcagaacuagccgggcgugguggcgcacaccuuuaaucccagcgcucgggaggcagaggcaggcggauuucugaguucgaggccagccuggucuacagagugagguccaggacagccagggcuacacagagaaacccugucucgaaaaaaaaaaaaaauagcagaacuaaauucaguuuugucacuaagagggaaagggugaggguugguagugggaacacagacucauuagccucccaaaagccaggcuuccuucacuuagcagaagucccuggccacagaaacccaauuugcucuuuuccauucaaaauguuguucuugcauuauggccuauguagugacaguuuuggaauuuugguuacguuggagaaagugguuucauuuuaaucacugaaugugaagauauaugggguugcuuuguccuguccgcagcagcugacuaugauuugccuccagcucuaucagagccaugguuuugcuagauucagauaguuucugcaauugugugauguuugaaaugcugguaacuuuucaaagaauauauaaauacuagagcccugauuuggagggagguguggggggagggggaguagugaguggucauuuagggagauuguuugcaauuuguuaguagcauuaaucaaagaagaaacaaaaggaaagaaauuuguuuccaggaucuuuguuucuuucucuccugucuaauaauaagggaugggaaggggugguaaaggguggggaaaggaaucuacaaaguagcaaaggccagcugcaggccuacaucuuccuguuuuuacacuuauuguggggagggucagacagagaucagaauacaacuuuugggaggaaguuuuccuacugugaauuccagggcaguugguguugacagugagugccuuaaaccucuuaaguucuuauuaucuaaaucaucuuuaaagggcagccuguuggaccuugacuguggucaaaacugagaaggugggggucuccuccuuucaauaauagcccuggauuacauccagcccuauuuuagaauguugugauuucgggguagcaugugaggcuauacuaaaaugugugucuuagauugauggucugcucugcugcuugcagucuuggcuggggccuuguuggaagaagcugaacagcugcuggaccgaggcauccacccaaucagaauugcugauggcuacgagcaggcugcccgaauugcaauacaacaccuggacaagaucagcgauaaagugcuugucgacauaaacaacccugaaccucugauucagacugcaaaaaccacgcugggcuccaaagugugcguguccuaucaguaguguacuguggccuguaagccuucccuucagagggcugugcaccuguccuaaaaugcagcagugugguuuguucaaguuucuguucugcuuguuucccuguguucugauugggagggcauuuugccauuuagguuauuggaucaccuaagauuuuccuaacccgcucuucccgucaccucagcacuagggaaucauuuuggggaagcuuuuuuuacucaguacacaaguguacugaucuaaagauuuaauguaauuagaagaauggucuuaaaauugaugucaacauuuccuaaugucuacuuuuaccccuaaagaucagcaaccucagucaaaaacugcuccucucucuacaguagcaaaaccuugcagucugcugcuguauuaaagcccaggggaagcaguuacacgugugcuacauuuaacccugcuguguaggguuaugcuguuccuguggcauuucauacguguuuacuuguaugcugcuccuguuugucccccuccugcuugauaccacauucacauaugagcaaaaucggaaucgucgucauuuccuuuuggccauuuccguucucccuuguuacucugcuuacauuuacucuguacuuguauauacagcuugugaaagucugcucuuucgcaucauguggauugggaaucaaauucacggcacuggguuuugcagcuagcacuuguaccacuaugccaacuuggcagcuuuaugaccucuuguuaaauagugugaguggugcuuagauaugugagcuguuagagaggguugaauaugcuaccugguaagucugagcuguggagcaccugaggacugcucacuccguguaacugaagagccugcuaccacuaagggcuucaugcauucuuuuaagggaaaaucaauauacacuuggguuucaagacuuguaaguucaaaucagagaggguuugcacggcucagauuuacugcuuugccuagaccacuauugaccccgguccauuuugaacucagaaaguagcccuggucuuccuagaaguacuguugagguguaugguguggcuaggaugcugcagucauaugagggauguaaaaguuguguguuuucaucaggauuaacagcugucaccgacagauggcugagaucgccgugaaugccguccucacgguggcagauauggagcggagagauguugacuuugagcucauuaaaguggaaggcaaaguaggugggcggcuggaagacaccaagcucauaaagggugugaucguugacaaggacuucagccacccacagaugccgaaagugagugcccgagugaggcgugcucuuaggcucgcauaccgcuucuaacucaaacccaugccuaaggugaucuuccucuccccauagaaagugguagaugcuaagauugcgauucucacguguccauuugagccaccuaaaccuaagacaaagcacaagcuggaugucaugucuguggaggacuacaaagcccugcagaaguacgaaaaggagaaguuugaagagaugauuaagcaggugagaccuggacugcuuccugaacugacuccaccgguuccuagaggaccagcacuaagggauuagcaucuggggcuucauugcuuagcuacaaguagcaugcaguacaaccuguguuggguaucagucaaaaacagccacugucggaaaacuaaaugguguaugaacaaagaaguugauuuuguccugggcuaccaugacgguuuagcugugccuuucauuacuuuauccuggccuugaguggagcaaacgagagcugugaaauaacaggaguuaguuagaacaugguuuggaaagcaaggugguuccccuuggcacaucuuagagucggaaggagcuuuccuguaacuuucacugcacugacaucacacaaacagcuccaccucucccucuuuuucagaucauguaacaaggacaaauaccuacuugcuauugcuaaaauuguggcacuucucuucacagauuaaagaaacuggugcuaaccuagcuauuugccaguggggcuuugacgaugaagccaaucacuuacuucuucagaacggccuaccugcaguccgcuggguagggggaccugagauugagguaggaggccagcacuuucgaugaucuuucaaugcauguauucaguaucacuugagcagcacuuaccuguaacaaccacagcacaccaaaaagcaacagcuuaaggaaagaaacuguagaagaacguuguagaaucaucuuuuuuugaauaacagugcuuuguauuucugguauuugcauagucaacucucugggcuucccuguuggcuuucagaggcaagauagccuuguccgguguccuucuggggucgcauacagggccgcccacacaguaagaggccggguuguaaguugacuguaauagagcuggguagcaccugcccccaccuagggucccaccuccucagagccugucugaugaaccacgugguccuagguuaaguguaguucauuuaugguuccauuuuggaaguucacuggcauugacuacaucugccuguccucucugaugcauccugacagcugaucgccauugcaacaggaggacggauugucccacgguucucagagcucaccucugagaagcugggcuuugcugguguggugcaggagaucuccuuuggcacuacaaaagacaaaaugcugguuaucgagaaguguaagaacucuagagcugugaccauuuucaucagaggaggaaacaagaugguaagaauucuguccuugggcuggagagaugguucaguuccucuggaccagcaugaggaacugagacauggccuccuccccagaucauagaagaagcaaaacgaucucuccaugaugcccugugugucauccggaaccucauccgugacaaccguguuguguauggaggaggggcagccgaaauauccugcgcccuggcagucagccaagaggcagacaagguaacagaguggcagugagaacugcugucuaggucucguguguuuauguccucucagcuucauucuguagaugaaaggaaguuuauuaagcuugcccugagugacuuuucaaugcaugcuuaugaacagcuguuggguuggcuauugcccagugcacuuacugucccugugucuuuccagugcccaacuuuggaacaguaugccaugagagcuuuugcagaugccuuggaggucauccccauggcccuuucagaaaauaguggcaugaaucccauucagaccaugacugaaguucgagccagacaggugaaggagucuaacccugcccuggggauugacuguuugcacaagggcaguaacggugaguugcuuguuggggcuguaggagcggagcgaguucuauccacuuggaagaugagugguacaugcugcaagacuguccuuagugaggucuucagugcacugggacagugcuguucugggucuuagugucugaguugauugcugugggacuuagucuuagcaacacaacucaguuuaaccacaguccgggugccuguuguugccauacagagugguuucuguucacagcuugccaccuagcuguugccccauggcugcagaguguuuggaaaacuuuaacucuagccgcuuggcagcccuacucuuggaagguggcagacguugaacugucuacugauuucacuccuguuccucugggugcuuugggugucaugucacugucuagccuccuuguagucaugagcucuaccauguucccacuagcacguguccucaguacuuagaaaaucuagccgaaaaugacauagggcauuguggccaguuuacugcuacagcucuaggggguuuaguuuaggguuuuauuugcuaagauuuauuuuaugugaauaaguguuuugucugcaugcauuuaaguguauauauacuauguguuugucuuguguccuuggaagccagaauagugcauuggauccagggaguuaacuagauggauguaagcugucauguaggugcuaggaacucaugcucucucgaccagugggucaucuccagccucucuuuuauagaugaauuauauguuuacuucauuguuuggcacuuugguauaugauguauugugaguacucuuucccucacauccuauucccucccuauaaguucaucucccacacuucugucuuuuguucuguuugaugaacugcuagguguagccaggacugucucuaugaccauagguuggagccugguugcuucaaccauaugcacagcugaagacagaugacaccaaauccaccaggggcgacuaguuuaacagggagagguggggccccauaagccacucugccaaugacugacuaauggcacagacuuaaaccauuucuguuuuugaaaugaaauuccacuauauuucccaggcuggccccucagcuccaccuuggccuccccaguagcugagugcacagacuugccugcugcaguggcuuuguugugacaacacagguugaagcuaccuguugauaacuacauuugugugugcuccuggacugagugcuguguuuuguuuuucagauaugcaguaucagcaugucauagaaaccuugauuggcaaaaagcagcagaucucucuugccacccagaugguuaggaugauucugaagauugaugacauccguaagccuggagaaucugaagaauaaacuguaccauuuaccacugugacuaaauaaagggugugucuguugugcugcgucugcaguuacugcugguccucucacagcuguagaugcuggaauaaaagcagcugucugguaacugcuuccacuuauucagagcuugauagaggauuugaucucacaguucugcacuccugggauaucuuucagcauccuucauccgcagaacuguaaugaaguagaacacaacacuacagauacuuuuuuagcagcucaggugucucggugucugguuuuacuucacaguugacaguacaccaguacaccagcaccugcuuggcugauggaaccagugcuagagacugaauccucuuguuccucccaaguuucggacaauggccaguuagcucaggugccagucagaacuggcuuggacaguucugugcuuugggcauaugcucagagagcaauugaagcauacguaccuuuuuggcuggaugucauaauuugagccugccuuggaggucagagcccaugcagccuagcaauuaccugucuugguggauccugugaaaaguagaacuuagcugauuaagucuggaggcccuuccuuggcagugcagucugcucccacuccaccaauuugauggacacagcaggaugauaaucuuacauuuucuguucuccagggugcuucagggugggggugccgccaagcccccguaacccgugauuucucagacccaugugguggaaagauugccacaaguuaaacucugaccuccacaaaggcauguagacacaaguguuuaaaagugaagcuacgcauucacaaguuuuaaaaaucacuuuauuagguugaaugucgacacugcucauuaggggaaguugaauauacauagugacaacugcucuuccugguuuuguacauuuuaacacuugaauuaccaauguaaggccauaucugagaaucuagcuggucccugaauugcccccaguuccccuaacagucaugcuaucauggauaguaagagaugguuaauuauucaggcaaauuugggcaacagcugccuugugcuugggugcuguuagacauacuuguucagccauucaauuagguuccuccuugccuccucgauguagggcuugucagcaggggagcagucuucucucuuccgaugcacaaagccaugaguuugcccagaaaacguuuuaacuugguaauuaacuaugcaguguucuuuaagcuucugggucaguguagaaaccuaauaugggaggggguugauauauaaaaaugugaggguaaugugaccuuagcccuuuggucucuacaaagcccuaggugucuagaauuuacucaauauguaaacugagcuggcuuccuauuuucccuccaagugcugguggauggcauccaccacugcacugagaaggaguccuauugcaauaguugacagugaacaggcuccacagccauugaguugucuuuaacaguuccuggccacuuugaggaguugcagagcaucguaauggcuccuccauaucagcccuagaagcucuuggauuuacacgagcugagacccaacaucuaccguaggucagaauuuuauaagucgugguggcguacauuuuuaacgccugcaguugaaaggcagaucucugaggccagcauggucugcauaaugagauccuugucugagaaaaacacauucuuggcaugcuugaagcuuccauccuccgcagcacagggugggguaggcuuucacuguagcugcccuacugaccauccuagcuuagccaagcacagcccuuugagaccauugcucauuucccuagugacuauggggcuacuggggagaugcacuuugccccagcuaucaaccggagaccauacacaugggugacuagaccagaaaaagauccaaauucaaacuuggccugcuguguguuacuauuauccauaguaaagcaaaccaaaugauuuuaaguuuaggacuauugcaaauuauuuguauugagaucuuaguuaagacuuauugacaaauggccacuuuuaacuuagacuuuccuaaccaucuuccugugcuuaauaaauccaucucaggcuaugguaacugguggauuaccauggaaaccauucacagugaacaggcuguaccaggaacacauacauccuucagcugccauucugaacagauccauucggggcuuaaguuccaucaguaaauguucaucauuggaaaaccaauaaacuaguucuuaaaaacuuucucggccaggcagugguggcgcaccccuguaaucccagcacuuggaaggcagaggcaggcagauuucugauuucaaggccagccuggucuacagagugaguuccaggacagccaggggguacacagagaaaccaugucucaaaaaagcaacaacaaaaaaacuuucucgggcuggugagauggcucaguggguaagagcacccgacugcucuuccgaaggucuggaguucaaaucccagcaaccacaugguggcucacaaccauccauaacgagaucugacucccucuucuggagugucugaagacagcuacaguguacuuacauauaaccaauaaauaaaucuuaaaaaaaaaaaaaacuuucucuaaagaugucaugcuaugcaauuagauaugcaaaugaagggcugccuacucaccugcucaaguggaaucacagugucauuuucugcaaaaauaaacaacguuggguucuucaaauuauaaacaucuucagaaucucugaugauaccuagaaagaguugaggggcauugacuucugcagaaagcugccugaauucgguaugguuuugcaaaguagaccauguggucagagaccugcuuccauguguuagggguggaagugguaugcaugcuuucuugugcaugcccacauggggucuagugcaccugugucugugaguguggaggccagguaucuuaaagucacuccucguuuucaccauaggaucucauugagcuuugagcucagggauuucugcacacuggcuggccagggaacuugaggaacccaucugucuccaccagcccaguccuggggugacaugugcaaagccugacacacacacacauagcagauuuucaugcagaugcuagggaucugaaugcaggucuccauggauagguggccaacacuucacugccuuagccaucuccccagauguguguguauuguuauuuuuaguaagcccacagaagccuagccuaugagauucugagaaugugcaaccgauuuaaccagaucuuuuuacucugcauccuguucaacaggaaccaggccaauaaacuugaugcugcucucuccugagauggcuuuauacaucaggucguuuuucaaaccaccacucuagaacuuucuacagggaccccacauguucaguaaacuagaccguuuuuuugguuuguuugguugguugguugguuuuuugauuuugguuuuuugagacaagguuucucugugcaguccuggcuguccuggaacucuguagaccaggcuggccgcaaacucagaaauccgccugccucugccucccaagugcugggauuacaggcgugugccaccacugcccaaccuuuuuuuuuuucuuuuuuccuuuuuuuuaauuuuuagacaguuuuauaagaagaacaaccauuggaccaaguuauuauucaaacaggaccccaaagagacagggucuacgugucuacagguuauuguauauguuuuauugcucauccuugccugaacauccuaaagguuaauuugugcaaaguauuguucugccaggcuuagggcagcccacuggugccuuugguuggaaaaaggcaaguccaugcucuguugggagaaugggcaggaaaggacuagugagcuggcucacuugccccacaagccugaucccagaacccacaucaaguuguucucuggcuuccacacaggcauuguugugugcaggcacacaugaucaaugauuuuaaaagaugaaaggaaaaacaacuuuuuuccugcuuccugccacugugagagcagagcuaaguaacacacagugucucuccucccugugacuccucuccagaagacgucgagccauugaagggauaucaguccucccugcacaacucugacaaagccagauaauaggucuggacauucaguggaugucucuuuuuccugccauaaccugccacucacaugcacagcagcagccagcagguggcgcuagaaaggcaugcauccaggaccaccuuuuaauuuacccauagacaccauuggccugaaaauuggcuggucucguacuagugauuuauugcauuuguuuuauguaagacuagcucucacuauguagcucaugcuggcccaaacuuuucaauucugcuucagccucccaaguacuggggucacaaguaccaugccucacuuuaucuccuuuuguguaagaaaauauuuuguuuuguuuuguuuuuuuuccuuagugcuaauagaagaugaaacaccauguccgggaguucaagcgccagauagaaacagcuugugaauguguaacuuugaaagagcagucaacuuuccuauauuuguuuuuggcauauuuuagucuggaugcuuuugaauuguacauucagugugcuguuucugucaaccgauaaaggguucuuaucucauaguaaaaac

SEQ ID NO: 7705 - RNA, 972 nt, Mus musculus
aauggccaagaguccauccaucucaggagacuacccaucaccccaccagaugucuaucuggguuucaaauuugguaauaauaaagguagagcuccagcagcugagcaagaugcccaaagggaaaaaggccaaggggaagaagguggccccggccccugcuguugucaagaagcaggaggccaagaagguggucaacccucuguucgagaagaggcccaagaacuucggcauuggacaggacaucggcccaaaagagauuuaacgcgcuucgucaaauggccccgcuacaucaggcugcagcggcaaagagccauccucuacaagcggcucaaagucccuccugccauuaaccaguucacccaggcccuggacaggcagacagcuacucagcugcuuaagcuugcccacaaguacaggccagagacaaagcaagagaagaagcaaaggcuacuggcccgugcugagaagaaagcugcuggcaaaggcgacgucccaacuaagagaccaccuguccucugagcaggagucaauacagucaccaucuugguggagaacaagaaggcucagcugguggugauugaccaugacauagaccccauugagcuggugguuuuccugccugcccuguguugaaagaugggggugcccuacugcaucaucaagggaaaggcgaggcuggggcaccugguccacaggaagacaugcaccacuguugccuucacacagguuaacucggaagacaagggugcucuggcuaagcugguggaagcuauuaggaccaauuauaaugacagauaugacgagauccgucgccacuggggaggcaacguccuggguccuaagucuguggcucgcauugccaagcuggaaaaagcaaaggcuaaagaacucgccacuaaauuggguuaaauguaugcugaauuuucuguaccuaaauauaauuacaaaauuuaauaauaauaauaauaauaa

SEQ ID NO: 7706 - RNA, 1008 nt, Mus musculus
cgauggaaggucauaugcucuucuuccuccugguugugguagugcaguuuuuaacuggggucuuggcaaauggccucauugugguugucaaugccaucgacuugaucauguggaagaaaauggccccacuggaucugcuucuuuuuugccuggcaacuucucgaaucauucuucaauuguguauauuguuugcacagcugggucuauccuguuuggugagacacacguuauuugcugacaauguuaccuuugucuacauuauaaaugaacugagucucugguuugccacauggcuugguguuuucuacugugccaagauugcuaccaucccucacccacucuuucuguggcugaagaugaggauauccagguuggugccauggcugauccuggcaucuguggucuauguaacuguuacuacuuucauccauagcagagagacuucagaacuuccuaagcaaaucuuuauaagcuuuucuucuaaaaauacaacucgggucagaccagcgcaugccacacuacucucagucuuugucuuuggucucacacuaccauuucucaucuucacuguugcuguucugcucuuguuguccucccuguggaaccacagccggcagaugaggacuauggugggaacuagggaaccuagcagacaugcccucgucagugcgaugcucuccauucugucauuccucauccucuaucucucccaugacaugguagcuguucugaucuguacccaaggccuccacuuuggaagcagaaccuuugcauucugcuuauugguuauugguauguaccccuccuuacacucgauugucuuaauuuuaggaaacccuaagcugaaacgaaaugcaaaaauguucauuguccauuguaaguguugucauugugcaagagcuugggucaccucaaggaacccaagacucagugacuugccagugccugcuacucaucacucagccaacaagacauccugcucagaagccuguacaaugccaucuuaau

SEQ ID NO: 7707 - RNA, 3771 nt, Mus musculus
acuguuccugaguguauuagacauaccuccggcuucugauuucucagugcaacuuccagaagcugcuccuuccagauccaaacaauaugcaaaugaugcuuguucuucaacuuggaaggaaauggagcagagagaaaguuggaaugucagcauccuugacagauguugcuguggguggugaguccauuacacaaaggacccuguguggacaucaucgcuucuaggcaugcauagcucccaucugggcuuagauuagagguucucaaccugaggguugugaucuuuuggggggaucaaaugacccuuuaauucacgggagacauauaucagguagccuacauaucagauauucguauuaugagucauaacaguagcaaggaaguagcaaguauaauuaugaaguaggaacaaaaauaaucuuugcugggggucaccacaacaugcagaacuauauuaaagggucacagcauuaggaagguugagaaccauaucuuagaaccacuuggcugcguagugcuaggucuuugauuucaauggggaaauguucuuccauaucuuuaaaaauggcuugaaaaauaccaagaacugaagaaauccccuuuucagugcugaaccuguuaagagcacaaaggcagucacccuaaacauuuuugcagaagguaaaaaacauaaugaacaguauccaaaacgucugucugcagucacauccucacgaagagucaaugcauccuucugcauacuuuuguccuugcauuuuuaaugguuaaauaauguguguaagaagcgggcagcauaacugugguuucucuuaaaugggaagaacauuucucccuccacccguuguuacacauaugcucaucacagcuaagaugauuaugcggagggaaauuuucccccaugcauuugcuuuauuacagaugcacguauugaauauuuuacaguaaaaauaugaaagggaaggaucgaccaaacaguugucacccauauugucucauaucaggaugacagguccuguuaacuuugcagggcaacaugggcaugcggugaggcuuaaccauagcucugagauaugacuucagacccaaugucagucacacauagcaaggucugacucucuagacaugagaugugucuauugugaagagcuuuguccuuuuaccugauggauuugcucaccuugagguauacuuuuggcaagcuaauaauaauaauaauaauaauaauaauaauaauaauaauaauaaagcaguaauaaucuuguuagguuuuaagacuuuuacuuuaaaaugucacuucuauguuauuuguucuuuucuuucacuaaaauaauauaucuuauuuguuagauaagugguauccagaauuucaugauauugauauaauauuggcuuuaaaaugugcuauaaugucgcugucacuuuaagauggucucuuagguuguauuuucuguacugaggcccaaacccaggaguucucacuugcugggccagagcuggauugccagaggauggugaccuuguagguucaguguuaaauaaguucuaagaugccgacugauuuuagaaauagcaaaugccaagagguuuuugcaaucggcaaauacuucucauuccuucugaagguugcuuaccuacaucuuuacccaagcaaguggaacuugcuaauuuguauaaucuaaggccuuugaaagaaaaacaggcauuuuauauuuuauguaaaaguauauguugaaagaacauggccuuauuagauugaguucauuuaguuaaagacauauugacaggaagugacaccccagacacacuugugugaacccaccaaaaaaaccuaaauccccaaacaccuaggucagggacuggagaggugcggcagcaguuagagaacaugcagugcucuugcagagaacccaaguuugguuucuaccacccauauuaggaggcucacaacuuccuuaaugacaccuccuggcccauaugggcaccugcaccucugcucacacugauacacauauacaaauagcuaaaacuuaaaacucuugucuuuaaaggacucggggucugugacguggugccagugaguuccuacagggacguuccacucaaacuucucacacuguguaucuuugacaccugcuuuuccuugcuugugaugcuauaggagaauacccaacacugaguccuuuauaaagcacagaaauguauuacccacaguucuggaagccaacaaugcacaauaucaaggcaccagaauuuguugugaugagaauuucuuucugggccccacauguggaaacgugcaccuaagaagggauguccccuacgugucacaggcacuaaauacagauugucccuauucacuagacugcuagaggcuacacaagacuauaucuuagucuucugcaaagguacagccuugccuuauaauucaucuggagagauaagcauaggguggauauuaaauugaugucauaacauaaggcaaaacuuccuggggagcuuauccaauauccuguuucaugcagucacugcauggagauauaaaagaccuugaaaauaaagggagaucuaguaauucugaagaaacgauguccagauaaaaauuuaagacuucaauuuagucauaaaaaaaaaaaaaaacaguacuuauaggagcugaagggauggauccaugguuaaaaacuugcuacuucucucacaacuaccugugauuuuauuuccaaauaauacaaugaauucuucugccuucuguggacacacacauguaacauucccuuacauggggacacacacacacacacacaagaacauaaguauaaagaaaaauggcaagacauaagaaauauauaaagaugugcuggggacuccuguaugcaacuaaaguguguacacacuaggccagcugagaauuagcaccggaauagaucaacaugaaaauauuauucuucguaacagacuuggauccuuuguagccagcccuuugaaauucccuauuuccucagugucaggggagguaaaguagggugcaccugacucucgagagccucuuguaggagaaggcuauaacagaaccagaagggcagcugagugcacuucacaggcuccugaaccaccuuguuugcgcucaucauuggauaggacuugggaggugacacaucgaauccucccaugguugucaugcaccgcugaucuguguugcauguuucagucugacuuuguauguauuaguauaaagcacaugcuucaagaagaaaaucacauaggagaaaccuggagagaacuuuggacaguuuaaagugcuuucuuucauuccgucuuucccaguacugagauaggacucagaccuuaccuauucgagccaaguaucugcucaggguaccugaggccugcaaguucuuccagaaugucacauaacuaacaaaccuccacgagauuugaaaagguugccucuccuaccugcagcuuccucccugcuggacagaaaugaaacuaccuucuuuccuuguaaauuagucaccgucgccacauucuuaucuuguuuguguuccaaccaguggcugcucaauggcguuccuuccucuuccacuggcuuaugaaaacgacuucugugcguuuuauuugcugucacgcaugcugaguaaccccuucgcuccuuuucuguugccauuguuauuaacccauuucuuugcguguauauuuaggaagagaauucuaaaagcaucucucugccuaaaacccucaugucaagccagacccacagaaagagcagagacug

SEQ ID NO: 7708 - RNA, 114544 nt, Mus musculus
ugggagcugccaaucccaguguaaucccguaagaauuucucccugguuuuaucauggaguccuggcaaccuccuuucccccaguagcugggaggaaccuugagggccaggcuaagaagggagggaagguaggggcgguugaagcggaggcugagcaggaccaagaccaggaccagggagaggacacggagggguguggggugagaucgagggggaggacccaggaggaggcggcgcguagaaggaggggcgcugcagccaagccaccagucuagcuguagagugcuguacuccagauacuccuggagcuccagccccucagaccgcgcguccccgccgccguucgccuuucggcauccuaaacuugagcggcagcucgguuucaacccaucgacugcuugcuucaaaucagacagcauugcgacccagacaccggaguccgccgagugaaagcacaacgcugcccuguaggaccagaccaagaaaacagccucgcgaagcagcaacucuggguugggaguacagaagccaacaagugagaaggcgccgcguuuccggggcgcagggagaacgcuagagcaggcgccagagaagacagcuagagcucggaaucggagcccaaaccucucuccuggaggcggcucagcuucuuuuuuuucuaggcccucuuaggcuugcucugggcuuccuuuuauccggguaggagccacaucccuggggaauaugcagcgcgcguggauccugcucaccuugggcuugauggccuguguguccgcagagacggugagugggcccagccggggaagugcacuguuaagagugcccgggcaaauagaagagccagaggguaauugggggaugcuaccugggggaucugccaacccugaacguggggcugccuagguucuacugaaacaaaugagcuugcuuuucaaccacuugccccugggcucuuccuuuucccucuugcacaauugagcugcuacagggaguuacccaagccaugucuucagggggugggagcacaagacuuggagguuagggaccccacagguccuuaaagucauuuccagcuuucugccuugggggauuuuaugguguagucuaggaaggacagagggcuaaaaguugcagguuacuagagcaccacugcgggccaggaaaggauccaguaagcucuguguacuggacaaaccccaggggugaguuggaaacuuuggggaggaucuguuccucugcacacaucccccuacuccaggcuuugagcuugacugaaggcaaguuuagggagauaggguccauauuaaggaaaccgagaguaucaggagugaaaguuucuaaaagugcauuuguuuaaugcucccuguggcuguggcaaggggcccacacuaaguggagaugcagucgguggucuauuuggaggcuccuggcuucauggagcuuuugggaacaggccugggcucucugguuucugggaucuuccaggaacgguccuuguggagcaaagcuguuggagagagauggaauuuuucaaaauggaaagaugagggugcuugugacauugcuuuggcccucagauccucuggcugcuggagggaauguagauuucuguccugccaaccucauacuccuuuggauccauauucccaugaacugucuucuuccacuacuagcauccuuucaccucuguggcccuggaaauuugauuucuggucaggauuguguuucugggguuggaguuuguuucucugcguugcccaguguaugcacucuuaggcucaugacuagugugccagccccuaucugggucacuacaggucuguuuuggcagguggaaguccaagcagcuucuauugacaugcagucccagggcugcaggcucaauuaaggagugcuccucuuuucuuuacucuuguuuccuaugccauuccuuuggcauccaguaaguugcccaauuugaauuaauaaaaaagccuuuagcuggguuggauaaucuccccuuuuugacccuuggacgauugguaaaccuuuuggcauucaggagaauaaggacauuugugaucagcuauagggugggggcacugcugugugggcuagaaggucauuguccagaguucgagggugggguacuuagaauuggaaacugcauaggauagguggguauuugagugauugugauguaaaaacacaacucugagucuuaccagaauucucacagcaaaagauguuuaauccuuugaaauuagcaaucucucuuggcuaguucugaacuuuggugugcuguaaacuaaauuggagcuauucuguguguauuucaaagaaaacagaacaacucaaaacaacaggaaccauugcauuacauagcugugcaaaacuggguaaagggacagcucaacugaauuauuguccagagaggaucuuguaaacugagcagaguuggggaccuuuucuuugcagaaccugguucagagauuugcuaggagaaaagcccuugggagcuucuguauggcuuugauagcuucuuaagaccuggugggguuugcuguuguuuguuuucccucaaaugugcuugucuccucucccugccuuauuuucccugaaaucucuuauguuuggggcucuaccauuuucucaguucaaaacagaauugaauguuuuucaaaagagcagcuuuauuggaaagauucuguuuugaggccuugcacuaucauucaaagggugauuaaauauuuuugaaaugucaacuugagaauccuacauacagccuuuguugggcagugagucagucuuucucagucaaagcuguuucaaaacccaaaccagcuaauuguccauuuacauugcuuuccugucucuauuugcuucaccuaaaguggcauaaauauacccagacuugaaaggcaugauuuuuuuuuuuaaguuagcuauuacagaacauuauuuccagcacuuuguauuuuaauuuggaaacugcuguagcguccugggauuuaaaaguagugauuguuugagcugugacuccuuuuggcaagaauggagaaauaucagcagcuaguaaauuuuuuaguuuuauacuuagcucagagugagaaaaacuucucagacacuaagauucaaaacugauugggcaaaagaacuaggggucuucuugaggacacggaggcagcaggaaagccuguuccuagggacccauucaugcuuuccacuggcagcugaagacuuucacuucuggaaggauggugaagggaaagggacagcagugauguguuucuagguuccugucaauuuuuuacaugacuguuuauguuagaaauaauacaguacagacugcuguaaacauauaauuugaacuggaaauauguuuaaggaaaggaagucuuuuaaacugguggaauuuuauaaacaugcuuagaugucuguaaauuaaaagaaacuguuaagucacuuggagccaugcauuaccucaaaaggcacuaugaaagccaggcucuggaaagugugcacuagaaaggaaauuaaagcugaaauacuguagcccuuagcagucuuucuuuaaauguauuuuugucaguucuaauggggcaaacuaguugugcuuugacagaaacaaaggcucuuuaucuuucaguucaauauuagcaguggagaauugucauuuaagaaggaaagcucagaauauguguguucaagaaggaauuugaauaugccuuucaacucuuucuugugggaacuggaaugccuuuuuuguuucauuaaaaauguuaacaagcaggguggugguggugcaugccuuuaaucccugcacuggggaggcagaggcgggcagauuucugaguuagaggccagccuggucuacaaagugaguuccaggacagccagggcuauauagagaaacccugucucaaaaacccaaaaaacaaaacaaaacaaacaaacaaauaaauaaauaaaugaaaauaaauaaauaaaauaaaaagguuaauaaauuaauacuuuuacauauuuaugauauuuugauucauguaugcauuauaugauauucaaaucaaaguaguauacuuuauucuguugucagccuaacaguggacuguguaauguggucaacugaagggcaacuaggauaaucauaaguugggaaagaauuuuaaaaggucagcuaguuuuuuucuaaaagcaaaacuaauuuucaaaccuucagaacacccccaaaccugaucauagguaguuuggaaucuuccugggacuaucuauucugaggcugaccuggcuaaucagagcccagucaacucugucaucaagguuuacaaggagucuagucaagcuauugugcuauuggugugccugcugguugugauccaacaggcccagugagcagaagcuguccuucuuccuuugccagaaaaccaaauuacaagaucuugcucaucauucccuccuucccaaggcagaaagaaggcuugccaucuuucauacccaggccaaaaauacaucccaguaucucaaagucaucuccuucuuucauggaguaggagccaaugaaaagucucagaagaaagcccacaucaugaagaagagcuuugacugaaaacaaggccaucauguuuuaacuuuuuagguugccauagaguuuuauuucuagccuggaauaaaauugacuggaauuuugaagaaauccuugauuccuucauuuaucaugguucccaucuauacccugccuuuaaacucaccaggguguugaccccuccuuuuacucagcagguggguuuccugcuaggugcugggauuaagcagugagcaagccugcaaaucuucugcaucuucuuagugacuguauaguuaccauccuuggccuggugcuggucugcucuaugguuugcccuuuguuuaucacuuugagauguuggcugugguccauccagaaacuaccuuguauacuaauugugguuuggaaucugcauucauugaccagauuuguaagcuguuccaugcuaacacugcuucuugguuacuccuucuuggucacuguucuguuccuuccuuagacauagcugaauuuaagcauccccccuuuaauaagcuguucauuagaccuccuuuaauauucuguuuaguugcuuuucucuauuguuccagccaaaccuauuuuuaugcuccuguaaguagccagacagacugacaaggucaugggaaguacauauaaauacaaaucuuacaaguuuaucuccaauuuuugcaagcagagccucaguguguguggcuggauaauuuguaucuuuuacaaagcaucucugaugguuauaaugagucagcuuccccugggaaucacagguuacuccuuaauuauggacuguccugaaucccauccagaccucucagcuguggcuggguuagagcaaagcuaguuucccuugggaagccaacaggccuggguuucugugacagugcuugcuccuuguccauuauggcagaacucacacaaaauacaaagcuccaagccacuuaaaaaugcauucucuaagugaauugggcccccaaaauuauuuuaugccaugaauuuugaccaucuugagggugcaguuaaggcaucuaugaauggcagaagacaugacauaguguuccuccuuugacuaugaaauacagauuaguguucuuuaggaucucuuacccuccugugucucuuccauaaagacugagcccaugugagggaagggguggugucuauaacucuggucuacaaagcacagaacucaguaggagccaagaccugguaaagcauuauuaauucugagacuuuuagccagggugcuggagggcuuggcagacaugaauuaaugggcacuuuuccucaaaucaguuuuuucugggcucacugaugauagguauuaugcuugggguucucugaauccaccaccucuaagcggccugggccagguuuuaggaugguguccuuuaugccucagccuuauuauuaugacaggaguagcaggaagcguggacaauacacagaugcaaagaccuagcaugcuagcacugcucauucacucuugcuccuguguucugcagcugggucuagagaccaaacagucagagguguuaggccucugucacaugguggugugcugcuaggaagaaagguaucaugaaauauggggaccugggagucagaaagagaacauuuuucuuuuuucagggguagaaauagaagcucuccagcuaucugagcuccuauuuaaaugcauacacacacacacaccaccaccaccaccaccaccaccaccaccaucacuaccaccaccaccuuuaaugcuagcacuuuggaggcaaagacaggcuauuuuuuaugaguuggugaguagccugguuuacacagugaauucuaagccaagcagucaggcagggaugcauagaggggguugguaaggaaggagggaggggaggagagaaauauaaacuacauugaugaucgguuuuuaccagauugaguuuggacaacaagaugggguggacuacucugaacugggacaggauugaaauugaauugugaauguuucuccuuucuuggaguaucuuaaagaacugguaugacuggaagaaggagagaaccuuaaagucaacagagauuucccauuuacauuccuuagaaugagagugaagaaugcccauuuaugacuuguccuccuaacugagaaaacugcuaugcuugcgauuuucuuuccucuacuguugaaucuauuuuaugaaaaauguuacaaagaugcagaaacagugugaccuuuacacaguacuuuguuguuguuuucuccagugcgcagauauaagaaauacuaauaguacugacaccuaaccugcagugcauacagugggucucaugggaaaaugacacauggagcaaaacuacaauuauuaagaguuaugaaaagugaaagcuuauguuuuguauaauuuccucuuagaacugaaagacuccuaaaguaaaugcaugccaucuuuagaccaggcccacagggggaauuuuuauacauuauuaaggacugcauccugugggucaucuacagagugacagagcugaauuggagaaacuuucugccauuaauauuuaggauuuuuggguuuuuucuucuuuuaggguauuauugaggaaauuuuagauuaauccaauuaauacauaaucaaguccuugccaagugauuuuugaguuuaaaauuuuauuuuuaaauuaaaucacagugauauaugcuuauuuugcaaauauguuuuaaguaggaaaguucugaguuuauuauugaagcaagggaugcucucccauuucagaaugguaaaucacuugugguagucggcaaugauguguuagcuugagcacagcauucaucauguacucugaauaguuucauugccuggaauaccuccugagccagcaaguaguaguuucugauacgcucacaagcuaauguagcaucaugacugguugauggggugggauuaacuuugacuauagauagaagucagcauaacuucuugaugacauuugggaaggcuaagaccucauacaggugccuucuacugcuucccucuuuaguaauacugugggugcuguggagaauaggagcaagagugggaagcagcaggcucuuugguaggcagcucagagcugggguucuagaauuggccugguuuagaauacauuuacccuguaacacugguguauuuauuaaucucugagcccaacauugucaccaugguaagugaaccaugcuaaaauaauuucuuaggauuuuguuagguaaaauaaauaggaucuuuuaguaacugguauauuuaugcccuaugccauguguuuguuacagcucuaaguuuucugcuuccuaaggaagacgaacuuggcacccacaacucaugagcucaugugauaaacacuagcugagaagggcucagaauguccauaacagagccagcuacuucuugcuuccaucuugguaaaaacaagcucuguacugagauaugaagcauauaccgauacucagcugauaggagaaaauacaucauuuauuaucucuauuuguccucacggagacagggcaaacccauaacaguccauuucuaguagugauuuuaccacuacagaccuauccagagggaauaaucauaacuggauaaacaguguuuucaagugagcucauuuugaagcucugcuuauaauaguuuuaaacaaauuaaaaccugaguauauaauaaugacuaaauuaaagggucuaaugcacacuaaauuucauguagccaucaaaaauguauuuguaaaauguaaauaaguuuggagacuuuauaacagauuaaaaaguaagauuugaaaauaagcauaguaagucacuguuuguguguuuaagacuauauauagaugugugaauuuauauaucuacauauuauccagauacauauacuauaugcaauccugcauaugugauagaauuguguagagaaugagaaacacacacacacacacacacacacacacacaaacccaaacacauacuuaugcuauaaauuaggaguaucagaaaaaaguuguuacauuauauuaauaugcugauuguggauauuauuacuaagguucuguaaaauguuaucagcaggaaaaacaguuaauggguguaaaagaucuugcugauuauuucuguacuugccuccagaaagcaaaggccccagacugggaggguuuuccuagugagcauugcaggcccuucaaggagcaagugauuguuguucuagagcacagggaaugaagugaucaaaguuucuucuuuuccaaucaauggaugagguuaguacuauccuaugucagaaucagaggcauacaggaaaacagauuauuagucagguucacaccacuggugccauaauuguaaauagguauugccauauucaaugcagccacaguuuuauuaaaagaacaauaugagaucacagaagaucuauccaagggauguuuuaacaucaggaaagcaaugcugauauuaacacuucaaggggaguauggccaucucaacagaugcagaaaaccaucuuauacaacacuaggaaagguuuuauacacugucacugaaauucuuguuaagugggagguuuucuauauauuaggguugauacaucugugccaaugacuuaauucgcgugacauguuuaggaacccaaaggccaauguuuaugaagauuuuaggcaacagucuugugugggugacagguaugugacaguccaguaaaggcagggcuguagcacagagguuuuaacucauguggaguuguaguuucagcauuuccaguccccacugugcacuccccaaauucagaugacuacaggagaucauauucaggcuuuggaguucuguaaaucacaauuugguucuggugucgcuauuuaaaagccaugugaucugaggauguuucuuaccacuuccaaacuuguuucucuaauuuaaaacugagacuuauaauauuuguucuuuugagacuuugaagauuacuuuaauauucagcuuuaauauuuuguugcuuugaagauuaacuuuaauaucaaacauaaaacuugaccuacaguuggcauuuuaaggaugcuuguuuuauuuuucuuuaagcuuugugguucugaaauagucucugauaaaaguuuuuaaaaauguguacauacaaauauguauggguaggucuugcauuucucacuugugucuuguggcauacaccaaguggcuuacauugucacaaauauagggccaguuauuuauuugacuagagugggugugcugcugaguuguauuuuugauuuuucucaucaucauuguuucuuggguuauacuuaaagcacacaggaaauguacaaagcagauuucacuaagacaggaaagccagguguaauuauugaggauaucacuguaaaauguucaaagaagccaauaccagcccguucaauuguaaacaccaacuacacuaaguucacuaauguauuaauaauuuaugucccacuuuugacaucauuuauuuaagagagauauuuugauuugcuuauauuagauuugguucgauuucguaauuaucuuaguuaguuauugaauuaaaucauguuuaguuggucuguuaacacuuaauguacaucacuauacaucuaccaaaggaaagucuuggcugccuuuucaaacuaaaaacaaauugugacuuggagcuuacuuucaaucugcucuuaauccacauuugguuacucaggggaggggaagaugaacuggaucuaugcauaauagacacagcauguaaaguaugcaucuuuuugccuugguccaguuggauauguuugguaaucugaacugccagaaagcuauaacccagaaagaagcaggaccacugacaggaguuaagucacuacuuuucuaggaaagcagggucuucauaaaacaccagcaugauggagggagacaucagaacuguguuguugacuuuuguuuuuuguuuuguuuuuuuguuuuuuuguuuuuuguuuuuuguuuuuuguuguuguuuuugguucucuuuuuuuuuuuuuuuuuuuuuuucuauuugaccaccaaugaaagccuucagaaaaauaaaauauaaagaagaugcaaaaugaaagaaacuuguuuaguguuucuuggaguuguuugcuguuuauaucagagaagaaugagacuuuauauuuuagcuagucacauucaccauauaauguauacuguaggcuccuagagucaagaugucccuuguauggggccagcuuagauugagaacuuaguguuggauaauucucuuguauucuuuuggacucuuuccuuucaauccuuguaacaauuggaugguggaugguggagcuggaauaguuacuuuuaaaaaauaaggauuuggcuaaccuuuguuuuuuugagacagagucuuauuacauagccuauguuggccuuaauuuugugaucuuccuaccucacucagccuccuuagcaauaauauuauuagcaugugucaucacauccagcuauguuuuguuuuaacaucgauuuuuaauuuauuuguguguguguguguguguguguguguguguguguguaccgauguuugugguggucagaaggucacuuucaguacuuauuucucuccuuucaccauauagguucugaggaucaaacucagguccccagacuugacugcaaucauguuuuuuaaacugagcuaucacacaggguccuggaucugacauuuagaaagugacacaaugaacacugagagagguuuaggagcuugaccaaggugcuguaguauauaguuuaaucuaaguggucugaccuacuaguauauuuuuucuuuuuuccuuuuuuugcugucaagcauuucuuuucuggcuucucccugauuccuggugguacuguucugacauacauaugaagaacugaaacaccaacagaacauguguuauacgcaauacacaccagugugccucaugugcuaugggaaacacgaauaaggugauuuuuagcuaacuuacccauuccuagcaaaaccucuagcuaauuccuuugcugguuuauggaccuucuagcuaguugugggaggaggauuccagcgauuuggaagaaccagauggagcagggacugaaaucaagucaauuugcaaauuuuaggacuacuguggagauaaaagcuuccuggaaauaaaaaccaauaugcaaaacacuugugaguuaaagcugcguuuuucuaauaaggaaaaggcuguuauuguagguagaggaauaaagaacauuccucagauuuuuacauuaaaaaauacuucaucagugugcaggaggugagucaagcaugccuuuggcccagcugaaaaugauccuuugcuguguucuucuugccagcauagaaaguagauugaucucucaacaguuuacucuugaagacugcuuuccuaaauuacuucaucauacaagugcguguguuucagccauuuucagaaaagaaguuugugggaugauuuuuaaagagaauuuauuggagacgacugucucugaucuacuacuacaaauaaugaaugugaucccuacuuuccauucauuauuugugacugucaccugacugcccugcagggugauuuacagagguggcagccuacacuccaaguuagagcuugaguuuuucuggcugucagcaagccccuguuaugauaccauaaucgaucaggaacguagugaaacuuucaguguuucuaauuuuaauucaccuaauagguaugcaugcuggauugucaaagcaccagguccuuuauuuuccuuaacuagcuuaauucuuuuggccauugaaauucagaguucuuuaccuacaugucacauuuugcuuugauggguucugucuacauguuucccuuuagugguguggaagcuaagaaauaaacuuguuugggguauuggagauuucaucuugggccauaugaaucaaggcuaaguucuuaccacugagcugcacucccaagucuuaguggaaauuuaacuaaacucuaugucaguugauuucuguugugcuguggaaaggucauaucuggaccuuaguguucacaucuauaagaagguuauuaaucacauaggcuaccucccugagauaauggcaugauuaggaguuaauacugguaagccaaacauuuagaagacuauccugcauggaguuugcaaucuuagugcugcugcugauucaaauggaugacucauaaaauauauucaucagacaagacagaacuaugaacaagagagagggaugagggauggagaugguggcgccacuaacuagguaagaucgucagaggaaaauuauggauuuuccccuuuucuucucccucuucuuuuuauggcuguucuguuguuuguuuguuuguuuguuuuuuuguuuuuguuuuguuuuauuuugguggaaggagagaguguuuugaccucaauaugcuugucaucugagucuuggaggucuuauuauagaguagugucaugaacucaugauguacaguaucacaucuggaguuuuguugcuaaugcguaucauucuagcguucaggagacugagggaagagaagacucaugaguucucgucagugacacucugucucuuacauugcccugugcaucuaggccucacaugcauaaaacuaggauggggcccagcucuugguguuuuagaaacuccucagguaagucuuaucuucuagaagauuugagaaccuuugcgugagaugccuuuuugaccucuguccuaggaagucucuggcaggcaagacuucaagccccaggaccacaauggcagugccuuguucucuuccacccuccuguuucccacacugaaaugacaucuguuaucuguacuuuuugguaauuguuuccuuaucuuaugguggaucugggaguucuucagauaaaaaagugauauauuuggaaauuaauuugucuuuaaaaaaaagaugucauuugaaaauagacacaggggagguguccacaugaagauucacccauauauacaaaugcaccagcauauacauaaugugcauguuuugugaacacacagaaacuggaaacauuuacauuuauuaaggaaaacuuuuuguagaggaacaguggaugauuguccuggugcagacaacauguuuagucagcuuauuagacuugucccaggaauacucugaauggagaacuugugugauuggcuggaauggaauucagaauuugucuaaaugcacugaucuuguguuaagucuuauacauaugguuucaagauugucuuuuuaugguaccaggacuuaaguacuguuccauggaccuggaucaaguugcugccuuccacacagugccauuuuuuuucuuuuucuuuuuuccuuuuuuuuuuuuuuuuuuuuggccauucaguggaaagagagggcuucagacugugguggacacaagacaucugaacuucagcaagaagcaguagcccauuauugaaucuauucauaguuuacuuuuuucauauauauaauuugggagaauguuugcucucauuuaacccuaaaaccacaauuucucaucuguuaaauaaaagagggauaucuugaauugacacaggaggaaagaaagaccuuucaaaaacauucuggauuucucaaauauuuuaaaaguugcccuguaggauagcauuagaacacugugggguggugggcugugcacagacagccugguccccaguugagcaaaggucuggaaccccagauccccgguguuggugauuuccaccugcaugggacaauaggaguucgcaccuggcucucugcaggggcgcuguggaaggcuguggguagguacagccucccacaguccccugcagagagguauucagcugcaccaagcccucacacaugcaaauaagguuuccccaaacccucaguccaagccaaugagaaguaccugcugccaaacccugacucaucccccccaaacuguauauaaguccuaucgaacgaauaaaaggugugggagaacgacuucaugauccgagccuuugcccuaagagcuguaacacuugaggaaaggucggcucuccaaagcgccgccugaggcucugccgcacuccucaauggcuaaucagcuucuggucagcccagcccgaccugacccagugcggggcagcacagaauuauggcagaggagguggagcugacuggagcagcagaagcagggaagcgacuuccccucccuccccucauuugcuucccuucgccggaacccucgcaccaagccuggcuagaaucuccguggaaaaucucugguacccagacccacaaaacaccacccuuuuagaagcugugacuccacaugaaucugccucgaguugagagaagaguagcauucugagaaagcugcuaguggaggcuuagaaauccaguaagucuaguaucuagaaugauauucaauauuauggccuaguuuuuggugaggauaggauuaacugugccuucaaaaaguauugagcacgguguggcuuaaucuuagaagucaagugaguagaaaugggauuuucuucucucucucucucucccuccacuguaucccugauaagcagguuagcaucccagagcauugauguaauuauuauguagcaauguuuuacucaguggacauugaggccucugagucgguauauccagcuuuggaccaguggcugucagugucugugggccaucaacaucugccucagugaggaccaugugugaagugcagauuuugugucccauuccacacccacacaucguuuuccuuacuucucauuagucuauauggccagagaggugcugugugcugggaacuacagacauuccucacaaggauucuuuugccagcuagcuuuggagagcagcugacccuuggaucucaaugcugagagcaaugcgggcaguuaagugagaacuccugacccuagaugcuuauuucaaucuuugcagcugccugagagauugcaguacucagaguuggagaccagugguuugguacccuacggaguaggagcaucaucugaaagcuaguuagaaauccagacucuggaaccccguugagaguuacuaaauuacaguuuucauuuuaacaagauuucugugacucauaaacacauuagaguuuguagaaaaguugcuuuauagaaauaaugaauuuccuuuauagaagucaaccucuagaauggcucuaauuuacaaguuuugugaggaggcagaacaguugguuuggcuucugccugacaguuacuugcaaggcaaccaacagagagcaaaggauagcuucauagcaguugcuuaggaccaggaauauuguaauggugacagucugucggccacugggaggugagugguggcaguuaagaccuuugcagaggcauauaaugaaaaccccauuuuuaaagcagaugaaugcaaaggaacaucuuagcucccacaauggaagggugaaauaaaagcucugguauggcugcaccaagaauauauacugugauugucucaaggaauccggucugauaugcuucucaucucagugccccuuuguuagcaucacuuccuggcuggaaaagaauuaagcuaacaguuacguuauuaugaaaauguccuuaaucauaacagcuuaaauagauuuauuccucuuugcauaauaaugcaaagacagccaagaaagcucugccuugcucucauacagcucucacugguuaaguccagguggcuaugucccacuuaauugccuagccaggaaagaaucaaaaggaccagagcccagaaguguaacauagcauucuucucauaaccuauugguuggaauuaagucacauguccagaaugguccaugcaugguggagaaugcagucucuauacacaaggaaaugugccuacuuacaucugaagagaaagggcaacuuugagauauugaugggccagaagagacuaauccccugggugcaucaagauguagcaugacaucucuggauuaacagccuacccucagcauuugcaguggaaaaaggucccuuucucuaugagcucucuaucaaccacucuaggaagaaccccagauuggcuucuucuugacccuuccuuggccuggaauacaugcaccaagccaggaaccaaauauggagaacucaucaccugaaccccauggacuguuguagagaaggaaagauuuccaaagauggauggacagauucuuaccugagaagaaagagggaauauugugguaugggucccaucucccaucaucuccuuccauugccuguauucugacuuccuauuguaacuucccuuugauguaaagccugauccugacuuuaaugaaggaaauggguggcacauacagccaucagccuuggccucaaaauuaugaggcaccagcaugaauaugguucagguguuaucacccuucauaucuaugucuguucauugacacauuaaauaacaggcuuagugcagacuaaguuguaccuaaugcuuaaacagcuggcaagaaacagaaguagagaacuugguguggggccuaaauagauaaaggcuguugcugucucucagcauuuuugaguuuggagcauuuggaaauuaaguuucugucagaacaaguucacuuguuggcuguauugguauguguuugagcacugcaccauuugcuuuagugguuggcaaauuugaaucaagguggagauagacuuggaaaaugcuuuucucaaauacgcuaaauuaaaugaguuaaaugucuaauucugacaaauguguggaagcuuguagccaaacaaugaguuuuauaaaaauaaugauuugaacucacuucccaucgcuuucucaagcucuuuauguacuuuccuauguuuuuuagaccuuauucagagcacaaaagauuagaagugauuucuaaagcuaaaggcauuauucugcaggaaugcuguaaagaguaaaguuagacuuauaagcagccgaagucuuuaacauauucuguguaaugcuuuaaaaaagacuuuugaugucucgggugauaaaaaaguaauacauaauagucaaauaacacaccaauuccaagccuuucaacugaaugcuuauugucuauuuaauaaaaauagggguuguaggcacaucugaugcaaaugaacugaaauuuuauuugccagaacucugcguauccuguuaauaagauuuacuccaaacacugcuguugguuuaauaaauacugaggggacauuugcaauacgccucuuggcaucugcuguuucucuccucugagcauugacuacucuugugagucuuuaccaggcugcuuuugcuguuuuguacuuugagguacaaauagagacagagaacccagaggguucuaacaaauuucauaccauaaacuuuuuacagaugugcuuacuauucauuaagaacuuuuuguuuacugaaugaaaacaauauuuucuuuuuggcacuuuugugcaagagguuuggauuuuauuuuacuagaaaccuaagaaacaguaaugaaaguuucuagacaguugugaugaguuuuccggacauuuuaacuuccuggaucucccauucuuuuggacacuggugugaugcaguggcagggagcucugaggagacugauuuggguuggauaaaaggaagaacuuucuaaauagcaggcagauuaagaauaggccaaccagacagugauggcuaauagggcuugugcuuggguuguguggcuagcuacugguuuuggauauucaagaaauacuguacauccucuggcuguggaaauuagcuugccuuucucaguuccuuguaaccuuagagggugcugcaguucuuacaguuugauguugugaacugaguagcuuagcaugcauuuugcuuccuuuacugaugacuuggucugacaaaggcuaggaaucuuuuguugucuuuaguaguacugugaaauuuuaggaucaacacacacuaaugccaacugucuaguugggggaaucauaaccauugcaauuugacauugucuuagcuuucaaggauucugauaggcaucuaccauguacaguagucacucaccaacucaggucauugucaaguugcacagccucuuuucuucucuccuguuguucucugcagcccaaaggccaugaaaugucccugcauuuccuuauggaagucauuccuccaacacauuuaccaaguauuuuaaaguaaaauucuuuaaaauuccaguacaguuuugccuuaugccccaucuucuccuuggcagucaagaagaucaguuguaguugucaguuagaauacacuaaucauucaugacuaaccauuuacucuuggcugugauucuucauauaguuccucucaaauaggauuggcaaugcucuugauaugggaaguagaaguuggaauaggagguaaaguucuuaauguagguagaaaauguccauguguuagagaacagagguaauugaguugugaaggccaacugucccuguucuauagcugagaacccgagcucagcuccuuccacauuuuaagcucuggaguuuagccacugaguauacagucugacuuguuuggaacugaauaguuuucucaaacgugaacacauguccaugcuguuaugcccugauuccgagggaaaccccggagagcuuaggaacuacagaguccauugcaauuugcauaagaguccuuuuuaugagucucaaccuggauuggaaaccuuccuacaguguuggucagaagugcgaccaugggcuuggauggcuuggcacuuauauacagcauaguuagagauucuuugaaugcuuaagguggagaggagggaaggugggugagguaagucaucauucagacacgauaccauuugguagggcggaauccagaggcugagaggggguuucuuccgaccuaaggauuaucuuuauggggcuaucgggaacuaguuuuauggccagcuauaacugucuaugaucuuugauuaccucucaucuaugauuuaaauguaauucuccuuuuuccaaggacaggcaccggcugcagcugggaagagcccagcagguuaucagggagagugcuaguuucuggaguuggggaguuuuaucauuugucucauucaagcugguaccuguggcuccuugaguucucucugaguggcaggguaggggggucccuguguuugcuguaggguguggggagcaggaguuggggaaaagcagaacuucugagggaaaacacagaggcaagcugccuuagugucucacugcucuugcugugagagaaagccuaggggggagggggacuucugugggagagugcagaagcaagcugcuuguacacuucaaugccccccccccccaaagccaaacaaaccaaaacaacaacaaaaaaacaaguguauuucaggggcuuggugaaacacgauguaucugaaccuuugcauuagaaagauuccaaagcugggcauggugaugcauggcuaaacucagcacuugggaggcagaggcaggcggauuucugaguucgaggccagccuggucuacaaaaagagucccaguacagccagggcuauacagagaaacccugucuugaaaaaccaaaaaucaaaaacaaaaacaaaaacagucccaaauaccuaucaacuugaugguaagaauucuugccaaagaaaagaaaacacugaagguggcuugcucaccccggauucuccucacccuguggaaaucgacauccaugguucccauccucuagucuacauuguguaaacacacugauauuuuagacucauugcuguaggcugacaaauagaaaguucaggaugacuuccuacagacuucccuccuaugccaacauuucaguuccacuaaaaagauuaucuacaaaaugcaaaauuuugauccagagcuaaaaaugaaauaauuccucguguuaucuguaaauuguuuaugccuuaaaauuuuuaugcucaugguugauauuuguccacaauguauaacagauuugcuaagaugauuuaccuaccauaaauauucacccuuuaaggauguuaugcucaguagguuuugauauauuuauaguuguguaugaaaugucaccacagucaaauucuagaacauuuuaucaccucuccucauauccccauuaucaaucauuccuucuuccacccgugccaaguucuaggaaaccacaguguuaccuccuguauauagaugugccuauucuugucacugcaaccaacagaaacaauaacagaaagccacaacuaauuaaaaugaugaguucuggacccuagucccagugaacagauacaucuacaaaauaacuccaggaacugacauucagaguucaucacagaagagggggugacaagaacauaagagccagagcgucaggucagccacagccacagccacacacacacacacacacagacacacagacacacacagacacacagacacacacacacacacacacacacacacacaccauuaugcagauagagcagguuacaguaagggagggauauauguauauauacauauauaaauguaacaacacuuaauguaaaaaaaggucaugaauuugaaagacagcaaggagagguuuauaguaagcuuggagggagaaaagaaaagggaaaaauaauguaauuauauuagaaucucaaaaauaaaagacaaaguaaaaacaaagaagaaagaaaagagugaaguagaagauugugguuacaggccagccugggcaacacaauggauucuauaccagccugaccagccugggcuacagagugggccuguuuaaaaaacaaacaagcaagaacaacaaacaccuaaaccaaucaagaacaacaaauugaaaaguaaguaggagacugauugguuugcugguaguuuuauuccuuuucuuuucucucuggcaaagaagacauuauggagucuucuggaguaguucauaugaugggucuuguccuugaccugcaccuacuuuacuaguaggacuuagcaaauaaggacuuaacaaaaugaccagcugaaaauguucucaccuauauaaggugccaguuuacuagguuauuuuauuuuaugauguacaaaagcuugcauuugugaucuuugaaguauguccuggcuucuuucuucucaaaguauaaaacauguaguagcaacccagcacucugcucugacucuugacugauuccucucauggacauuguugaagagucugucugacuuagaguuguggaaaaauagcuguauguucuuacaacauguuugaauuuuauucugggccuguaaggauuuaacacuaugggcuuuuaauuguuggcaucugguacauuaauauaaugauaauaauaauuggaaauaaugugguucaucucuugaguuguuagcuuuaauucccugaauguuuuugaacagaagucucccaaagucuuaaaguagaaccauuuggaggagacccauucuaguuuuuagucagaguguguucagacucugucuuguucugauuuguugcaaugauuuucauuguuugauuuuaauguuuuccacaugaaaacacaaaaccaggcaauacccaacaaaauccaccuaaaugcccucucugaggagaccgaacagaagcaacaaugugucugucuucuuugagagcugccaggcucuguggggccaagcacaguggcagaacucuguugggaaccaggcugcagaagcggaagaggaagcggaagcggaagcggaagcggaagcagaagcagaaacagaagcagcuuggugcuuaugauuucugugugauaagagcaacuuuucccauucuccagauaacugucuaguagauuugcaaaucuauuuuucccuccucacugucuuuaaugaagucuucaaauucuaaaauauaauuuaugacuggaauuuauuuaauauggauucuuaagucucaaggcgcuucucaaaagauuucaaaauucuauguauucauuagugugaacgucuaacaaagaaugugcaauugaaaagggcugaagcuucagaugaagagguggcucagccauuaagagugugcaugucuucucugagcuuggcucuccacacucacaacagcucucacagcuaccuguaauucccacucuagaaccuaugcacggguagcacacauucacacaggugcaugcauauaaagaaaacguaauaaaaauaaauacuuaaaauguaauuuguauagagaucugggaacucuucaaauauuuacaacuaaauaagaaucuaauuccauugaaucauuaaagauaacacuuuugcuucaggagucucggucaccaaauugucuaaauuuaugcuuaacauggaaaaauauuuuaaaaucauaauggaguuugaauuguuuguaugcuagaagcaguaauauaauauuaacuauacgaacaaacacguagucucucaugaguuaugcuggccccuaauuugacaaauuuaguacauaguuguuaccuagaacugacugguucucaagcaaacuuuuauuuucucgagagacuuccuggcacacggugaguugugcuaauuauaguugaucuaagaauccagccaagaaaacuuuguaaugaugaccuuauuuuuaaaaugcauccugcaaauccuucucccaaaccuacaagaagaaaacauuuucgcuaaagcuaaguuguuaguuauauuuccaagagaacaaaaccaaaucauuuuuauucuugcguaccaugggauuggauuggagaggcauuacagugucagggggacauuccauugggguuaggaaguagugucugagcuauauauuuaguggugacuuuggaugcuucacucaccuuuaauguuguguagaauacugccuguccaugugaacacaggcacaguaagaggucuguuaacagacguucacauccacggcucucuagguaccuuucccacccccacaucauuuauauaugauauuuaguguauggaccccaaccagacuucuguuugaaguccuugaaucuggagaggcagcuugauaaagcaaaacagaaaucuguuggcauuuugagaguggaguucacagaggauguuguuugcaguguccugaaaacauacaggccagcagcuggagcaggccuggugacaggcaaucucacuuccagagaacaaggagggcugagcaguccucuaaggauuagcuccagcucagcagcugcugucugagucugauuaugcacauccggcucuaagagaccugcauuaacccucagccccugggaacuucagggcuguuuuuuuuuuuguuuuuuuuuuuuuguuuuuuuuuuuuuuuuuaaaacaaaagacucuuccagggacaaccaaggacuaaagcccagaaaauguagaggauaaaagaagguggcucuuugggagacugaauuugaaguagccuugagccaaagcugaagaagaccuggcaaauaguauuugucuuugcagaccugguggcggacauugggggaaaggacuggaccaggagggcuugagcagcugaggaggacagaggcucagagaaguuaaguuaccagcuuagucauuuuuccacugcuaugaagagagacaguauaguaugaccauggcaacuuagagaagaacgcauuuaaugggcacuuaaaguuucagaggaugagucugugaccaucauaguggggagcauaggaacaggcaggaacacauggcacaggauaguagcugagaacuuaacauuuuuuuucccacaugcuugaggcaaagagagugugcaaauugggaauaacacaagcuauugaaaucucaaagcccagcccccauggcacuccuccuucaacaaggacacauucccaguccuucccaaauaguuucacucacuggggaccaagcauucaaauauaugagccuauggaguccauuuuaauucaacuaccacagagaaaaaucauguuuucccauuccccaguuagagcugaaguaccacaugucugaaguuguuaucuuuaccuugagauaaucauucaugcuuuugaaaacugaccuuagagaagaaacacuggagaaagcauuauggaagcuggagacaugguuaagaauacauacugcucuugcagaagaccugaguucaguucccagcagcuacauuucuggacucacaaucuccuguaacucuagcacccagagauuuaaugucuccugccuccaagggcaucugcacacaugugcgcauucccauauauaguuaaaauaacaaaaacauauuuuuggaacauaagaaaagcacagggccuggaaacauggcucaauaguaacaucagcuauucuuccaaaggauucagguucccagcauccacauagcuacucacaacuggccacucaaucucuaguuucagaagauccagugcccucugcuguccuccguggacacuaggcaugccuguaguacguagauauauaugcagacaaaauacacacauauauaaaacacuuuuuuaaaaagugcaucggggaauuauauggcaaucacuguguccagcuuguugggauauauuucuuucaagcagcauuuugccaguguguaaaugacuaguggauagaccacugcagucaauucuguguaugauauuuaaaggcagagcagauacugggaaggaaaguagaagcuaagaaagcuucauggagaaugagccuucuuuaaugaaauggauuccuuuguucaacuccagcgguaugaggcccagcgcugcacucugggagaauuagguguuugagaaugacaguguguugcugagccuacagcuguccagguaaacaaaaggcuuuguuagaaaaggcuuugucagagaagauggcugucuugaguuguguugcuguguagcaucuacacugaguguugaaugauucccuucuuuaugguuuuagcaggaacuauagaguuauuccuuugggugguuggaguugaugcuuucauguaggaacuaacacauuaaaugcaaaccaaucaguaaauacuuccuuauuuuuguccaauuaaaagauugagcuauuagguuaggguuuucgacauuguugcuuuaaagaguuuuaacuaaaaacagaacaaaccaacaaacaauaacaacaaaacaaaaccagcaugguuuuauucacugaaauuucuugugguuuuggaacauauuuuuauaauuccugucuuguguuuguguguuugcuuguuuguauauaugcuugguguagaggccagaguuugacauuaggugucuuccugacuuguuucucucccuuauuuuuugagacagagucucuuacugagaccuaggguucacuagcuauuggauuagacuagcuggccauugaacccuggggaucuugcuaucucugucucuucagcaacaggauuauauguaccuggcagucacacccaguuuuuauccaugcauucguaugcucagauucuuaugcauguauggaaagcacuauacugacugaucugccucuauagccuuguauuuuauacuucuuaaggaugggaucucuaguuacucugucuacuuuuguagguugagugugaucccaguguguaguuguucugugguucuauucuguguaaaaauaaaaauuagaugcuguauuuaggacgcuuuacugagacgcuacagauuaucuuucuuugcauuuauucuuuucccaagauuuugauaccacauauaggaaaagcaucuuccagacagcugugguuugagaagugguuuuauucagccaucucaucacaauguauuugguugacugauuaugugaauacaaccugagggagaauuucagugguaaucucuguaggcaguuguucuaacucaugugauauauacuauguaaccuuuggagaaucuauuuggacugccgaagcugaggaaguagccuauggaucugugguggauaauugaaguuguuauuaugcugugcuauucaacuuuuagagagcaaaaugagcagacugaaggcauaaguccugugugaauugcuucuaaacugucagcuagguuguaauucccaucagauggugacuuaucuaggaauuggcaugucucucccuggaguagcuguaaaccaaggaaguguguuucccaccagcuguccuugccugggguuggcauuuuucccucucauugucacucuaugucugucuagaaguguguuguucuuuuccaagauagugcauuauguggcucuucaaggaagauuucucuaaggguuaugagcucagcucuuccauccuuagugguuccuguuacaguaacaaaccuuaggguuuaagauagcuauauacaucaucuuaguccuuauuccuuuuuuccaaaaaacguaugugguggauuauuaaggaucuaaaaucuuacgcuuuuugggaucuccuuuuuagaugauuugguaguauuucuguuuaaacucaaccacauuaauagaaaguugaggguuuugacuuacaggaggccuuuaugaauaguucacacuaggauaucuagcacauguucauauaacguuuuuggaagcauuacuuaguaacuuuccugggaguugauuuuguacucaugcuggcuucucuaggagauuccuggguaccaucugagaggagccuucauuauugccaguccaggagggauuuacaucuguaaacuggacaaaaauaugugaaaaggugauuaguuuaauuggucuacaauuauaauuauucaguaggaggugacuguggaauuacuauuauagcuccaaauuccugcugggaaggggaggaaaauaaaaucaccgaaaacagcaauguucuaaaauguuggcuuaacauacaguuaguaacaacaaauuguccaagcacuuaaaggauagagaaauucuuaacaauuugugcaccuaucuaucuaaaaaugagguggacuuuuuguucaggauaacugugggaaaacuuucaaauguuuucuuuuccuuggcauauuagauuuuagggagaggugaacucucaguauguuuauuacuugaauauugucucccaugguagugaagacuaucaggguggccucaggagcacuguuguuuugucuuccuucaaaaaaauuccagucccuguaauauuguaaaguggaguguuuuucuuucacaucaaagggcagggaaaguucuacagugaacuaagaaggagggagcugacauuacagcccuagcuuugggaaacuaugugaggaaugccauaguucauggaccagagacccugaagugaaucuaggugccuguguugucccauaaugaaaugacugcaggcagaaauugaauccagaugaaccccaaauaaaauugauggcuuuauucagcauucuuuucaugagauuuaacuuucuaaugugcacauauaucacucuggugaugucauuguaaauagccgaccuuuguuucaggaagccacugugcagggcugcgugcagcacugcuuggauuucugcuuacaucuguuaagcaugugagauaugcaugcaagucuacacacacacacacacacacacacacacacacacacacauacacacacacccuacaccuugauauuuggggaaaaaaacucaaugaaaaccacucaaaucuaauuuuagaugcuccaguuuagaauaacaacuuuuuugguuucagauacugaaguuguggaauucuuaaauggccuuguugaaaguugcauuaggaagucuccaaugcagagcacugggguuuguugucuugccccauccucucuuaccugugguuaaugauugcaaggugucugggaauaaugggcauacccugcaaaguuuguuagcggcaagcuuuggugacuuuuaaaagucaucccgccauccucuucuucacuaauaggagucagagugcugccauggauacaccuaauaaauaccugcaggaaucacugggcuguuuaaugaaaccuaauguagugccauuggugcagcucagugggcaguucuuauuuuccugugaucaaaaugugaugucugaaggauuuucaaugacaguccucuuuccuccucccuccucucaauuuuguuuuguuuuuaauacaucacaauuaaccuaggaaggcccugaacucaggguguagucaauauuguauuguccuugaacuccugaucucccaccucuaccucucaaugaagggacuucaggcaugugccaccaugccaggcugcuccaaugacauccucugauuaccauagaauacuagugaaauaagauauuuaaaagguaaauucaauuuccauuugagcuuagaggauaccagagaacuugaaucacaguaauaagggaaugaauucugcacuuaaggucacuguagagagaugaauggaacuccugcugacccuucuuccugcauauccucaugaugacuucaaccucccaguauuugaagaugcccauucucuucucuguuguucuuuugcuacuuuagauucaaagguggcagaacuuuuggccaaugcaugaugauauuaggccagagagaacacuguuuuuguccugaccacuauauggaaguacugcuccauuauuacaaaugcaccauguguguugcagcucuaaggaccucucuucaccagauucaguuagaguuguggaccuccucuccuuaguaguggagugguauacuuaauuuucuggauguuucuuauaagagccuacucuuuguggguaaagccaauccuaaccuguuucccuaucuuuuacaucucuucuaucacuugauggcucuguuuaauagcuguuuaggacuccagaagaggguucuuguucugggggacagcauuuagucauauuuucucugcucucuagcuauuuggugacaaaaccuucuucaagcucuucacaauccagacaaguuaacuaaucucugaccaagaagagagcugguguuuggaaguaguacagaacuuagugccucuuuucacuagcaaagugaaaccaauuuuguuccuaagaacuuucaaauccuugauuggugggauccuucauacauugcuuaggccucaguuuuuccacauaugaaaucagaggaagacccuucccuuauacaaaggguaugguguugagaagaaauaagauccuuuaggagaaagguaugaauauuuugcacacacacuuccagaguuggaucucacagcuuguggauuagaugugagugaccucauuucauggauguggauaguaagucccagaaagguucaaauggagcuuaucaagcugaacaucugggcuguauuugcacaucauguggcauagauaguccuggcuuguggauauggcuuaggcauguuuugcuuuauagcacuuuccugauacuuugguucuguaggcuccucuuauggcuguguuuguuaugaaaguaggaauucugugaguauguaaccgauuauuugugacuggguuuauacauggauauacaauuuuguaauuuuuguagacaauaaagcauuucaaaaucaucauuuauguguguguuggggaaacuggcuccaugguucccacagauaaccggacggacauucaaauucuuacccaagaaauaguauuuguauauaacaauaguaauuauaugcacauaucuucacauauuccagauaauauuuugauuacuuauaaugccguauaagcaauaauuuauaauaguuuaaaugcugcaugaauaguuauuauucaguguuguuuaggguguggcaagagcaaaguauacuuguuuaguuuauauaaaauuguuuuagaauauuuuuuuaucuaaaguuuguucagaaggaugaaacaaacuagaagcuuacagcuucucaacauagaacugaucuccuuaaagcaguuacacagacuucuucguuaauauagaacuguguguuucuuguugugaaguauauugucagaaaaugcacagccaacgucuuauaguuacauaaaugucuucucuguuuccugugagguuuaagauaauauagcagauuucuuauuuuuggcaagauggcaaaauagcagagaaguuaucuuuuuuguguucuaugaaugccagcauggagcuucagagaaugcugcacauaauggggggaggguuaugugugaaaaggccauuuuuuuuuccugagaauuuuuuuugggguggaucuucauaaguacuugguauacuuuaucaagaccagagguguaaaagacuucguauauuaacaugggaagaacaucacacccagggacagguuuuuaaguuucuggauuauuugaaagcccuaccagccccaacagucgaauaauauugaauuaaguaagucacuuaauucuauacagggaauguguucuccaucgccauagucuuuagcuucugcccuggaacagugauugcaagaaucuccuguuucugacacuggggcacugaacucucuucugacaguuucccaccuggggugcauuggugugguagguucaugaucccacccccucagccaauggggugauucuggguaggucaccugcagccauagccaaagcugcuguugguuucuaauauguugugaaaaugcugccacaaauuaaaugugcuuuagucaaugguuucagucuaaaauucaagaagugccaccuguacgggacaggagauaauguuaaauacaauaggccacgaaucauuccugcaauaucaggagcaugugaaaaauaaaggaauggaagaaaauacauuaaaacuugaucuauaauuguuccugaugacuggacaaucacuagauauccuauagauaacuuuucuuuccauguauuuaaucuguaucuuuaaauuuucauaugcuacgaacauauucaauuuaaaauacaauaaauuuauuaaaguaaccaaguuccagcuguauuggcucacacuugcaaacccagaacuucaaagaaugaagcaagaagauuguuaugagcuggaaccuaggcuggaucgcagaguaccaaucugccucaaaacaaucacaacaacaaaaccaaccagauuuauacuugaaaccauccucauauccuuauuuuuugaauaagggaucauuguuuuuguucugguuaagaaucuuaagugggagaggacccaucacacccauaaccauuacugagggcauuagcaucucaggguacuuuaucugugcuuauuuugaaggcuguugaaggcuuaguaggcagccugugagugggcuuuagaagcuucucauuugggguuggugauaucaggugcuuucuuucuauuuuccuucauaaauauuuuuucucuuuuucuugggauugcugaauugguuuuucuuccuuuguuauucucaauuccuuguauguuuauaguuagaugucccuuguggccacuuagcuaugugauggagaaucuguuuuuaacuugucuugacucauuaugguuugccuucucccccucccucucucaugcuuauuuacaucuugcuuccuuguagugagaugauuaguuuaaaacagacuuuuuuuuuuuaaaggugccuuuuccccccuugaucuuuaaugcuuucaauccacuuuuuaguaaaacgccucacucucuugaucuucugaaaagaguuuucauugacuuuuggccuuuuaaucauuugaagugugauuuuggaguucuguaaucacaguaaguuaguucacaguacuuccaugacauaugaucaugugucauacaauuauuuggguagaaaacaugagagggaaauuugcugagcuacugugcuucuuaagcacaagcuuggagugguuaauagcuagguuaacauaucacacucauaaauaccaauuuacuacaauucuguuacuauuaaaacuguguuaaauagaguauuuucuuuuauauauauaccauguuaagauuuuuauuuggagaauaggcaaaagaaaauauuaauagaaauuucuaacuaauagaguauuaguaaauacuauugcaauuaaauauauaaauuuaaaagugcauccuuccagucugagccaaugccaugagcaggucuugagugcuagcucugcacucaauccaaccauacccagaggaagcagaacccccaggagcucuaacaaaccuaggaucauaggaucauaggaucacagggucucaggaacuuggccacaccaggauuucuggauuccauaggcagcuugacucccagaagcucuuacacucaggaugucaggaucacaggaucauagagacagcuggacucugaggaguucugacacaaccgagauaacaggaaggacaggcuccagucaaacugugaguucaggcagcacuagcgauaacuagauggugagaggcaagaguaacaaaacauaagacacagaaaccaaggucacuuggcaucauuagaacccaguucucccaccauagcaaguucuggauaugcuaucacauaggaaaagcaagauucagauuuaaaaucacaucucaagaugcugaaaaaaagauuuugagaaggacuuaaaugacucccuaaaaaaauacaggagaauacagucaaacagguagaagcccuaaaagaggaaauacaaaaaucucuuaaaguauuacaagaacacaaccaaacaguagaaggaauugaacaaaaccauucaguaacuaaaaaugggaguaaaaacaaugaagaaaucacaaaaggagacuacccuggagauagaaaaccuaggaaagaagucaggagccauagaugaaggcaucaccaacagaauacaagagauagaagagagaaucucgguuauagaagauaccauagaaaaugcaaaaugcaaaaagcuccuaaccccaagacaccuaggaaauccagaacacaaugagaugaccaaaccaaaggaugguagguauagaagagagugaaaauuaccaacuuaaaggaccaguaaauaucuuccacaaaauuauagaaguaagcuuccuuaaagaaagagaugcccaugaacauacaagaagccuacagaacuccaaauagacuagaccagaaaagaaauucuuuccaucacauaauaaugaaaacaccaaaugcacaaaacagugaaagaauauuaaaagcagcaagggaaaaaggucaaauuacauauaaagggagaccuauuagaauuaaaccagauauuucaccagagacuaaaaauaaccagaagauccucgacagaugucauacagacucuaaaugucuuagucaggauuucuauuccuggacaaaacaucauuaccaagaagcaaguuggggaggaaaggguugacucagcuuauacuuuuauacugcuguucaucacuaaggaagucaugacuggaacucaagcaggucaggaaucaggagcugaugcagaggccaugaggggauguuucuuauuggcuugcuuccccuggcuugcucagcuuacuuucuuauagaaccaaagacucccagcccagggaugguaccaugaaaaaugggcccucuccccuugaucacuaauugagaaaaugccuuacagcuggaucucauggaggcauuuuuuucaccggaaguuccuuucucagugguauguccagccuuugucaaguugacaaacaaaaccagucaguacacuaagagaacacaaaugccagcccaggcuacuacccagcaaaacucucaauuaccauagguggagaaacuaagauauuccaugacaaaaacaaauuuacacaauaucuuuccauaauuucagcccuacaaaggauaauagaugaaaaaacuccaacacaaggagggaaaacuacacccaagaaaaccaagaaaguacucuuccaacaaacucaaaagaagauagccacacaaacauaauuccaccucuaacaacaaacauaaaaggaaguaacaaucacuuuuccuuaauaucucuuaacaucaauguacucaauuccccaauaaaaagacauagacuaaugaacuggauauguaaacaggacacaguauauaggaaacauacuucagugacaaauacagauacuaccucagaguaaaaggcuggaaaacaauuuuccaagagaaugguuccaagaaacaagcuauaguacccauuauaauaccaaauaaaauuuacuuuuaaccaaaaguuaucaaaaaagaugaggaaugacacuucuuacuugucaaagaaaauaucuaccaaggucaacucucaauucuaugguccaaaugcaagagcacccacauucauaaaagauacuuuacuaaagcccaaagcacauauugcacuacacacaacaauagugagagacuuuaacaacccacucucagcaauggacagaucauggaaacagaaacuaaacagagacacauugaaacuaacagaaguuaugaaccaaguggauuuaacagauaucuacagaacacuucauccuaaaacaaaagaauauaccuucuucucaccaccucauggaccuucuccgaaauuggccauauaaucuaucacaaaacaggucucaacggauacaagaagauuggaauaaucccacacaugcuaucugaucaucauggaauauggcuggucgucaagaaugacagaaacaauggaaagcccucauacacguggcaacugaacauucuacuuacugauaacuuggucaaggaagaaauaaagaaagaaauuaaagacuuuuuaaaauuuaaugaaaacauaagcacaucauaccaaaaaguaugggacaaaaugaaagcagugcuaaguggaaaacguauagcucuaaaugccuacaaaauguaacuagaaagagcauacacuagcagcuugacagcacaccugaaaacucuagaacaaaaagaagcaaauuaacccaagaggaguagaaggcaggaaauaaccaaaaucaggacugaaauaaaccaaguagaaacaaaaagaacuauacaaagaaucaaccaaaccaggagcugguucuuugagaaaaucaagauaggaaacccuuugccagacuaaucagaaggcagagagacaguauccaaauuaauaaauucagaacugaaaaggcaggcauaacaacagaaauggaggaaauuaaaaaaaucaucugauacuacuacaaaugccuguucucaauaaaacuggaaaaucuggaugaaauggacaauuuucuagacagacaccaugugcuaaaguuaaaucuggaucagauaacccaucugaacaaucucauaaccccuaaagaaguagcagcagucauuaaaauuuucccaacccaaauaaaacccaggaucagauggauuuaguacagaauucuaucugaccuguaaauaacaccuaauaccugagcuggcauuuggguucucuuagggucuguaugacaucuguccaggaucuucuggcuuucauagucucuggugagaagucaguaguaauucuuacaggucugccuuuauauguuacuugaccuuuuucccuuacugccuuuaauauucugucuuuauucaguucauuucuuguucugauuauuaugugucgggaggaauuuauuuucuggcccaauguguuuggaguucuguaggcuucuuguaugcucacgggcaucucuuucucuuaaguaugggaauuuuucuucuauaauuuuguugaagauauuugcuggcccuuuaaguugaaaaucauucucaucuauaccuauuuuccauagguuuggucuucucguuguguccuggauuuccuggaugguuugaguuaggaucuuuuugaauuuugcauuuucuuuuauuguuguguccauguucccuauggaaucuucugcaccugagauucugucuuccauuucuuguauucuguugcuaaugguuccugauuucuuuccuaggguuucuaucuccagaguugucucccuuuggguuuucuuuauuguuucuacuuccauuuuuaguucuuagaugguuuuguucaauuccaccaccuguuugguuguauuuuccucuaauuuuuuaagagauuuuuguguuuucucguuaaggacuucuaccuguuuagcaguguuuuccugaaauucuuugagggauuuuugugcuuccucuuuaaggucuucuaccuguucaguaguguucuccuguauuucuuuaagugaauuauuaaugcccuucuuuaaaucaucuaccagcaucaugagauaugauuuuuaaaucagaaucuugcuuuuuggguguguugggguauccagaacucgcuguggugggaguacuggguuaugaugaugccgaguggucuuuguuucuguuaguaaguauccuacauuugccuuuugauaucugguaaucucugguguuauauguucuagcuaccucaggcuggagcuuguuacuccccugauucuguuugccuuugucagcucuccuggaaguccaacucucucuugagucccaguggucagagcacucuuggcaggcaagcucuccucuugcagggaagguguacagaggucuggagcucagcucuaccuccuggcugaagaugaaugucagaagggaaccuguucaagaagcucucuugcuucugcagcccacauuguuucugcucacaaucuucccaaaccaucuuuugcaguacuagcuuaaaugauaugcuacuagacuuggcaaaagugugcauuuuggcaguuucauacuauggcucauuugaggcuaucccaugcuaaugcuuuauucaauuucaguuuauaguucucagguuccuuuaaguauauacccuucuccccuacaaacauuuuaguuccucucaaauuauuuugccuccuuuaguccuacauguguuuuuauguacaugugguaugaggacuuguuuguguccugugcauguguguaugaagcccagaagucaacuucuuuuuuuaaaacuuuuuaaauauuauggucuucauugaacguaaaucuccccauuucagcuagaguacuugcugggaucucucucacuaguucuccccaguauuggggcuuaccaugccuaguuuuacuggguccaggugucuuuuacugucuauuguaaugcuaagugugcccccagcaaccuuagccccugugacccugccccguuauuuuugauuggugaauaaagaugccaacaaccaauagcucagcagaaaagacaggugggguuggaggaagauaaaggagaaagaggaggggagaggaagaggaagaagggggaggaggaggagaagaggaagaguagaagcgggaggacaagaaggaagaagggagaagaaggaggagaagaagaagaaggcaaaggcaguggcaagaagagaaagaacacgccaacauggguuaggaauaaagaaaagauagcccugugugcuggaugauugagguuaagagcagcccagaugacacaguaaauaauaaguaacaauucagguuuauugauaugaaaguaaauucuaauaacauagaggauagguauuugccuacauagugagcuggggucacuaugggcucauagugaguuagggcucaucauaacuauuaagccuguuugugcuuuucacucuggaacuuaaauagacuaaggugagguugaaaccucgaaaccucgaaaccucgaaaccucgaaaccucgagcugggaauuaaagaauuucaacaauaucuaggagaccugaacucaagcccucaugcugugacaacacuugaaccuuuuuccauccucaguuuuaucucccaagucuguccuuccccuagccccaucaugaccucugcccuuucucuaauggcuuggccauuuguuguuuccuaccauaaauagugguucuugguaaaucagaaugcucaauuaaaauggaucuacuuuuuauuuuauuuaguuaauuaguuuaguuuaaauauaucccauguacuguuugggauauacgcuaagaaauguuuguuguuuucagaaauucauauuuauccagacaugcuuuauuuguauauaugagucuauuaauccuaugaauaccagcuuauuuauuaaaaauguucuuuucaaagcagcauauuuugaccuucaggaccaguaggugaguaaaagaagauguuaauuccuaccugaggccuugcuuugacuaacuugaaaaugccugcuagucaguacaagagccuugacaacacagagggguuucugagauuuuaaggcaugaaaugggggcaucagccucaauuuaggagaucacaugacaaauguaaggaaucugugugucauccccagauguaggggauaccuauguacuggcuaguuuucugucaacuugacacagcugggguuaucacagagaaaggagcuucaguuggggaaaugccuccaugagauccaacucuaaggcauuuucucaauuagugaucaagggggaaaggccccuugugggugggaccaucucugggcugguagucuuggguucuauaagagagcaggcugagcaagccaggggaggcaagccaguaaagaacaucccucuauggccucugcaucagcuccugcucccugaccugcuugaguuccaguccugacuuccuguggugaugaacagcaguauggaaguguaagccaaauaaacccuuuccuccccaagugcuucuuggucaugauguuugugcaggaauagaaacccugacuaagacaaccuaugagaucguuauucacaugcuuuacaucuuaccccaaacauagaaaagucuuaccuuccuugcauaagucccaaucauguggcuuucucugaacacagcaggaagucugccuugaagaauguaugccuaagagacuaugagaacacagcuaugagaguuaaggauuauaucaggccauuuuaugaaucacaaaaauugguauuuuugugaagcucaaaccaugaugcugaagaaauaagccaaaagagggaugauuuuaucugucagcuaaggucuccuaaccuauauaugcagauacacuacucagaucuccuuucucugagauggauuuaauuuauauauaaggaguuugaaaagggacuuaucuuaguuuuuccuuuuuacuuucuuuuugugucuucucuacuccgaaacagaaauaaaacaaacaaacaagaaaaccagguucgccauggcucugcauagcaacagugaagugaaggcuggucaugguauggucacugcuccauucagucauguuucuuaagaaacuuacagauguggucaucaugauaucugaaugucuucuguaagcuuagaggacuuuggauuguagguccuagggauauagcugugaaugggccagacacgaucuaugcucuguggaguuaaugcucugcuauacuuuuuagagaagucagggagaaggaaguuccagccucugggaccuccuuaggguuccuuacuaugcucuuuacuucuguaucuaucagagaaagucugcucuuggccagaguucgguucuggguacccggcaggaaucuacacaguuugaaaaguucaucagacuuuagguauuucagucuaauucaacagcagccaaauuuaguaaaaccauuuaucuaccaauuuaucucuuuaugaaauaaugaaggcaugaucuagcacgugcuauaaugucuucuuauaaaauuggugacacaugcccaugagccuaauaauuaguaguaaaggcccggacuagguuacuagcaagaauuugcagaaagacgaagggagagagggagucagcuggucuccuuauuggugcuuuaccagaccuuugugggauccuauugugaaaaguaguagggcuugauuuaucuuaaugacuaaaaucaauuuuuagaagaauagggagauuauacuguauuagcaagauuuauagcuuuucucugcaccaaaagaauuuauaaauauuaugggagggaauagaaggcaaagaagaaagaaagcuauugauuuugcaaguccacuuucauguuuuuaagacaaugguugggggagcuuccuucuucugaagccacuugagaucugaaaucuuacauuuguagaccaugacacuucuugaguugcuugaggucccuagucugaaguucagagaauucuaugucuucauauccagagcuauuucuaauucucagaaauaguuugaaaauagcauacuuaagaaacaacuggaaaaaaaaagagaaacgacugaacaugguacaaacauucuguggguguggaggcuccaucagagaacauggcaguccagggauaauaagaguagaaagacugcaugcaagucagagcaaaguuaguaaccuucucuuugacagguucuuacuuuggacgauuguuauuauuuuauuggguuuaaacacuaguguaaugagcccuguauauuauguuggugucacuggauaaugagugaaauauagauaauuuuuuccauuccuuaggagacuaugcacuuagagccgucagcuuccuuucuuuuacaaaagaacccugacuucgggccuaauugguuucugaacauuuagaaguacuguguaucauacaaaaacucuuacuucuuguaggauguguuauauggaaaguuaaauuauauguuauauauuaugcucaggcuguaggcauuguuguuacucaaucagcgauagacuuguggggcaagguuuacacaguaaaaccugguuuaccuaagggucuccucaccaggggaaccauaucuugggagacagacuaaccccuacauuucauucccaaaagucuauuucagaccauauaacaaaacagguacagaaauguaccaaaacugcaggugcaguuguuuuaaaacaaguauuuaguaaauauuucaaaccaaagauacuacagguaaaaagauauuugcuauaaauuuuacuguuuaauuuuuuuuucuuauuagcauaaauugacugaagcuuaugauuucaauguaaaaaucucccuaaaacacaugaaggguuuuucuuuuucguuauuuaaaaauucuucaaaauguguuaauuuuuuaauauaggguuauuugccucgaagucuacaguauaaaaauugauagacaugaguucagaaauugcuaaaaguugaaggggcaguuuccauggcaacuucuucagucacccauaccuuuauguuuuagaagaaucugcauugcugagcuaugaauacaauauuaaggauucaaucaaaucuuugccaugcaaagagcaauugcuagagagauacauuugccuuaaucaucauuuaaacaaacaaacaaacaaacaaacacccaaaccaaauccaucccccaccccccacccccacacacacauauacaaguccacaugucuucucaucugggucagcccugcuagggugcugaccaagacauuauuuguaaacaguaaccuuaaagggauaauggcgaauucuauaggaggcaguuacaauauaagcuauguuuauuucauccugguuugaaauguuaaaauaaacauuuuaaacuguuuauuugaaaauacuccaugugcuccccaaaguaaacaaaugauuaauuuuggucaaaagauaguucauacuguagucauuuucugauuuucccuuuugaguguaagaagacaaaucaauaccuguuaccaucuugccaauaccuaguggcaaacauggaauuuugucuaauguaacaugaaucauuggagucuuggcagaaaugacauuaaagaaggucuuuuaucucccauguuuucaaagaugaaacacaucucagcaugggagagaugacauuaaaguacuuucuucaaacacauuugagugcuuuucuucuaaacuagauuugugcuugugagauugcacacaugguaaaguccuuauauguuuguggauucacagucuagugacuuauuacccuguugaauuugaaacuuuaaaaauuuauauuagaauuggaaaagcaacauugauucugggcuuuuugcuaauacuuaaauaaaugaccauauauuaaggauagcugaugcuuguccagcacuguacugcaggaagcaaaagaaauguaagaaaggauccugauccauuaaagaugucugguuucuuuccugaugcuucauugaaguuuuuaaagaaagauaaaaugcaauuuuauguuuuaucuuaaauccugucuccuuucauuuucccuuaaaauaccccccccaaaaaaaaccaagcaagcaaacaaacaaacaaacuucgguuaaauauccuugucaccauuuauacuauaaauguuaucaacuuuauaaccuuuacuggucauuccuuaaaucuaagcaucaguuuuuaaaggugucauuucuggaacaagguauaguuuacccuuauucuacucucagagcaucauaugauauaacuaagugaaaguaguucugaccaaugaguuuggaugggaaaaauagaccauauugcuacaagauauacuuuuaaaauugguccauuacacuuaagaccacugagauaauuauaucaagugcccaagaaguuccaauaacuacuaagaaaaggaaacaaaauguaauucugcuauggaaguuggauauuguuuauaauuaugcuuuuagauccuguuauguucuaaugagaaucucucccauagguugcugucacuguuuggagaggcuuaggagugguauggcuagaggaagcauaccaccagaguuuggcuuugagguuucaaagccucuugccaucccaguuugggauucaagaugugucccucagcuucuguuccagucaccuugccugccuacggccaugcuucucugaucgugauggacauuuucugucuggaacuaggagcccaaauaaguucuuucaucuauaaguugccuuagaaggggauucuuaucacauuaauagaaagguaacugauaacagacccauauucagaaucuuaugaugguccaaaaggauaaaagaaccucuuagaccccagucuuucagucaagcauaaguguucagacacuuucaaucagggguuagcuaaauucaccugccucauugggggggucauuucuguggagaccaugcuacucugccaccuccaaacagaccucuguggguuaucaaaaccaggacuucaaaaagggcuaguacucuuuaucuuuccagcagggauuuuucucuuucuagaugaagaguugugcccacaagcugucagugaaggaagucuuaacagcaguacuggaguggaugcauucaaacagaagcugggaaaagcaaagcacuuuuccagaaaagucucaguucacgccucaggccaaggggauuaaguucuccauuuugcuugauagaggaauuugaggacagccuuggggaaacauuuucuuaccugcuuuuuguuuuuugauuucuaacacaucucuguuucuacagcaaauaucaaaucuuuuauucaguacaaaaaaagaaacuagaagugccugucacauugaaugugaguguguuccauuucuguauuugaaguauaguuccuucauugauuccaaacacauuuaccauaguaaacaacaugugcugaacacagaguggacaagcuaugcaccacuaauccaaaaguggaaaggcuauguguaauggugugugccucuaaucuuagaauagaagagcuaguugugguggugccacuaaccccagaccucaggaguuugaagcaugaauauuuugaguuaauggauauucagugaggccuugacucaaaaaauguuuuuauuuuuuuuuaaagaaaagaaaaauugacuuucacuacuacugagguaaaauucaagaacauuaugauaauugaaagaaacuggaaagagaaagccccaaacuuacucugaaugacuagaacaguuaccuuuauagaaauagaaacaacaaugggugcugcaaugcuuaggagauagaaacagaagguuaauguuugguuuaugaaugucaaugucgcaagaugaggaaaguugguagagucuauuugcacuguuacacaguuauuuguauaaugaucugcauuggacguuuguguuuuguuugauguucuccaguaguuggcauaaaaguuuccuagaauugacagggcucacaaaugaaugacagguaaguuuauagugcugugggaaccaggacacaggauaggucauacucaaggaaacacugauucucagacauaaccuggcugcgaaaagaacugugaagcucucuuugugacucauuuuuuuauugacuccugcuuauagcaugcagagcugcuaagaaggaugcagcauccugucaacaagcuucuccauucacuggcaugccuucuguucuuuuccaaauccagcacucccguuccaucuuggugcgcucuuuuacuucucuuauuucuucugcauguaucuuucauuuuacaauccacaucauuuuccaucacagaaucuaaauucaaagagaauaugggcucugaaauuugacuuuagcagcauccagcacagcagaccguauguaaugaguguuuuggguuggggaaagcucugaaguuggaagcugaaauggcuaaugccuauacaauagaagguuauuaaugucucuucagugguggccugguuuuuauagcagagaaugaauaaacacccaagauuuuuguuuuuguuuuguuuuguuuuguuuuguuuuguuuuguuuuguuuuguuuuguacugguccuaaacaauccugucacauuauuucucugcauaucugucuuaguauucuagagagaucagaagugggacaggugaccuccacugagaacucaaggguguacagguccugcuugggauuucaaggugaauccauggcuuaacuaaaucuauuuauuaaauaauuucuucucuucuucagugcagaacauuuuuuuucuacacagaauaauagugagaacggugaccauauuccucauuugucuuucuuauauuucuccuacauggcugugugaacuucccaagggccagagcuuccucauucaucgugauaugccugcuguacuuugcucagagcagcagcagcccuaggaaauucuguagcuuuuuaaaaaauuuacuuaguauaugaaugggcuuagagauaauuauacccacuuacaauagaugaagcaauuguagauuuuuaaagcacaugaauguuauagacaaccucauuuaguauaauuaucaucugguuuauagauaauuaaggaacauaauuguauauuuuuuacaguuuguuauuaugcauuauuugaaggcugcccugcauuuuaugggccuaucacuucaugaugucacauaagugaucuggggaggggcagaggugcaugccuucuuuaaguucacugagcugucgacuguuaccaguauauccugaugggcuaaguuggcuagcuuggcugcuuugacuccugcauuagcuaagagauagguuuuacuauuucaacucuucucugccuaggaaacaguucugggaauauuuuaguuuuuuuguuguuguuguuguuuguuuuguuuuguuuuguuuuguuuuuuguuauuguuuuaaauaaauguuugauagucaagucauuggugucuugugagaguucuguuuacguauauuguuucuugaauucugauuuuucacacacacaaaaucacugccaguucucugaauuuuacagcucuuagccuauuccaugacugauaauuuugacaauuucucccuuuuccccucccuacugaagucauucugaugucagaauucagacaaaacuuaaaugagagagaaacaagacuagaaacuguauccaggaauaaaggaguuugauguaggucauuugaaaaguguaagauauagacaaagagaggggagaugauucucuuacagcagugggagucaggaccaaguccaaggcaaggaugaauccauggcacuugaaaagacugugguaacagaagcauaaccauguuucaguggaauauugaucucuguagagcugcagaugcccuagaauccagugaacuauguaaucauccauaguccugcuuuuuucuacccugaaacucuguucaguguggacaaacucuguucuguucugggauuaguguaucuccugcgaucugcauugccaccaggcaccuaagugagcuuggaauguuggaaccacgcuuuaugaaaccaugccucagauggcagugccuacagcuugcaguguaguauucagauaagugcaguuuagugcuguacccuggagaccccaucagggaugcuaaggaacccucagaggcuguucauguaagagaguaacagcaagcagaaauucaagguagaacuuuucuagggcugaugguaugggcagaugagaacuguugagaaauuccaaaguguuuuuuguuuguuuguuuguuugguguugguguuuuguuuuguuuuguuuuucauuugucauucauugagauguuuucaaaaggcaagcuuuuaaauccguuccucugcaggucugguaauagagccucauagauacuccauauaauccaggacuagagauugaacuuggagggauauuuuaguugggaccaugaacccuaaauguacugaaggccacugaaccaauucccugaaauaguagaaugguacagauguuugcuuuguggagaagaugggccauagccuugacuacauccacaaacaugcccuuacuaagauuugucaaagcagacaaaggagucaugagaugugucuggggaaggcaaggcuggcugucuugcagaagacauuccauuugcuucucuguauggguugccgcaaucauuaacugggauagaaggaacaaaaagggcgguguuguguaguguguauaauaaauuuuucuguuccguaaggagcugugccauugguuuaggcugaaguacaaagggauagcaauuuuaacagugaggagcugaauuauaucagcuuugcagcugaaagauaaaagcugguauaugaaacaggaucuugugugaaugaguucuucaaguguuucaauaaagauucaucagagcaguuagcucucuaaccagguuacagucucuggcuucugauuccuuuguggaauuaaaaaugcuuuuaguaagaggagcuaaacaagccuuugguuuggauuucuauauauugauuuauggaccuggugagcauccugcugugaacuuccucugccaaugguaaccaucacaauaagcaaagcuuuucugaacuggcacuuccacagacccuggagccugcuauauuaggugugacaguuuuuaaaaagcaacuguguuagaaugaaaacaggccacuucuaaauggucuauugauuugcaaaaccuuugugucagagugaauagucucauaucugaguugagaggagaugcugaccaguuucaauuuguuacuauagcuugaagcuuugagcugacaauguuucagugauggugcuugccaccuguggaaagucugcuugugucucaggcuucagucauacaugugaaaauccgauucauuauuucacacaagaaaagacuuuaacaguuccacuacagugugaaucucugugaauguggaucuagaaggccuuguuaugacucaagcucucccauaaacuuguagauccccguccccaccaaugcucugcauugggcuauugguggaaauuguuauguggcuugugucuuaggccaacauggauaguguucaaugaguucuccauaagaauuacaaaugggagaggauugauagacaguucaguggaacacuugcugcucuuccagaggaccugaguucaguucuugguaccuauguugggaacuucacaacuaccuguaacucuauuucuaggggaaccaauucugucuuguggccuccuguuuuaauauuguuccuggugagaucuaaauucuauuuuuuuagacccuuaauguccuuuuucuguuguggauuauacuuuccaauuauaaaauuagucaugauguuguaaugucugcugcaugacagauauccucccaaacaaggacugucaaggaaaaagacaguucucagaauuacaaauacuuucugcuguagauuauggugugauucauauugucagaggaguuguuuuucugugcucagccuugaguauguauuugacccauuuuucaaaacucauuuuaaccuauauuucaugucaucacugugguuuugccuuuuaguacaagguguagagguccauuagguggcugcagcugagccuaagucugagacugagacuacaaagucugagucuagcuguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcuuccugaccugcuugaguuccaguccuggcuuccuuggugaugaacagcaguauggaaguguaagccgaauaaacccuuuccuccccaacuuguuucuuggucaugauguuugugcaggaauagaaacccugacuaagacacauugguaccaguggagugggguauuccugugacaaccugaccauguuuuggggaggacuguggaaggacuuuggaacuuugggcuugaagauccauccauuguuaagaccucugucggauguuguguaggagcuuggaagauaauguugagaacacugcagaaguuggagcucuggugugugaaauuucagagggaaaauuaaagacucuuuucagggccauuucuguuuugauugugaagauucuguaguucugguuagcuggggcugaagaaucagcugugauuaacaagauaccagaacuacuaaagcaaaaacuuugcauuacugggacuauugaugcugguuagcuggagcuaagaaauuagcggugauuaagaagagaccagcaucauugaggugacaucuucugggaaguauuuucugaaagcacaguggcuguguuccagauauagccaaaguuguaccuugugcuguggcuggacuugguaauguguaagggucacccaggugguacugguuuugaaggcaugaaggaguugagcagagcagcugaggcuuggcacugugagaggccauggaaggccauuggugaaagugcagccucaguugcaauugauggcccaggacugaaggggucaugcaguguuuuggagaugccaguaccaugagaugaccaccaagagcagcagcagcaguggaguacaggcaucuggagccuagaggaugacucgugugcuacaaagggccuggcuggagaagugacccaagcccuuggaggagcccagaagaucgugaguuggaucccagacauuggacaguuggagauugacuuuugcuuuugauugugacugugcccugauauuuucccucuugaaggaagaaacuguuuuaguggagcccacaguuaagagacuuuuaauuguaaaaagacuuuggauuuuaaaagagauggauauuuuaaagagauugaaauuuuaagcauauguaaagacugugggacuuuuaaaguuauuuagaauggggaugaauaagauuguaaggguugaggcuuacuagugauguuuuugugugucaaguugacaaggggucaauuguacuggcuaguuuugugucaacuugacacagcuggaguuaucacagagaaaggagcuucaguugaggaaaugccuccaugagauccaacuguaaggcauuuucucaauuagugaucaagggggaaaggccccuugugggugggaccaucucagggcugguagucuugguucuauaagaaagcaggcugagcaagccaggugaggcaagccaguaaagaacaucccuccauggccucugcaucagcuccugcuuccugaccugcuugaguuccaguccuggcuuccuuggugaugaacagcaguauggaaguguaagccgaauaaacccuuuccuccccaacuuguuucuuggucaugauguuugugcaggaauagaaaccccgacuaagacacuagcuuaaaacauaagagagaaaacuuacuugguaguacacucaaaagaaguguuuuuugcaguguugaaaguuguugacuuuacaggcuugaugucaaguaguacacagauauaugucuuugaaaguuuugagcccacauauuugucuauaugaaagcuuuggccccaacucuguauguggaacagggaagcugagcauaucugagcaagcauuuaauggaaaucacagcauauuauugcauuguacaaaauucccucacuaacaugcuaagcaaauugaacugaaaugugcccgagaaccucaucugucuuguauugcuauacaaauuguaucugucagaaauauuucuugagaagucuuaagugcaggaaucuaaauacaguauucaacagaacuccuuuguauuaaaaucgaggagucuucuucuuaggaaaacauuaaaaaagccauguuguuuaaaaaucgauuuugacuauuuacaaauuuucccuaucauuuuuccuccuccacauuuucugccuaccacgggccuuggcuuagagaaaacaagauaaaugguuuuuauuuuuuucuaacaugucugacuguugaaucagacacaaaggaaacaaacaaacaaaauagacucagaauggaauaccaaaauucuuaucauauagguagcccuggaaaaugaagucguaucuuugagaacucucuauagacuguuguaaaugcuacagcuugagaaaaaauugguggcugcacagcucugggagaaagggcucuaaagcagcugacagaugcauagaagcagcauccuccaccugauaggccaauaauuugaggaauucuugcuaauugcccauuuguuuccuuuauuuauuuaggguagcuucaccagacuuuuaccaugggaucucccaucaaagaaaauucaguuuuaacugacuuuguaccaguuucuggaacaauggcacaguauaguugcaucucuucaaaaaauuuuuuuauuuaucaagucaguauuaaguauuaagguauugagguuuuuuuaaauuucuuaugagcauauuuaaaauaugcuauuucugcugaaauguguuagugugugugccuuuuucacugacagauuggaaugcugcaaccuuucuagcucuucaguuuuaaguguugaaucagcaagcugggcuuggaaauuuacacuuggaauuucaguuucucucugguuuauauaguagucccaaauacacagguuccccaggcuaggaguggcucugcuuuucagaaaauaaaaacucaaaaagcuugucagagaucucauauuuauaaauaacuaugcuguuaaauauaaaaauuaaaaucaggauggaaacuagguaauugccccuagcucuuugaggcuuugagaguaauuauaauccaaaagcaugugcaggguguuuaguuauucucagagagagacaaaucacacucccaaauugaauggcuagugcuguuuuuuauuauccagguuuucaaagaugcugaagaaauaguggcuucaauauuccccaacagguacacgucacaugcucacugacaugaacugauuccuauauaaacaaggauacccagaguccuuaggaaauaacguaguaaguguuuccaauaacaaaccucugcuaucuaggcauguugagucagaaaaauuuuauaaguuuuaguugaaguauacuugcaguggcucuuagacaagugaagcagguuaaugguuccaaggccuucugugaguguucccccucagccuccuacacagggcucacccaugaauaacaaaggucaaguggcuucuacugauggcuguuccaagcuguuuucuagguuucagauuguuggcccuuguuuguuguuuguuuguuuguuuuguuuuguuuuuuauuuuguuuuuccugcagugucuauggucaugccuggugagaucugcagguuuuuccaggucaggaguuacuucaggagcaauuugccuccagcuucucuagugaucaacagaaguucccauuggcaacggcaaugugcagaaauaguagguuauuuucuccagggaaccuugccugguucaaguacugugacucuggagaagguuucuuggucucacaccuuccguagacagguagcuuagaugcaaaguucaugucacggcugccagggguuacaucacuuucuuucuggaaaccccuaugaaauaugacuggaagagagucuggucaugcuuacuaguuuccuagucaaagcacacaaguuuuggucugcauauguguguaguugcguacgugcugcaaccuuagcuaugauuccucaggagcucucuaccuugcuguuuuauucaagcauuucuacgaaccuggagcuuaucuagucauguagccuggcuggccaguaagccucaaggauucucccaccuuuacccccuagucccaagaacuacaaagcuaaccuuuuucccaugccacaucaugaaaugggccucuuccucagaggguagugacuaggaauaaucauuucucugugguguuuacuuuaugaaaacccaugcugucagcauccugugccugaaguuacugaacuuuuguagccaucuccuaagucaggcauaugaccaaucagucauucacauggaagaaaagcagggacacaacaauucaguuauuugaccaaguuuuggaacuggugggcccaggaaaaaucuaggcagcuguagauuccugaucuuacccaaucacaccucugucaccaagugcaagaugguugcagggucguuuguucagauucugauggacuuuuccagagauugagcuugccugucucuaaguguaggcaggucauuuuguaaacacuaggacaugauccaccaaaaaggcuucgcugggcagaccccaucuguacccugggcagucuccaggcucgcucugcuucagcuccuuuggguucaggagucauguucuguuguguuuauuuccauuuucauggaguauguuuucucagauuuccucuguccaaucuuuucuuccuccuuccuauuuucugaaacaagaucagccaguuucuuauugggcacgggguauggggcugcagggacccgauugacagagauucacaauuuacgcuuccucucaagagugugugaauaccuccugguuugcgcaaaacaucaaaccccguugaucugcaguagaauuagggucacaggaaugauggugcuauguucucuaagggcuuagccagaagcccugauuuauccaaauuguauucaagccaaugccucaccuuaaauuaaaauagguaugaaauacugauguuaguaucuaauaucaaaauauaacuuguuuuuauucugaacuccaucuugguacuguuauguccagaggccuagaguuuuguuuauccccauguuuugauauauuaaaguucuugaaucauaucucauguuauugaucuuagguaaggugucaaaaucaagagagcagcaagugguaucaugcuaccaugcuuuuggcugcauucugcccaaccacugagggaauggacuuuaggcagcuaugauuuaucaccaugaagccaguuugcacuuuaccuuaagaacaaagcaaagcaaagcaaaacaaaacaaaacaaaacaaaacaaaacaaaacaaaacaaaacgugcccuuuaagacagguuaaaugugucaaguugcuuaaaccaacaauccaaaucuauagacaaaugauacauuugagucugaaaaaucuaacuuuggacucccaucugacuuuguuuuuuaaugugaacaguugcauucaaaaucuuggaaaagaucaccaauuaaagcacaaaauaaaacuaagagaggaagugagccucucacuuauuaguucugugccccuuguaaggguuuauucugauuauaauuguaaaguuaccugcuuuguuucaaacuuugaaacugaaggggacauggauuugugggauuuguuucugucuggaagauuguggcauuuuuuauauuuugaaguccugauuuuguuuuguuuuguuuuguuuuguuuuuuugaacuguuuuuguucuguuuccuauuucuucuguuucuuguugauugccacuuuccauauaaagugaaguaacauuccuccugccauacuucccucaugucaggacauuuugaauguugaaauucccugcugucuaaaagcaucguuuuuguuuguuuguuuuuuguuuguuuuguuuguuuguuuguuuuauuggauauuuuuuuaaauuuacaauucaaaugucauccucuuuccugauuucccucccuccuggaaauauccuaucaauccucccucccucugauucuaugaggguguuccucuacccacccaccuacucccaccuaccacuccucgauuccccuacacuggggcaucucuuaaaccuucagaggaccaaggaccucaccucccauugaccaugcucugcuuuauaugaggcuggaaccguuuguacucauugguugauggcuuagucccugggaguucugggggcggggggggagucuucuuguugauauuuuuguucuuccuaugggguugagaaccccuucaguacuuucucuaaguuuucuauuggggacuccaagcucaauuaaucugauccagauuuaacuuugguaccugguaucugucaagaaaauuguucauuuaaucccaguuuucuauuuuuguugaguauaggcuuuuguaguaggaucugaugauuuuuuggauuuccucagauucuagucuuaugucuccuguuuaauuucuuauuuuguuaguuuggaugcugucccugugccuucuaguuagccuggaucaggguuuaaguauuuuguugauuuucucaaaaacugguuccugauuuugauuauuugucauauauuuucuuuguuucuacuuguuugauuucagccuugaguuugauuauuuccugcugucuacuccuccugggugaauuugcuuccuuuuguucuagagcuuucagguguguugucaagcugcuaguguaugcucucucuaguuucuuuuuggaagcacucagagcuaugaguuuuccucuuaggacagcuuucauuguguccuauaauuuugaguauguugugguuucauuuucauuaaacacuaaauagucuuuaauuucuuucuuuacuauccuugaccauguuaucauugacuaaacuguuguuuagcuuccauguguaugugggauuucuauuauuuauguuguuauugaagaucacucuuagucugugguguucugauaggaugccugggauuauuuuaaaaauuuuguaucuguucauuacuauuuugugacagauuacauggacaguuuuggacaaggugccaugacgugaugagaagaagguauauccuuuuguuuuaggauaaaauguucuauagauaucuguuaaauccauuugguuaacaacuucaauuaguuuuaccgugucuuuguuuaguuuuuguuuccaugaucuguucauuguugagagugggauguugaagucucccacuauuauuaugugugguacaguguguccuuugagguuuaguaaaguuccuuuuaugaauaugagugcccucacauuuggaacauagauguucaguacugagaguucauuuugggagauuuuuuuccuaugaugaguaugaaguauccuuccucaccuuuuuugauaacuuuucauugaaauuugauuuuacuuaacauaagaauagcuauuccagcauguuucuucagaccauuugcuuggaaaauuguauuccaaccuuugacucugagguagugucugucuuugucacugaaguggguuucuuguaugcagcaacauguuggguccuguuaugcagccagguuauguguuuuuauuggggaauugaguccauugauauuaagagauauaaaggaaaauuaacuguugcuuccuguuauuuuuguuguaagaguagagauucuguuuuugugguuaucuucuuuuagguuuguugaaagguuacuuucuugcuuuuucuugagcauaguuuccuuccuuguauuggaguuuucccuuuauuaucuuuugaagggcuagauucaugaaaagauauugugugaauuugguuuugucaugcaauacuuugguuucuccaucuauaguaauugagaguuuugcuggguacaguagccugggcuggcauuuauauucucuuauggucuguccaggaucuucuggcuuucauagucucuggugagaagucugcuguaauccuaaaaggucugcccuuauauguuacuugaccuuuuucccuuacggguuuuuauauucuuucuuuguuuugugcauuugguguuuagauuauuauguguugagagaaauuucuuuucugguccaaacuauuuugaguucuguaggcuucuuguauguucauaggcaucucuuucuuuaggguagggaaguuuucuucuacaauuuuguugaacauacuuauuggcccuuuaaguuuaacaucuucauucucaucacuaccuauuauacuuaguuuuggucuucucauuauguucuggauuuccuggauguuuugagucaggaucuuuugcacuuugcauuuuuauggauuguugaaccaauguuuucuauggaaucuucugcaccugagauucucuuuucuaucucuuguauucuguuguugaugcuugcaucuaugacuccugauuucuuuccuagguuuccuaucucuagaguuauuuccauuugugauuucuuuauuguuucuauuuccauuuuuauauucuggauggauuuguucaauuccuucaccuguuugauuguguuuuccucuaauucuugaagggauuuuuguguuuccucuuuaagagcuucugccuguuuaccuguauucccuuguaauucuuuaagggguuuuguuuguuuguuuguuucaucuuuaagggcuucuaccuguuuauuuguguucucuuguauuuuuuguuuguuuguuuguuuuaagauuuuuuucucuccuguauuucuuuaagggaguaauuaauguccuuccuaaaauccuguaccagcaucaugagauaugauuuuaaaucugaaucuugcuuaucugguguguugggguauccaggacuuguuguggugggauuacuugauucugaugaugccacguaguuuugguuucuguugguaagauucuuguguuugccuuuugccaucuguuagucuccgguguuagauguccuugcugucuuuggcuggagcuuguuccuccuguaagucuguacgccugugucagcacucuugggagaucaacucucucauaguaagaccugugcacagagggcuugggaauagccccaccuccuggguguagauguaggcccuuaggagccuuggcagcuucugggaucugugcacuccugaguggacccgccuuagggagucaccagagagaaauaucuccugaguccugcuucuauuccuuucaggguuaugggucuguuuagauggguuuacaugauccuguuuuaacuuuggcaccuuguaugugucuaggaaauuguccauuucauccagauuuuucaauuuaguuuuguauaagcauuuguaguaggaucugaugaguuuuugaauuucugugauuucugucauuuaugucucccauuucauuucugauuuuauuaugugaauacugucucugugccuucugguuagucuggcuaaggguuuuucuaucuuguugauuuuucuuaaagaaccaacuccuaguuuuguucauuuuuuuguauaguucuuuuuguuucuauuugguuuauuucagcccugaguucgauuauuuccugcugucuacuccucuugggucuguuuacuucuuuuuguucuagagcuuuuaggugugcuguuaaacugcuaguguaagcucuuaccaguuucuuuucagaggcacuuggagcuaugaguuuucuucuuaccacugcuuucauuguguuccauaaguguugguaugauguguuuucauuuucauuaaauucuaaaaagucuuuaauuuuuuucuuuauuucuuccuugaccaaauuaucauugagcagagaguuguucagauuccaugcauauguaagcuuucuguuguuuuuguuguuauuguagaucagccuuagucugugaugaucugauaggguggaugggauuauuucaaucuucuuguaucuguugaggccuauuuuguggauuauuauauggucaauuucugaggagguaccaugagaugcugagaagaaaauuuauucuuuugcuuuagaaugaaguauucuauaaguaucuuuuagguccauuugguacauaacuucuguuaguuucaguguaccucuguucuguuuccaggaucugugcacugcugagauugggguguuaaagucucccacuauuauuaugugggaugugauuugugcuuugggcucuaguaaaguuucuuuaugaaugugguuucccuugcauuuggaacccagauguucagaauugagaauucaucuugguagauuuuuuccuuugaugaguaugaagugccccuccuugccuuuuuugauaacuuuugguuggaaauugaguuuauuucauauuagaauggcuacuccagcuuguuucuucagaccauuugcuuggaaaauuguuuugcagccuuuuacucugagguagugucugucuuugucccugaggugcguuuccuguauguagcaaaaugcugguuccuguuuaccuauccagucucuuagucuaugacuuuuuauugaagaacugaguccacugauguuaagagauauuaaugaaaagugauuauugcuuccuguuauuuuuguuauuagaguggaauuauguuuguauggcaaucuucuuuuagguuuuuugaaagauugcuuucuugcuuuuucugggguguaguuucucuccuuguguugguguuuucuaucuauuauccuuuguagggcuggauucauggagaaaacaaacaaacaaacaaaacccaccaccaccauaaccaacaaaagaaaccucuuuuuagggcugauuuaugccagucuuuguugaagugguacaaaucugaccauugguuacucagaauccugcacaaaacuguaccagaagugguaaauugaaauaugcauuaccuccuauucuucacuaccccacagacucuauguccauaaaugugcuguggacuugagagaugauuucugugucucucucuacauguuaggggaggacauuugcuuacuuagucaugggcuucuuguggcugcucucugucauuacagaucaacagauaauaguuaucaucuaguuuccaaucuguagucuuguguucuggagauaguuuugccaggcaguauaagcuccuugguaauucguucaguuuccaagagaauacagucuuguagcuccauggcuuggaaguuauacccaguaauagaggcagauguccucacaagcacugaugggaagauuuuaugcuuuaguuuuguugagaguaagguuuaaggauggaaccaagagugagagaaagagaguggcagugacucggaggaucagguuauacuaguguuuauucguaaacaacaauaaaacaaauagaaagugggaucacauuuauucacacacucacuucacucaccuccaaucuggcauaugucauagccaggcuccaaugacugugcaggcaaggacugcaacauuucauacugugcuuuggcucuaugauggagcuuuguuccagaguuggggugucuggaaucagugggcuggucccaaggaugagcuggucuuaacuugaagagucucugucgggacccaggaucuggaaaaguugcaguugccagaucaggauuuuuaagucucuuucagcucagaaauucagcauuauuuuaucugacacuggcccuuaucaccuucauucacacauuccaggcuuggguuccaugguaacauuuuagccauugagccuaaaauugaggcguucacuuagucauugcauuuaccuuaucacauuucacauacacacucacuaauuacaauaguuacacagauguaaacuuguuuugaaaugggaugucuguuuugauuucaugugguagagauaggauguauuuuccaguuaauaaaaaaaaagucuccauaguguuagagaugaaaauuuuauuagcaguggucaaguucaaugucuuguuuuaugagugaauacacuuaaaucuugauaaacacagccauugaugaagccauccugauaugauuucuuugauucagaagguacuucagaaccucagaggaucaucauacugaaaagaauuuucuuguuugucuacaucauagaagugaauuuagguugagucuuagcuuuauagaguaaggcuucugauaaauaguguuuggcaucuguaguccuaacaugguaugcauauauagucuuuuacaguacaaaccaagaaggaccuaugaggugagggagcagaaagccaaaacucugggaggccagcaacagguucaucaaugagugcugugaugaguguggugggguguuguuuugucaugccacccauuagacccagaaacacugaguaccuuccaaagcaggagaaacaccagguuagaaaggcugcaacagugacugccauggauaaauggaacauuuagaauucagcuccacuucucuuggggccagggaaaguuuaagacacagggagaggcaguagaguagcuugugaaacugagaacuguuugcuuuguuuuuuaauguucuuuuuuuuuauuagauauuuucuuuauuuacauuucaaauguuaucuccuuucuuguuuccccuccgaaaaaccacuauucccugccccccccccccccccgauucccagcccauccacucccauucccagcccauccacucccauucccaguucuggccuuccccuauacuggggcauagaaccuucagaggaccuagggccucuccucccauugaugaccaacuaggccauccucagcuacauauacagcuagagccacaugucccaccauguguuuucuuugauuggugguuuaguuccaaggagcugugggaguucugguuagaucauauugauguuccuccuauggggcuucagaccccuuaagcuacuuggauacuuucucuaguuccuucauuggggaccuaugcuccauccagaggaugauugugagcauccacuucuguauuugccaggcacuggcaaagacccucaggagacaguuauaucagguuccugucugcaggcucuuguuggcaucugccauaaugucuggguuuggugguuguuuaugggauggauccccaaguggggcagucucuguauggucauuccuucaaacucugcucugaacuuugucucuguaacuccuuccauggguauuuuguucacccuucuaagaaggauucugagcuucugggcuaauauucacuuaucagugaguguauaucauguguguucuuuugugauuggguuaucucacucaacuugauauccuccagauccaucgauuugccuaagaaguuuacaaacucauuguuuuuaauaucuuccauggguauuuuguucccuguucuaaggaggaaugaaguauccacauguuggucuucguuuuucuugauuuucuuguguuuuucaaauuguaucuuggguauucuaaguuucugggcuaauauacacuuaucagugagugcauaucaagugacuucuuuugugauuggguuaccucacucaggaugauaucuuccagauccaucuauuugccuaagaauuucauaaauucauugcuuuucauagcugaguaguacuccauuguguaaaugcaccacauuuucuguauccauuccucuguugagggacaucuggguucuuuccagcuucuggcuauucuaaauaaggcugcuaugaacacaguggagcauguguccuuauugaauucagugaucucucagcagagcauuagaaucacauuuggugcauaggacaguagauaugccucauggcuuacgggucuugaguagacuucuguccugccucuuacacaauuguuuuaggugcacaaacauggcuaggacgugaggcacuuagccucaucaguuguuguugauaaccagugccugcucuaccaccucugggcuuaaagagaauuagcugguaugaugggggagaguuacaggguuaaguugcagauggagacacaagcugaucaugauuguugcucuugauugcagaauuuacccuggcuucuuugacagucuccuaugaaaugggaacuggucauuuaaaugcacagguucaugaagaauuuugggguggacuuucauauaauauuggacucagcacauaaacccucuccuggcuuuuagguauuucuggacuauuuaagagcauuuaauuaaccccagugcuguaaaauuauaaaacucuguguguguguguguguguguguguguguguuucauucauuaggaugauaaggaguguggugcaaugguuuucacaugcucugcucacauauuugggaaaauaauaaaugugaaucauaggagaaauuaauuguauauaauacgcuuuacacacacacacacacacacacacacacaccauacauacacaugcacauaauagcucucaugccuacuaaauuuuuguaauguauuaauagcaaacaugcauacuacuuauuuuuuuugcugguauuuuugaaaacaccaggucuauuuuuuuuuacuuaacuuuuaauuaaaaaaaaaaacaaacuuuuuuucaucauuuucagcauuucuguuuagggaaaauaugauucucucucucucucucucucucucucuguguguguguguguguguguguguguucaaauauuauccauaguuuucaaagcucacaugugagaguuuaucaguaagcucucagggcuauaauauuuuuauccaaauguaaucaagaacugaaaugaagaauuuuguuagcaagaagacagugaugauuuaccaguuaucuauggugugaagagaaaauguuguuuucuuuuaggucuuacacauuaccaucuucugccuacuuuuagcugauaaaaaaauucacaggaguaauuuccucaccucaaguauguuuucacaaacucauuuuuauuacuaaagccuuauuccucacuuugugagaauuggagcucuuggacugaacguccaaaacucucccacacuauucaauguauugugugccugugauucuuguaacuacucuagaagguaguuagugguauagccuuauguuuuagaaaaacaaaaaccaaaaaacccuacauauugcugcucucaacuccuggucagguauggcucacagggaagcugaaugucuuccccuguguguucccuauucaggcagaauuccugguuucuaguguuccucaugcuuggagugaagugguaaaauguaauuuuagcgucagugaacuuccauguuugccucaaucuuguucgcugugucuuuaaaaaguuguaugaaaacugaggcucauuaacucaaggccuccaacagaaguucuuauagcaauuauccuuauaauauaucuucuagaggugaaaauguucuguaauaaauucagugucagguugacacuauuggucaaccugaagaucagguuuaaaugagaaaaauauuugaaugaaugccuuuuuuacuuuacugugggaacuaaaagggggauauagggaaagaugggggagggaggacagcccacauccgucuagaguuccuccuauggucugggcagguggacacgggagggcugccagacgcuuuccacuuagcccugggugggcauguaagccacugaccccacucgacagggggauggacaaggggcagcccccaacuggggacccuggagcaacacccuguagcuccaggguuaugggagaaagggcugaggaagagagguucacacgcaagcgagaguaagugcagugggccuugacuggagcacaagaaggccuuccaucagcagauuagaaacagcccauuaggagaaagccuauuucaucauccaagugcagcgggccuugaugaacagagacagucuaugguuuuagagcuuuauuauagaaaggcagggggaaagagagaagguggaaagacagagagagagaccagccauugccaagaggagagaaggggcaaaaagagagagagaagaaaggguagagauuaaaaaagagagugagaggagaacaugagaagagaggagaggagagugagaggagagaggagaguaaggggaguaagaggaguaagagcaagagagugagguggggccaagcagcccuucuuauguuaugcuguuaucuuuacuguugcuagguaacuggggaggagucuagccugaaggucagaagcuugggacaaugccuacaugacuacuagccaugccuuuccuguguggacugaaggggcgguaacuucgacaggauccaggguuccaggagacaugggggaacuccuuccaucccacguaggugaauuaucaccacaggguccuggggcuccacaccucaacuugacuggagaccagacuaucuccaguguauagcccaaugccccacaguuuaccugucagauguaaccugucauagagccuaagaaacugcccugguaaaggccagagaccaucugugauuguuauauagguccuggucuauaugggucaaucacuugcuuaucaaaaagaaugucagaucagaugcaagaaagcgugaugagcaaggaaagugauuggccaucagggaaugaaaaguuucacaggcugauacuuggauuguaguuguagaguguucuuucacauccauucacccuuccuucuugcuguguccucagucuagguauccuuuccuucaugagauuacuugccuguuuuucauucaccuaaguuaauucuucuuugauauucuuauguauaauauaauaucuuccuccugauccuacauagcucuugucugucugucuaugugacuauaagcugagagcaagggcuacauagacauggugauucacacuuaccaaggauuaaguaccuguuaaauaaauuaaaaugaggccauaaaaaucauaguauaauugugcccuaauuguaauaaaucucugcccuaauuguagauaauacuuauugaaugcuuucuauguguuaaaugcuacacaaaucuuccaguagguauuaauucacuuauuuuuucccaacaacucauacaguagguaugcacuuuuauuguucuauuuuuugaaaguagagaagugaaauugagugucaccucaauaguugucuuuuuugcuucuugccucuagcuuauccugaugggcuucuucaggugguuuuuagaggcaauagagcuaggcuaguagaagggcauaggagucaagaaaagauuaaacaugagugccuuccaaggagggaguucuggcauuagguggauaaaaggaaauaucaccugaacaagucaccccuggaauagcaauaguaaaacauauuacugggauuucuuaaucagcauaucuggggcacuuacaaacugccaggcauuguccaaagugccuuuacauuuuaauugauuuaauguuuuugaaagcccuaggugguaaccccuaaugacucucauuucuauucuaugaggacccugaguuucagggagguccuguagcucacagaagacaaacuuggguguuucacugauagguuuuuaaaaauccugcccuaaggucgcacuugauuuuucuguucuaaggagauggaugugggguuaugaaaaacaaugucucaaaugauauuucuguucagauauuauaagaucauuuuugcauuuggagucagauuuuuuucuauucguuuucuccccccacccccgacgccaauuaauuaauuaauuuauucauuuuuccucccagucacaguaucccccaucuccuccuaaguucuccccucauaugggccuuccacaccuccccuucaccugugagaagggagagauuacuccuaccuggcuacuaacccacccuggcaccucuagucagugcaaaacuagguacauccucucucacugaggacaaaaagacaauccauuuagaggaacaggauccacagacaggcaacagauucagagacaguccccacuccaauuguuggggaaccugugugaagaccacauugcacaucuacuauauaugugcagggguggggcacuaaauacaguccuucuauguucuuugguuggugaccuagccucugggagcccccaaggguccaaauuaguugacucuguugguuuucuucuggcauccuuauccccucuggguccaucaguucuucccccaacucuuccauaagacuccccuagcuucauccaauguuuggcuguggaucucugcaucuguuuugguuaguugcugggcagagacucucagaagacaguugugcuaggcuccugucugcaagcauaacagagaaucauuaaugguuuuagggauuauuaggcucucaaguugagccacucauugguuagucauucccccagucuuuguuccagcuuuguccccaguacagguuuuuacuggcuucacauuggguucucuucccccauaucucccguguugauuugcauuuggaaguggccagagggcuucaagaaccgaacuacuuaaggugaaaaaauaauucuuugccaaguauuauuuccaaguuuuauugcaguaacuccuguuggcuuguaccacugccacaauccucagcugcacauacuaggcucucaguaaauacaugaauuagcucuuggccuaaguccauaaugguagccagcaucuuuagcuuagggaguccuuaaagucuccaguuuggacaugguccuuugauuaauagcagagcccccagggcagcaguggaaaggaaauagcacugucaccacaaacugcuuucuuuauucaccauaggaaagcuuucugugguuuucuagauuugagguggcugcaacagccucuggcucuacaguaauuuuucuagaguucuaugaugugccuguuaggcauuuaaacuguaauugccuccuaagaauaccccacaaaaguaucucaguuugucccucagguggcaaucagcuaagauuguguuaucugugaaccacauuuucuguauccauucuucuguccuuggacaucuagguuguuuccagcuucuggcuaucacaaauaaggccguuaugaacauaguggaacacaugccccuguggcauuguagagcaucuuuugacuauauccccaagaguggaauagcugggucuucagguagaucuauuuccaauuuucugaggaaccuccagauugauuuccagagugguuguaccaguuugcaaucccaacagcaauggaagaaugucucucuuucuccacauccucuccaacauguguugucaccugagauuagacauucugacugguauaagguggaaucucagggucauuuugauuugcauuucucugaucacucaggacuuugaacauuucuuuaguuguuucucagccuuccaggaugucucaguugugaauucucgguuuaguucuauacuccauuuuuugguuggguuguuugguuuuuuggugauuaacuucuugaguuuuuaaaaauauauuuuggauauuagcccucuaucggauaugggguuggugaagauuuuuugucaauggaauacuauuuggcuauuaagaacaaggacaucuugacuuuugcaggcaaauggauggaacuagagaaagaaagaaagaaagaaagaaagaaagaaagagagagagagagggagggagggagggagggagggagggagggaggaaggaaggaaggaaggaaggaaggaaggaaggaaaggaagaaaggaagaaaggaagaaaggaagaaaggaagaaaggaaggaaauaucauccugagugagguaacucagaaccaaaaggacaugcaugguguguacucacuaauaaguggauauuagccauaaaaauaauacaggauacacaagauacaguccacagaauucaaagccucaacaagcugaagugcccaagugaagaugccuuagucccacuugagagagagaagaaagcaaucacaagugaggagggacagauggaccuaggaaggaaaauagauggggucauggggguguauugcgggggagagggaaaccugaucugguauucggugagggaaaaggacuagaacccugagggcaagcagaaaggauguaaacaggcaaccucagaaaauaggagguuggggggaucccccagaaugaaucagagaccugggaggugagcaacuuagaacucaaagggagggaccuuagaugaaaugucugacaguagagagaaugaacuuauagagcccaccucuagcaggaagacaggauaucaagugagggaugugguugccaucccacagucucaacucugacccauaauuauuccugucuguaagaaggauggaaauggaauggaaccugaggaaaagaagguccagugacaggcccaaagugggauccaucucaaggggaggucccaaggccugaugcuauuacugaggcuauggagugcucacaaaaagagauguaucaugacugcccuuugaaauacccaacaagcagcugaaagagucagaugcaguuauuugcaugcaaccaauggacagaagcagcugaccccuguuguugaauuagggaaagcugaaagaagcugaggagaagucuaauucuguagaaggaccagcaguccuaauuaaucuggacccuggaaaucucucaaacacuggaccaccaaacagacagcauacaccagcugauaugaggccccaaaacacauacaguagagaucuuccagguuuguguuaaaucagagaugaugcaccuaacccucaagagacuggaggccccagggcauuuagaggucaguuggauuggggggccugagcauucuaauagagaugggguggcgaggaggugugggauguggagcaauaggaggguggauggggaggggcaggaaauggauuauggaguguaaaaaaugaauuacaaauagaauuaaauuuaaaaaacacauccaacaacaacaacaaaaaaaaauuuuaugcuuaucuuuuuugacuuucagccuccaacacaagugacacacaugugcauguacagcuaaaauaagcuucacauacauagauagauacaugcacacauaaauuuauuacuuauuaauuuuaaauuugaauuaaaauauuacaauuauuugugucaacauuguacugaaguauaauagaaaaguauacaaaucugaacucugcaucuugaauugaaauuauaguuuaaauguaucaaugaaauguaauucgugaauaauuuugauauugaaacuaucaucuuuauauuauauuuuauauuuuuuauauuagcuaauuaaauugggguuugguggaguuggagacagaaguuuugaauuauguuuucuuguuucucuuuuucuugcuggugguugauccuggagucuuguguauacuaugcaugcauucugucacuugguugcaccugaauuauucucucuugaaaugaccauguaguaacuucuccacauuucagagacauugaagggucuccucccaccccaugauauuaucugaguuacaacuuguauuauuuuuuucuuuucuuuuuuaagccuucaauucuauuuuuuuuuagccuuugaauaaauacaugaauuccaucacggcugcauacauacagaaauugugucuguucuguagaucugacauguuugucuagugaaaaaguaccaaagaauugguugcacaugcaauucugauaaaguaagauuucuaucuugauugauucuauuuccucuccuuugaagacacuuccuguacuuuuaaccauuucuccucauugguucuucuucuguuucuauaaagaaauaacaaacacaggcuaccuuuauaaaagaagagaggcuuauuuagcucaguguuugggaaauuuaaaagcauggugcugucagcagcucagcucuagugaggacccucauaggagugucaggugucaggacaggucacaucaccaaacaggaagcugguagacucaaguugcuuuuuauaucaauuugguuuuaaagaaagagucaacggcuucaacaagagcuccuuuaaucccauugaagggaaucucuucccgugaccugaacauccuccuuggucuccuccuuuuaaaaaaaauuaauuaauuauuuuuauuuauauucuuuuuuauuagauauuuucuuuauuugcauuucaaauguuaaccccuuuccuaguuuccccuccgaaaauucccuauccucucccuccucucccugcuccccagcccauccacucccacuuccugacacuggcauuccccuauacuguggcauagaacuuucauaggaccaagagccucuccucccauugaugacugacuaggccaucuucugcuacauaugcagcuggagccaugggucccucgaucuguucucuuugguugguaguuuagucccuuggagcucugggagguacugauuggaucauauuguuguacuuccuaugggguugcaagguccguucagcuuuuucaguccuuucucuagcuccuccauugggaacuuuguguucagaccgaugauuggcugagggcauccaccucuguauuugucaggcacuggcaaagccucucaggagacagcuauaucaggaucccgucagcacacacuuguuggcauccacaauagugucuggguuuggugacuguauaugggauggauucccagguggggcagucucuggauggucuuuccuucagucucuguugcacauuuuguaucuguaucuccucccaugggucuuuuguuuccccuucuuugaaggacugaaguauccauacuuugguuuuccuucuucuugagcuucaugugaucugggaauuguaucuuggguaaucugagcuucugagcugauauccacucaucauugaguguauauccuguguguucuuuuguuacuggguuaccucacucaggauaagacagcauuuuuaacaaaugguucuaguucaccuggcgguuaguaugcaaagaaugcaaauugauccauucuuaucuccuuguacaaagcucgaguccaaguggaucaaggacccccacauaaaaccaaauacacugaaacuaaaagaaaaaaaaaagugggcaagagcauccagcacaugggcacaggggaaaauuucguaaacagaacacuaauagcuuaugcucuaagaucaagaauugacaaauggaccucauaaaauuacaaagcuucuguaagacaaaggacacugucaauaggacaaaacggcaaccaacaaagugggaaaagaucuuuaccaacccuacaucugagagaggacuaauauacaauauauacaaagaauucaagaagguagacuccagaaaaccaaauaaccuuauucucuuuuccauugcauggguccuagagauccaacucaaguccuaacggcaggggucaccuuuaugcacugaacuguaucacuggccuuuacuguuguauuuuuaaugaaauaauagcaagcuucuguacaugaaaguuguugaaacaauagucauuaaaugaucuaguuagauaaaugggauagacagagcaauuaaauuguuagucacugacuccugcaaauauacauuuaagcagcuuauccaagcaggaaaagcuuaccaaaguagguggcuuuugaagacccagacuuuuaaccaaaaucucaaaucuccuagaaaugaauuguuccauaucaguagccuccagacaccuguggcuacuggaacauaaauuuauuaagaguaaaaaaaaaaaaaaaaaaaaaaaaaacagaggauuucaauugcuuaggcagggcuaauggcuaucauuuugaauagcacagauguagaaauuuccuucaaugaagaaauugucacuggcuaacccuaauucacaaaaaagcauuccaauuggagggugggacuggaauuaguugaccaagcugauucugguuucucuaaugcuuuuagcuuuuuugugccaucaccacuuuacaauagaagagaugaagccuagagauguguuuucuaggggagaaacuuugcuuaaaaugacuuacuggggauaaaaaggcuuucuggaccaguaaagcugugaaaugcccccaggugacaaccccaggaagcuuggcuugaaaucagucugggcucuuaaucagcuaguauuaaagagucuuauagaauucucaacuuuugcuaauuuaguugggugaauuugagaggauaggauagauguggagagggaguucaauuuucucauggaaaagcagagguuguacccaucccuuccaaaaacugugaugacagcuacaugccaggaaugugaagcuugaauggauaguggacaugugccauagcaauuauagcuagcuucuuaaaauugaaauuacuguuauuugaacgcaaagcacauaguuaaguuuuucuuuucuuuuugccagcuauuuugauguggucagaucuaauuucauucccauggugggugucagacuggcacacaguauuguagguugugacuccaauuagauuucaauucuauguucauuuuauguauaguauuuuaauaaagucucauauuuuccuuugaaacaaaagcaccaguaacaaacauugcauuaaaucaugcuuuuccuuggugucuaaucuggaaauuggcuguugacauuagugauuuuuuaaaaauuugauuuuugaugcaaauuccaaauugcucugucuguacauuaaaacuuuaaauauugacuucuuggcuuuugaaaagcucaaguuucaaggagaccuaguacaaaaagugaacuugacagaauaauauaccuaccauaauuucuguaaaaagacuuaauauauucuaguauuuggaaguucaaucaggguauaauaacuugaaacguaacuggauauacaggccuagaauugauagcuuuuucaaaaauaggcacagggaaaauaauauauuaucuuaugccagauauugaaugaaaaugaauuuccauucaaucuuuaagcuagucuugacuaauaaacaacuauuauaagaguggcuguuuuaaucaguauuuaagaauuauaggguauauucaacugaccuuacaaagaaaagaaaacacucugucccccuuaaacaaaaggcaguguauuagaugacuuugucuuaugugauauggugugugugugugugugugugugugugugugucugugugugugugugcgugugugugucuguguguguguguguguguguauaauuuaaauaguguuucauguuaggcaagucuagaagaauugauuaugguuuccuuagccuuaaauuguuuucuuaaaagcugugaaaaaggggagaauuaauaucuuuuauuagcuauuuucuucauuuacauuucaaaugcuauccugaaaguccccuauagccuaccccugcucugcuccccaacccacccacucccaauuccuugccuuggcauuccccuguacuggagcauaugcucuucacaagaccaagggccucuccucccaaugauggccaacuaggccaucuucugcuacauaugcagcuagagacacaagcucuagggguacugguuagaucauauuguuguuccuccuauagaguugcagaacccuucagcuucuuggguacuuucucuagcuccuccaucccuguguuccacccaauaggugacugugagcauccacuucuguauuugccaggcacaggcauagccucacgagagacagcuauaucaggguucugucagcaaaaucuugcuggcauaugcaauagugucuggguuuggagacuguuuaugggauguauccccagaggggacagucucucgaugguucuucauucacuaucagcuccaaauuuugccucuguaacucccuccaugaguaguuccccauucuaaggaggaaugaaguauccacacucuggucuucuuucuucuugagcuucauguguuuugcaaauugcaucuugaguauucuaaguuucugggcuaauauccacuuauuagugaguacauaucaugugaguucuuuuguaauuggguuacuucacucaggacaauaucuguugaggccuguuuugugaccaauuauauggucaguuuuggaagguagcaugaguugcugagaagaagguauauccuuuguuuuaggauaaaauguacucuagauaucuguuaaauccauuuauuucauaucuucuguuaguuucaaugugucucuguuuaguuucuguuuccaggaucuguccauugaugagagugugguguugaagucuacuaccccuuuuauugugugaggugcaaugugugcuuugagcuuuacuagaguuuccuuaaugaauguggcugcccuugcauuuggaacauagauauucagaauugagaguucaucuuggaauauuuuuacuuugauggguauggagugccccuccuugucuuuguugauaacuuuggaagucgauuuuauucaauacuagaauggcugguuacugcagcuuguuuauugggaccauuugcuuggaaaauuguuuugcagccuuuuacucucagguagugucugucuuuaucccugagguggguuuccuguaugcagcaaaauguuggguccuguuuuuguagccauucuguuaguguauguuuuuuauuggggaauuaaguccauugauauuaagacauauuaaggaaaagucauuguugcuuccuguuauuuuuguuguuagaguuggcauucuguucuuggggcuaucuucuuuuagguuuguugaagaauuacuuucuugguuuuucuagggcguaauugcccuccuucuguuggaguuuucccuuuauuaucccuugaaaggcugaauucauggaacgauauugugugaauuuguuuuuguuauggaauacuuugguuucuucaucuaugcuaauugagaguuuugcuggguacaguagccugggcuggcauuuguggucucuuagggucuguacaaccuuuguccagaaucuucuggcuuucauagucugaugagaagucugguguaauucuaauaguucugccuuuauauguuacuuuuucccuuacugcuuuuaauauucuauuuucauuuagugcauuuuuuguucugauuauuauguguugagaggaauuucuuuucugguccagucuauuuagaguucuguaggcuucuuguauguucaugggcaucucuuucuuuagguuggggaaguuuucuucuauaacuuuuuugaagauauuuauuggcccuuuaguuugaaagucuucauucucaucuacuccuauuauccguagguuuggucuucucauuguuuacuggauuuccuggauguuuugaguuaggauccuuuugcauuuuguauuuucuuugacuguugugucaauguucucuauggaaucuucugcaccugagauucucucuuccauuucuuguauucuguugguaaugcucauaucuaugguuccugauuucuuuccuagguuuugaauuaggaucuuuuugcauuuugcauuuugcauuuuuuaauuguuguguccauguuuucuauggaaucuucugcaccugagauucugucuuccauuucuuguauucuguugguaaugcucacaucuaugguuccugauuucuuuccuagguuuucuaucuccagauuugucucccuuugguuuucuuuauuguuucuacuuccauuuuuauaucuuggauuuuuaaaaaauuccaucaccuguuugguuguguucuccuguaauucuuuaagggacuuuuguguuuccucuuuaaggaccucuuccuguuuaccagugguuuacuauaauucuuugagggauuuuugugcuuccucuuuaaggucuucuagguguuuagcaguguucuccuguaugucuuuaagugaguuauuaaugcccuccuuaaaauucucuaccagcaucaugagauaugauuuuaaacccaaaucuugcuuuucaggaguguugggguauccaggauuuguuauggugggccuacuggguucugaugaugcugaguggucuugguuucuguuaguaagauucuuauauuugccuuucaccaucugguaaucucugguguuagauauucuagcugucucuggcuggagcuuguucuuccugcgauucuguuagccucucucagaacuucugggaguccaacucucuccugagucccaguguucagagcauucucugcaggcaagccuuccuguugcagggaaggugcacagaggucuggagcucagaucugccuccugucugaagaugaagacccaaaggaacccugacuaagaagcucuauugcuucuguggcccacaugcucuccuguucccucuggugucugagagaccugggauacaagauggugcucucaccugagucuggggucagagcccucccugggcgcugacucuccucagugauccugguugugcuagggcuccugcagcauggagaguccucugaggacuauaauacugucuguugaguuuuugcccaagauggccuguggcugaugccaaugggaaagaaccccagcugcuguuugggcagguuuccugugccccuguuucugcuggcccaagccccucugguuuguuuuugaacagauguuguguuccacucaacaguaagauccugggugugugagggcgccugugguguggaaaauccucaggggaucaucugcugaguuugugcacaagguggcuugggcggaagaauuaauauuaaagcuuuaagaacagcagcuuuuuacagagcccccgccaaucccagcuugauugauuacagcugcuuuuguacaggaucuaaaagaacaaucuguauuaaaaacaacauucuuuggucugagcuugaacaguuccaaaagggguuuccauggggucugcccuacaaugugggcaauucaguggaagaagcuauggucauugccauugggacaguagcaucuaggcaggagaaagagacuuaggugaggagugacuggcauacauaacagagugguuguccuggcagcuguauucucagccacauucuucagccucuaaagcaggagaggaaagucaaguugcucuuacaaaggcaaaagcacacaaggguaagaagcugcaagaggagucagaagacagguguguuucagaacagugggcagagcuagggaucuccauccagaacucgggacaguggugagggauugcuccucagccuucacucucuaaauacccccacucuguugugccaaggcugugggggaguaaauacaucuuacuuugguauuucacacaugccacaguaaccuagcugguaaggcugcauucugcucugccccaauucuaugucuucaccaauuguguuuucuggauaauuaagaugaaacugaguagggguuuucauuuugaaaaaagaacauuuugacagguuuucacuguguagccaaagguggcuuuuaacuugugacucuccugccuuggccuccccacugccaucauuguagaugucagacaccaugccuggccagugaacauuuuaauacauacucaauggggccaucuguuaguuacuuuggacacacugaagauucugacuagagugggauauguagagaguggcagaaguuugcaucauugugugcagucagcacccuuggaugcuggaucaacaugaaaggcaaccuucaguaugaccugugacaaaaccugagaaaucaucagguagcucccacuggucuugcauaacacagauaugacucaaagauuuacuuuuuguuaaucucccauauuuuaauaaauuaaauguuuuaccuauaacaaauugguguuuagggauaagcauuccaaucacuacuuuuaauuaccauguauuauccuccuuuggggcaaaaaauaauaaaauauucugcuucuuaaaaaugcuuucuuuagugugauucuuaauuuuuuaaauaaagaaccuaauuuuaucauuugucaccucuuuuauaccugauucauccucuauaacccaacagcauaggcuuauguaaucuuacaaagagaaugucaggguaucuuuauagacagaucuaguucugguggaggcaguucagaaagaggcaggcagauucccauggaguuaaguuuugcagacuuuggccagcaugucaauaugcauaacuaugaguguucguuguugguggaaauaauauuacuguccauaaauauauuguucuucuaauuucacaagauaaugaaugugcuuuucagguauucacaaaucauaacacaacagaauugcagccaucccacauccccccucucucuuaucugcuaauuuuuauuuauuuaauuauugagaaguccauguauacaguaugucuugauuaaccacuuccuccccuuuaacuucugccauuaucccucacuacuucuccuaacuucacauguuucccucgcccacccccauccccagcuuggaagcuucauaaaagccaaggcaauuucucaagggucagagccucucuuagaauugguuagauagcacaguacucuuuuuacagcagcaauagauugcuguacuuaccuuacuucugacucacuucuagcucagcuuccuacaacaccaucugucacugcugcaggccugagaguucugguucaugcccagcauuggcugcagcaucuaccugcucuuuaaagucaaagucauucccauuuuucugucucauagguuuuccauggcgcucugucagcccucauuugaguggagaauacauauggaccuaggaauguagguauugaaaaauuccuuagagugaacuauuaaauucaaaccagagcuaguuggcucccugugcuuagcuuagaaucuuaucuauaaugauaguuuucacagaauauugaugaaagagaaauaaacaccaaauauguuucccauccccaucuccugccaaacucuacuaagaaagaacaucucauuacuuuaguuagaauuuauuaauacugaccuucuccaaacuuggaucauucagguuuagcuuacaaugcuucuauuuuacuguagucaaagcuauggucauauggauauaaaaauaaacacuggaauaugcuagcucaggagggugaaaggcaauaauaccuauaauaacauagcugcaaacauccugcuuuucucugcuauuccuaaaaaggaaucaggcacacagcagaggacauauggaagcaaugggcauuuuccuuuaaugugucauacguauuccucauaacccacucaccauccuuggcgccuuacugugcauugcuuuggagaucccuguucuuguugccaacaaauuuaauucaccacaaagggcgcuucccuucuucccugacuuaggaaucugaagccaccacuacaaacagaaguguggcuugcaaguguguucuguucauguuuuucuuuccucucuuggucagauuuucugcugugguuguuaccaaggaagaaaacucuuauuuuguuuaggaugagcaauaaagcaacuggucuuaggauuucuuuguguguuuguuugugauguuggguauggaauccaggaccuuacacaugcuaagcaaguggucuucugaagagcuauuuccuuggccccagaaagguacuuuuuaaaagcagauauauuaauugagauuugcaaugcagagguuuuaaauuuuagaaguucagaagggcaacaagugaaaauugucucuagguagaauauuuugcuuuuaguaagcuuuucccuguaacuauuacaaagcaagaguugugucaagaauuuaggugcaaagauuugggugucauacuuccuugcuuucuacuguguucuucaccaugaaauguagacugugaaaacuaagggauuauuguccuaguuuuguugaauaauauaccagaaaugugguugucagcagaugaacacauacucaauaguauguuugauugggguuacucauugucaccaaauucuauauucaagagacaugagacugggaaacagauaccuuguuuguguauuccaaugcaugguaguagaggaaaguggcuucauuuguuaaauaagcaugaaagauugucuggacacacaaaucugauuuguuacuuuaaauuuaucuaacaagcaaguuauugaggcaggaacuauuauguagaaucaauaaacaacacaguggugaaccaaauaguuuuguaguguuguauguaccagcauccaugcauugcgacaccuuuucugaaagcacugaaucauacauucuaguuaguguucagggaccaaauaacaccauggcaaaguguuuuggcuuagguaaaggguguguguguguguguguguguguguguguguguguguguguuaaagcccaaucuuaugugagaauuuugguuugggaaaucuuuauuguuguuguuguuguuuuguuuuuguuuuuucauucauuuuuuuuaauuagguauuuucuuuauuuacauuuccaaugcuaacccagaagucccccauaccaucccaccaaugcccuaccuacccacuaccacuucuugacccugcuguuucccuguacugaggcauauaaaguuugcaagaccaaugggccucucuuuccaaugauggcagacuaggccaucuucuuauacauaggcagcuagaaacacgagcucugggagggguacugguuaguucauauuguuguuccaccuauaagguuguagaccccuuuagcucuuuggguacuuucucuagcuccuccauuggaggcccugugauccauccaauagcugacugugagcauccauaucuguguuugcuaggcccagguauggcuucacaagagacagauauauguggguccuuucagcaaaaucuugcuaguguaugcaauggugucagcauuuggaggcugauuaugggauggaucccuggcuauggcagucucuagaugguccauccuuucaucucagcaacaaacuuugucucuguaacuccuuccauggguguuuuguucccaauucuaagaaggggcaaaguguccacauuuuggucuuuguucuucuugaguuucauguguuuugcagauuguaucuuguauguuggguauucuaaguuucugggcuaauauccacuuaucugugaguacauaucauguggguuauuuugugauuggguuaccucacucaggauggugcccuccagguccaucuauuugccuaggaauuucauaaauucauucuuuuuaauagcugauuaguacuccauuguguaaauguaccacauuuucuguauccauuccucuguugagggacaucuggguucuuuccagcuucuggcuauuauaaauaaggcugcuaugaacauaguggagcauguguccuucuuaccagauggaacaucuucuggauauauguccaagagagguauugcuggauccucugguaguacuaugucacauuuucugaagaacugccagacugauuuccugagugguuuuacaagcuugcaauaccaccagaaauggaggaguguuccucuuucucuacauccucgccagcaucugcuaucacuugaguuuuggaucuuagccauucuaacaggugugagguagaaucucaggguuguuuugauuugcauuucccugaugauuaaggauguuaaacauuuuuuuucaggugcuucucagccauucaguauuccucaggugagaauuccuaguuuagcucugagccccauuuuuaaugggguuauuugauuuucaggaguccacuuucaugaguuuuucuauauauuggauauuagcccccuaucugauuuaggauagauaaagauccuuucccaaucucuugguggccuuuuuuuucuuauugacagugucuuuuaccuuaccgaaacuuugcaguuuuaugaggucccauuugucgauucuggaucuuacagcacaagccauugcuguucuauucaggaauuuuuccacugugcccauauccuccaggcuuuuucccaauuucuaaucuauaaguuacacugucacugguuuuaugugcaguuccuugaucuacuuagauuugaccuuaguacaaggacauaggaauggaucaauucgcauucguguacaugauaacugccaguugugccagcaccauuuucaaccauuguugaaaaugcugucuuuuuuccacuggaugguuuuagaucccuugucaaagaucaagugaccauaaguguguggauucauuucugggucuucgauucuauuccauuggucuacaugcugaugcuauaccaguaccaugcaguuuuuaucacucuauacuacagcuuuagguccggcauggugauucccccagagguucuuuuaucauugagaagaguuuuugcuauccuaguuuuuuuguuauuccagaugaauuugcagauugcccuuucuaauucauugaagaauugaguuggaauuuugauggggauugcauugaaucuguagauugcuuuuggcaagaaagccauuuuuaauauauugauccugccaaaccaugagcaugggagaucuuuccaucuucugagaucuucuuuaauuucuuucuucagaucuuuccaucuucugagaucuucuuuaauuucuuucuucagagacuugaaguucuuaucauacagaucuuucccuuccuuaguuagagucacgcuaagguauuucauguuauuugugacuauugugaaggguguuguuucccuaauuuguuucucaaccuguuuauccuuuauguagagaaaggccauugacuuguuugaguuaauuuuauauccagcuacuucacugaagcuguuuaucagguuuagggguucucugguggaauuuuuagggucacuuauacauacuaucauaucaucugcaaaaaguuauauuuugacuucuuccauuccaaauuguauccccuugaucuccucuuguugucgaauugcucuggcuaggacuucaaauacuauguugaauagguuuggagaaagugggcagccuugucuagucccugauuuuagugggauugcuuccagcuucucaccauuuacuuugaugcugucuacugguuugcuguagauugcuuuuaucauguuuagguaugggccuugaauuccugaucuuuccaggacuuuuaucaugaauggguguuggauuuuucaaaugcuuucucugcaucuaaugagaugaucaugugguuguugucauugaguuuguuuauauaguggauuguguugauggguuuccguauauuaaaccauaccugcaacccaggaaugaaaacuacuuggucagaauggaugauuguuuugauguguucuuggauucgguuagcgggaauuuuauugaguauuuuugcaucgauauucauaagggaaauuggucugaaguucucuaucuuuguugggucuuugugugauuuagguaucagaguaauuguggcuucauagaaugaauuagguagaguaccuucugcuucuguuuuguggaauaguuugugcagaacuggaauuagauugucuuugaaggucugauagaacucugcacuagacccaucuaguccugggcuuuuuuuggcugggagacaauuaaugacugcuucuauuucuuuaggggauauaggacuguuuaggucauuaaccugauccugauuuaacuuugguaccugguaucugucuagaaauuuguccauuucauccaaguuuuccaguauuguugaguauagccuuuuguagaaggaucucaugguguuuuggauuucuucaggaucuguuguuaugucucccuuuucauuucugauuuuguuaauuaggguguugucccuuucccucacgugaaucuggcuaagugucuauuuaucuuguugauuuucucaaagaaccagcucuucauuugguugauucuuugaauaguucuucuuguuuccacuugguugauuuugccccuaauuugauuauuuccugccaucuacuucucuugggugaguuuccuuccuuuuguucuagagcuuuuagguuuguugucaagcugcuagugugugcucucucuaguuucuuuuuggaggcacucagaacuaugagcuucccucuuagaaaugcuuucauugugucccauaaguuuggguauguuguggcuucauuuucauuaaacucuuaaaagucuuuaauuucuuucuuuauuccuuccuugaccaagguaucauugagaagaguguuguucaguuuccacgugaauguuggcuuucuauuauuuaugauguuauugaagaucagccuuaguccauggugaucugauagaaugcaugggacaauugcaauauuuuuguaucuguugagggcuguuuugugacuaauuauauggucaauuuuggagaagguaccaugaugugcugagaaaaagguauauccuuuuguuuuaggauaaaauguucugcagauaucuguuaaauccauuuguuucauaacuucucuaaguuucacugugucucuguuuagguucuguuuccacgaucuguccauugaugaaaguggugugcuaaagucucccacuauuauugugugaggugcaaugugugcuuugugcuuuaguaaaguuucuuuaaugaauguggcugcccuugcauuuggagcauagguauuaauaauugagaguucaucuuggaagauuuuaccuuugaugaguaugaagugucccuauuugucuuuuuugaugacuuuggguaggugauugauuuuuuuagauauuagaauggcuacuccagcuuguuucuucagaccauuugcuuggaaaauuguuuuccagccuuucacucugagguaguguuugucuuuuucccugagauggguuuccuguaagcagcaaaauguuggguccuguuuguguagccagucugucagucaaugucuuuuuauuggugaauugaguccaucgauauuaagagauauuaaggaaaaguaauuguugcuuccuauuauuuuuguuguuacacuuggcauucuguucuuguggcugucuuccuuuagguuauugaaggauuacuuucuugcuuuuccaggucgugguuuuuauccuaguauugguuuuuuuucuguuguuauccuuugaagggcuggauuccuggaaauauaaugugugaaauugguuuugucauggaauacuuugguuucuccaucuaugguaauugaaaguuuggcuggguauaguagccugggcuggcauuuuuguucucuuagugucuguauaacaucuguccaggaucuuuuggauuucauagucucuggugaaaagucugguguaauucugauaggccugccuuuauauguuacuugacccuuuucccuuagugcuuuuaauauuuuaucuuuauuuugugcauuucuuguucugauuauuauguguaggggggaauuucucuucugguucauucuauuuggaguucuguaggcuucuuguauguucauaggcaucucuuucuuuagguuugggaaguuuucuucuauaauuuuguugaagauauuugcuggcccuuuaaguugaaaaucuucauucucaucuacuccuauuauccauagguuuggucuucucauugugucauggauuuccuggauguuuugaguuaguaucuuuuugcauuuuccauuuucuuugauuguugugcugauguucucuauggaaucuucugcaccugagauucucuuuuccaucucuuguauucuguugcugaugcucgcaucucuuguuccauauuucuuuucuagguuuucuaucgccaggauugccucacuuuggguuuucuuuauugugucuacuuuccuuuuuagguuuaguauuguuuuguucauuuccacuaccuguuuggauuuguuuuucuguuuuucuuuaaggacuucuaccuguuugguuguguuuuccuguuuuucuuuaaggacuuguaacucuuuagccguguuauccuguauuucuuuaagugaguuauuaaaguccuucuugauguccucuacuauugucaugagauaugcuuuuagauccgggucuaaguuuuuggguguguuggggugcccaggacuggccgaggugggagugcuggguucugaugauggugagugguuuugguuucuguuaguaagauucuuacgucugccuuucgccaucugguaaucuccugaguuaguuguuauaguugucucugguuagagauuguucgucuggugauucuuuuagccucuaucagcagaccugggagacuagaucucuccucugauuuucaguggucagagcacucucugcaagcaagcucuccucuuacagggaaggugcacagauauuuggcuuuugggccugccuccuggcagaagaugaaggccugaaacaggcccugucucagaagcuguguugcuuuggccugucacagaagcuguuaguuucuguaguccacacucucaccagugcagacaagucucagagggauccaggaaucaagaugucuccccguggugcucaggaaaagcccuaccaggcagggcagacaccucuccucuggcaggggaggugcccggaugucuggagccugaaacggugucugccccagaagcuguccucuagggaauugggggugucugaugacucugcgcccaggugaccuggugcuggcacugaccagaaaagauuuggacccuggucaggccggguuuuccugaugcugucucgggucccucacgauuggauuggaacagaaguuguguuccacucauagaugguccuaggaucaugugaagaguccucuaggggaccuugggggugucugcugacucugcgcccaaggugaccgggugcuucuggcugcuuuugauuguaugcacuucuuuuugaagcagagaauaauguccacauucagugccacaguccacagucaauguacuuuuaaaaaccauuuucgaacuuuuauaccuggucucucagagaccaauccaugcaggagagggcaggggccauagaagcaacauagcuucuuggauaggaucacuucaggccuucauccucagcaaggaggcagagcugagacccagaccucugggcaacuuacuugcaaggagagaccuugguccagagagugcucugaccacugugacucaggagagaguuggaaucccaggagugcugaaagaggcuaacagaaucacaggaggaauaaguuccauccagagacagcuagaacauauaacaccagagauuacuagacgguuaaaggcaaagguaagaaucuuacuacacagaaaccaagaccuucuucaacauugaccauauaauuaauuggucacaaagcaggccucaacagauacaaaaauauugaaauuaucccaugcauccuaucagaucaccacauacuaagguugaucuucaauaacaauauaaauauuucaaagccaacauucacguggaagccaaacaacaaucuacucaaugauaacuuggucaaagaagaaauaaagaaagagauuaaagacuuuuuaagauuuuaaugaaaauauagccacaauauacccaaacuuaugggauacaaugaaagcauuccuaagaggaaaacuuauacaucugagugccucaaaaaaaaaaaaaaaaaaaaaaaaaaaccuagagaaagcauacacuagcagcuugacagcacaccuaaaagcucuagaacaaaaggaggcaauuucacccaaguggaguagauggcaggauauaaccaaaaucaggacugaaaucaaccaagugaaaacaauaagaacuauacaaagaaucagccauagcaggagcugguuuuuuguuuguuuguuugguugauugguuguuuuuuuuuguuuguuuguuuuggguuuuuuuuugagaaaauaaacaaaauagauaaacccuuagccagacuaaguagaggguacagggacaguauccuaauuaaggagaucaaaacugaaaagggagacaaaacaacagaacccuaggaaauccaaaacaucaacagauccuacuacaaaacgcuauacucaacaaaacuggaaaaccuggaugaaauggacaauuuccuagaaagacagcagguaccaaaguuaaaucaggaucagauuaaugauuuaaacagucccauguccccuaaagaaauaaaagcagucauuaauagucucccaaccaaaagaaagcccaggaccagauggguuuagugcagaguucuaucagaccuucaaauuauuccacaaaauagaaacagaaaguauuauacccaauucauucuaugaagccauaauuacucugauaccuaaaucacauaaagacccaaaaaagaaagagaacuuaagaacaauuucgcuuaugaaaauccuuguaaaaauauucaauaaaaucucaaaaacugaauccaauaacacaucaaaaugaucauccagucauggccaaguaggcuucauuccagggaugcagggauggauuaauauacagaaaucgaucgacauaacccacuguauaagcaaucccaaagacaaaaaaaaaaaaaaaaaaaaaaccaugaucaucgcauuagaugcugagaaagcaugugacaaaauccaacacccauucaugauaaaagucuuggaaagaucaggauuucaaggcccauaccuaaccauaauaaagacaauauacaacaaacaaguagccagcaucaaacuaaagggagauaaacuugaaacaaucccacuaaaaucagggacuagacaaugcugcccacuuucuccuuaucuauucaauauaguauuugaaauccaagccagagcaauuagauaacaaaaggggauaaaggggauacaaauuagaaaggaaaaagucaaaauaucacuguuugcagaugauaugauaguauauauaagugaacccaaaaguuucaccagaaaacuccuaagccuaauaaacagcuucagugcaguagauggauauaaaauuaacgcaaacaaaucaguagccuuucucuacacgaaugauaaacaggcugagaaauaaauuagggaaacaacacccuuuacaauagucacaaauaauaugaaauaccuugcugugacucuaacuaaggaagugaaaaaucuguaugauaagaacuucaagucucugaagaaagaaauagaagaucucagaagauggaacgaucucccaugcucauggauuggcaggauuaauauaguaaaaauggcuaucuugcugaaaggaaucuacagauucaaugcaauccccaucaaaauuccaacuaaauucuucacagaguuagaaaggggaauuugcaaaauucaucuggaauaacaaaacaccuaggauagcaaaaauuauucucaacaauaaaagaaccucugguggaaucaccaugccugaucucaugcuguacuacugagcaauuguguuaaaaaacuaugugguacugcuacagcaguagacagguauaucaauggaauaaaagugaagaaccagaaaugaaccuauacaccuauggucacuugaucuuugacaaaguaauuaaaaccaucaacuggaaaaauaacaucauuuucaacaaauggugcuggcucaacugcugguuaucauguagaagaaugcgaauugauccauuuuuaucuccuuguacaaagcuccaguccaaguggaucaagaaacuccacauaaaaccagagacacuaaaacuuauagaggagaaagugggggaaagccuugaugauauggacacaggggaaauacuccuuaacagaacagcaauggcuuuuacuguaaaaucaagaaucaacaaaugggaccucauaaaauuucaaagcuucuguaaggcaaaagacauggucaguaagacaaaaaggccaccaagagauugggaaaggaucuuuaccaauccuaaaucugauaggggacuaauauccaauauauacaaagaauucaagaagcuggacuccagaaaaucaaauaacccuauuuuaaaaaauagaguauagagcuaaacaaagaauucccauugaggaauccggaaggccugagaagcacuggaaaaaaauguucaacauccuuaauauuuaagggaaaugcaaaucaaaacaauccugauauuccaccucacaccagucagagugacuaagaucaaaaauucaggcuacaguagaugcugaugagguuguggagaaagaggaacacuccuucauugcuggugggauugaaaucugguacaacuacucuggaaaucuuucuggugguuccucagaaaauuggacaugccccaguagaggggaaugccagggccaggaagcaggaguggguggguaggggagcagggcagagggaggguauaggagacuuuuguagcggaaacuaguaaagguauagcauuugaaauguaaaugaaggaaauaucuaaucaaaaauaaauaacacauuaaaaaauuucagacauuugcuuuuuuuccaaagacuggugauuuguuggcuuacuagagacauuuaaguuuucuguggauaagaaaguuaggacacuaugcauuuacuuucuuuccuucuuuaggcacuuccuucuuuaguuguuuuuugagacagacucucacaaucuagccaggauggccugaagcuugguuugccaaacaaacugacuguauacuuugauccucuugucccagcuuccuaagugcugggauuaccugugagcaucuucagugcuaacucauuggagacauucuuaacagguuaggguuucucccacaagccuuccuuauauuuggagcuaacucacugcacucuuccguaaagacaagaaaauguagaucuauuuuucccagauguguugucaacuagguugucuuuaaaaggccugaagacucagcagaauaagaaacuucaacuuuucuuuguugaacuuucuucucaugcugucucccagagcacacugguauuuguguuggcaagguguaugcaaggaaugaugcagaagacacugaagcagguucuuccacucaguuauauccucaccugagcuauguucauuauuuuuaaauuaaauuuuguuuagaauacagaaucaaguauuuccuuaauauguuuucauacauauauauucuacucugcucauguucacucucuuuugagccuucaccuucccuauacacuauugugcaaucacacacaugugcaugcacaaaugcaaacagauacacauacacacaugcacacacacacacacacacacacaccaccaccaccaccaccaccaccaccaccaccaccaccauacaccacugagcguucuguauaacuaaggaccuacaagugcuaguucauauagcugugaauuaugaguuucuuaagaauaaguuuuaagaauuuuucccauuuuugggacuccacauuuuucuaugauuagguuaaauggaauauauauggggaaaugguaaaagcuugggaaauuguuagauaguagaccagucucuuuaaacaacccuuuacaaugagugcuuguaaauacccaagggcuuguuccucugucagauccaucacaguaaaggacaggagugucuuuguccaaagaguucuuucuuucuauugcauuuuaaagaugagauauuucucauaauuaauuaaagacaacaagcaccuguggcucuaggcaacaccaucuuccauaaggggaauuggauugguaggauguuaaguagagaagaaaauguugagacaguuccuccuggcucaaucucuagcugguuuccucuacuuccaugcuuuccacagcuucccuucuguuccugaauuuguugugaagggccagcuuuguucucugagcccuacuagcccagggcaucagcucuucauagccauggugagacccaaauuaaacagccucuguaugaaauaccacauuuccacugcuggccucugugcuucuccucccagccacuuccacacagucacucugugccacugagccacuaagcaugugcagagcaugugcugucaaaggggaguguauguuuaucuaguugugagauccccuuagcaugaccuuagagagaugcacaucacaucuuaaggaaaugcugguauauaauuuauuagccuuuucagcauguuaacugcaaaaucuuuuaccaacacagggugugaacacuucagaaaugguguuugucuuguuugggacaguguuuuagaggaauggguccauagagcacuagcugauacaggugaaaaagguccuuuuugcucucaauguggacucuauacaagaauguuguugauuuccacuuuguugccaguguuucugaaauuagagcagggaggaaugauuuuaauuugaugucaaaauuacuugcaucccaaugaaugauggaggaacaaauacuuuuggcugcuuccaaauacaucagacaucuggacagccuugaacuacccugaugcuauaagaccaaaguggcuucaaccagacucuagacguuaccuggcccuaucucaaguccuauaguaauccaagccgugcagccaccucuuauaccaguggcuguucaugcuacucagagugcuaaaauauguugcugggauacucugagagaauuccaccuacauugguacagaaugauuguccugauaacugggucauguaacacuaaaagccugauugguauauaagaauuaauuaucucauuauuaacacuaccauaucagauuucuuugagaaagaacaaagaagagaaugaaacacauuuguuauuaagaaaggagaaacuagcuucuaaaaucuucuucuuacuuuaagaacccugggucacuuaaucagaggcagugcaaagugugggaauugugggacagguuaccucccaggcuugaauucaagagcuuuuaacuaucaggauccuagaggucuuacaauguauguuacugaaaccugaaucgaaucaaagguugcuuaagccagugugauuuaguaaucucaguugacaaauauuuauuugcacuuugaacuggacgaagaauaaggucaugcagguuauuccagaccuggaugaaaacuuuguuuccauccagaagcagggagaguacacaggagcuaauuaaaaacaacaggaaacucucucuucccugguacaugugcugcagagucagaaaaagcaaguucauaacuaggggacuucucuagagaagccaguguguuuugaaaaccaggcaggauuugacaggguagauaguuccuuagguaauuuauaaagacaagguuuaauccaggcagaaaccaacagcagcucgaggcagguaguucaacaaaaggaguguuuucugggcaccuacuuuauuccaggcacuaagauuuagcagugugcaguaaggaggcuuucagggagguccugcuguugagucuaagaugccuuguacaccaacacugacaaaugcuuucuuuuuuauuauauuaaaacgacaggucauuuuuauauaaaauaacaguuccacguacccagauuuuuccuguguacuuuaagucaucuccuggcuacuuauaaugguugugcugauagcuguuguuuauuaugguauacacucaguaccgaauuuuuuaaaauuuauauucacauuauuuugugacagggucuuauuaaguagcccaggcugcccucaaacgugugauuguccuaccucagauucauuaguaccauuauauauuuacacacacacaguuuuucaaccuacaguaguuugaauucauauauguaugaauguauaucccaggaauguuagggggcuaugugcacagccuucucccacaaaagagcugagaauguaauagggucagagaauguaugaggcuagaguauacagaagucccuacucaguuugcaagcuuugagaauuaaaauauggaaugaucagaggcuuggagacugguauuuuguagaacugucucagauuacagaugaaucuaacuguaugucuggacagcuccagaacauucuuggcugcugugagagggguguuacucaugccugcaaaccagccugcuggaacccaaaucccuaagggcuguggccucuuaauugcccagugugauaucucaaagugauucccauccuucuuuguuccuuggcaucaaggccaguggagauugugggcuaacauuuaauauccuccugccucuccagcaagccccugaaacuugagaggacaaaguguugcuuucagagugugccugcuaguuuucccagggagguucacgcauauugacuguugaaaccgaguuuuauuuuuagaagaaaucuaguggaaaccaacauaguaaggggaauuuuuucuuauauauauaauuccgugagggacaaacauuccaauuugaucguuaaaaauaggacuaaaaugaaugucauuuguuccaaaaacugcuagucugagauacuuguaguaaaauaucaauuuacuaaauccuuuuguaaaaaaaauuccacuucugcucugucugcaauucaugcaaguuacuucuugggcaaacauagacugaauuuuaaucauggccaauucuugaaaagcugagaggcucuggaaaugggauaguuggugacucaauccugcuccacaucaagccuaugacuugcugucaccaagugccaguaauacaagaaaaaguacucuuguggguuuaucuguuugucauuaaacuuugcuaagccagcaagccugagaaguaggcuugccauggacuuucaccauuggcauaugagcuccacaggcccuguuccacacagauuaccuugccugaugucagugugggucuggucuguacagagaucucugguuuucccuaguaacuggagagcacuuaucuguagugagaaagccacgcauggccacgccuguuaaguaucugguguguauacgucccuaagugauuauuuagccuagugucauaauaccuugcuuuauguuuccaagaaaaucguaaauaauuuaggcauucuguagcuuaacauuaaucacuaaguaaucucauuugugauagaaugaaugucugagauaguuuaguaacuuagaacaacagauacucagguaagugaaguggggugcaaugagcuaagccuaugccagacuuggauaucagugcggucauuauuauauaagauuaggccacgugagcuuccuugggguuuugugugugugugugugugugugugagagagagagagagagaaggguggcuggacaggagaaugcagaacacagcugcaaagugacagaucuucaauacagcauaugcaaaaugugaacaguagacaaagcagagccuuucuuuucuuuuuuuuuuaauuagguauuuuccucguuuacauuuucaaugcuaucccaaaagucccccauacccacccccccaauccccuacccacccacucccacuuuuuggcccugggguuccccuguacuggggcauauaaaguuugcaaguccaaugggccucucuuugcagugauggccgacuaggccaucuuuugauacauaugcagcuagagacaagagcuccgggguacugguuaguucauaauguuguuccaccuauaggguugcaguucccuuuagcuccuuggguaauuucucuggcuccuccauugggggccgugugacccauccaauagcugacugugaucauccacuucuguguuugcuaggccccggcauagucucacaagagacagcagagccuuucuuaaucugaccauccugaauugcuuaucuuuccuuucucagagaacagagcugacauccgauaaggauauguaccuugacaauagcuccauugaggaagcuucaggaguauauccuauugaugaugaugacuauucuucugccucaggcucagguaaggcugccuacuggaugccauucucuauaccccggcaugcacacauuucgcugugccuucuuccguuacaagcacagcaugugucauagucaugagcaugguuuggggauacaaauuccaguucaagcuaugagaacuuuggaaccuaacuuugcugagucucaguuucauuauuuauaaguggaaauaaauaacuauauuuaccacugaguuagguauucaucucugugaagagacaccugacagcaacucauaagggaaaacauuuaauugaggauggccuacaguuucagaaguuuaguaauuaucaucauggcaacaugcauggcaacgugcacacagacauggugcuggaggaaccagaguucaacaucuugauccacauacagcaggagacugugugccacacuagguauagcuugagcauaggagaccucaaagccuacccucacagugacauacuucuuccacaccuacuucaccaaggccacaccuccuaauagugccacuuccuauggccaagcauucacacacacaagucuauuaaggcuguaccuacucaaacuaccacaaucauauaaaguuuuucauggauaaauggaguugaggagauagcuuucaguuuuauuguuaaaaauuuuagaauauggucauagaaaccaccguucaagaaaucuuucaaauacccauuuaauaaaaugccugcucuauguuaagauuauacacaaaaacaaaaacuuacaggcuuuuaaaguauauugcucauaaguaggaggaacagaacugcagcuauguaauauaaagauagauuuaugucuuugauuucuucaguguauuaguugucuauugucucugcaauguugccuaacaaaccauccgaacacuaaguacuuugaagcagugggcauuugguuaauucauuauccugcauguuuuccaguuagaggcaggcucuacaauggcuuacagcugaagcuuggcugauuuuggcuuaacucugucgugagcagacuuggcuuuaguccacaugggcccuucagucuccaggugaccagccauauuuucacagagugaagcaaaaaucuaauccuaaacuuacaguuugguacaacgucauuucuauauguaugugcauguguaggcauguguguacuuauguacauaugaaugugaguucauguguguauguugauaguacagugaucaaagacaguauguuugcuuuauuccaagaagcugaaagaagugucacaagagaagaaggaucuuaguuuuagaugauuucuuucguccugugugcuuaugugggacauaaugauuagaauaugaauuggaggaggccauucaucucauaguugacaggaaccagauaauacagaaggcagugauaauuagguauaccuucccaaugcaugcccugcuguugacaucuacugccaucuaaaucuuauaauaccuuucaaaauagcaccucuacauaugagucaaggauagaauacaugagucuaugggggcacauuucauauucaaaucauaguaccccaugcaugcauacaacugaacaauguuuccagccccaaguugcgccucuuaauugagacagcuaucaacauauuacagaggauguagguacauggaggaggaaaugugcuuggacacuuuuccccaauauaucuuaccuggaaauguuucaccugugcaagcaauggcucaguggacaaaccagaaaucuuugguggguagcacauagaaaagucuuagcaagaccuuucuuucuuaguguguuuauugcagaugagauuuaacuaugguaauaguuauuauccugaauauaaauaugugccagugcaguugaccuagguuucagaauguccuagaacaaauaaaggucaauuguuucuggugaagaucuagacuuauaaggguguuucaguuugaaaaugaccgaucugaaaauauagaggcaguagcugaccuaguaacauccugcuguaaaaauaguucuaguuauucaagggagugugaugcauucacauaugcagaacaagugugaaagaguugcucucugaaacccacaacacuauuaauaucuuacacucaugauaccucuuuuguuuagcaucucaaaagugccuuauaacugucauuucaaaaugccuuggggaauaauaaauaugcaucuuugugguccccauuucgucacagaucuuaguauucaagggucgugggagaucguuauggguugcucaacucauuuugcugacuucgcccaagauuuuguuuacauuuaguauaagguauaugccucccugacucauccaguuauuggagugucacauuugaagcccugaacguacucaucauauggacuagauagaaaugagacuuaaaugugggcaaauuuuucuagccacagauauaacuguaggcaaguuuuugcugaaaaaaacaaacaaaacaaaacaaaacaaaacagaaaaagaauuauucuuggcuuuagaaacuaucuugagcuuugcuauggauauuuuuccacuuacuagucuguguaaguaaaauuugugaagcacuuugugcugggaaaagccuuauccauauaauucuguuauaaagauaucccugauucuauugucauuucuacuuucaauugauacaauccacagugcagagagaugaaggagcuugcucucauugauccaugugaggcugucagaaaguaagggaccaggaagcaagaaguguggcuuuagaaaaggccuugccuuucagcccuugggguuuuaccucuuauguugaaaauccccauuuuaccauuaagaggcuuugccucacaaauguccacugaaaucaguguauugcucaauguaccaccugaccuuccuccucucaugcuauccaguaggaaagcaaaugucccagaacaggaugucuaaaggcccagagaguccauuccagcaagaagaagggaccuacauuacauaaauauagauucagaaugggaaccaacaaacugagaaucuucacaagcauuugugaagccuuucacaccaagggcuaaacuuuuaaaacacacacagaaaaagaugguuuucaagcccaagagagcaagaauucauucacacaacucuagaaauuuaaaaaaaaaaucauuauaaugcugugauuggugacaacagaagguacugaccaacagaaauaaauaauagacuucugguuaaagaugacaaauugaguagaaagccugccacauucaagauaaagugaaauuaaaagaguagagcaugaacucaucagaauggugaugcaguaacccaaacaaaacccaaagaugcagugguugugcagcacuggucuuggcagcugugaaaagacagaacuggcaguucagaacugggaagcaccaggaccgcgcugcagaaggccacagggguucagaggugauggcauaaauggggagugaaagugaauagccucagggucaauaguugaaaaucucucuaagaaacaaauagacccuucccuccaucauaaguuaacccuccacagauugauuauugaaaauaaaguaugguauugagcaagggaguccaaaagacuccuaaaacaauguagguugucccacagaaguucaaguuccuauuguugaaaccaccaugcauuacagacaugaaacgcaaaggauuugagcuggauaagaccugaaagccucaaaaggaagagggaacagaaacucggaaaaagaagaaaauguacagaaaaacuaauuccaagaggcgagauguuuuaaugguaaaacaagaaggggacacaacaaaacaggaauguuccugagagugaaacuccaguguuagaaauaagaaacuuacuggaaaaugaagacaugcaaaagauaguuauuuguugagcacauauuuauuaagcaccuucuuuaaugugggaacagacaucguucauucuaggaacacuacaguaaacaagcaaaugaacaaacaaacaaauaaauaaauaucaaugcuuuuuaucauagggaaucacuucccuugaucccuuuaucuguuuuuccaaauuucauucuuuuuuuuuucuaguaagaaagaguguuaauccaucuagugcugaguucuuggcuacugcacgucugcagggagccacccuugaacccuucccaauagcacuaauucucuugcauuuucaaucucuuccacuauaugauauuuuugccaucucaaaacucagaacuaaucaaaacaugaaaaguguaaacucucuuucugacugccuuucucauggaaauucucuguuuacucuaacauuuuauagucaaccuucccaaaaaugguguggugugguccuucaucagcuccugucuuacccaugcccucugucugccuuccccugccauccacuacugauacuuuuuaagaucaucaaugucuuccauguuggaaauauucacaaauauuuuauuuguaaaacguguucuaaaucaucuugauucauuuaggauacuauaacaaauauuuuagaguggguaacuuaaaaaacaaaaacaaaaaacagccuaauuauauuggucacaguugugcaggcugggaagucaaagauuacaucagugaaugugguauauaugaguguuuuuuuuuuuuuuuucugcuuccaaggugauaccuucuugcugcauuuuuauuuaauagaauaggcaaacuaguuuccucuggccucuuuuauaaggugcuaauucaugcacaaggcagauagaacccucauuaccuaaucaccucuuuuucguuguuguuguuguuuuucaagacaggguuucucuauauaucucuggcuguucuggagcucacucuaaaccaggcuggccucgaacucagaaaucugccugccucugccucccaggugcugggauuaaaggcauguacuaccacuguccagccccuaaucaccuccuuaauaucccuuuuaaaaauuguagcggagacaacauucuacauaugaacuugggaugggacauaacauaaggagacaucauuguuauuaaacacauaggcccuggugggcgaucaagcaugugcagacaccaaugcacacuaaaaaucuuaaaagaggaggacuaaagcuuagccaugaaggauacuuguuaucugccauuuuaguggaggaggauaaauauaucuguuuauaauagcacaaaaguaggagaaaauagggaaguuguaaacugucaaaagaaauagaguguaucaaggaggugguaguucacaguguacaauggugaaaggaauguguuagucagauuuccauuaccaucacaaaauaucuaaaauuagcaacuuaaugaagaggaaauguuauuuggcucccagguuugaaggcuuuccccaagguauaauggccuguugcuuuggagccuguagcuaggcaaagcaucaugcuuggagugccugaugggggucaguuaagaaaagagacacaggaagaggucauggucacaguauacuguugaagggacugaucccaaugacugaucuuccuugaagccucgccuuuuaaagcagcaguucuccaccuguggguuacaaacuguuugaggguuacauaucauauauucugcauaucagauauuuacauuacaauucauaacaauagcaaaauuacagcuauaaagcaacaucaaaauaauuucaugguuggaggucaacacaacaugaggaacuguauuuaaaaguuacagcacuaagaaggaugagaaucauuguuugaaaggucucacuaucuuccaauagcauugugaguugauagccagucuaacacaugggcuuuggggaacauuuauccagccaauacaagacaagacaaacucuuuaaguauguuuuaauauaaagccauuguauaugacaacauggaagauauugaugaucuuaacaaaaaauaucaguaguggauggcagggcaaggcagauagagggcuugaggaggacaggagcugaugaaggaccacaccacaccauguugacuauaaaauguuagagaagacauuuuccaugagaaaagcagucagguaaaagagaguuuacacuuuucauguuuugauuaguucugaguuuugagauggcaaaaauaccauauaacagaagagauugaacaugcaagagaagcagggcuauuaggaagggucaaggguggcucccugcagacaugcaguagccaagaacucagcacuguguggagauuaacacucuuucucacugaaaaaaaaaauuaccauauacccaggggcccuacaaacuuacugaaguccauaggucuauuugugcuagaaacuuaagccugguaacuugagagcaugauucugaauaauaaugccugauaauguacagaucugugucgugagucacaugauaaacuuaucuucacuuucuuccuaggagcugaugaagacauagagaguccaguucugacaacaucccaacugauuccaagaaucccacucacuagugcugcuucccccaaaguggaaaccaugacguugaagacacaaagcauuacaccugcucagacugaggugcauugucuggcauugugaauacugcugucuuuugccuacacagaacuguuuucugugagagaagccccacauaaaauuauaugagggcuaauaacccuuccacuguauugcuguaaauggcucuuugcucuuucuuccaacauuuuacaguugaucugcuugcgguuuuuaucagcuaggacuaucuucuuuagggauauacuguuuugaaaauggcacuuuuccuugcagaacuucuguagcccaguuacaagacgaacuauuaagcuacuuagcugagaguccgauuuucuuuuccucauguuaaaaaaacauuguaaacuugacauccauuggaccagguuaaggagggaugauaugaaucuuuccuuaaggucucaaugaguguccacacccaccaucaguguugcauacacuugcccuacucucagauacauguguaccugguguagcugcauuuauuuguugugagaccuuaauaagaaugagaccuuggacuugaaacagggaaaacaccuaaguaaugaaaacacugaauuuaugcuuugauuuuguuaguauuauauuacaauuagcuagccuuccacuuauagauacacuguuuaauauggaaauuggauauuagaauccagugaaggccuaagcauugacuccuggaucuagucaaauuucuuggaucauuagaaagauuggaugugaauauuacauagcaggcaccugagcucuuguuccuuguuucacuguguaagcauuaguugaauuugguggagcagaugagaucaagccaguucaccaagugagcauguguaauaauuuagugguagacuuuacacacauuagggauggcauguugcuuaugaaaacuuaacaacacaagcaccuguuuuuucaguucacccaucuguugauuuacaaauaagaugcugccaagcucuugcagcaugcagguuuuguggcaggcuuugugggauaaaaagcaccccuguguuagcaggaacauaggcaggcuuuucuuaguagaauaucuguuccuccacuuucuugauuuuccugacucaugaguccaucaagucauagcacauaacucccuguugacaaagcucccugcagacaugcaguagccaagagcucagcucuguguggauuaacacucucucuaggcuuacaaagcauuggcacuauugccagcagugccauuccacagccaggaaccagaaaggcaaggagauacucugagagcacuggggcagacauaccuagcauuuccugggagcuguuccauugguuucuaaguugaauuaauaaaacagaugaggaaaggagagacaaaaagcagcaggugcuuuuggugauagaaucgcugaauaugucagagcaggcagguaugccagaauuaaaugaagcuuguggaaagccuguggaaagaugagcuuggucucucccacaguuuuaugugaucuuuuauaacaauguuuucaacucaaugaccguuaagacucaauauugcagagucagaaacucucuugguaaaguuuuggcuuccaaucuucaauaguuuuauucuaaacaaaccguuguuugguauaaauuuauggacuaaugacaaauauggauugaaaauugauuuaaguuuauagaaauuggcccuaaaacauaaugaauuggccuuugcuaacagacauuucguggaugaguuaagaaauuaaagaucucugaacauuuuaaugcaaauauuuuauuuuuaguucuauuuaaugagaugacaagaauucauccauucaugggaguucuauucagugugcaucaaacauuguucuagguguccaugaugaagauauugauaaugaauaacacuagcagcaauguaauuuucuguuuuauacuuaugugguacggcuagauuaaaccuugccauuagagaaaauuuuguguuuuaauaggucccagaguggcauuacugucauggguauagauagucuauccacuguguuguacagcuaugugacugaagaauagaaagagaccuuucuucauuuugugaagccuaguuuuuuucacagccucuagaauccagucauggauucaauaaacuuucaauuggcuucauucaauuaugugugcucccuuuucauaauuacacaaagcaccuugaggcuuauguacugacugaacacucuucuaagugccauuucuguggagagccuucuagaucaucacuugaauuaauucuuuuguguccuuauucagaaguugagucgaagggaacugagcaagucaacucuuaaaugacuuuagggacuuaaaauauuaacaaguaaaaccuuguagcuuaucuuaauaauaaagauaauaagcauuacauaaacuuggggucaaagcuucaguaucuuucucacuugcuaguuuucacucacaucuuucccuggaugcaaauggguaucauuccauuccuugauuuuuuuccucuucccuuugcuaauuucuaaaagcauagcaaccaaagcaaugcuaaugagcaagaaagcaugugcuuccuugaugaggacucaauaagccauucugcugcccuuucugccagauaaccaguuacugauggcaauccuauaagaagaaaauggaaagaaccuacaaaauacugccaacaggcuucucucaucugcauuacuugggcacagcaagacuuaaaggaccaaccauguuuucuauacucagacagaaaacagugaaacuugaauuuauauuuauacaguuauaaaaauuauaauuauuuauagaaaauauggcagcuuaagauuuaugaaguauaggguuucuuguaucuugggaaaaaccucuaucacauguuauuacuguguuugguggaaaccuuguguguucugaucacuaaaaguaguaccaauugguucacauugaucucuagaguucaagugaauccaccuggucuagacugcggucuuuucuagacauaaagaugacuuugaaacaguccaagaaaaugaacuauuuucuuagaccuuuugccuucuuuaauaggauguauuccagccuucacaaaacagcugaaugauucacaugacucugcuuaagauggcugggaauucauaggaaaaacuggaauagguuuggcuagggaggagauucagugucuacugauuuuguagcugguauuguguaaaccugacaguagagguaucagagaggaaggagccucaguuaaggaauugccucuacaagauccagauauaaggcauuuucucaauucgugaucaaugaaggaggguguuccuaucccugggcuggugguccuggguucuauaaaaaaaagcaagcuaagcaagccagaggaaacaagucaguaagcagcacuacuccauaacuucuccaucagcuccugcugcuaggauccugccaaguuugaguaccuguccugacuuccuucaauaaugaauagcaauaugaaagugugagccaaaaacaaaacaaaaaacaaacaaaaaaaaaacaacaaaaaaaaaaaaacccuuucuccccaacuugcuuucuggucaugguguuuggccacagcaauagaaacccuaauaaagacacagcuuaagaguugacaauguuuuccuaucaguaguguuagccaaugagaaagaaacucaccuguuagaaaacagcagcucauuagaaucuuaacuuuucuaaaucaggccuucucaaaccacaccaucaucugagggacuuuaaauaacaauaaaaaucagcagaccaacugaacagaauacucaaaggguguguguguguguguguguguguguguguguguguguaucaguggagauuggcugccucauggaccuagaagucacuuagcaagcuggccagagccuuaagauucuaccaugcccccaacaccgugccuucaugugacuucaaggggacaaacucagguucucaugcuugcaaacaagcaaguacuuuauugccagggaucuucccaacccagaaaguaaagauucuuagaauugucaacuaaaacaauuauucauaucauucuugucaucuuugcuucaaugauacuagaaccacaagcuacauggguccaaacugggacucaccaacuggcaaaauaaacaucauacacauuauuauucaugauauuuacuaaacuuacuuuuauggaaaaaaaccugggaauauacuuaguaucguuucuucuucccagcacguaucaaaagagagauaauuguguuuucuuucuuccccacaccagucaccugaagaaacugacaaggaggaaguugacauuucugaggcagaagagaagcugggcccugcuauaaaaagcacagauguguacacggagaaacauucagacaaucuguuuaaacggacagaaguucuagcaggugaguugcuaggagugucaagugggaaggaacuucaagaggccuuccugggauaggugacauucagaaagcuugcugcacauuacuggccuucaggaagcaaucuccaggcuuuuuauuucagaaugacaggugagaaguuaggacuacuuugucuauuuucuguuaacuccuccagucugucccucagccagccauugauaagaggcuaacaugggagacaauuucagguuacaguccaucauggcaaggacaucaaaauggcaggagcuugaaguaguaaauugacuaggcaaagaacuguugaguguggaggcagggugggagaugucggucagacagucauaauucaggugaucuuccaaguucaaaaccaacuucggagaaggaaaagguacaaaugcugcugcugcugcugacaugauaagaauuuugccucuaauugaaauucaccugaugaaaguacagguugagccucacugaccugagcaucugcaauauucuaaaccuccaaaacuuuuuaagaccugacaugaugccacaaauguccucaggaugugugccuauaacaggagcacacuacagaaacuuugucccaugaauagaauuauuuguuaacuuguguaagcuuuccuaugaacuauguguauaaaauauacguggaaauauaaauauauuuccuguuuagacuuguaucugaucccugauaacuuaauccauguauguaaauauuuaaaaaaaauccagagauggaaacacuccugguuccagauauuucugaaaagaaauagccacugaagucuguacugauauuuguuuuaaagaggaagaugcgcaagauuuaacaacauuuaauuuauacaaugcucuccucaaauugaagaauaaguagacaucugcaugcuuucuauauuuaaucuucuuuuuuaaaaaaaucuauuaugucauauuuugugcuuuuauugugauuagaagauuacacuauaaaaugcaagcaccaaacacaaguaucugaaaguguagaguuaggugaaguuacagcuggauuuuucuuauggaggcuuuguguugauacaaucaaugaaccuuucugaagaaugacuccugauuauucuguuuaaaacuugaguucuucccaaucacaaaagaacauauaugguaugcacucacugauaaguguauauuagcccagaaguuugaaauaaccaagauacaauucacagaccacauaaagcucaagaaggaagaucgaaguguagacacuuagguccguuuuagaaggggggggggucaaacaauuugcaaaacacaagaaaaucaagaggaaggaagaccaacauguugauacuucauuccucccuagaauagggaacaaaauacccauggaaggaguuucagagacaaaguuuggagcugguuuuaugugaaguuccuugauccacuuagauuugaccuuaguacaaggagauaaguauggauugggaaaggaucuuuaccuauccuaaaucagauaggggacuaauauccaacauauauaaagaaaucaagaagguggacuucagaaaaucaaauaaccccauuaaaaaauggggcucagaacugaacaaagaauucucaccugaggaauaccgaauggcagagaagcaccugaaaaaaauguucaacauccuuaaucaucagggaaaugcaaaucaaaacaacccugagauuccaucucacaccggucagaauggcuaagaucaaaaauucaggugacagcagaugcugguguggauguggagaaagaggaacacuccuccauuguuggugggauugcaggcuuguacaaccacucuggaaaucagucuggcgguuccucaggaaauuggacauaguacuaccggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuacuagccaaauggauggaccuggagggcaucauccugagugagguaacacauucacaaaggaacucacacaauauguacucacugauaaguggauauuagccgaaaaccuaggauacccaagauguaagauacaauuuccuaaacacaugaaacucaagaaaaaugaagacugaaguguggacacuaugccccuccuuagaagugggaacaaaacacccuuggaaggaguuacagagacaaaguuuggagcugagaugaaaggaugguccauguagagacuuccauauccagggauccaccccauaaucagcauccaaacgcugacaccauugauuacacuagcaagauuuuaucgaaaggacccagauguagcugucucuugugagacuaugcuggggccuagcaaacacagaaguggaugcucacagucagcuaauggauggaucacagggcucccaauggaggagcuagagaaaguagccaaggagcuaaagggaucugcaacccuauaggcagaacaacauuaugaacuaaccaguaccccggagcucuugacucuagcugcauauguaucaaaagauggccuagucggccaucacuggaaagagaggcccauuggacacgcaaacuuuauaugccccaguacaggggaacgccagggccaaaaagggggaguggguggguaggggauuagggguggguggguaugggggacuuuugguauagcauuggaaauguaaaugagcuaaauaccuaauaaaaaaaugggaaaaacaaaaaacaacaacaacaaaaaaaaaaaaacaaaguuuggagcuaagacaaaaggauggaccauccagagacugccccaccuggggguccaucccauaaucagccaccaaaugcagacacuauugcauaugccagcaagauuuuugcugaaagaacccugauauagcugucucuugugaggcuaugccagugccuggcauauacagaagugggugcucacaaucaucuauaggauggaacauagggcccccaauggaggggcuagagaaaguacccaaagagcuaaggggggcugaaacccuauagguggaacaauauuaugaacuaaacaguacccccagagcucuugucuuuagcugcauauguagcagaagauggccuaaucggccaucuuugggaagagaggccccuuggucuugcaaacuuuauaugccccaguacaggggcacgccagggccaagaagugggaguggguggauaggggaccagugugcggggagcguauaggggacucuugggauagcguuugaaauguaaaugaauaaaauaucuaauaaaaaaauaaaaaaaaaagaagggggaucaaaauaccccugagaggagauacagaaaccagguuuggagcagaaacugaaggauagucuguccagugacugucccaccuagggauccaucccauauacaguuaccaaacccagacacuauuguggaugccaacaaucaauugcuggcaggaccugauauagcugucucaugagagguucugccagugucggacaaaugcagaaguggauguucacagccauccauuggauugagcacaggguucccaguggaggagcuagagaaaggacccaaagagcugaagggguuuauagcccaauaggaggaacaacaauaugaaccaaccaguacccccauagcuuccagggacuaaaccaccaaccaaagaguacacauggaaggacucaaggcuccagccgcauauguagcagagguuggccuugugagacaucaaugagaggagaaacccuugguuuuguuaaggcuauccaguguauccccaguguaggggaaugccaagacagggaagugggagucuguggguuagggagcaggggggagggcgaauggaugggugcagucgaauggggaaaugaggagaggggauaaaauuugaaauguaaguaaagaaaauauauaauaauuaaaaaaaaaaacuugaguucucaaaucauuuauaaaaauaucaauagguuggaacuggccaaacuaauuccugaaagccuugaccuucucuuuuucuucucuuaucucagccgucauugcugguggugugaucggcuuucucuuugccauuuuccucauccugcuauugguguaccgcaugcggaagaaagaugaaggaagcuacgaccuuggagaacgcaaaccauccagcgcagcuuaccagaaggcacccacuaaggaguuuuaugcauaaagcucccauuuagugucucuauuuaggagagcacugaacuuuucaaaauaaagcuuuggcauagaauaaugaagaucuuuguuaucuguuuuguucauuacagagccauacuggcccuuuaaugaugagaauuccauuguauuuaaauuuuuucguguauuucuuuagaaugacauaaaaguaaaaaucuaacaucugcaguguucugugaauagcaguggcaaaauauuauguuaugaaaaccccugacauucauggaauugauuugaacaucuaugugcaaauacaaaaugauuguguuuguccucugguucaaagaugacugcuacucccccuugucagcaagucuccaguuaaccuuacugaguuggucuucauuuauuuaucucuugucccucuucucuacccucccuucuugucaccuuucuuagaaacaaaaccuuaugccuuuuguagcugucauggugcaauuugucuuugaaugauuacaauaaugguaauuuaguguauaugugauuuuucucaaauauguuaaccuuaaccuccacuuuauauaauguuuuuaaauaucagacuauccauuuuaugcuugcuuuaaauuucauuacuuguagcuucaggcagauuugcaaaggcaaauuaauguguaaaauuggauuauuacuacgaaacuguuuaguccuagcuaucuucuuuugggaggauuugacauaacggacaagccucagcaaacccaaagaugcuaacaguauuuugagaaguugcugcagauuccucuggccacuguacuuguuaauuucuugucauuugaagguacgagaaagaguuuaaagaaaaaaaaaaaagaucaguuuuuguucuuaacaugcauuuaaauugcaaacaucuuuuuaagccuuugaagugccuaugauucuauguaacuuguugcggacugguguuaaugaguauauauaacaguuuuuaaaaaguugguauuuuauaagcacagacaauucuaaugguaacuuuuguagucuuaugaauagacauaaauuguaauuuggaaacaacaaaaaaaccugcugaauaaaucacauggccuaauauugaaaaugucacuguuauaaauuuuguacauuucuuaccaaauguacaucuccccuugcugugacugaccgucugcucucagugacuauauggguuugguuucugaguaucucauggugucugucaaucaagaccaaagaaccccucagugaggcuguuaauuacgagauuuaccucuaaauuguucagaggaaaaguauuguuauucugcauguauuugggugcaggaauaggaugacugccaggggauuucaagguuugcagccuuuguaguguagcuacugacaauauugagagagaugccuucuuuugcaauuuacucuuaaaaguauaaauuccaaagaagcaaagcgaccuuucuagaaguaggugucuggggaacagaccuauagaauugcuuaccugucaaagcuccccuacagaagaacccuguaagugacaaccacagccacuccaugggguaggagggaagguagggggcucugccuguugaaugacagccuggcugcuuaagauggauguuucuagaaaagguaaugccagaggaggaguuggaggcaugggggugccccgauuggguacucacugaacagagcauuuccuuuuuuuguucuguuuucuauuuuaccauuaguuuuuaguuuuaaacugugagccauggaaguagaaagaagacagcaagauccgcagcuuuuccagcauaaaauuaacuuuugauaaaguuuggcuacuucguuugagcaccuucccugagcuugucacagaacacauuuaaacaaaacuaaaguaacacuugaaacagugcugugucugaaucuuuaauggccuuaauucauaccuuucuguccaauuacagcuguaauucaccauguuaaaaggaaaugaugggcccuuccaaagcugcacaaugccccucaauuacggaggcugagaauguaguggguauaccucuaacugugugaaacaguggaauuuaauuuguagaauaacuugcuuggaauaucuaugccagggaaaaaaaaauccuggcaaauauuuugucacugcuguaaagcacauuuguuaaaagugccaaaauaaagucugucaugccgaaaguaacucauuguauagacucacauccaauuuucuguauacucucugcuuagugugguuuaaaaaaacaaaaaacaaaaaacuuuaaagauaugguaaauaauaucauaaaacuguuauuagucauuacugaguugagaaaaauuuugguaaaacauaaauauuaaagccagugugguauuuccugcuuuuuaaagcacaugugaacaaacucccugugugaguauugcuuuuuguuugagagacuguagcauuucaaacuguccuguuuuuagcucauggugggcaaaugggaaaaacacacuaaagaauaaauaaaauuuuucauuacauguuaaaaagu

SEQ ID NO: 7709 - RNA, 1016 nt, Mus musculus
ggugaggcugagcaugagcaguaguugaagcaccagaaagauggcggaggaagggaaaaggaaaaagauuccuuugguuccagaaaaucuccugaaaaagaggaaggcuuaucuagcccucaacgccacuuaggcaaagcaggcacuuuggcaaagagagagagaaaagggaaacaauucagguuuagacgacuagaaucuuuuguacuugauuccuggcagcagcaacgugaagaggugcguguccagcaacuagaggugaugucucgugcuuuggagaugccugauaaacauuccuugaccuucguuauaugcauggaaaggauugaaggagugaguuuauugguaaagagcaccaucaugaaacuuggccugaagaaauuguuccguggcaucuuugucaaggucaccccucagagcguaagaaugcugcucacgguggagccuuaugugaccuggggauuuccaaaucugaggucuguccggggacucaucuugaaacguggacaagcaaagauuaagacagucccucugacagacaacacggugaucgaggagcaccuggggagauuuggugucguuuuccuggaagaccucauccaugaaauugccuucccuggcaagcauuucuaggaggucucuucauucuugugcccuuuccaccucucuguggccugccaugcuaccaagaacagagugggcuuccucaaagagauggguucaccugguuaccggggagaauggaucaaucagcacauugggcagcucaacuagagcaggagcagguuuuccaaaaaacacccauuggaaguguuuuuguugguuuguuguuuaaaauuaucaaguaucuucaaaaagaugauuuucugucuucagaaacuaaaggagggggccuggagaaugacaguaagaugugagcaucagagaugcuuaccacaccccaauccauggaaagggacgauuacccuuauuggcugcccgugucugaaaucaaugcaagcugugcucauccugcc

SEQ ID NO: 7710 - RNA, 4016 nt, Mus musculus
cguggugacgucacgguugccauggagaggccagcuucguagagacccugggcugguagcggcuuugaaaccuuguucucuggcaccaugagcggacggaguaggggucgaaagucuucccgcgccaaaggccggggcaaaggccgggccagagcccggguccgggccgcugcggaagacgccuggcacgacgaaaagccaccacagagcccgcggcucggggaggacuccgcggccgcgcaggugcaggccggcgcagcucaaggaggcgccgaaccagccgagcugcgggaagaggcggccugccgccucccgcuggacugcggccuggcguugcgggcucgggcugcagacgagcgcgggcuggcggccccugauccggaccuggagagggcccguucccucgccgagcgccugaccagcgacaccagcuucgugggaaccgugggagccuuggcgaagcugcgacgcggcucccgcauuggaaaucggcgaguccccgggaggaaggccccagauacucggagcgccacggggaggggaccucaggccacaguuagugggaagccgaagauggccucugcgggguugugcgccgcugcuccagugggggaggaaaaaaagaugacagagaagcaugcuggggcagggucucccgcgacagugggcagcauggauacccuagagacgguccagcuaaagcuagagaccaugaaugcacaggcugacagggcauaucucaggcuuucacgcaaguuuggccaguugcgacuucaccacuuagagcgccggaaccuccucauccagagcauuccgggcuucugggggcaagcuuuucagaaccauccccagcugucagcuuuucugaauaccaaagauaaggagguauugagcuauuugaacagacuggagguggaagaacuuggccuugccagguugggcuacaaaaucaaguucuacuuuggccgaaaccccuauuuccaaaacaaggugcucauuaaggaauauggcugugguccauccggucaaguggugucucguucagcuccaauccaguggcucccaggccaugaucuacaaucccuaagcaaggaaaacccagaaaacaaugguagcuucuuugggugguuuucaaaucacagcucuauugagucugacaagauuguugagauaauuaaugaggaccuguggcccaauccucuacaguacuaccugaucagugaagaagcccguggagagaaaggaaaggaagaaaggccagguccagcaaaacugagcccugcaccugcagugaggcagcccaacugauccgacacagaucucccuaccaccucuugcuggaccuguuaggcugaccacguggguuugguugucugccuucuguucauaccauacaugguagccacuuuggacuuaucuucaagaaugugacauuugugauaauauucucugcuuccccaugaccucaccuugucacaauaguguugcaugugugacauucucacuguuuguguaucaaucacuucugauauaugacuuucucuacacuauccagucccuguucuuggcucuggcucuucccacuuuccuuucaccuggacauucugagucauuguccagauggauauucaagcuaugcuacuucauggccagucagcugggcuuuguguccauuuuaagcaugcauguuaucaguggcaagauuuuucuauugcuaucacaaaaugaagccagugcuuuuauucuguggguauggagacaucaaccaagguucuuccuauuuuguuucccacuucagccuagguccagcagacuacugguguggaugaggacaagggaaaacaagaauauguucuguucacaucauacaucucuucuugccucauagacagccugcuagugaacccucaucauggucuggcuaugccugacugcagucaguccauugacuguuggcuagguggguguuauuggcuccaucuugcuuaucaaagaccucaagaacugccuauggacccagguaccuucccaaugcaugagcuacaaacccaccuuccccagacuuuagaaaaccuacugcuugucagauuggugggcagccuggcauuugugaacauaugcuuguugcucucauguugugagcccugagaaggguagagcuuuggaccacaucuuuaucaacuggguaucugugccauuucucuuauuccuuauuccuugcuaagaagggacaagaaggaauuuugaggaagagagauuuuucauuucuaugcccauguuuacgucacaccuucaugcaacuuagucuccuucccuaucaaccuaccuugggacuuccuacucuccuuaugaacccucucccagccuuuuaaaauagcaucacagugcagacaaaaaaaaaaucaucaaccagacuuuucuacauacaguuagggaggcagaaagaggcuuccuuugcacacucauguaguaggcugagauaggauaaagaaaaaccaaaaggucucaagagagucuauggucagacauagguccugaauccuggcuuuguucaguaguucuaaaguuguaugcaucugcuagaauuagaaacccuaaggcagcaguguuguggucucuugugucuucugucuguuucuuuuuaagucccaggggcuucuuccuuuugucucauuugauagccuaugccacugggguccccagcccccagcuuucccacucaguagugcuuugcuaucuuuguuucuuagcccaaauguacucacuauggaagaaucccaagguguuacuggggacaggacaggcagaaccuguucuagauauuucugguaagugugcaggcugagcuggaccaucucuaccaaaguuugucuguguucugacuuaucuucuuuggaaaguagaacucuguaagccagcccccaugcugguauggaagacuucauucuuaccuuugugaggggguccuugagaaaauaggcaagggaaucagggcaagauagguaugaaccugguauugagugggucaguaaaacuugauagaaaugcauugugaugcugcagagauaguuauccuaucucuuagugaugaaggugacagaagagaccuuacucaggguugggaugggagaguuaaagguguauguaaacaagaugccaggucaaggauggauucagaguucugggcagucuucaucaucguuaguuaauuucuuuuuuuuuuuuuuuuuuuuguaauuacagaaacaaaccaaaaguaauguuacuauauuggguagaaguuacauccuaaaguguguaagauuaugcuaaaugcugaguauuuguccucuaaaaucuuaccacauuuuguauuuuugucuaaugaggaaaacagagcuguauaaguuugcuuuugcuauuuauuauguaaauuuccaaaaaauaagagugaagaaaguggugccuggacccuguguaccuuguagcuagaagcaaugaguaaccuaaugucaucuguaucuucuuccuccugcauuuuucgugaaaguccaagugcauauaccagugcagcuggaucuacuuugggagacuggggcauugagcugaaaugugcacucucaugaucacaauaacuccacuaaugugaauuuugugugaacugaugauauuuuuagaagugggacucauaaaugagucuucacaauuaguggaacucaaaagagcauuggugaggauauucugccacagauacaaaagaagagaccauuauguuguaaaucugccuaugacccugauguaaggcacuugagacccuuuucuccuuuguaacauagagacuuguauggacuguuaggguugcuguguucugugaaaauaaucaaauacaacauaaucuuuucauuaguuucuguaguugauaauuugauauccugguaauaaugugauuauuucccuguuccuaaguggcauaaauacuugcaagugugcauguacaauggaaaaaaaauaaaaaaaauauucuugugucaccauug

SEQ ID NO: 7711 - RNA, 7039 nt, Mus musculus
cgggggucuuguuacaacuucagaacgguuuccgugucguuauucguacaagacccucgucucucucuaccccccauuugguuauuaggaggagguccccucgagauccucgaauaacuggaccugcuggacgggucaaguggcgcccgacguggagcacgagguacgacugcccuccggacaacggauuaaggauuaaagagguaccgcgcagacugagaaacagugggacaguccaccgacacuucacucgagugucgaguacggacgucgggagguaagccuaggcauucaauuguugucccauuaaccauggggcauuuagugaagagauaaaggguucucuuaaggagagagggauaagaguuuuuuuaaaaaaggggaauuuaauaaaauauuuuuguuuuguggacaagagauguccauggcugguauuaaaugguucugaaacuuagaauaaaguaggcaaagaaaucaauaguuuaauaaaacaaggagaagauguccaugaguccuuuuuuaguuauuggggaaucaucagagaucuccuugagcaggcagaaaagggcggaaaaggugcucgccucuuugcccuuacugaagauuuuuuagaaaacucccaaucgccaucucgcaaaagcaagacuaagccgccugcgcacaguaucucuauuagaagguuuagcagaaggcuacuugguacccaauaaauaaaauaaaguuauucagucuguccucacuagaggccaauauuuaacuugaaagucagaguuuguggaagacagccuccuggacugcugacaaaaucuguuguuaaggcaauuucgcugcagacauaaaacaauuagggcucuccccugguguccucgcccagaccgcacaagcggcccugagagcuuggcgcgcugucccugcuacaggggcacuaacuaugccccuaaccaagauuauacaagggccccaagaguccuaugcgcaguucguugccagauugcaggaagcagcugagaaaauuuugggaccugagggucuguuaguccgacaacuugcucuugaaaacgccaauucagcauguagggcugcucugagagguaaaaccaagaguuuagauauaaaugguaugaucaagcuuuguaaugagguagauguguuuucucaacaaguuucuaagucuauuaaccuggccauuggggcugcucuaacuccagcuccaagauuggugucaagccccauuggcccaaguuaaaaguagacaucuguguccucacauuggguauagaugccgccuggggcaccccugauuauuauaugccucaauuaacagcgguuaacacaggugaauuugggcccccuccucaaaagacguuuuuucucaucaucggccgaguguccagacuuuuacaaggccuaauggugacuccuacagggguugacaccgacuaccauggggagauaaaaaucuuagucaccgccacgcaggaaccacuuacccuuagggcuagagagcgcauagcccaagccuuaccacucccacuauucggccauuucccuuaugaaagaggagcgaggaccuuccucccugggauccucggaagucuacugggcacagaaaauaaccgauucauggcccaugccgacuuuguuucuagaggacaaacaguucaaagggcuccuagauaccagggcagaugugacaguaauucccucaacacauuggccugcagccuggcccuuacagcccacuaagggaugguguaauccacugaucauaaaauuuacugcuaagaggaggaacuuagaggcuugagaaaguucucgcucucucaccuggggccuaagauuguaucaagauaacuaugacaauggccugaccuuuaaaaccaucccuaacaaucauaaaggauccauaggacuuccaggcacccgccccccuguuccugccccagggugugcuacgacccuguuucagcccacucucccugcggggaggccccccucuuccacugauuuacuguggucuauauugaaugcuucugcuuuagccuuguugcauaagacacaaagagauaaugcgucagaaucugaagauuguuggaugugcuuuucugcuucccugcacuuuuaugagggcauagccuuauuugaaaauuuuacccugcuuucagacgcuaggcagcuuccccuugagucaguucagcuuaccuugacagaacucucugggguaagaaguuguguguugggcccaggcaugcuucgaggcccuugcuagagauuugcaauaacacauuuauaguaaauaaaaauggguuuuaaagagacuucguaaaggucaaaaaauucauagauuagguuuuauuggaaguuaagaaaucauuuccuaaaacacauauaauucauuuugucaaugguguuuuuguugguugcagaaaauagagagcguuuuuacagauggcuauaaaauauuuaacuaaguguggacugauaauggcuucaaaaaagauuuagcaugguaaacuuuuaggcuauuugagacauuuaguguauagagauuguguguuuucucaaaaauuugcccucagauuaaauaaauuaaaaguuuuagaugcuugccagaaacuguuagaaaauuuuggauuuuaaucuugguuugacaagcuaccucuucuuacaagcaggaaaggaaagaaaggaauaaaagaaaauggauuuuagaacucucccaggcacagagagaaauugggggacgcccuguuuuauucucucuggccccuacaggagaagcucucuacccucuuucuauugucugguuggugcaccaaucacgugucaauucauguauguuuucuguuuuguugucugaaugacuguuucguugucugaaugacuggcuguuuuauguuucauguuaaaaagaaaagaaaaaaaaaugguuaaaacuuuaccugcugaaucacucucaguuugcacaacugaggcugagaggcccuucccuuuagccaaaaucaagcacagcaggagagguccugcugaaaaacuuagaaucuacaaccucuuaguucuaaggcaaauaagcugauaguuguuuuuuccuaaaaaaaauucucugcaauuuugugauuauuguguuuagcaaaugacaaagugugucuuuaucuuauaaguauagcuauaaaaaguaaaagucuuuaauugaucuaaauuuauaagauucgugaagccacuucauuugguuuuugauuggucuuaaagguauaaauaugaucuacauaucuuggucauagagaacuggcuuauaaguuauuuggguaugauuaaaaagguauaacacugguuacaaaguuagcuuaaguaauaacuuaaggcuagagucauuuucaaacaaaagcaccuggcauaaaacagcccagaaaacuaguccucuaaagauacuucuaaauugagauaaaauuuuguguaauucuuauccuaaaaaauagacuuauagagauaagauuuuaaaacaaugucucuuuaauaaaacauuaaaauucacacugucaugcauucaggaaugagcagccaaacuucguaacgugauagugauguuucuaguauugauuuuaaagaaaauaaauuguuuaaaauugggucuugcuuuccaaaaguuauagauacauucuaauauuacaacgaaaacuuaaaaauuaugguuaaaauugcuaguguuccauugacugcagcuugcaguuugauuacaaauuuaagaucuuuaauucaccuguauauuguaauuaagauaauuauaagaguaaucauccuuaagaaagaguaucaaaaauuagaggcauagacaguuaaauuguuccucuaaaacugguccuuauuacaggagggccaagaugcucagauuaaaaaauauucuacguuuaaguuaauguagcccagagaagauuguggccuucuuuuauuuugcaaacagugccuaagaaaguuuuucccuguguucaaaaaaaguucuuuuuagcuuuguuacagaucuauucagauguuuaaaauaaugcuuaaauucaaagaguuuuacuuuuagugaacuggugaucacuagauaauuuugccuguagguauggcuaacauagcuuuacaauauguauaaaauuuuuauugucugcuucaauacaagaaacaaaguuuaaaucuuucaguguauauuguuuccuaagugaaaaaaaaaaaguauucuauuagcuaaugccuccaaagagaaguuuaaaguucuaaaaaguaaucguugcuccauaagauuuagaggcaacauauuuuuaauauuuaggauuuuaguuacagaaaaucuaaaaaagaaauuuauuugcuucaaaauuuuuauuuucaaaaccuccaaaagauguuuugucaacaauuuaauguuacacauguuacugagauauuuuauaauucucaaagacaagguauuguaaaacuuuaaaaacuauaccuucuuuaaaaacaaagaagggggagagaaauuauauccccgugcacauuauuuggaucacauauuuguuuuggaaaaacuggauagaauagugucuagggcagauaaaaaggauccacuuauuggcacuugccaugauccuguucagauacuuaauauggggaaaagggggaauguuucuguuuuuuccacagaaugcuacaagagcaugcuagcuuccaaugugacaggcugaccugugaccugugagugccugacaguggugaccaaaaagcugugcugagugcacaaaagaggagaaaucggagaacauccacuuacaaacagauaaagaaacuucguaucuccaccaugcgcugcagcaaggaguaccaaccuggugccaacuuaaaauaaaaacaacuaaaaaagcugacucgugaggcaaaaagacugguacagagaauguacaagaugcuuucgucagagagacacuguuuuuggccacucaggccagcuccuuauagcuaugaaaguuuguguaccuuaccuauaugcuuauuguuagauaauuuuaagaguuaagauugccaaucuuggcaagucuuuuuauauucauuguaauucuugucaauuaacuaauuguguagauccuaauuuagauaaggaaucuacuguuauguuuuuguuagagaccugcuuaugcuuugcugcccauuagaguuagaaaaugauccuugguuuuaaaaaucugaaaaugcaaacuuuaaaagguaucuaccacagcuuuagaucagcagcuacauacugcccauuuuguuaaugauaagcauagggauauuuccauagcuuugucagagcaacauauuauauagauaaaaauuuagaggcaaaagaugucuuaaaguaguaguuuuaguaagaagacaggauauaacauacauuaaggcuagaaagguagaaauuuuagacauagccaagccuugaccgguguuccacuguccuagaaaguccuugagcagaccauggguuuagaauucaggaagaaaguugacaauucagugacauucagaauugccucuggcauuacacuaucacuuuaauaaaagcuaggucauugccuuacacaggaacuuaccaucaacuaggaaaaaggaaguuuaagaccuaaagaggaaccagaguagauacuuagaacuguagauagcugaguuacacccauacacaaguauuuacaauggccuagagggaagguagacuaccaaaacugguuuuucaaccucccccuggcuuucgaccuuguugcccucccuuuugggaccccuauuggaauuccuauuauugaucuccuucgguccuugggcauuucagaaauugaccugauuuguuaaaucucaaguugauucaucucuuucaagcgcauuuguuucaguucauuaccauuggcuagacguuggugauaacaagcagguuacuggagaagaggcagauggugauaacaagcagguuacuggagaagaggcagacgaggauaccgcuucaucacccucuucucggggagagagacucaauuuccauaaaaugcuuaaguaagaucauucaccucccccuaaauucggccaucagucucaugccacaaaucauuuauagauugccguagucugugcuuuuccgacaugguaauauacguucucgccacauuggaaacuaaacagucaucccaggcuagacacaucaaaaaauuaaaacuuaaagccgucgcccgugagaguuguaagacuaaguacugcacagagauuagucuagaagcuguuggacagucucugagaggcaugucugauugcauaaagguugagugccccagggaccuuuccccagaaaaaaacggcacaggagcaggucaggguuacucuggguaaagaucugugggccugagagucaauccuguacauggccccuaacauuacacacuggggaucagaccucuaccucuacccacggagcuugcuucauuccuaauucccuuggcuagcccaaguuauauccaaaagacuggaaccauuaauucaagccuuauagaugacuuguccuuguguccuuccugguuuuagagaaucauccggugagcaaacagacguuuaggugaucuuuaaaaacguggcuacaaauuuauuauacaauaugccuuuauaaaaauauuaaaacgggggagauguugggagccauuaaggcaacgcuauuguccugaucucugaauugggccucuccccccaagaagaaaagagggucaaaagcgggccaccgacacauggauuccgagaaccaugggagguuccagcccuaggucaucacugauguccugaccacacccugauaccaccaaguuccugcuuccccguguaacugccuaagaaugugcaauucuauugccccccucccacugauaauuacuuccccuuuugcuuguauugcccuaccccucccacugauaaguaucuguacuucccccuuugcuugugcauuuaaaccuuggaccuuucucaauacauuggggucuugauacaacuucaaaaaaaaaaaaaaaaaaaa

SEQ ID NO: 7712 - RNA, 46296 nt, Mus musculus
aggguccagcaaggaagcauuuauuuggcgcagcgcucccagcgcccgcagcuggcuggagccgguggugacaucacgagcccgggcaggccacgugacccacggcuucuccuccccccugccuccuagcgucgccgcggucuucgagcccagugucccgucgcagcggccacucggagcucucgguacagugcagagccaagggucgggcgagcgguccgagggucggggcggccaaggagaggggcaggagcagcggacccaagacgaagcgagcgacgcucucacaaacuuccacgagcgccggagcuaugaagauggucgcucccuggacucgguucuacucccacagcugcuguuugugcugccauguccgcaccggcaccauccugcugggcgucugguaccuggugagcgcgcccuggcgucgagggagcccccgggguccccacgcgcgccgcucaccccgcgccacuaagucgcuucuaggucggcgucggucugggggccgcccgcgaucauccgccuaaaguuguauuauuagaaaguuaauucucggggagagccgggcugcaguggcgggggcauguggggccgggcggggggggguggggcaccgggcccugcgaggugcgggccgggcauguucacccccgggacgcaccacggcuacacagcguucgcccucgcgaguucgcguccgagcagaaacgguugggaaauucuuguuccucucgagaggauuuuccugcguacgccuguuuaaagcucuuacacagggaagguacccaagugugccuguguuccaguuggcuuggagaagccaucuuaacaaccacucagguuccugcccgaggacaggugaucccucugaauaggcacggcgggcaaauuuaguuuucuuuaaaaauggccuucagguuggcgcucacauuugugucaagaacaaacaugugauucucuggggcagcgaguuagcuugauggauucuugcccuguggcgcuggcugcccuugguuggugguuggcagccuuggacugagucggauuccucaauauuuuggauuuugugacaucauuuuagagagauccgagcuacuugcugcagaacaacgaaauguaguugaaagugguaguuaaguggcauauaaaacuuuuuaguuagaacauauucuuagcucccuuugauaguuuaaaaagauauucaguauugaauuguaaacugccuugugccauuuuaaacaaugcauuccccuuccacgugauguuacaguucuauuuauagucucaaguuuucuuuaguuggguccauuauggccgcauaauagaauuuuuuagucuuaaaagcuuuccaacagaccuuugguauauguggguucuggcuguucagugugaaugcaaauugaacauuaauguauuggcucagcccugacuuuucuuaaagccaaggaauuuacaggaauuuaaaaccauaguuggaguguggaaaguggccucaggaagugcuuuuaucgauggccagucagggcagaaggugggcugcaaaugucuguguccuccuuggaaguguucagaucugcaggcuugcaagggcuucaguggaugcaguugguaaaaucuagggcauugcauuaggcaaauguacuacaugaucuacgggagauauaaaucuacuuuagucuuguuggcagucauccaaccaugcuguauuggugugucaaaagcagacuucccccuccguaggcuuccuuuccuguaagagccugcccuuugugaggcauacgcuuccaaggagaccagaaaagcuuagguacucaccacaucuauauagaaaucuuuucuauuccuauugaaaauuucuuguucacuaguugaguucccuuauaguuuuaaauacaaaucuguuaucuaagaccuuaauuuccauuuaaaaaggucaacauggugagggccuaaggccuaaggaaaaaugagguaccuaccuaccucuccuuccuacaagcaccccccccccaucuucucacccugucucaccugccacguggucauguauaaaaagaguuuucaguguagacugagccccaacacagcguacuacaugaucuacgggagagaaauacuugagcccuguaguugucagguauccaaccaugcuauauuggugugucaaaagcagaccgcuccaaaugaaaauuuuguguuucguaucccugcuuacugacuagggcuuacuaguauuacccuuuuacuaacuaacuagguccugcaugcuauguacuguguucaguaagcuaaauuuaauuuucuagggaugaaauuagaggcuaagagcuugugguuuauuuacaguccuugguuacagcucaugugauaauccguauuucuuuaagccuuuaaaaaguuguuguuuugccuugacuaucaaagguuuucaggaauaaaacauugauuuggcuacuagaguuuucccucuaauaaauuccauucacauaugugagauccacuuguuacuuguacaguucauugacaaugacaccaacguuacuaauccauaucccuaagaaggucugaaaccucacaggauuuucucugucucuuccugguccuagucaguguguugggguaggggcguaggccacucuacagacagggucuuauggugugcaccugaguucucuucuuguuccuuucauuuagaaggcaugauuuuuuacuuuccuaguguuggaaucuguaauuggcuuauguuugacugcuuaacauaucuuagucugugaauagaccacaucuuuguugugcauggagcuguuuuaguuuggggcuauuauauguauauucaacucuucugaacauucuuaagcaauguugcuagacauacguuuguauuuccauuggguggagcuguugcucauugggugagguauguuuggcuuacccagugcuagccaguuuuccaaucugguuaguucuaccaguuuguuuuauuuacuacuaguguaugaagugcugauggucucaugggccacgguguuuggugcugucagucuuagauuuuagcauuccaaguggcauguagugcuacacugcuuuaauuugcaggucccucaugaagagugauguggaagaguuugacuuuguuuaugaaucaauugcaugucauauaauuuuuauugggcugucucauuaauuuguagaaacuauuuauguacuuagauaccaauuuuuuuuguuaaauauguacaugugacuauaaugucccagacuguaccuuguacaaggucuuucuauguagucacagcuguccuggaacuugcuuuguagaccaggcuggccucaaacucacaagagauuugcugugugccucuagugcugaugagauuaaagacuaugugcagccuguaugcucccucccucccucccucccucccuguucccucccucccuccuuccucccuccuuccuucccuccuuccucccuccuuccuucccuccuuccucccucccuuccuucccuccuucccuuuuucccuuuuuuuccuuccuuccuuccuuccuuccuuccuuccuuccuuccuuccuuccuuccuuccagacaggauuuuuuuguguagcagcccuggcuguccugaaacucacuuuuuagacuaggcuggacucauaacucagauucacucaccuuugccucuaaagugcugggauuaaauguguguaccaccaugccaggccucauuuucuuaaugagacauuuuggugauuaggagcucaaaaguucaauuugugaagcuuuuucuuuaaaaguuaauacuuucuguauccuaugaaaucaaaggguauaaagauuuuuuuuccccuugaagcucugugguuuuagcuuuucugugagauaggagcugacauccauuuuuuuuuuuuucaaaaagacccuuuaagcugaguaugggagcacaugccugugcucuuggcacucaggagacugaaucaggaggauagcugugaguuuacaauagccuauuaaaauuaaaaccucgagaaagagagaaauguguaguugauugacugcuguguguucuggaauuuucucucucuccauuacaguagaauaauugguccccuguauucaaggguuuggggauguaucuguaauaaauguaugcaauccaucauuaauuaaauaauacaguauaauuaugugucauuuuacauaguauuauuaguuauaaguaagcgaaacaugaguucuaaaagaagauaugcuagguucuaggcaaauguugagccauuguauguaagucuuaagcaucgaaggguucugcuacacuccccacugcccagguuuucccauacucgaauaucaggccauccauuuagacuuuccagcucaaugccucugauuuuacuuuaaaaaaaauuauguguaugaauguccaucagcguguguguaugugcauacaguucucagaggucgaaagagggucacaguuacagguccucuggcacuuggauagcugugaucuaugguggguccggggaaccaaauccuaguuuuuuccaagagcacuaaguguuuuuaaguguugagccaucuuuccaguccugucuacuucugacaccuuaaucucuuuauuacagcucugcaucuuguugacuuuucuguuugggucucuugcccaucauuucucuuucugagaaugcucugauuagcucucacuuuacuacugaaauaugacugaucugucuuaaacauuuagcaucucuucacccccuucucuuccagauauccuucuuaaaaagacuuuuuuuauuuauguguguuuaucugugccaugugugcagaaaucccuggaagccagaagagagucccugaagcuagaaauauaggcuguugugagcucccagugugggugcugaggaccugcucagauccauccacuggaagagcaggaagucgucgcuuccgcccuggauguacuuguuuguuuguuuguuuguuuuuaaaagauuuauuuuauguaauugaguacacuguagcugucuucagacacaccagaagagggcauuggaucccauuaaagaugguugugagucacuaugugguugcugggacuugaacucaggaccucuggaagagcagccagugcucuuagccacugagccaucucuccagccccccugaauacacuuuuaaauacaaauggcuaugacaguugcacgcuguccuuuuuuuuuuuuuuucaucuagaauauauucacuggguagguggcagugaucagcuuacaggcugugaaaggucaggauaguuggacuuacuagccuugccagcugggucaagccugaugcauuuggcuuuugccuaugaaauuggcaucccuuuuagcaggcuuuccugucccccuuuuaacuuuauuuuucuuucauuguauuuauuaguauuauuguuguuguuaauuuguuuuuuguuuguuuguuuuuguuuuuuguuuugagacaggguuucucuggguaaccuuggcuguccugucuugcacuauacaucaggcuggccuugaacuaggagauuugucugccucugccuccugaguacugggaucaaacaggcauggcuacauccagcuauccugguccgcaaaagcaacccugcuugauagguggcaguguagucauuuaagauuaacaguuucuugcuagcugccagauuauaugacugccaguaaauccagagccauguaugggguugacucuugguacugauaguccuuacugucuacuguucugccacacacuccggucggucgagucagcuugacaggccgagaggccuggaagccauucacgaggcagagaguuucacggaaacucaccuccuggagucuggcguucucuuuaacccauauacucauacccuauucccgaguuagucugguguauggaucuacgugcucucuuuuaguauuaucuuauuauaagugccuuuuaagauugaauucugacauagcuaagcccaccugccccagagacccauuccagacagacaaaggggcccagagggucugcagcacuguucagccuguaaaagauugaaauauuaugcugaggagccaggauuuuuauucucuaggcagugggggaaccauuauaaagucacaaacaggagugauauuauauaggauuuuuuuuuuauuguuguuguuuuaagauagaaucucacgcuguauguguauagcccugacuggucuggaacucauuauaugguuuaggcuggcuuugaauuugugucagaugcuccuuccuccgucucccaagugcugagaguacagguaugggcuaccaugucuggcuagccagcuuuuagagaagauuaaaauggcaggguguuucagagggcuacaaaucaggucaggcuguguuaacuuauagcuaugagacguagcagguucuuuucaggcagaucucauuugcugaugguguaaugcagguggaggauuuauguuaguuuuuucucuguugcuguguagccucuaacuaucugauuugaaucaguuuggauacagccuccucuagcugcugcuccucucuuaaaaaaucaaaggcaggggcuggugagauggcucaguggguaagagcacccgacugcucuuccaaagguccgaaguucaaaucccagcaaccacaugguggcucacaaccauccguaaugagaucugacucccucuucuggagggucugaagacagcuacaguguacuuacauguaauaaauaaauaaauaaaaaaaaaaaaaaaaucaaaggcaguucuguauaaugcaagcugguagaguuguuuaaugaauaucuaugaaaccuaguuaguccccauuaugaauaguuuccuaaugguaaccaguuguuagaauuuuuuaaaagauuuauuguauguguauuuuaugugcaugcaugucugagcaccaccugaaugucuguugcccacagaggccagguguuugguccucuggaacuggaauuguagauuguugugagcugcugggaauugaacccaggcccucuacaagcguagcuagugcuuuuaacugcuaagccauuucuccagccccuguaaggauguuuugaagacaagcuagacaaaaacaaaagguugcuuuuaaagcuguuuguuaauagcaaauuuccaugaccccuuuaagcauaucuaacagaauacuagguauuaacuugauuaaaguggguuuuacauugcaaaguauauuauguugaaaaccaaaacaaaauccuuauaauuugcuuugucaacuuugaaucuucgucauguaggagaaagaggccagaauucucccuuuuccaucugcccgcccccuuucgggcagccuuuuuaaauguuuucucucucccucucucccucucucccucucucccccucuccucugauucugccucuguccuccagaugguuagauggcaggcaugcaucaccacgcccacugggggcaggcaugcaucaccacgcccacugggcaccacuuuauuguuuguaagaguuggugcuggggauugauugaugccugaguccuagaagcuuaauucacucucuccuuuucuucuuccugaguccuuggcuuucuagaacucuuggaacuuuggaaacuguugaagagcagugaagucgcuauccccacucccacccucuaauacaggguuucuuucuagguguaguccugccuggaacucaucuguagaccaggcugaccuuaaacucugccugccucugccucccgagugcuaggauuaaaggcguggacugguucuuauuuuacuugaagaaaaugccccauccccccccacccccaccccaccccaccacacacagaagcuuuagggcaacacugucuccuuccacucaggugggcuuggcaacaagugccucucugcugaaucugcuuguugccugccccuuguuugucaacccuucgacucugcuugugagcauagaaucaguguuucauucuguaaaauagaguauuacagugagccaaggcugguuuccuaaaaaaaaaaaaagcugcagaagauaaaaacaacuuaaaaaaaggucauuucaaaguuaaccccucuucuaggauuagggcugggagacagaacaacgggaaaaucacuugucagcuuugggguacuuuucuguuuagggauuaagggagagggagcuucauugucauggcaauugaagccaacuguucugggaauuuauuguucccucucagaaagucucuuaaacagucucucucucucucucucucucucuguuuuuguuuuuuugagacaggauuucucuguguagcccuggcuguccuggaacucacucuguagaccaggcugggcucgaacucagaaauacaccugucucugccucccgagugcugggauuacaggugugcgccaccacugcccggcuuaaacagucucuuaaauagcccauuucaguugggugaagugagcuucagcaccagggacuccaucuugguuuuuaaccugaucuguuggggcccaggcaauaacuugcuauagauuuuauuuaauagugugaauauaguuuuaaauuguuagcaaaaacacaguugaauuuuuaaaacuuuuggcccccaagauggcauggccagcugcguccacagugcagguuuggagaagcauugccuuuggacauagggucuguauuuguagggugaucacuauggagggcuugguacuggcaaaaauggaggugcuauggauaggaaaggaaggcacagcuuuggguccacaucuauccuuggcucuggcagucuuaagaagccaggcuuggccaucagugugccaguuaaagagaaaguggagaaaagggauuuauucacuaugugaagagacugguuucagacaucccaggacugaguucucaguacaaaggagacuuacuggcuccagaggaacaaagggcagggaauaaaccaagacaggcuauagaggacaagggagaagaggaaaggaagaaggaagagagggacagaggacaccuggauagauuggagaaagaugccaccaacaggcaaauagcaguuuauaaagcuuucucuguauagccuuggcuguucuggaacucuguagaucaggcuagccuugaacucagaggcuccuaagugcugagagaaaagaugugcuauguuccccacccccacccgccaccaaaugaguuuauuuucaguuugggcuguaacugggaaagggaaauacccucacuccaugcugccauuugugauauuauaguuuauagaaaagacaaaacaaaagccagcaagugguguguggccuucuuacugaaacucagacuuggggcucuugcugcaagccauauuuguucccagcacaguguuuaugggcgggauccccauacucaggucacaauuagccuuccuacuaaugagagcccucggccuuucuggagauagcaucuuaucugugcccugaaauuggaugccagauuucaccccuggugaacuuaugcaauaugaaaccagcgcaccacuguaucaguacaguggaauagaacugucacugacaugaagucuguccuuagccuauguacuccuuuccuggagagaauacuaacuaucaugguagaguucaguuccuaaccacucuauaucaggacugccuggggaaucuaauuuacuagaguuugcagaucucuaggacuaaaggaacagcucuccaucccaggauguuaugaaauuuaauggggcaaggagguaccuuuggagacccaggccaagguguguccuugagaaguuaugacaucccugguauaaaagaggcuuacuggggaagggacagaggagcaggggugggcaugcagaaaggcagagccaugaggacagagaaaagggcggggaagagagagagagagagagagagagagagagagagagagagagagagagagagagugagagagagcgcuagggagaggcauacacacaaagacaaugagacaaggagagaaaacaaaugcuggaacagagagggggcucggguggcaggguucucuaagcuggcuucagauaccugguagaggacacagaggacauaggucccugaggguagaucaguggaaucuguauacuaacagagaguaauagaugaguuugccuccuaugugguccuuuguaaggucucuguuuuguuucucuuacucuuuggguagucugucuuauuucuguguuugguaagaagguggagaacaucucaguccuguuuuuccuuuguaaggaagaagagccuccucugguauagguaaagcugcugccaucuuguucuucugcuuuuuggaguuguggggugggaccaccauccuaaccugaggucuagagaagccccuuuguuuaccuuuguuguguuuuauaaaaacagagaagaaauauguuuggaggugcgguacgguaaggugugggagaaggggugcguuugcgggcacauucugagauaucccuuuccccugagggaccagccacaugacaguauaauauagaguauagaguuuauucagggcauggagagggagguugagggaguagagauagagaaaggcagagagagggagaggaagaaagagagaagaggaauagaggccagccaugcacacauugagagagaggaagggaagagaaggggaacaggagccuagaagacagagcuagagcaagagagagaagaggggcaagcagccucuuuuauagugagucaggcacaccugacuguuaccagguaacugugggguggagccuagacuaaaugcuaacaaccuuggugugugguuggggacagcucacuaucaucauauuuggcucugaccagcugcaaggugggacgugagggcagaggaaauuugggggacaugagaaggaaaaaagcccuuuaucuugguuccaguuaaagccucauggccacagagaagcaggaauuucaguaccuauccagaggcugaagguguuucuguggaaacccaguuuauaagaaauuuuguauaugaaucucugugcagcucugugguuccuaguucaggauccucucaaauucugauuacauccaggacauuucuacuuaucaaggagaaaaggggaggaaaaagguuuucuagcaaccuuuugagauguaacccgaguguaaccaagacuggcucuuaaaaccucuucuuaauaagcaucaacucugcuugauacuggcucaccaugaaauucuuuucuguugggaagucaagaaucccaacuugacccaaggaguuuguagaaaaacuccucauauuucuccaaccaucuaccuggagcuguguccccagguuaccaaccccaucuccaggggaauucuuauuucuaaguuucuuagggucacccuguauaaagguuugcucagaaauugaaacauuccauccugcagggaagcccuuaaaagaggaagauaaacaacugaacugagaacagcuucaggaucccugaaacuuagcagauucacuaggccccucacuaccauuguaugcaauaaaggcagaguugcuuucagagcaguuaacgggaggagcuguaaagaagacugacucucaagacaagcugagaugugaagacuccaagaccucagcugccuagaacacgcaggaacaggcucugcugagcucccuggaagaaguuuagacuagucgcuuggaaaguauauucucaggccuguugagcaccugcaggcugugcagugugucccacguuucccacuuuugugaguugucacuuaugcuggggugggccuuggugaugcagcuauuaucuuuugagucauuucugcuccuuuaaguaaccucaauaaaacuccugguugaccaaguuggucuuugguguuaucuauacuuuggucuguuguaaguaaggcucccuauguguggugaguagaccugugugcuguuacacugcuuuuguuacccaacauaauugaugggcacuuacuagaacucaauaugaguuggggaggagugagcgaauuggggaggauccugacuauggguagcaaggcugaggccugaguuggggacaucggcagaggaaauucugauaguguccucugcuguauaguggguguuagugugccuuugugguaugauguggcaugauguggcugcaugauucuugcuaugaauagugagacacacagcuaagguaagcuaucaggauuaggaguaucaauaggaggaauucuaagauggcagucuucaacuguguguuguggggcgaugugccugauugagagugaugcccacuacauggauacaaacaccccaacaacacuuaaaaguugagagaaaaauuuucagccuuugagauucagugcgcgaugaucggcucuuggcaagcaacaguguaggcugcuuagccagugcuguguguaguuagaaaggcaucugaggcugagaugguggccaggcaggaacuugguuuauguaaaggggcaguugcaacaagaaaggcaugugcuacucaaauccuccuccguguuagccucugauuugacaaguaaauuagguaagagaaagacagagagaugguaaaaaugaucaacgauacuucucaagucuaaccuuuaauacaaaaagagagaaaaaucuguaacuuagcaugcaacaagaaaguauaaugaucaggaaugcugggauugagaaacaccuuuaaacaaguaguaagugagccugucucugcuuugugagacugagggacaggggagcagaugggauuagucugacucuuuggagguagaaaacccgcagaauucgguuacauucguaacuucuaauccuuacuuaagggagagcauaaacggacacgaagauaagccagugccugguagguuaacauaucagagccauuaggaacauuuggcuaucuccaucugagguucccacaaauagcagcggcuggaggaccauaaagguggagaaacaugcucuugagggaacuaggaauacgagaagcagucuuugaaccccaguucacugauacaaccguguucacagagggguuaaaggaaaggcugauccagcaggaccuugagguagauauagagcuucagcaguuuugcugaguccaucaguggggcacgauaggaaaggcuuuggcagaucuaagugacuuagaccggcaugugaagagaguccagaaaguaagagagcaaccuaggggaagaacgacaaagaggaagaaguuggucuccgauacuguggagacaaaugugccaagauuuguaccgagcuggaauugcuaagggauaaccuguuagaaagccaccaaacugcugaggagcugcuggggggcuuuuaagcuggagccagaagguaucucuaauagaggugucagaggugcacgugaucaggccuggcccagggguaguaacuauggcccagauugacuaaggaggguacauugcucucuagccaaagguugugcucucgggguggagaugguuugcccagucaaguugugguagauugagagucaacaaugauggcuacagccacaaugucaacucagggccacucugauccagggacccagcaggugcugccagggagaacaggguuucaggcuaaguaggucugagcacauugacagguaggaaggcuccauggaagagcuccaggcugugaaaauggcucagagagaaggauuaggauuauaaaaacccaguuaaagccuccuguucaggcuuucuacccagccuuggucugcggaccaaggaagcaauugauacaagcagaugcgaccuuuccuguuggauucaacccugccucacacccagacuuuguuuauguuucacuuuagugucugagccucuggggucaccugguacuugcuccgaauacaugacagcagacguucagggcgcuucaccaagguuaucuuuguaacuccaccuuuuguuuugggaugaugauuuggaauguugccuuguccugcccauccuuaaaaaugguuuuguuauguagugacauauauauauauauauagauacauauacauacauauauauguauauguaucuaucuauacauauauauauauauguauguauguauguauguauguauaaaaccugugaguguugcagauuuggaaaggcccuggaaagacaacuagguacaaugguacuuccacuugucuacaaccaaaguggcuggguaaauugaaaggaaaaaaaaucucaaguuucccuauauggguagaaaagggcacucccagaggacauaauccaaugauuauuaaugaagauccaaugcuaggguuguucuaccuccugugaguuguuagccagggaagccccugagacccccccaaaauguaaaggcuauugcuacugcuguugguuguaugccagaacuaguuagucagaucccauugcugaagauacugaguaugcaggaugagacugcaggacaugaaggaguuaagcugggacugaacgaccaucuugcuggguggcuuucauagugccaguuggggcuauauagggugcuaguagagaacugucagcaacauucuuguuuggcuguggacccuacaugcaaaauaccaacauugcagccagggugugcuuguuugugcaguagcugcuucacagccuuuccauuugauuuaaggccuguucuacaagacaggguuuauaucugguauuguaagccagagcaaaaaccugugacuggggaggucauaggucucaauggggaagcaacuuuuaugguuuuagcugucuucagacacacuagaggaaggcaucggaucccauuacacaugguugugagccaccaugugguugcuggaaauugaacucaggaccucuggaugaggagucauugcucuuaacuacugaaccaucuuuccagcugcuuauggauaugauauacccguggcacugccuucuaaaugugugucugcacucguaguucccuguuagcagccucaacucacugcuccugagaacaaguggccaacuguuguggcgcaguguccugauucuuagccuugguucuacuguauauccgaaacuaguccuuuuuuauagagcuccuccugccuuagccuccuaagagugaacuauugaggccuacuuauucugggcuuuguucucccugcuacaugucccagccugucaauacuagguauuuuuaaaauugcagaucuuaggucccuauugcucagccuugacuagauucuaggccagcccugccucgucacauccauagaaucaaaguuacaugauacaaguaugacuacuuucuuccuuccaaagcauagaucucauaaguagacugugucagguguuauuuauuccuuucuuggggacuggggugggaggcauccauugcuuuugcccacugccuaauauauuuuuaaaaacacauuucuuacuugcaaauaauauuuuuauuacaugcauggguauuuugccuguguauaacucuguguacuccgugcaugccuggugccuggagaggguguuggauucccuggaccuguccauuauauuucuuguuaauuauguggucuuggccuuuuuuuuuuuuuaaggcaugcaccaccucauccauuuugacuccugcauuuuaaguguauauaaagauagcgcaaccuaaaagugaugaccagagccaaccaaguccauucagagaaaucgguugaaaucgguugggauuguuacuacugccuuugcauauuggcuuuauuagucuugcacugagcgacugccaaugccuuuaccucuggagcacugggaucaaaggccaggccagcaccgugcccugcuuuauugagggucuugagcugccagcuuaccaguuauguuguuuguuucuuuuguuuuguuuuguuuuuugguuuuuuuuuuuuaguggcauaggagaaaguuuauuguggauaaaacagaggaauagucagaggcaggggcaucugggagaguccagaguggacacgcuccugaguucugugagaacagagugaggaggggaaccaggugcaagagccaggaggcccaaagauagauaagcugcugacacuccgugguggggcuuuaggugcaagcuacaagucugaaagcauuuuggguaucuggagaaaguaccagggccuaacacacuacuuacguaauugacuaagaacaaggaaaaguguguugacagugcagaauuauugguacucaccucacugaaagacacagccugaacacaagcaagaaaaccccaaaagcaggggugugucugcugggucuuuugcauagaaacuagcuauggccuuuacacucguggcaagucgagguuggucagagcucaugaucuaaugagcuucugucuucucuuucaggaagacuuuacucaguauucccagggcuuuagcuuguauuuguccucuuccaucugaccauguuuguuaguugccgugacgacuguugccccaccucuuuguguugacccaaguccucauggacacuccuguauucauuccuuucguggugcuaaaguccuacccagcuguugaguaguaauacugaaaaggcaaggcagacugacuguucagaaaggucucagcucucagaaaagaagcaguccagggugagucaugugaagggagguggaaagaaccacaccuuccacaaaccuccugagagacugguucacugcuuauaucucagggaugugggccgccuggaaugcuguaaguccagggccaucguuagccccauaauagcugcuuauuaccugccucugcaugagaccucgcaucucugggacuauuagguaguuguuuggaauguaccaaucccaggcccccaccaaccaaaggcuaaggaugcuaucagcaucugagacuuguagcugagauuccgguuuaccgucuccaccuaccugauguuccaccagcaaaugugaaagaggaacauggaauuugggguaacuccagaauaaaauauuuuacuccuuugagauaagaguagugguuuuggggguuggagagauggcucagcaguuaagagcacuggcuguccucccagagguccugaguuaaauucccagcaaccacauggugacucacaaccaucucuagugaaaucuugggcccucuucuggcaugcaggcguacgugcagauucucauacauuaaauuaaaaaaaaaauaaaaacuuuuaaaacagugguuuuguuuuguuuuguuuuuugucuucuuguuguugguuuuguuguuguugacagucauuugauugugcaagaagcuuaccacuuuuuuuuuuuuaaagaauaacauucaggaggcaaguggaucuuugugaguuuuaggccagccagaacugcauaauaagaccuugucuuuaaaaaagaaaaaaaaauaaguuaaaaaaauucuguguauuugugguguguguauuauauguauauaugcaugcaugcauguauguauguauguauguauguauguaugucagaggacaaaucaggaaucagaucuuuccugccagggaucaaaucauuucaucaaauccugaugcaaguaccccucuaccugcugugucccucacuaaccccaacacugaucauuaucugaauuccugcacaaaguucagaggccaggacugacccugggauacagaggcccgagguucagguuugaugaauguccuuguaaagcaguaggcaauacuggggagagaggauaagucaaacuaauagaacugguaugaaacccacuagagggagaccaagaggggagagcagaaaugcauugcccagucagaaacaagggcaggcauggaugccaggccugaggaggacuagaagccagguggagaagggacagcaugauucccugagaugacgacauggaggaacuuguagcagcuaagaccuuagcaucuucccaaccaucguucuuggcagugacaagauaaccucaccaggcuggaaguugggcuugcuugcuuccccuacccucuugcccucaucuuugugucuugucucuaaggauucuggcucuauggugcucacccuacuucugccauuccuagcaccuaagaccacugcagauaacaugguguggcagucucacagagaugugagagugaaaguaacuagaaccuaaucuuuuugaccauccagagagggcuaaccuuaaaugagagacuccgaccaugucacaccccaaauuccaaucuuggccuucagguucucuaccauccugcaacugcccuccaucuuuaggcucucucacccuggugcuuggaauuacugugaggugacugcaguuugugcuccuucucugcuucccucccccaccucuccccccaccccccaguaccuauaacuuccuuagcaucacuuuugagacuggcccugagugugguccacgcauuuuaaccaaauauacguauuaguguuaucugcaagcgaaaucauacaaucaaaauaacuggagaaaguauggaauauggaagauacuguuaagcucuguaaaaagacagauguugcaggauuauuucaacucccuugaauacagauguaacugcaguuuuuaucuuuaaagcugcuguacucccgagcuuuggcaccaaaagacauuuuggaggcauuagccuauucuuggucuggcugccaucugucugucugucugucugucugucugucugucugucugucugucuuaccgccugccugccugccugccuaccuaucaaccaaccuaccuaaccuaucuaucugccuguuuauagggggguuucucuguguagcccuggcuggucuccucugccucuacggugcugggauuaaaggcugcgccaccaucgugccucauacucuuaauuggcucaauugaucauugguuaauggcuauuucuaacucuuggaucacuucacuugcucaugcuuggaguuccucucuuccaugcugcauacucucacagucuccuccauggugucaucaacuuccuucaaauggaguuugucggccacaccaucagagucuugugaauuaugauuuuuuuuuagagaaaaacaagaaauguugcaauuaauauuaauaugcaugucuggagacugacuagguuaucaauguguaccacguucuuuuguucguagcucagagaggaagaacaggcagaucucuaacguucaggccaugucacccugguuacauauagugaguuucugacucaaagcugcauagugauugccuagcuuuaauuuuuuuuuuucuuuuaaguuagggcugggaugaaggucaaggugaccagauguggugguuugugcucaguaauuuaagagcuucuagguggggauaguacauucaaggccaaccugggcuaugugagacccuuucuuaacuccccacaccauugaccucauacuuguauauauuuaaucaugcauguguauguauuccgugaauuaauuguucuugucaggcugcaucugacaauuuggaaaauagaggaaggaaaauaaaauccaagucauacaacaauucuaaaauaaucccuugagaugaucauauuaaaaaauucugcaguggguauuuacccaauagucuuccaaauaguaggacgugccuuuaaggccuuuucucuccauucugagaagaguaaaacaguacacgcauguuucugagcugggugggguguagggagaugagggagaagguaagcccagaugaugaaguuauacauaugagcagaagacaugaaggcuagguuuuugacuuaaguucccaagucaaaucuccccucuccagucugugauuuugagcaguguuuuugaguaguuuuccuacacuggggauuauuuugcauuccucuaauuagcuagagggcuuguaaggcucaggaauaaacauagcaagugcuuacuguggagccugaguagugucccguuuaaucacaaugugugguauacuccuaaaaacacacaggaagggauaaguagaggugggagccaugggcuacgaucaucucuacguggguaugcuggguuugaaggauacuguccucagcgaaagucagagacuaggggcagacggauggugauagugcuuuucauagccuguggcacacacacacacacacacacacacacacacacacacacacgcgcuagauugacuggcuaguacauauguuucauggacuugcccacuccccaugcuucauuucugcuucccaguacugugauuauagccacaugacaacugcgcuaacaaaaagaaaauuauuuguguguuaugugcauauguuuguguaggugcacauauaaagguacaacuuggaagagucgagucuccuuccaugugggauuugggggaggauugaacgcauugauaguaucagguuucaugacaggugcccuuuaccccuguugcugauccauccacccuguugcacuuuuuaagccgacucuggaggucugaccucaggucuucguacuuguccagcugagccgucuucccagccuagcugacgccuaguuggccagaggccucugcccgggagccuuugcgcacuuccucagcugcaggcaugcagcaccaugggugaucugagacucuggccugggugucuuaugucccuuuucucuucugcagaucaucaaugcugugguccugcugauccugcugagugcccuggcagaucccaaucaguaucacuuuucaggcucugaacuaggaggggaguuugaguucauggaugaugccaguaaguacguacaucagauaacagcuggugauauuuugggauuccuccggacaaggagucugaccgucugccuuuucugcuaaauuacaaauauugauucaagggccuauuugagcugcuauuuuaacuuuauuuucuuucuuuccaucauuacaaaucaagucagcaaauacuuaugugcugcccaugcccuguauucuuaaugagugucagauaguaacauuuccauaucuuaugugagcauccuuuucgcauucucaagaggcagagucauguauuauauuuaguucagguuugucacuguguaccaaaggaugaccuuggaccucuggacccuccugccuauacuucccaagugcucaguugaugggugggcuacucugccaagcuggaauuuauacauuuaaaaacuaucauuuucuaacagacuuuuugaggcuuaggcugaccuggaacuuuauauguagcaaaaaacuaaccuagaacucccgauccuucugucucugucuccagauguugggguuauauacauauacuacuaccacacccagcuuugccauggacuuuggcuuuuugcaguagagaaugaagaaauaucaggaaagaugaugaaaaggguuacacaucucuggguauucugauagcuccaggaguugccuuccuuccaggaagagauuguuacugguuagcugugguggagccuuuccuggcaauggaaucaggcaugaggcugagugucaauggauggccagcccagagauaccuguagugcaggccuugucuacucaguccugcugggucuuggcuaagugagaggcagagcuaaucaugaccacaaagggcagguugggcgaacugaugaucagcauugcagaacuuuauauggguuuaagaaaguguaggcagaggcagaaugauuuuggaagcuuggcucaaacugcaaagauugauuuuugaaaaauuacaaagaguugagaaagugguuaaguguuguggguuuugguguuguuuguuuguuugcuuuuugcuuuuuuuuuuaacuguguaugguuuuacuugcacauauaucuauguaucauaaauguauggaggacggaggaagaagauaucagauccccuggaacuagacuuacagaugguuaugagcugccuugugaguccuggaaagcaaacccaggucauuugguagaguggucagugcgcuuaauugcugaguuaccucuccugccccaagucuaguggauuuuguccucagagugaaacaaguaugcuuuaguaaaugugugaacugcuguaugcuguaaggauccccuuugcuauugacugaagaguugagugguuugcuguugaguggcuuggagcauagccugggauucuggucucagacauuuugcuguagugaagaggcacuggggauggaagagaggcugagugugaauagaaguugaugagagguuggucaaaguugucucauggccacauaggugagagaagcuggggaaagaauguggaaacacacuuaggaugaaacuagauuuugacuugaaacaugcaggcuccaaaggcagaagggcucgguccuaauggcugcuaccugaacuuacuaaucaccucugcugacuucagagucuccuuugagaaguggaggaagugauggaaucuaauacagauaugggugugaaaaggccuaggauggggacuguaguaacugcucaguuaagcccucacugacugguuauguagguagagcuguugugauugaagcauggaaauuaauguauauagagacauagaaaggggucagacccaacuccccaggauugaguuaacugcccuggguggggagagaggaggagagagagaaaggaggauggagugaauucuaaagggcucagaggucagucaagcugguaaugaaguaaaggaacacagagcuucauacccaucuucuacuauuuaauaccauuaagaauccaggguggggcuggaagauggcuuagcagugaguucaauucccagcacccacauuguggcucacaaccauuucuaaagggauccgaugcccucuucuggugugucugaagacagcuacaguguacucauauacauuaaauaaauaaauaaauaaacaaauaaauaaauaaauaaaucuuuaaaaacaaaaaaccaaaaaaaccaaaguccauggugccugugauccuagaaagagggaggcugaaacagaaggaucagaagucccagcugcucuggagccacauaacaaaguucaaagccagcuuugagcugugcaauauccuacuuccagaaaacagacauacaaagaaacaagaaacaaauagucggggcuaaaggcugagaccuugucagacacaaauggaauuucuuuauaguuccuaauuguucugcuuugauaugguuucacuguggagcccuggcuggccuggagcucacagagcucugcuuuucucuuucugccucuggaguacugggauugacuaaugugucuccaugcccagccugacgguaucugauuuaccuguaaagagaagcccugucugaaagagucaggggggugcggagcgggggagguuaggcgacgagagacgggaaaagacuaacuaaauagaggaaugauugaauaucauguggcuacaaagguaaaggagaauagguauucauuugaaucuuuuaaaaacuuguuucuuuuuuaaaauuuauuuauuuuuuauuuauaugaguacauuguagcugucuucagacacaccagaagagagcaucagaucccauaacagaugguugugagccaccaugugguugcugggaauugaacucaggaccucuagaagaguagucagugcucuuaaccacugagccaucuuuccagcccaacuuguuuccuuuuaauguuuauuuucuguauguugaucgccuuuuaaaaauaagcugcuaggucagcugggccuggaggcucaggucuguaauccuagcuauucggaaugcugaagcagaagacgguaagaucagagcuuucucaggcaacuaccuaacagggcaaggcugagaacaaagcucacuggaagaaugcuugccggaguauaggugaggcucugcuuuugguccucaguacuacaaagguggggugggaccauaaguuuguagguuaaaggucauuguaucagacaaguccuuaaguauuuaacccaggcauagauagaauuaaguaauuguugagauuugguucagucagcuacacaauuaugauugaagucuucaagucacuagugcuauuugguagggugagauggccagcuuaaagcacugcuucaaagcauuuguugcuugcugaggaauuggauuuguuuuucugcaauauucguaggagcuuauccccauaucuaacuucaguuuuagaggaguugaugcccucuucuggccuauguggguacaugaggucuuuuguacgcgcaguacacauauauacauacaugcaggcgaagcauccauaaacauaaacuuugcuuuuguuuuguuuuuuuucuguauacccuuggcuguccuggacuccaggaacuuuacucuguagaccaggcuggccucaaacucgcagagauccuccugccucugcuucuugagugcuggggucaaggguguuugccaccaucaccccauuuuuuuuaacuuuucuuuuuuaaacuuuaggauuuauuuauguguauaugagugcccuaucugaauguauaccugcaugccagaagagggcaucagaucacaguauauaugguuaugagccaucaugugguugcuggggauuaaacucaggacuuguagaagagcagacagugguguaacuguugagccaucuuucuagcucccccaccuccccuuuuaaagacuccuuuguguguacacacacacacacacacacacacacacacauacaacaaauauggcuguguguguguaugugugugugaucuuauguagccaacaauggccuugagcucaguguagccuaggauaaccuugaacuugugauuuuccugcuacagguauguacuaccaugcaaugcuuuaagcucucuggagagcaaacccugggccuugugcaugcuaggcgagaacuuuccccaccgagcucauguugcugucccugcgcgcuggcaucugccugacaggauuuuaccuugacaggcagagcacagauuuauuucuuugccaugugguacuuuuucucaggagaucugguagaugaucaaaauaggggauaaagaaaauaaaggcauuuucuuuacaucuagcuuuuagacauuucugcuaaagaaaucuauguauuucuguauauuuuuaauuuauaaauuuuucauaucaaaaaaccugaggaauggaauggaucagguggugauuaaaccauccaucccauccaucuggucucagccaugaauuaauuuauguaucuuuuaaaugacaucauucuguaguuggcacacucagcaucuugacuacauuuugauuaauuucuucagcuuuuugaagauaauuggguaaaugucuauuuucuaggaauaaccccucucacuaggcagcaccugacuucagucaggcagcccuguugccuuagguugaagggagucugggagaugguguuugcuggaacugaaguuaauaucuuccugaaggacagacaagugaccuuuggccuagggucuccacccccuaaccccaucccuauauugggcauucugguauuucuuccucagccaagggcagacagcaaaggagcccucuuaguaagugucagcuugauacaguagaguuauuugagaagugggucuuagcugaggguggcauuguuuccuggguaggugguccagggauguauaagaaagccaguuaaguauggauucaaguagagccaaaaagcaguuuauaguucaggcucuuguagaaauauaagcaguggcuuccuuugguaauggucuaugacauggaaaacaaaccuuuucuucccuaaacuugcuuugcucagagaauuuuaucacagcaauagaaaggcagcaaggauguuaaccacacaggucuccaugggcagagcacagcauggggaggguggauuuggagaggugaagaaaaagcauccgugguuauauucucccugaccaguccuguaccuggagcacaccucucuacuuugccuacaagagauacuaaaaauccuggugucacaguauaugccuguuauaaacguuugcugcaauccuugauagcuuugugcuccuaaguuugccagcagcugguuaggcacuagaauagcuccaguuucuaacauugccccauauggcuucacaucaaggcuucagugacaugccuuaugguuauugcugaucacauguuaauguuuuugaagucuaaauuacuuuuuaaaauauugucagauucagugcaagguaggacuuuugaccuuuucccacaucuguuaucuguuugucugccuguccaccugcucaccuuguuuguuuguuuguuuguuuguuuguuuguuuguuuguuuagaaugauggggcagaaguugaucccagggccaggaccauauagcacauacuagauaaacaugaucacagagcucuauagucccagccccuuugucuuuguuuuguuggaaacagguuguggguaagucaccuagacaggccucccacuggcagagaucguccugucugagccuccaaaguaguugggauuaacacucaucccauguuccuacagagcuucauguugaaaagauccaggccuaucagaaaaguugaguauacacuucuuaaugguguuugcaguuuccccuuugcuugcuugcuugcuugcuugcuuuuugcuuuauuucugagaauaacuucuauucuugucacccaggcugaccugaagcuuuggugaaccuucuaucuuagccuucaucauuuguuuacuuucuucauagauuugucacagugcucuaauuugccuguuguucaauuuggaaggagauuuauucaugauauagcauacauuuauggcauagauuugcuuuuuuaacuuuacuaugucaaagaaaauuauccagguacuuauuaaaggugugaaagacuuuaauucaagagggaaagaagagcuggcauagugguuuaggcuuggagucaggaccuggggaggcugagacaggagugugaguuucaggccaacuaggaaggacuaaagaguaagaccuuguuucaaauguaaaagugagcugggcucugacucaugugcucuguaguucacaugugugaaacagagcaucucuauuucaucucucugccuagguccagagagauggagguggauaccagggguugggagagcaaagaguggagagugaccauuauuggguauuggaaauugauuuuggaagaguggacuuauuuugcuuggugauggucauguagcuuuuuaaauauaauaaagccacuaguuuacacauaguaauggaaggcugaacuuuaugagauuugagauuucauuuuaaaauuguaagacaaacccaaauguuaugcauuuugauaaauucuuuaguaauccucucuucugucugguugccccccauuuguucccagaacuccuuccucucuucccauccauaauagcuaacuauuggcuucagaacaaaaauaagcuagucuuugcagcuuaucauaagcuaugcuaaaccugugaaaccagaaguuggcaaguuauagaaucgcucuuugagaauucucagugauaaguuauaaauaaucaacagauugaguguauuagacucuucaguuuuagggaaguaaaauuaauaucuuacugcuuguucuucccugagcuugggccucaggaggagccccggaagcggcacuuaagccuggguuuucuagucuucacuguggcauuggagggcuuuccauuuuguucugaguaguuacauacuguuggaaguucagcugaaaauaguucccuacaguucgugaugacuguuuguauucaugagcucugcugccagcaaugugaccagaaguuagagaagcucuagauguaaauggaguuagcugcaagccuuuugaggaguaaacaguccacgagcugggggaauagaauuagaggaucaggaucagacacaggcauuucagguagcuuuuaugugccuugucugucucaguggcucauuggauccaggaaacauuuucuucucucucucucucucucucucucucucucucucucucucucucucucucucucucucugucugucugucugucuuuugagacaggguuucucuguguagcccuggcugccuuggaacuugcucuguagaccaggcaggccucagaaauccaccugccuuugccucccaagugcugggauuaaagguaugugccaccacugcccggcuaggaaacauuuucuaauuauuccccuuaugucucguccagcaggacccaguuauucaugggugcgagggggaccgcaaaccugaagagaaaugagugagaaagagaagcuagaccaagcaaagaguugucaagguuucaguuuauuaggcugaaacgccagguuauaagcacacagcgaggggaaauagggaggggcugagggggaauuaacaaagaacaaagaagugggcaucuggggacaugaaggccaaauucagacugcaggcgggaggcacucugaguccuaucuccagaauguagaucccuccuuaacagucccgggugucaggcugggcucagcacauaacucauguccuuagaagucuugggagucaggaagagauaaggaagaggagacuauaauucagcuuuuuacggccucaggugccaggaagggaauagggaggagggggugaccaacuccuuaacacaggccauuuggcuuauuagggugggaaacugugaaaggccuaauuuuuuacgguauggucuccaacacccuuauaucugugguauagcuuuccuuaggauucuuuucagaguagaacugaagcauuaaagcaggaauuuaauucaggaaacagugugauauuaguauccucugauauugggguggggaaguuacuguccuagcauuggccagagcuguuggucauaaaauccccucuuauucauagugucaacuggcuguugguuugucaugcuagggacuagacccaggcaagcauucuacugcugagcuguccugugaguccuaggaaggaaugugcuuuaaucccucaaaauaaccuuuauuuacuguguauacuguguuacuucugugggguuggcagcugcuuuggagauggcagccuguuuucauccucccuguucuguguucugguuuacaguuugggucuguacaagcugcuaccugucuuaguuagggauuuacugcugugaacagacaccaugaccaaggcaacucuuauaaggacaacauuuaauugggacuggcuuacagucagagguucaguccauuaucauuaagucgagaacauggcagcaucuagguaggcaugguaaaggaccugagaguucuacauuuuauuuuauuuuauuuuauuucuuuuuuuuaagugaauauacaauuuuauuuaacauucaaacuucauuaagacaugugcaauauggcaguuuuacugggggggggggggaggguuaacccuaccugggaugauugcuugcugaggcuuagcagcaggguccaguucauacuuagcacuaauuaaauaauuuauugaauaaauacaauacccacaaaauacauucaaauuuucucuaaaaaaaaaaucacuuuuaaagccuuucuagucacgcuaaugagaaacacaauaaaggcagauaugcuaguuuaacauaauuggcugauuuuauacagcacuuauaucuuuuaguccacacguauauuauuaaaugauagagaacaucuaauaaaaccauuucuauauaacuaguaaauuaauuucuaagaaaaaaagauuuuacagaccccaucuuuuuguuguuuuuuuggguuuuuuugguuuuguuuuuuuguuuuuuugagacaggguuucucuguauagcccugguuguccuggaacucuaauaaaaccauuucuacauaacuaguaaaugaauuucuaagaaaaaaagauuuuacagaucccaucuuuuuguuguuuuuugguuuuguuuuuguuuuuuugagacaggguuucucuguauagcccugguuguccuggaacucauuuuguagaccaggcucagaccccaucuuuuauacccacccccaacaguccaacucuaaaggggauaaagccaaugccuuuccucacaagagcucaggacuaaaguugcuuugcuaucauaaucuguauuuguugaugcuggagagauagcucagcaguuaagagcacugacugcucuuccgaagguccugaguucaaaucccagcaaccacaugaucgcucacaaccaucuguaaugagaucugacccccucuacuggggugucugaagacagcuacaguguacuuacauauaauaaauaaauaaauaaauaaauaaauaaauaaauaaauaaauaaauaaaucuuuaaggaaaagaaucuguauuugugaucuauuaugagcauugagacaauauucaaauauucuaaaagaagcacaaugcacguugugaucgccuauucagcaacagugagcauugcauucaaaacuaucucaucccaggaauuaaauuaggucagcuacauucaugggcauuuucuccacuggaguauuguagaaaguuucagugugaugaagaauccucuugucuucuucaguaacaaaguuuauagccaaaccuuuccuuccaaaucgacccccucugccuauucaacucguucuuuauucaguaugcuguuucgcuuaugauuccccguccuaaauuacgucaccgccauuucugagugccaucaccaacugcugcuaucgacaccugugaauauaguuuucacgguugguauguaaaucguaguuuauaaccaaggacacuuguugcaugucaauccuacgagccgacaagucaguagugaucagaacauggcuugacccugaucggaauucguucauucauggugacaucucuuuccuucuuguccaugucaccauccagagcagaaacugaaguuccuggcaugcauuuucucugugagccagucccccuugcaucuuguauugagaaaaauaacugcuugugugauagucagagucucauacaagucacaaaguguccagcuuccauuccucuugcucaacauuaauauaaaauuguuuaauuccuucaagggucaauucuuccuucuucaccagaauucgaauuucuuggucacuucuagcacaucaguuggcauuguggcagaaagcaacacaaccuguaugcuuguauuuaauuuuuggaaaaucucacagaucuaacccuuaaacccucagcucaacauuucaucugcuucauccaaaacaaacauuuugauccauuuuggagaaagguaucuucuauuuagcauaucaaacacucccugaaguaccagcaacaucaugaggggcuucagccugcaccuucugcauuucauuuugagcauuuguuccuccaaugcaagcauugacaaguugcucccauauaaucuccaagagccaaaauuaccuuuuggaucuguugagccaguucucuggugggggccaaugcuagugcuugggucuccuugaacucaaucuccaacuguucaggauggaaauggcaaauguggcugacuugccaguaccugacugagcucgagcaaucacaucauauccuuuaauacagggauaauagcuuucuauugaauagcugaaggcuucucaaaaccauaagcacagaugccuugaagaagggacuccuuuaaauucauaucaucaaaguuaucaacaauuucauuccaguugcccucgaugacaccauugggguccauuccuucugggccgccauguucucuguuguaauccuuggagccaccagacaugaucugaaaacccacucagcgccugacugaaaagacagcggacagcacugcucuuuuuuauagccucgugaucaaaacccauuucccacagagggauuuucuuaucucccuucagaagcuacaaaauuguaguacuggaguuuguuaccggaagugaagcccuaagggaguugaugacaaaaauccacauuucacuauuuuacuagagauccaugagucaggagugggucugggacucugcuuucauuggaagaacauugcagcagcucgaaggccagcagagccuggggauccuaaguucuacaucuucaucugaaggaaggcugcuagcagaaaacucauuuccaggcagcuuggauguggucuugaagcccacacccacagagauccgccuacuccaacagggccacacccucuaauaaugccacuuccugggccgagcauguacacaccaucaucagccugagcuugggauguagcaguuuguccaggagagcugguuagaaguacacagagaaaugggauuuccgaaauguccucaccucucucacuguuugugugagugccaauaguguacuucauuucauggguuuuauuuguaccuuuuaauucuuuggguuuuguguucuuggguggacauauaaauuaugacucuaaucaaggucaguucuggagugugccacacaguccuuacuaaagaccucauacagugcauguuaauauuuucaugucuugaguaaaccuuugaguuuauuugccucucucuauuaucuaucucuauaaagaucauugaaauagucaauggccugguuuucacaaauuaacuuuuuucuuauuaaauauugagaaggucccccaacccccacuuucccaucccccaucaauucccccccccccucuuuuccuuacaguuuagggcauuugaggucauuaugggcaguucugaagggauggggacauggauacaugcucuaaggggccuuucuccuguuuuuguguaagggaccuuagcccaugugugggccuucccucucuauuuagcauuccagaaacacucuuaugaacaccacagaaaugugcuugacugauccaggucugucuugauccagucaaguuggcaauuaacacuaaccacuauggcagaauuagucacagccccaccuuugcucucaaccccaaacccucauuuuaucuucugcucagaaagagcaaccucugccucagccagggagaaugaaacaucucuaaaaccaucgaauagagcuacuucacugccuucucagcaucaggaguuagcagcuuaguuacaccuaaagacacaggcuuccugaaaaaauaacuguuuaccuugugccuucuguguauaggcaucacaacauuguucagugguuaaucuugggucuuuguuguugcuuuucauaaugugacuagaaaaugauauguucacauaaaaaccaagguaaauuguaauuauugaaaucagucuaaaugccauugaugagauauuucauauucuccgaacuggaucuggaggagcguguuaccgaccuucuccuccgaggcucccagcacccaacugcugcugccacggggagcauucgucaccaagacggugcugacagucaacaguguacugucccuuuaccuggagagaaacuggcaaucaccaguagcaguuagaaugagaugaauaaugaugugugcuguagcuauaaucccacaugacagaggggagggcacagugacuggaaggguaggaacagcaccagcuaccugggaccacccuagucauuaaaacagaguuuugaucauacuacaaaugaagaaaacuucagacauaaggccuagcaauuaguguuugauccugguuaggugacauugacagccagggugagaacuaagaugagagaucgcuuuagaggaaauagggacauuaggaucuuucguuguuguuguuguuguuguuguuuuguuuuguuuuguuuuucgagacagaguuucucuguauagcccuggcuguccuggaacucacucuguagaccaggcuggccuugaacucagaaauucgacugccucugccucccaagugcugggauuaaaggcgugugccaccacgcccggcuggacauuaggaucuugaacagaaacagauuuuuaacuuugagugaauaagguaucagaguuuuaauuugugaucuagguaggaguguauaaaguacagagacagcuuucugauuauaggauggcugaguuaauaggcaccuguguggcuacaggauaacugaguuagugaggaccagaaggcuuccuuuggcuucuguaaccagcaccucuucucuuugcaaucauguaggcacuuaggauuuagugaggacaucaccuggcacuuguuagcucugguuaauauaaaauuuucagcuauaauugguuuauaaacaaaaugaagagaaacucaguuuguucaguaguggaucuaauugucucuccccaccccccuuuuuugacuuuugcuagacaugugcauugcuaucgcaaucucucuccucaugauccugauaugugccauggcuacuuacggugcauacaagguaagccacuguugggaggugagggcggggccugucuuuaggcccuuccacuagagcaguguuuucagcuuucauugugaugcccaaccauaaaguuauuuuauuuuuguugcuacuucauaacuauaauuuuguuacuguucugaguuguaacuaucuguguuuucugauggucuugggcaaccccuaugaaacaguuuuucaacuuccaaagggguugccacccacccaccacuugagaacugcugcuguggcauaaucugagguuaccuuuucugaguguagaauuauucauaguucuuugcaagagucuuaagaaaucucucgcugacuccuugugguacuagaaaaacugguaaaacccacauuauuaugaacacuugguauuuuuguuugcuucuuuuuucuucuuuuuucuuucuuucuuccuuccuuccuuucuuucuuucuuuguuacuuauuuuauguguaugagugcucuaucugcauguaugccugcacaccagaagagggcaucagaucccauuauagaggguuguaagcuaucgugugguuguuggggauugaauguaaaaccucugcaagagcagucugugcucucaacugcugagccauuccuccugccccagcauugcugucucuucacugcuucagcuuggcacaccagucgcuggcauuccaugugccugguuaaugacugccagguuaauggccugguuaaugacugccaguccuccaggucccuucauauugauaagcucagugucuuguuauauccaacauacuaacauucuguuuucucauuuuuagcaacaugcugccuggaucaucccguucuucuguuaccagaucuuugauuuugcccugaauacuuugguugcaaucacugugcuugucuauccgaacuccauucaggaauacauacgacagcugguaggugacccuccuacucacugccucuugucguggugguggugguggugguggggcgcugauugaguaaaggacaaacaaaucacuaucaagggacacacacauuaagcagaucuuaaacuugcagcugaguauuuggugagaugguugagguuuuugcugaaaggugggaguucugaauuacaagggugcuuuuaggauguuauaacugucauaaccuccuaggaccugcagggaugaggcagagggcaggaauggcauuuucugugucuaugggaacauugauaugcuuugcuuaggugucagcaauggaugggaucuuucuucuguuggcuugugggagacaggaaacugcugucggauucucuccagacuuaguucccuagagaucucuuucuuccugauuucauguuaaguacuuuauggacaucugguggguaguauugguggcuggguauugaggagcuucuaauagcgucagauggaguaauuguggacccuugcacuauuuaaccuuggauuuuaaaauuaugaauguguuugaaaauguaauuuccguaaaauuguuuaaauggcaaaacauucacucuuugcgggggaggauuguuuuguuuuguuguuguucuuuuucucucucucucucuuuuuuucaagacaggguuucucuguguagcccuggcuguccuggaacucacucuguagaccagguuggccucgaacucacagagaucccccugccucugucucccaggugcuagaguuaaaagugugugccacuacugcccaguaaaucuucacucuugaagguucucucuauauaauuuuauuacuuguuuuuuuuuuuuuuaaugugguauuagggauuaaaccaagggccuggccacacgcaagcuaagcacuucacuguugagcuacauccuuaguuuagagaccaggucuugcugaguugcccggcuuggccuccuaucucagccugcucccuguucccuuggguuacagacugugcccguguguucauuacacgcagccucucuaguaguucugaacucaggguaaggaccaggagaggugaggcuacaggauuccuguggcauugggaacuagaugauccaguggaaagaaugguugguggggauagggaggagggaagugaggagagaggaauggcugaggggagugggggagugaggagagaagaauggcugaggaggggagagaggagguggggaggauagaagcuuguagucuugcugacaguccugcucugaccugucccaccacagaaggccccaaauuuuugcuccuuagaaaugucuacauuguuguucuuuuuauugaagagccaggacuauguuuugauuggcaguagugucuaaaaaguuccaugugccaguuuuaagaguugccucuugggagauaguagaacaugaaagggccugucugugauggggcaguagaggauuagccucuguacuaagacuucauguuaccucuaugaucugcuugcugggcuccucaaaucgugcugcaacagaggaagaaacucagucccaacaagcuuaucauguacgggacugggcugguggugaugguaaggauaugugaagacaggccaguagcugcccugugcuguggaguggugcacuguauguccaguucaugggcuggagagccacacagucauaguggcuucauuugacccuaccuuaucugcuacucuccagucauucacuuuggaaccauuaggugguacaacgacaauauuguuuaagcugacaagaauuauaauuuguaaaaaaaaaaaaaaugggcuuucacuuuuauuuguaaugacaaaccaaauauuagaaaugaaauauuucaggaagccaggugaaguggcugaaguucaaggucagaaguugaaggucauccuucaacuccuacauagugaauuugaguccagccuggguuacaugugacccugucuugacuucccaaucucccuccaaaaacauucgguaccauuuaauggucauucugagcugggcacaguagugcaugccuguaaccccagccccuagaaggcugaggaaaaguccacagucagccugagcuacuuggugagaacccauuugcacaaaacaaaucccagauccgucugagcuguaguagcaaaucauguacauuauaaacaaugccucgaaauggcaaugaaaagggacguugacauucccaugauggcugcuacugcugacaaauugaaauguggcgaguuagaaaggcagucgucaucugagaaggcugcagacgagcccaagcuggaauccugcaaaacaugguuaaaguaauucaucauccuuguuuacaaaacaaaauaaacauguaagacuucgcuauuuagaaagaugugccauuagcaaauauauucauauuagugaguuucuccuccuuguccugcacacagacuuuagaauacccagaacaugaagaaaauaggaaaacacuaccaugucaaacauuaggaguauucaaagcaccacauuggugguggacccucauggugcaguggagggcggacugcugcugcacacuugauugugucuguuuccccuugacuucccuucgcuggaauuacugccugaguuaggacaguguuggcuuucccuaacucacuguugcugucucaucaauagaggcaucuguccucaguaacagucaccagucuccaccaugccucugcugccuguggaauacaucuugaaagaugaaugaaguuggcuaaugagaccccuuucccuuucagccuccuagcuuucccuacagagaugauauaauguccgugaauccuaccuguuugguccuuauuauucuucuguuuaucggcauucuuuugacacuuaagguacgcauaaauagucucuuuaugggcuaaauauuaaauguauucugauuguaagagagauaaacaaaauaacuaguuuguugccucuugauuucauaauguuacaguuuagucuguugucugugugagagagaaauacuaaccugccuuccacaggccagucaaggagacauggcccagugguuaggaguauuugucuuuuuccagaggacccagguucuguucccagcauccacuugguagcucacaaccauccauaacuuuaguuccucuucacaugucuaugucaccaggcauguacacagugcacagauauacauacaggcaaaacauccauacacauaaaauaauaauaaaaaaaacccaacaaaauggcccagaaacuuagaauacccaagauauaauuuacaaaacacaugaaacucaagaagaccaaaguguggauacuuugccgcuucuuagaauugggaacaaaauacccauggaaggaguuacagagacaaagguugaaucugagaggaaaggauggaccauccagagaaugccccacccagggguccaucccauaaucagccaccaaacucagacacuauugcauacgccagcaagauuuugcugaaaggacccugauauagcugucucuugugaggcuuugccagugccuggcaaacacagaaguggaugcucacagucaucuauaggauggaacacaaggcccccaauguaggagcuagagaaaguacccaagagcugaaggggucugcaacccuauaggugagacaacaauaugaacuaaccaguacccccagagcucguaucucuagcugcauauguagcagaagauggccuaaucggccaucauugggaugagaggccccuuggucuugcaaacuuuauaugccccaguacaggggaacgccagggucaagaagugggaguggguggguaggggaguaggggggguaugggggacuuuugggauagcauuggaaauguaaaugaagaaaauaccuaauaaaaaauuagaaaaagcuaaaaaaaaaaaacaaaacaacaaaaaauguauuugggaacagauuaagguuauacaauacauauaguacugcaacaugcauuacaugcauauuaugacuuuauauuguucuaaguugucuuuuuaacuuugaaaauuaaaaauccgaugccugugacuugcagggcuacuugauuagcugcguuuggagcugcuacagguacaucaacggcaggaacuccuccgauguccugguguauguuaccagcaaugauaccacaguaagugugaugucaccagaggggagaccucccccauccuccccugcaugauggugccuaaugcuuuaguguuugccacguccugcuggauuugagacauguuuuuuuguuguuuuuguuuuuguuuuugaaguaguguuucucuguguagcccuggcuguccuagaacgccucgguagaccaggcuguccucgaacucacugaaaucugccugccucugucucagugcugggauuaaaagugucugccaccacugcugccuggccaagucauguuugucaucugugugcucugcagaguguaccggguuguagauuucuugccagugugacagauaccugaaagaaaugacuuggagagggcugcuuugauuaucuuuuagacauuucugucaugugauaggacuuguucuauuaccacggguuugugguaagauaugaagaauaucauugcugcagacccuguuaugggagagguugcucacaucaaggcagccaagaagcagagaggacaauggagacguucccaaaggacuaccaccucccucuaagcaagccccacuacagauuaggaacucaucaguagguuaauccauugaugagaucagagcccuuguuacccaguugcuucagugauuggauccacuagcugggaaccaagugagucuuggcagugaggggagguccaggguauuucacauccaaaccaugacauagauaauaauuagaccuuggaaaacagcaguaacaaauaaaacaaaaacaaaaacaaaaacccagccugaagagagagagaugucucagcagugacugcuuuuccagagucccaggcucauuucguagcaccauguggugccucacaaccaccuguaacuauaguuccaaaugaucagacucuguccuuuguguaaauuucuuguuuuguaccuauucuguauccuuagaaaggauaagcagaugcuuucucuaaacacuaacacaucacaguauauaggacugaugcucaggcuagaccauccuuuggccaguuggagccucaucaauagcucccggguguucuugcucucuaguauaacacagacuuguguauuuucggcaccaccccuguggugugccauuucuccaaagggcuguucuuguugguggaaaaugaucucuggagaucauaauguaguccccgaggauuggaacacucuaagauuguuuggcaaggacuaggggacuuaauguuggcauucuaauuugaagaccaaaaugugccagugccugccucaccaucaagaaggcuggaauaaucuaguuuuucacagcacauaaccgcauacguuucuccuuugcccaugucaguauuggguauccacaucgacauaacaugucaugccuggcuuucacuuccuauuaaguauugguccagauggcucuucucccaggcuaaauaaacccauguugaccuuuguggauagauacuggaguucuuguuauaaaauaaacaugccuccuguccuuuucuaagacagugcauaugcugugauccagauucaugcuuucccaaauucugcacacagagaagacaggaaagaguuguuaaauacuggacaucauucccagaccagguuuaaucgugcuuccauuucuagccaaaccaugaugggaaugccuggggcagagggucccaaacagaaugccugcgagccugcgugagaauaaauacccagcucuucauugcacugagcagccauguaugcacagcaguaugcuuaguauguaggaaguguugcuuugucucccuuuuuuuuuuuuuuuuuuuuuuuuaaagauuuauuuauuuauuauauguaaguacacuguagcugucuucagacacuccagaagagggagucagaucuuguuacggaugguugugagccaccaugugguugcugggauuugaacuccugaccuuuggaagagcagucgggugcucuuacccacugagccaucucaccagcccccgcuuugucucccuuaagcauuuaaaauaucccaaggugccgcucugcgccucugcagccaccuggcuccagcacuauuggugccuuagggagaugcacccucccuucuagagccucugcuggagaagucaugugguagacacauuauguaaugucacauuggcuuccuaaugcaugaaaaugugcucaccggaggaacagcacauuaaaguaauaaauacauagguuauguauauuuuucauaauuaaacauuugcaaauugaaguuuuugaaaacuuaaucuguguaacauuguuucacuaacaccaacaagaccaggguuccagcaguauuuugccaaauggaacgcaaucccuguggaccaggguucucggaaccagugaaaguaauauuuagcuaaaacagcgucugaaauucugauuccagauaaaagcauuauagccuuagauaugauaggaaggcuauuaauauuuuaaagggaucugggcgugguggcgcacgccuuuaaucccagcacucgggaggcagaggcaggcggauuucugaguucgaggccagccuggucuacaaagugaguuccaggacagccagggcuacacagagaaacccugucucgggaaaaaaauaaauaaauaaagggaaaauguaaacuucaaggagccuguuaugcuaugucuuguuguaggcgcucagauuaccuuaaugucagauuaccuuguugcucugacuucucaaaguauucugcuaucugaggcuuuuugaaaagucuguuuuauaauacacuuagaaauacaguuaaaagaaaaaacuucaguggauggucagaucaucucccuaggagccauugcccaguagauucucugacauacugaaggucaguuaacgcugacccuugaccuuaaaaaugcucugaagaacucagcagcuggagugacauuuauggugguuucagugacuuuuccaguaauuauggcacaguuccugcagguuucuuuccuucaucccuaagaaacuagacagucagaaccuaaagcauuaacauguuuucauccuguagguguugcagaaaagucauaacuaacuugccagacaagcuuggggaacuccuugcuuccagggcaguuagagggcaagcuuuagauguguuuuagccggauucaagagcaucugaugaccaagccagcucagucagccaggcugggucuuuguauuguuugggcgaugguauagccaucuuugucauaugaguaauuuccacaauguugauaugagaugaaauugccugauacacauuucuuggaacauagcugcacuguuguguggagcacggcuguagcucuuccuauucagaugaacugaauuucuuuuccagauuuuaucuauuguauguguggauuuguuugugugcacacaugugcauguauaguccagggguugacacugggugucuuccucugccuuuucacccuagguaacuuuacugagcuggcuccuucugggagucgggguguauguggacagaaaaauggaauuugugugugugugugaaauuuguguugaacauauauaaauuagccaccaguugugugugugcuugaauguucuggcacucagccauuagcuucugcuugguagcagcaacuuuacacugaaauaggauguguucuuggucuuuuaguuuuucuuuucucccuuauuuauuucauccugaccgcaguguggcccccgcuccaugaaugguuaguuuuuuuuuuuuuaaaaacaacuaaaugccaagugauaaaaaugucaaaauaguuaccuuuucaucugucacaucauggcauccuagguggcaaauuugauguuaaccacgugacaguuauuucucucaauguccaaguacuucaucccccuuauagaaaaggaggauggcugcaucuucagugccaacagaacauaauaggaacagaagggcguucugguucguacgucacccaucuggucuuugagucuggacuagauucagcaucauuuagauaagaggaugcugagccuucgagaauuuaaacuaguuccaucuggagaauuuucgaaagcacucugauagccagaggugucacaucaagaauauuucacagccaacauggaacagugagugagggugucaccagcucaguggagggagggauucuucaggccucuuggcuucagauugcaaggcgaagucaguagaguauuucugagaaaagagcaucaguguugaagugcugauuugcaaugaaacagcauucgauacaggcuugcuugauaaugaauauaccaaagugugagaguucuauuuugauagaacaugcuuaugcuuccccugaaagaaaauguuguauucggucucggaacauuuuggggaaauuuggccugaauguuucguuuugguuuuuuuuucgagacaggguuuuucuguguagcccuggcuguccuggagcucacuuuguagaccaggcuggucuugaacucagaaauccuccugccucugccucccgagugcugggauuaaaggugugcgccaccacgcccagcauguuuuguuuugugagaaaggaaagaaacaaagcggaauaugcugguugcuuuccuuucuucaggagcccuacuuguucuaagauuucuccaaagacaaugguaguuacgcucaguuaauucuucagugaggcugcugaggauaaugcagaacccaucauucuguaguuaauguuccuacugcuguucacggcuuccaguggucauaggugacccuacuugauccauauccacacgugugugcuggaccccaggccacagccacagggagagccuugccugcugcaucuccccagccuucuucuguaaguagacaguggccaggccccuccaacuucccagaaacuuuuccacugcccaccuucuuucuccccaccacaaguguacacucagcauaucauggguacgagugcucucucuagucuagucacugccuuuucuggucugcacugcacugccuuuccccguuguugaucaucuuuuuguguucugcccacucugccuccuaagcagacagcacaguaauucacagcguuuguguugcugaugugaguacccccagaguggcuggucccucuguggggagagcccugcagaugccuccuugccuccuggacccaagugcaucccagguuuuccugucccuugagugauuugagaaguauucaggacacagggacaccacuaagugccccuuugaggaaacagacacaaagcugacaggaacagcagcucgugagauguggugucagaugccuugcuaugaagcagcucuacuguugccuguuaauuugauugcagcuacuccuugccacuugucugucaccugcuugccugugagccaugccagucaaauacacuaugggaaggaagguuaccugauucuguguguucugcaagguguuuaggucaacaaggaaugggcggcuuagugccugcccuugugccuacacaugggagaaccguucuuauucccuuauuccuuuacauauacccucuggcuaugcaggcacacguagaccaugucaggaaaacagagguggcagaagucaugccccagcuaagguuucaaagucucauacaaaacguguccacuuaguccuagaccggaguaccaguucucagaagacuuuaaguguaugcauguucaguuaaagccuggccucggacgcagggaguggaugccugcuuuuaaacacugacucugggcucuccuuuccaggugcugcugccuccguacgaugaugcuacugcugugccuagcacugccaaggaaccaccaccaccuuacguguccgccugaaccuggugcggaagagcugagagcagcaguuugagcccuuagcugcaugaauuauccugugguuucacuuccaugaugaacucucugagccacauuuuacaauuuagauguuaagcugaagccucuguugacacaugcccuguagcuaagcacugacuagcgaggcuguaggaguggaguguggugaguucccagagucuuucucaaaacuacagacguugguccccgggcuggcuuauaccugccuggccccagagcugggugggcagucauacuuuucuucuccauucccucugauuguuuugaaaguauaaaauuaaaauuagaugauacuuaaaucuuuccaguauacguaauacaaauaguauuaauugcucuaauuagauaguuaggagcccuuccauaugugauauaagaauuccccuacuaucccugaauucaaugauacucugaauuugcuggucaaggauuuucuuugggccaaauaaagacccccaagguaauaggcaacagugagggcaacagcugccgggcugccuguuguuuugggcuaugguugaugugucucccugugugaaaggggggccagcuugcucugcacugagagacucacacucccuuuuccuugguuaccugcaccaacagagccaccauguauguuugggaaaagguguucacacucuuuucuugcaagguacaaccugcuuugaauuucuaaguaugccuaaucauucauuaaaaugucaagcagucuucagaaagauaaggagguuuguucccauguagaauacucuagacugucuggauugugaaagacguuuauguucaugucucugaaugugagcaggucuccugcuugguccuugcucaaugugcuguacacaaaggcuuugcaauuaaaguuugucugcauccaagaaaacagucg

SEQ ID NO: 7713 - RNA, 2149 nt, Mus musculus
acaguugaauaaauuuuaauguaaaauuucuggauuuucugaguucgaggccagccuggucuacagagugaguuccaggacagacagagaaauccugucucaaaagacucaaccaaaacaaacaaaaaccaaaaaacccuaauuugcaggccugguucuauucauacuucuguaauacacuagcuguaaaaaugugagaauaacacaguuacuaucucauagaguguguguguuggcuaaguaauauguuuuaguuuccguuuuuuuucuuuuuccaaaagaucaacucacagagauugccagcuccgggugggauuauagguauagaucaucucgacccgcaugacucauggauguuuuuaaaguuauuuuaauuaaggggaggcaggguuguucuucccuuuccuaaccuccagggcaaaguaacucaccauacagcuuaccuacuacccuggguuuccuuuuucaugcuuauauaaauuugguggcacaggugcuugugcaguugggcagaggucacaggucaacuucuggguacuuacucgguaguuguccaccuuauuuuucacaagaucuuugagaccuggagcugacagguuagacuagguuggcuggcuagccagccuuggggaaucuguuccacaaauggaguuacaagugugcacaaccaugccagacuuuugggggcuggggauugacagagagguuuaggcauaaaaugcagguccccacgcuugcaaggcaagcacacuuuacugacugaacaaucucaacagcccuggguuuucguuggugcuagugcguaaauaguagaggcuuucaagguuuuuuuuuuuuuuccuugaaugcuacauuuauacaacggcccaaguuucguagcaaaaugauuuuuuaaauuauucguauugcgacuauuucuuuacuucuguauacguaugugagcauucaagcgcaggccaaagaaaaaccugcuggacuuggcgcuccccucccaccacguggguuuggaacucauucgucuacuuagcgacaagcgcauuuacccgucagccacuucaccagguuuuuuuuuuuuuuuuuucaauuguggucccugugcaaaguaggcucccaaguacacgguauaaaaccgccgcaaaagggguguguguccuacggagcggcaaacaggaagaucagcggcggguggacagagaugccuccgcuccuggugagcagucacgggguaaaccggcggcccgggguccuuccggagcacgcccaagacaacgucaggcggagaccagcccaggagaggccaggucgcugccgccucgccacggagcccugggccucgucgucagcucccaucgagcuccggcucuccgcggugucagcccgcugcagcagaacaaacgcccagaaccgaaggccggagcccagacgccgcagcagcccagccugcguuguaacccgguccccauagcaaccaacuaccgcagacuacucucgcaagcgcuguucugcuugugacccggaccggcuucucuuccgcuuccggucccacaauccucugucggccuagaagagcuuugcauugugggagcuccuuccuuucucgcuccccggccaucuuggcggcugguguuggugagugagcucugcgggguaaacgauuaggcggcucggggagcuccgcuagcugguguuugacgcucuggauuauaauccucucuucuguccucuguguaugcuagguuggggguugucccgcaccuaaggcaggaagaugguggccgcaaagaagacggugagugaagccgaucgggcccggaagccgguucacguggagagcugggucgggccggggcggauagauuugagcacacuggguggacgacuugucgcugacguuucagggucucaaagugaauccgagaggcucuuuguauggucucagacaucaugaaaggguucaguuccagaaaucuggaacugaguuugguuuuagaugacugcaagugguguucaagucucaaacguuugcauuguagaaaaagucucuggagucgaucaacucuaggcuccaacuuguuaugaaaagugggaaguacgugcugggcuacaagcagacucugaagaugaucagacaaggcaaagcgaaguuggu

SEQ ID NO: 7714 - RNA, 7221 nt, Mus musculus
cgggccaggggcagccuggggcgggacgcgggcugggacggagcucagcgcgcucgcagccggagggugauggcccugcagggcugcgggcuccgacuuuacccgcaguccgcggucagaaacuggcccaggcaccgggaucugggcgagcucugagcacucaucccaacacgcucgcucuuuacacaucccgcuuccacggacugccgaagaccaauuaccgcugucgcuuucgcucccccagaucauguucucgguucccgggacaacgcgccgaaaaagaaguucucccaguuuggaccucaugaccuuuccaagcugugcguccugcuguccggaccuagucugaaccgcgcugcccaggcagacaucgguucuggcggugaguguccuuuccagggccaggcuguagccuuccaaaggaagggagggaugugggugcucaaggggcgcccagguucucagucuggagcgcuacaaguucagaaaaugaaaggcagccgugcggacccuagucccgggccucguguucuggccuccuccggucccugcacgcgacucccagcuaauacacucaguuguacuuuugugcgcugucccuuaguuugguuuugguagauuuacgcauucggcaagauuuauaaaggccgaucaucguacuuuguggccagaucccaucaccccgugauauugcuccccugcucuagaaagcgggauccacgcuuccuccuacugcagcuccggcacucagcacggaagggccgggacacacggugcaaucaagccagcgacuccgaaggcgcauuucacaggggaauaguccagucaugggugauuauuuuuuccaaccguguacuggccucuugcuuuuccuccugcuccggucuucgcccagaggccaacaggcaagcuucucaggagcugagacgcuuggguugucgagaaauagcucggaauggagucgcgguuguaggaaggaggcaggacaagguguuuguggaggcagcaacgcuggaucggucuccccaccugugagcagagaacaaaagaguucugacugcuuucgaagcgaaacugggugcagacagcaacuuucucugcuccacaaauuccagucuugaacagaacaagaaaaugaaauggagagggagggagcggagacaaacccaguuuaugcggagggcgccuuaauuuaauuaacucuucgggaaggcagaggcacggggaaggggcagaaacuucgugccccccccccacuugaccaaauucuccucccccaccaugaucguagaucucuuucuacuauagcucucuggcuuuuacacaguucugcuguguuugaacugaaaaucagcgaacauaaccauucauccaucugucauuuuacucagaagcccauacacagggucuagcagauaacgccgaacgauauuauuauuauuauuauuauuauucaauguaacaucacuauuaccaacgauuggagagucuuuaucaaauaaucaggaccccugugcucuccaguguuuuuaaaguuuuaccaaacugaaauuaauauguacuuugcugacagccagcgaaauuaaauuuuacaaaucgucuaacaugccugagaauuccauugaaaaccgaugaaagaaauguagcuuucucuccauugaaccguuuaugacuuuucaugguuuaacuuuccucgcaaaauuaaagguaaccagugguccgaaacaugcuaguggagagaugacagcagagggcccauaguuagugccugagauggaguaaguccgcagccccaacaaaacgaaaguaccuuaguuccauggguugacuugagcgaugauuugacuuacauugcuagagacuaaacaggggcgugggaaucugaacucucugguuauuuauguuugguagguguuuaagggcacucuauuuguaaagagauaucagagggcagacuggcuugcucuuccucaaaccagaugacucuuccuugcaaagaaagcaaacuuucuaugaaguggcaauuugggaguaacagaaauuauaagucuccuuucugcaguauaaaucauugggaagagaagaguggcacucggauuucuguagacagaauuaagauugugaccuuuauggcaaaguuaacuuggagcauuuggagucagaaaucaucaauuuuuauaguuguucuguuguauaguuguucaacagagccauccugccaccuccgucuauucugagaaccaugcauugccuccugcauuuauuucuaagaaaucuagacugagaauaaauccagauaaucauuuugauuuccucuccaugcaggagagaggcugccuuucgacacuagggggaaaaugguuugacuuucuggaaaauccuuauuaccuacggagacggaaauaaagaugaaauuuauuguuuuuaauugaagaguaaacagugauguuaguagaaucuuccuacacacacacacacacacacacacacacacacacaccauaggagagggguucaguguugcagcugaacagcagugaauagugauuuguguggugggaaaguuauuacuaaugggaguuuacaguuucgguugaaugcucugacugagacccuccgacuguuagacacuucucauuaacucccagccugaacgcccagaccacauaccaccaggcagaagcaguucauuaauaaaucucuugucuccaaacuguuccaaacaguggaggaaggagggaguccacggaagcagcuaguuucaaccuugcgagagcgcugugucauagcgcagcccucuaagccugcuggcagauagagucucaaacaacccuucauaaacgcuauggggcagaaaauucggugcagaaaggauugggugggcagggagaguagggcaggcccuagcgccccccugccuacuccaaaaccucaggugucccgguguuagcaacgccuuuggacggcuuucuuccuugccuggcgaaguucucagcucuaaacccugcaccugggaggccacccuaggcggugcugccagaacauguuuauaaaaggggguuggcugugggagacugugggcucacugugaacgcaguugaggugcuccaggguugccccuguggacgugggcaucaggcuguagguagccuaggccucgcaauaugcaaggaccuccugcagcuccuuuccuuggccuccuccugaaugcucacuucuuuccgcugcucuuaaggcuuccugggggugccagaucaggaagcagcccccuuuuuucugagauccuagcgcucgguuugggaaaacaggguuccagacucagguuccgcauccucacccggaggaaccaugcuggagucugaaccaccuggaagggauuuugguagggggguggaggagaggcaaccccugagaagaaggggugaguccaagcugaacccaguccccgaagugucacuuuuccuuccugugggcccgucacuucugauaaaugagaguaaggcgggggggggggggacaaaacaaaacaaaaacaaacaaacaaaaaaacagcgaggucagcgugaggagaagcugagcccugcaagcccgggagaacauagugcucccgguuagcgcgggaaaggcgaccugaguggggcgcagcuugggaagaagccacaccuguggaucgaaccaggccuucgggucccggaucggaaccacgaccugcggugccacagggagcuggcaagcuccgagagacagcaguugacucuguggccugugggccuugaccucucaguccucaugauuuccccacuuaagaagaugcgggugacagugggacugacuggugcagcaccagagcccucucugcccgccuuucuuuccccggucggagcccccuguccuggaacccggccuuccuaucacccgcucgcccgagggccucuugcugcccaagcucugggaaucucggugcagacuggcgggucugauuucgaggucuuggaggcuaaggaaaagggaauuuaagagaugucacaggcgagaucgcccaaggacugaagaggcuggauaauuaaucgugaugucucccucucuuccccggacacuuuuagggauuccucugcgugcuguuguuuugcgggcuuuucccccucacacccuccggccucugagaccuggaagaaaggggcggcucucugcaccccuucggagccuucaggaagauggggagcaaggcccugccagcucccaucccacugcacccgucacugcagcucaccaauuacuccuuccugcaggcagugaacaccuucccggccgcaguggaccaccuucagggccucuacggucucagugcggugcagaccaugcacaugaaccacuggacgcugggguaccccagugugcacgagaucacccgcuccaccaucacggagauggcggcugcgcagggccucguggacgcucgcuuccccuuccccucgcugcccuuugccacccaccuguuccaccccaagcagggggccauugcccacguccuuccagcccuacacaaggaccggccccguuuugacuuugccaacuuggcgguggccgccacgcaagaagauccuccuaaaaugggagaccugagcaagcugagcccagggcuggggagccccaucucgggccucaguaaacugaacccggacagaaagcccucccgagggagauugcccuccaaaacgaaaaaggaguuuaucugcaaguuuugcggcagacacuuuaccaaaucauacaauuugcucauucacgagaggacccacacagacgagaggccauacaccugugacaucugccacaaggcauuucggaggcaagaucaccuacgggaucacaggugagguuggggacuauggcaaggugaaucugcccaugaaauguccuauuagauauuccaagugucacuaaaauuccccucuauuauagaaugcucauccaaaccccucccaaagcugaccucaguaacccaccccccagucuauuuaccgcccuccgaaccucgcugaggaccgcugcauucuuugaaacaagaaagagcuuuccucuguccuugagcaggaaaaaucuggccuaggagucaguaacuguuuccucugagucggccuugguacugagugagaggugaaaaggcugcgggaucgcggauuccuuccagcuggagggguggcugaaggaugcaaguuugggcugcuguggcgccauuuccggacaaucuaccggauucuucuacaccgccaccccccuccgccccaacacaccuccccgagugcccuggagcucagguuuucuuauucuuugugggggucuugagucauuguuuuuaaaacgucucccaccuaccaucacaccccgaauaagcaaaggacaucggguuaaaauaauugccauggcuggagguuucgccuaaaucuaccuguaacuucugaggugggacuucauccuugaggccaagauaugauucgcaaaaaucgucucccaacccccagccuugccuucugucuugauuuagucauuuuaaaucccagagaaaacccugacggccuagagggcucucucugcugcauugccagcuccacaaacuugccagagagguuggucaagggaacauaaagccagacugcucgugaauguuuccaagagucuguuaguugagguuaaccauaaacagaauuauacagaaaaucuaaaacaacauaaguaauagaaauucugcuuucuuugcccucucaaaauuucguuggagaaauuguggaaagaaugauccuuucaaugaaaacuuguauugauuuucagguauauccauuccaaagaaaagcccuucaaaugucaggagugugggaaaggauucugucagucuaggacccuagcaguucacaaaacuuuacauaugcagguaaguuuauuuucuucuuuuaaaagugcauguuuuauuuuuaccauuauggcuuuacacggaguguccaaggcagggaugucucucuaaugguucuuuuuagauuagcuuucuggggugaaagaaagcaacacuuguuuuuaaaauauaaaauuaacauuauguaacauaaagaauguuucuuaacgaacagcccagccgauuaacaauaaguccuaauguuaguauuauauauauauuuuuuucaucccaucuguucugcguuuaaaacuuccguguuugggaggcaauaaagguaauuuugacaguggaaucaugaugaaaucccauaugcugucuuucccaggggccucguaauuuguaguuuucaggacauagaggaauaguuuaauuuuccagcaaacaggagcuucauuacccgggagaaugcgguuccuuaagaaggacuaccgcaauccccacccccccuuuccugcccuugacgccgcgaugaaauacguggcccaccgagguggucuuaucagugcaaucgggccucugcgggugcuugcucgugugauucacgauuggcggauuaggagcacagaucugucccugcagguccccucuuuuguugucgcgcgcuuguuauuuuaaggcuugauacggguaagacagaaacuguugaggagggugccgugguggugugaaggauuaauccuuugccuugcuucacaucugaacaggaaucuccacacaaaugucccacauguggaagaaccuuuaaucagagaaguaaccugaaaacucaccuucucacccauacagacaucaagcccuacagcugcgagcagugcggcaaaguguucaggcgaaacugcgaucugcggcggcacagccugacucacaccccgcggcagaacuucuagcgaagcccaggaucuguccugugcggccccggcucccuuccccccagacaccucuccucgccucccaccccaggggcccaucccuacccucacugaccccggcucuucccugccugcagccgcaccugcagcuccagggaguuaacuguucuucugaggacugagaacucucuagaaagccacacacuacccccuuccaaaccagcaugugcuagauccuuguagauauucacggcucauuuuagagcucuguacauaauauugugggucuucguccggucguucugucuguuuuuguaucuuguuggaugcaccuagacauggaaaacgaaacgcaaauuuaucuuuaaagacuguauuuucaaaauaaaaccuuucuugauucag

SEQ ID NO: 7715 - RNA, 830 nt, Mus musculus
caugccgagguaccaccacuuaagagaaaaaccucaacaauuaacggagcccggagcagcgccgggacggcuucaggaggggcagcggcugggaaggucaagucgcucggaaucucuccgccccgcagcagccgcacucuccggccucucuccagccagucuuggaccugggggaaucucccgacuagagaccagagaugcccccccaccggagcugccgagccgucugcugcgggcgggacuaacggucgucacccggacgugcgggcgggcgugcgggcgggagacgccccugggaggagggcggagcggcugcgggccggcgcaccugggccgcgccgcccaccugagccgggagccucggccgagcccgccccugccaccuuuccccgcccagggcaccacccuccccaccuuccgucugagcgcucgccccgccuccccgcccucaucccuucgcagcuccgcccugcuccauccagcucucuguuggucccugcaucacugcgugcgaccagacuggagggacgcaucgguuagaaaaccugcagugccaggcaucaucccuggaaguguuucgcccgauguacaaagucaaagaauccuaucaacagcuuuggauaguaaaggcguaaauacagcauaaggacggagagguugacuuccuaacuauuugauuuuggguuaagagaguggcaguggucccugggaguccacuugaacuuguuagguagccaagacuguccuggaacuccugauuuuccugccuucaucuuccaauggcuaggauuacaggagugccccaauaaacccagcaacaccccccaacu

SEQ ID NO: 7716 - RNA, 3108 nt, Mus musculus
cggaaguuggcgaggcagcgccggaaaaagcuuuugcgugcucagagaagggacgcuucuuccagcuguggagguagggagucuccggcugaugauuuuggaaguaaauuuguggcaaaaccaggagagacacuuggcuuuaaaaucuuugugggcagccgggagagguagcacacuccugccauuugagcgcuuggaagcagagguaggagaauuccgccuucaaccagcgccuugacuuugagccuggcuuagguuacaaagugaagacucucaaagucuuuucaaagaaccaagcgcguaaauaaagauccccgguggaguuagucucgagacaagcuuugauggagcuauugcuccuaggucagaucugaauuccuuugaggagugagauugggcaaacaaaccucuccuuagccuauuaguguauuacucuuguguaaagaguaauacacucuaggaucgugaagacuguaauaaacauucccccugguguuuauuauuauugaaauuguggguuuuguuuuguuuuguuuuguuuuguuuuguuuuguuucgagacaggguuucuuuguguagcccuggcuguccuggaacucgauuuguagaccaggcuggccuggaacucagaaauccgucugccucugccucccaagugcugggauuaaaggcgugugccaccaccgcccggcgaaaauguguuuuauucuuaagacccagcccacaccacaguuugggggaacuauagguauagauaaagaauugcgacuuuuccuuuuuuuuuuuuuuuuuuuuuuuuuguuuccccaucuguaauacuggguauuuauccuugggccucugcaugcuaggcaaacauucuauugcguuuuucucuaaggccggaaaauaagaaccuuguauugcgucugagaaaaaaaaaaaagaggcauguuuugugcgaagacccugauacucagucuuugucucugauuucaggcacuaacaauggacgcucagaaagauguucaaccaccaaagcagcagccaaugauauauauuuguggagguaaaauugacauucauuuaaauaaugcuuuacuuaaaaaaacaaccaccacccaaaaauccucucuuacaugaguaaaauuauaacguggagcacuuuagcgauuguuaauguaaaaucccccucccuuauuaagaucucuuccuuuuaucuggaaaagguguacugccuacagcccuucuuucuccuuggucuguuuuggcaauaaucgggcacuuggaugcuuuggugccuuuugguuugcuccaguugaaaucuguaguuaucauuugcuucccccauaguguuucucuuucaagcauugaauaaaugugcuuucuuucccagagugucacaccgaaaaugagauaaaguccagggaucccaucagaugcagagaauguggauacagaauaauguacaagaaaaggacuaaaagauguauccuuucaagcacauguucuaaaugugcagaggaagugacuaauacuuggacugauaaagacuaagacccgauaaaaguaguaauaacuuuuggauuaucuauuuuuuaaguagagugcauguggacuuauuaagaaugagagcugagagaguggagacuccacaggagguacacccagauuaauuauuuuaauaggauuuauuuuucccaaaacuugggcggcggggcccggugaauucaaggccagcuuggucuauguuuaguauuccagaccagcuagagcuacuuagugagacccagucucaaagaaccaaaugggggcuagagaaacggaucagcagauaacagcauugccugguuuauccaagggcccauuucuagaaccaugauugcucacagucacaggugguuggauagacagaccccugacccuagggacccaaaugguacaauauaugcaugcaggcaaaagcacucaugcauaaaauaaaccuaaguaaagaaauuuaaacccuaauaaguacauuuucaauuuauucauuuauuuaggguaucacugaccauccuaaaacucuggccucaaacucagagaucugccuaccucuuccuacccccaaccuccaaauaccaggauuaaaggcauguacugccaauguguuucuucccuuuuuuuuuuuuuuuuuuuuuuuuuuuuguaaacaugauuagcauuuucauguaccauucauuaugggcucucaguaagucuuuuuuacuucucaggaaaucuuuguuuuuacuaguagucauuguuuguuguugguuaugaacaaucuaaaguauagaagaaguuaauaacuuaaugaaaaauagugaggccuacaaacuguuucauguuaaccaacacaaacucuuaaaagucagccugcucuacaaagugaguuccaggacagccagggcuauacagagaaacccugucuugaaaaaccaaaaggaaaaaaaaagucaucaauugcuucagugaguuuuuuaaaaauauuuuugcuuauuuauucuuuauauuauuauauguuacauuaguaauuuauguuauuuaucuuguauccaaaaaagugagcuacugaaaauggaaguagugcacuuuauuuuuuuagauaaucucugguggucauagugaacuucauucuuuuguucauuuucuauccaauugcaagcguggugcagggggugacuuggaagccuuagucuuauacaauuuuaaguacuguuuaaaauccuuaacucaauucaacaguggugguuuuugaugcucgaugaaaugugggaguucagaaguaucuucauucauacauuugccucauugauguuucucuuuaauguauagcauuuggcuuaguuuacuuaaugaaaacaacuguaugccuaugauuucauuuagaaauacaauuguauuuuaauacuuuguauaaaggaaauuuugguucaauauauggcuuaauuuauugcuuuuguaauccgucacacagugaagauuaaaaguguuuccucaaaccauuucuauucaaugucuuguuagaaagccaucaagccagaugacuugcuucaggcccugggauccacguaguggaagaggaauggacuccugaaaugggucugu

SEQ ID NO: 7717 - RNA, 1044 nt, Mus musculus
agaccgaagggcuguuugucuaaauggcguaaguugcuauuucuuuacugcacuucugauaagaaacugccuugaacguggaggacuuccggucuucagucuugcucauuucccagauauugcucuuuucuuucuuuccuuuuuuaaaaacagcucuagaacucucgaucgcagccaugccugagugggcgcgcagcagaguuuaggcgguuuggggugcuaauuaauucaggugcagaagagcagcccagucaggcgaagcuggcaccuggcccaugugugaguggugacucaccugcuggaagacaaucuggggaccguauagcuugaauagcaacaaauacuuggcuugauucaugcguggauguuuacggauuaucuagaaggaaagcuggagccgggaugauuccuaaauaggguaagacagguugacaaagucauaaaagcuacccaguaggaauaaaguccgcccacucaucagcucuguugcuaagauucuguguugauuccugacucagaggauggagcagcgugcagccaauuguucuggaagaacucugacuuugugggacucagagugccuuccuagguggucucuggaggggucaaauaacuucaagcagggugcugcugguucccauuuggggacuaccucugaagccaaggcugaacucccccucuccugacuccuccuccucuucucucccucccauucccccuccucccccauacugucuugccccuccccucuuccuucuccugccucccucucuucucuccuuuccucccaacucucuuuuccugucuuccccuccucucaccaccuuuucuuccucauugaucccucuccucucucucccuccuuccucuccuuucucccuccccucuccucuuuucccucugcaucuucagaccuucaaagaugcuaaucuucagauuaagaggauaccaaagauguuuugguaucagauaaucugauuuuuuuuucaaauauucauuauagauguccuaccaaauuggcuuccaggcuguuacaauggcuca

SEQ ID NO: 7718 - RNA, 1044 nt, Mus musculus
ugagccauuguaacagccuggaagccaauuugguaggacaucuauaaugaauauuugaaaaaaaaaucagauuaucugauaccaaaacaucuuugguauccucuuaaucugaagauuagcaucuuugaaggucugaagaugcagagggaaaagaggagaggggagggagaaaggagaggaaggagggagagagaggagagggaucaaugaggaagaaaagguggugagaggaggggaagacaggaaaagagaguugggaggaaaggagagaagagagggaggcaggagaaggaagaggggaggggcaagacaguaugggggaggagggggaaugggagggagagaagaggaggaggagucaggagagggggaguucagccuuggcuucagagguaguccccaaaugggaaccagcagcacccugcuugaaguuauuugaccccuccagagaccaccuaggaaggcacucugagucccacaaagucagaguucuuccagaacaauuggcugcacgcugcuccauccucugagucaggaaucaacacagaaucuuagcaacagagcugaugagugggcggacuuuauuccuacuggguagcuuuuaugacuuugucaaccugucuuacccuauuuaggaaucaucccggcuccagcuuuccuucuagauaauccguaaacauccacgcaugaaucaagccaaguauuuguugcuauucaagcuauacgguccccagauugucuuccagcaggugagucaccacucacacaugggccaggugccagcuucgccugacugggcugcucuucugcaccugaauuaauuagcaccccaaaccgccuaaacucugcugcgcgcccacucaggcauggcugcgaucgagaguucuagagcuguuuuuaaaaaaggaaagaaagaaaagagcaauaucugggaaaugagcaagacugaagaccggaaguccuccacguucaaggcaguuucuuaucagaagugcaguaaagaaauagcaacuuacgccauuuagacaaacagcccuucggucu

SEQ ID NO: 7719 - RNA, 14013 nt, Mus musculus
aucuacuguuuaaggaauuuuuauuaaagcaagaauuuuauaauccaaauuacguuuccuugcucagucaucaguucugcuccuuaaaacagagcugaugucccaagcuauuccacaguaaagaauuacaaaauuaaagaaaggaaugcuuuaaauuuuuguacuuugcugaaaauucuuuucccagggucuauaaaacauuaauuuguuuuuauauuuuacuauuuuuuuguauuuuuuuguuguuuuaaaucaaguaaucuaggacuagcacuguuugcuagaccuggcauuugcucgguacauaagguucaaaguuuccuuuccuuuuuuuauuuauuuuauauuuugcaauguuuuuuuucauaauauuuaaauuuuucgauguuuaagauauuuuucuucggugaagcacgaguuucuguucguggucccugaucaaucuguaaauguuaaaaaaagacauaauuaaagccccugccugaauucagugggucagucugcugccuguuuguacuggcacagccacacccacuccuuuaauacucacagcuaucacaucacauacaacauggcccacaaaaaacaggauucuaguaucuuuuuacuacugaccuuacuauauauacucaaccaagcacuaacaguuuccugguagugggacagagagagguccaagaaacugcuuaaagccaucacccaauuuuuuaaaaaguaccgauuaugaaagccaacuuccguuacagggcauugcauacaauuuacuaugcaaaaucuguuuccaaguauugacuuaaaauugcugaucaguauuuaaggugaaaaagauuucguuauguauauaccccucuggaaagcugaccuaauguccuuaugucuggaacaagcgggcgagggagaacucacuuagacaguuggaacaccaguggcacuguucacugcuuucugggcagccucuuucgcuuggugggcuuguaguacagcuacagcuucaucaaccuggaaaacauaaugguucaaggaaauuaauucucacccaaacacuuuaaaaugagcccuaaguagcagcauucaugaauccggcugcaggagcugaacaaacugaucugagcaagcuuugcaaucuacuagcaguaagcuuugagcaaguuacccaaaauagagaaaacaagcacuacagguuuaucacagguuuguagucaguauuuacauauaaagccuaauuguauacucauuuguauaagggcuccauuuacauguucugaagaauaaaccugugaaggacauaggcugaaagcacaaaauaccuuugagcggagagacucuggagacucgagcaugugaaguaauucugaguuaucaaucuccaacagcaugccagugauuuuaccagcaagagaagggugcauggcuuggauaagaggaaacagccguucaccuagaacaacagacacucuaaucagaguggcaauggcuauuaucaaccagggguuuaggaaccuaccuuauuuaauauagaguauguacuagcuaccacacccguauguauagcacaaucugucacaaggcagucacuucucuggugguaucaguuccucaaguguuugguauuaacauagacaaugcuucuuuguuucaaggcuagaguggaaugucaauggcaaacaguagcccaccauguuuucuaguauuccuucacauaccauccuaagccaucucauuuuaggugcaaagugucuaagugguccuuguuauuuucgucaacucuaacugacagaccaagacaacaaaguuacuuacccaacauuugcuucugcucuugcgggggcgcagaugccaacauggaagcaguuaaagguucuugaccuugcacaugaacagcaggcuacacauaaaacagaaaacccucuuaauauugaaguaaugagacauaaaccagccaucucucaacggauagucauaggaaggacagagugcuaccugaauuugaucuagagaagcugagagaaauacugacuaaaggucagcaaguacagauaaccaaccccauguggcacaucugugcuugagaugcaauuacauuuuagucuucuuuauaguuuuugguuccaggacuaggaaaaagauuaagucuaauacacccauccuaaacaagacaccacauagggagacugcuggcugcccgucaacuuucuucacauagaaccuuaauaagauggcccagguaagucuaugcucauagcuugugcaguuaccaucagaccuuggauuucagcugaacauuaugacccuugcaaauaaaugauuaaacuguaccuguugcaugguaacuuguggcugugcauuaagauguugcuggggauugcggacucccgcagcauauuuauacuggggaacggugcggacagcaggaguggcugcagcagcagcagcugcaggacguggacccauugucuguguugauguguuagcuaaagagaaaaaugacuuuaauugugccauuuuaaauuggggaucaaucuuuacagagagguuuaagacucaccaacacgcuguguugacaugacucguggaaccugugaggaagcuggucucaucguacuaaaugguggucuaggagcagcugggcggauagcaccgggcauauucuggaaugcugcauucaaaagaaagacccuguaugaacuaggaacuucacuaagugagucaaagccuaagcuuuccuagggccaaggguuuaugaaaagccaaaagacccuuacagaaagugaguuucaauuuaauaucugagauuaaaauuuaaaaaaaaaaaagcaggauuaaaaaguaacaccaagugcuccugaaacccagcuuguuauauaccauggccaaggaccaaaaugccacacauuacccuguagaaugaaagcuauugcuaccaaggcaaauuaagaauugaagcaaauacccacugauggcauuuuuuuuccuuuguuuuuaaacuuggagcuggguaugacaaucaguccaauacccaucuuagcagucacaaagauaagguaggaggcuugcuaguucagggccagccuaagcuacacaucuaaaaaucaaaaaaagccaaaucuaacaacuauaaauuaucaggagcaauuuaaucacuacaauaggacaaauuugccucauaugauagcacuggggaauugaacccacagccuagcacaugggaaguuaauuguuauaucacugagcuacacacaugcccccacucccaccccaagucuccaauucccagacacaacuaaaugaggcuuacgaugaggucuggcacccugagcaguccagcgaggacuuggucuuaguugagcaauuuggcuaggaggauaguaugcagcacgguucugagucuggguaaagaaaauaaguccacaaaacacaacuaucauuacaugcucucaaaacaacugacucuaccacccuugucauuugucuucccaaucgaauaacuuagugcuuuaucguggagagcuuaugaagccaaccugacuuaguuucuucuucacacucaccugugggauagcugccaugaaguaaccugaaggaggugcuggcugguagggguugaucacgggguugggcacagcucguacacuugccauccucugcauauacugguuagugaggugagccuggcgcucuucuuugcgcugagcuaaagcuacauacaguggcuucguggccacaauucuaccauucaucucuguaacugcuuuaguggcuucuucaggggaugagaaacauacaaaaccaaacccuuugcugcgcccacccuccaucauuaccuauaaagaaaaaagaaaguuagggaaaugauagaauaaccaagaacugucucuuauacucagucauugaaccaaauaaucuuguuaaugcuagaaccauccuguauuaacugaguuaguuccuuacaaucaauacuuaagagcauucaagguauagacauguaauauuacaucuauuaucugugguagcaacgagaauagaauugcacaauuaaaguccaacaugaaacaguccuccuuaaaucaagacaaccacacaggcacaucauuaaaugauuuaaacugcauucaaaggacaagacuacuucuuauucuacugacaaaucuguuaagaggaggagaugcccaggauugucuccaucugaacacacgucaccucagcaauuccaggcaguguuggaaguuuugucaccaggacacaaaggaccuuuauuugccauuuuaaucaucccuuuguauuacuuggcaaaccugguuuuauuuuaguaaauaaaagcuaaacucaugucuuuaguuuaguuuuguaguuuaguuugccagcccugugacccccagaaaaguuuauacuauauuuuaugucccuaccauauacuaccagcaaaagucaauucaaacaccauucagguacaacacugaaaugaaagaccuucaaaaacacuagaaauacuaaaucuagaaaaaacugcacgcuaaaacacagggcaagccaagcaugccuauguuucuuauuugcauuuacccaauauaccuguaaauauuuuguuucuaacaaagucuaagucuacguaagucuacggacaugucugggaaaucagaauuaaggggcaagguagccacaaaucauggacacuggauaaaacacccacagcuuaaguucuuaaaccaaaauccuagaauuuagguuagaauccuauugcuuugcaaucugacucccaagguuuuuuugaaauaggaucuuuucuacuuggggggaggcugacuacccagaaugaacuauguaagucaacagguaucagugaacacaguuagugauagagcagaaccuaaggaucaaaaacucccuagcuuaaaaauuuacucacacaaucucaacucaaaguauagugcacacuuacuuuugcacuggugauuguaccaaacggagaaaacuccuuccggagacgcucaucaucaaucccgucaucaagauuuuucacauaaagguucacacccugaaaagaagagaacuaugaagagaggcaggaagacuaucgugcuaccuaagcacaccuguuacuguagagcccacaucucuucucuucccucccaaccuguuaccuggaaguaacugaaaugaacauaaaacagguuuccucaucccugucuuaugugcuuguucgaguaaauaugaaccugauaucuggugauccuaucuugcuucaucugcucaaauuugcgcuuaaguuccgucugccguuccacuuuuuucugagcucguccaacauaaaucuguuuuccauugagcuccuucccauucaucucauccacagccuuauagaaaccaaaaaaaaggacaacaaaaaacacuuccguuacuugcgaaauacauauaucucauuaacaagaaaaauuuguccaauuacuaacauuaacaacagacucauccccaaaucuccaggcuauaaagggcguacacacucuaauacauagaaugcaaauaacugauuacaauacggaaagcuuccauuaauguccgcauauaaauguauacacauuucaauaauguauauaaauuucaauaccagagcaaguuuuauacccgccuuugauagaauaaaaaaugauuuaagucucuuacuuucugcgcaucuucaugccuuucaaagcuuacaaauccaaauccuuuggauuuuccacuuucaucugucauuacuuucacacuuaaggcaggcccuaaaaaaaguaauucagaguaauucaguaguccacuuaauguacacauuucauguccuaacauguaacacaaaagucccagcccucccagcccuaagguuuuacuggucuaccauaugcacuucuaaauacuguuugauuucuuucaagcuuauggaagauuuuauucuuagcucaguaguugucccuuuacaucauuaacuugauuuuucuuguucaaaauaauccuucaaagccuucuguuuuucaacaguaaguacagagaauggcuagaucugcaggcauaaaauaccugaaagaauguuucuuaaaacacaaguucugccuuccccuuuuguggagaccauaagcaggcucaggcacagaaagaacuaggagugauugaaugauggcccccauacaucucaauacuugguccucaguugauuggugggcuuugagguuuccaaagacccauaccauaaaaugcuuugugguuguuguaacaaguaagcucucagcugcuguuccacugucaugccuaccugccaccauauccccugccaugacggucauggauacaccuuagacuguaagcccccuuagccguaaugucuuagcacuuagcaaaagaaaagacaguggucuauagccaggcuguacaagaggugguguaagguuuuuuuaaaaaauaaaauaaauuaaauuaaauaaaaauaauccaaucugccuuugggaggcagcuaguggaucucuccaaguccaaccuuguauauacauaguaaguccaaggccagagacccaccccauaccaccaaaaaauguuuuuuuauuuuaaaacucccaggugcaagacaaaugauauacaagagaaacuugacugaaugaggugcaaaaaacaugacugucaucuuacaugauugguacuugugaagaaucacaauuccuuuugcuuaaaagaggauucagcccuguguggugcuuugugccuuuaauuccaggacucaggaggcaucucuugggaguugugugccugccagagcugcaacucugagguccugucuuugucaaagcucaacacagcuuuaugauguuagauauaauacagaacuagauaaacaaacaaaaaaggccauuccuaggcucaacagaaagggaggaagucaccuacaaauaauccugccuuccucgucuuuuacuccaggaucccgacaucacccaccuaccucacacuaaugucugcacucagaggaucuuacuuaauguggcaaacccuuuacaucuccucagccacccacggcucguguuggucacuguacagcauuccacuugcauauuacucuugugcagugaacuauagccuaauucaaaucaaguguuaaaacuuacuagucaaauauuagucauuaacuuuagacaauuacucuaaguauaaagauuuaacuuugacacauuaccaaacuugccaaagaguuccuuaaggcgcucaucauccaugucuucuccaaaguucuugauguaaacauuggugaacuccuuugcccuggcuccaagcucugcuucucguuccuuccgagauuuaaaucguccaacaaaccuaguaaaauguuucauaaagcucagaugaaggcugaugguuuacaaaauauaucacaaaauaaaaugucuucacugaauaaauuuuaaaaaacaauuuauaauuacaaagggaagaguuuucuuucaaugcacauuugaucaaguuagccaaggguuaaaggguucacuccugucaagagaaauaacuguucugugccaaaaagcccugcauacacgcgcuucuucauagcuguuucagaaugguccuacauuguaccaccuccuuaaacagaaauucucaauucucucuacuaauacaagagcuugaucuaauugcaguauuaucaacauaacacuaaaacucaauucuuccacauuauuaaauaagaugacauaaauaauaaacaccaaaagaagaauacaaacuucuguaaccccacacaaaaaaucaaagucaacuugaaggcuucuuguucucuguucaaaagcacagaaaacauaaugagauuuaguuuuuuuuuuuuuuuuugguuuuucgagacaggacacaaaaaaucaaagucaacuugaaggcuucuuguucucuguucaaaagcacagaaaacguaaugagauuugguuuuuuuuuuuuuuuuuuuuuuuguuuuucugcagcucuggcuguccuggaacucacuuuguagaccaggcuggccucgaacucagaaauccgccugccucugccucccaagugcugggauuaaaggcgcgagccaccacgccgggccagauuugauuuuuuuaauccucaaaaucaugggcuucuucauguaguuugguaaagaagaaaggauuucauuguagaccaaacuuucuggucuaaguaaugcuuuagcuuacuaugucuuaggacagucaccaaaaccacaguucaaaagaagagaaacuguauguacacauuuaaacugcuuucugauauggugccucauuauacacuuaagccagcaaccaauuagucuuuacuuggaucuuaccaguacaguauagacauucuuuuaauuuuuacuaaagcacugccguugaguuuuccauuaugguuacaaguuggggcuauagucuuggguuucaguauuuguaggcuuuaugagcuaagcaccucuaccugaaaaucaaauaugccaaaaucucaaauuuuaaaacugcuggauugcaaagaacacuuuggaguuccuauuucuacaucugagaucagcauuuccuucacuuuauaaaugaguauucuaagaguugggagguggugcgugucuuuaaucccaacacucggaaggcagagaggcagguggaucugagguugaggccagaauaauguacagaguucaaguacagccagaacuagaaaagcccugggguggguuuuucuuuucuguuuaugaaaccagaccaauguaacuucauauugguuuccaacucgugacaggaauaugcuaccagagguagaauuugucaugaaaaugaauggcacugucaacgaucaugccaccacuggaauuuacacaucuagaaagaacuuucagaucacuuaauaagugaccuuacacacuuaaugcgugagcucaauucucccagauuaagagaaaucaaucugcaaauucagcugcggugguaacauaccauugaucccagcacugaggggacaggcaggcagaucuauuaaguucgaggccagccuggucuacagagugaguuccaggacagccagggcuacacagagaaacccugucucaaacaaaaacaaaaaaauagaucuccacugacaacagccuuuuaauuuucagugccauuugccaaaguuuuuaacuuguguuaaaccaguuuauuucagauaagagaacaauacuucagaaaagaugaauggaaaccaccagugagcucugaacucagacuacugggugucuucuugcaacaucuauccauuucuuuagcuaguuucccuaaacaugaaugaaauaggcugaugaacuaguuccuuaguuuuuaccugguucauuuuggguuucuaugaugaguaacugacauuacugaucaugaaugauuaugaaacccagcaaauaugagucagugcuauauguauguaaacacaguuugauggaucuuuuugagauauucucauguagccuagcuagguugauccucugccucuaucucucaagugaugaaauuacaggcauauacuaauccaguuacauucuuuugagacaguuucaguauguaggccuggcuguucuaaccuauguagacaaggugggccucaaagaucuuacagagaucugccugccuccacuucuaccucucaauugcugggauuaauaaaggcaugcuacuaaguccagcuccaguucgcuguauuuuaagagcacauauuuacuuguuuuuaaacugauagagaacuauuaaaagcagacugaccauauccacuguagacguagcuauacuuacacuuuacgaucauuuagaagcaucccauucauuuuuucaauagcucuuucagcugcuuccuguguuucaaaguguacaaauccauagcccuuggagccauuuucaucacaaaccaccuagggugaaacagaacacucacuuuucacuacuugcuauugcuuuccuacucuguagaaauguuagccacccaaucccaggaacuucagaaauaaugacaguauuuaacagacagcacaaagaucucuuccaaaucuaaaaguagcacaacgcugcaaauacuaaccuguuauagcucagcuuaccuuacaugaaaggauguuaccaaacgcagaaaacguaucauauagugcuuuauugucgauggauuuguccaaauuuuuaaugaauauguugccuacuccacuuuugcgaagugauggaucacgcugagaccacaugaugcguacuggcuugcccuuuauaacaucaaaauucaugguguccaaagcacguuccgcuacaagagacacauuuucagaguaaguauuacuucuaacaccucauuagccacuuuguauaaaauuaccagugacagggaguaaaaggauagccauguggccucagcucaacuuccucuuuaaagucaagucuuaaucauuguaaugaacaauuuaucccacuuauuuuuggauaguuaugcuucacaacaaaaaaccuagccuauaauuucaaggccccaaaaaagauugaauacuuguauuaaaaaaaaaaaguguacuauaaaaagaagugcuaaagcugaaacuuuuuuuggauacaggaucucuaugcagcccaggcuggccuggaguccagccaccucugccauguacccauuaccugucuuaaaugaaaaaaaaauacuaucauuaaguaaagagaugagaccuucaagggggaaacaguccacuugaacaccugaagcaaauuucaaaucucauaauaauuguaguuauugacagaacaaguuuuucagccaccuuuucucuuuuucuuucuuuuucuuucagauaaggucucacuguguaucuuuggcuuuccugaacucauguagcccaggcuagccaagaacucaacagacaaacacaugugcuggguuuaagugcagaaagcaccacaguccccccaaccacuuuucuguaaaugaaauuucuagcuccuagagcacaguaaucagcagccagcucauuaucaauuggccacaccuccuaagcaccccugguccugcugacuuugcuugagcuugggguuuuuuuuaaugagucacaucucccuacaaaacugaaaacuggucacuagcagaacccuaguccauuacugcaaucgguaaggaaauacuguaaaaaggaaaaagcugguuuaaaaaaaauugguaagauggaacauugaacauacagccacaaaauaaauggaagaaagaagaggcaagauucugagcaguuggaauauugguccacugacacaaauguauaaaguuaacuauaaccauggcaauuugagguucggcuuuucaaaucccaggaccuuuaaaaccugggcaugucuggauuuaaaaaagaaaagaaaaccacuaaguuucaagucuuucaaguuuuguuuucauagaaguucugguuacucuaucccaagcuaccuuccuguaccuuacauucugucaccugccagaguugaaagcuguaaugaagugacacuaaaagugccccuuagagagcaaggggcaggccaccugcugugcccuucuacaacuucuggcuuaccagagcaucacuuaagaugcugcuuaccccaaaucucaccuuuaaucuagugaccacucuuuaauuccagucuuccuuacuaaaauaaaacccagagcugacuucuaaaucagagucaucuagauuuaaaaacccaacgauaucaggccauagaucuuaucugauucuuagauuucuguuucagugaauugucaaacuuaaaacaaacucaauguguuacuucuuaauuauugcccaagauucauggauauuccaaaccacuuuacgaaagaaaaaucaaagaagcuuucauuaguuggaugcuauuaacucagcauaauuugauccagguuacccuaauauuuaggaccaaaacuggucaacauguuuaaaauucauaaccacaggugcuauuuuagaaaaaauauacauauguauacauuaaauaacgacuucuauuaaacuuaagaucuaauuuguuugaaaaugagccaaggagucuggugcccuagagucuuccacauccccuccuccacggcaugguuaaagaauacuucaucuagggaaaaccccaagcaauuauauaugguauaaggugccuuuccugguccacaggucagagaugugcuauuaggaacgagcuuacgacccuaaggaccaccaccaccaggcaucacccuauuuaacuuucuucuaaagccuagggcuccucccagcgauugagccaccggcaggaacaggccucgggccugugagguuacaggguucaacacgugguauuucccaacacugaaucguacuuccuccccggccugacugccgggccagggcaggggauggagggguaccuccacccgccgcuccaggaggguacucgaaacccccgaaucccacagcuuguggcgggagcgcggugaaggcuaucucaaccacccuccgggcgcgucaucgcccuaaaguuugagagcgaccgauggcgagaaaauggucgcagaggaggaagugccggcccgcgaggggcugcggcgccgugcccucccgcccccucgcccgccccgcuaggcccgccgccccggccgcauggccgcccgcccgccacccuccggccugccgcucaccguccgccggcugcuggaaguucacguacgcguagcccaaggagcggcgggugaucaugucccugcagacccggauggagaggaugggcccggccgggcugaacuucucguagagcaucgccucggucacgucggggugcaggucccccacguacagagaggccaugggguagcugggggcgcugggguucaucucggcacggcugcccgcggggccgcaggccgcgaccuuucccgugagaggaggagagcgagugcggggccgggggacggagccggggggaggggagcgggggcgagcgcagagggacaaaauucaaccggaaucgacgcguacucaacggccguggaaccgggggagcgaggcuggcggugcuggguccgggcggcaggaaggccucggucucuggguuccugcuuggagcugcggggccgcgggcgggcgggucggucucggcugcuucaccggguuauuuuauaaaagaggaagaaaaaaaauaaaagucuccggcgggggagacgcggauuuuuuuguaaauuuuuuuuggguuuuuucaaaggauuuuuuagauuuuuuuuggauuuuuuaauaauaaauguguguuccgagcccggagcacacacuccgcacucucagcacuaaccgccggggagaaggggaagcaccgccuccugcacccucuacuuauaccccccgccgcacucgccccgcccacgcgcgucugacgccagggcccuacgcgagcgacggcgccggaggaggcggaggaaagcgcagaggaagggagagguggcggcggcugccgcugcugcgggcguggggguugggcccgaggcggggcggggcuucugcgcaggcgccacagccaggggccgacuucccgcugcgcaaagccaggaaagggcgggacggccagugggcggccucggcgcggccgcuggucacgccccuugcgcacacgccccgcccccgcccgaaagagcguuaacccgucagcgcagcgggugggcagcgcgcggggcuuccggguuucugggcgccaaccgccccccacgugcgcgucuaguggcggccucuucccuccgccccggcugagguucugcuucgcuagccccccacccccgagcggcgcuggaaacgggugggcgggcgugagccuugccggccggguuuccuaggugugcgcggaaggaggcaggguaacugccucguucuccuacccggaccgcacuacgagucccagcgggcagcgccgccacgcgcgugggccgcggaagcggugccugccgggagcuggaguucucaacggccgcgggcuggcugaccucaaccggaccccaaccgucccgggcgug

SEQ ID NO: 7720 - RNA, 834 nt, Mus musculus
guuuaaucuuaacaauacacuuuuauuaacugugucauuuuaguuaauauuaauuuuagaucuuuaaaaauuacauguaucacuccuucgccguugugccgagcccgccgaggaguugccacgagcaaagcccacccucccgaacugaagaaguuuauggacaagaaguuaucauugaaguuaaacgguggcaggcauguccaaggaauacugcugggcuuugaucccuuuaugaaccuugugacugacgaguguguggagauggcaaccagugggcagcagaacaacaucagcaugguggucauccgaggaaacagcauuaucaaguuagaagccuuggaaagagucugaccugugcucagcaagcaguguccacauccuuccccaaaggccuguuugauugugauguagaauuaggucauguacauuuucauauggaacuuuuuacuaaauaaacuuuugugauacucaaaaaaaauucacauguaucaugggcaugcauccguguugggggugggacaugucaccuguggaagcccagagucaguuugucuuucccuucccuuacauuaaaccccaggguuagaacucagguugucaggauuggcagcaacugccugcccaagcugagccaucuagccagcccaacuguguucauuucccuauuauagcuuaacaaaggaugcgcugggcaggauaugcaaggacauuaagaguaggcccucaagcugggccaugguggugcauaccuuuaaucuccaacauucaagcaggaggaucgcucugaguucaaggccagccugguuuacagaucaaguuccaggacagccaggg

SEQ ID NO: 7721 - RNA, 1045 nt, Mus musculus
cuucugcggcaaaagcuuuauugcuuacaucuuuaggagccagagagcaagagagcaagagcucuauugcuuacaucuuuaggagccagagcgcaagagcgcaagcgaacaagagccagagcaagagagagaaaggcgaaaccccgucccuuuuucaggagaauuauccuccgccuaggacgugucacucccugauuggcugcagcccauuggccgaguugucgucacggggaaggcagagcacauguaguggaaaacuauccuuggcacaugcgcagauuauuuguuuaccacuuagaacacaggaugucagcgccaucuuguaaugugaaugugagggcggcuccccacacuauaaaauacaauuuuuuuuuuuuuguuagcuccaacuguaaugaccuuuucacauuucucccuacugguggguucuuccugauggcugugcacccacacuucccacuacuuaggaugucugucgcugccuucaagcaaacuuagaggaaaaugagaaccugucuaagauucauuaaaaagaaacacaagccgggcaguguuggugcacgccuauaaucccagcacucgugaggcagaggcaggcagauuuccgaguuugaggccaaccuggucuacagagugaguuucaggauagccagggcuacacagagaaacccugucucaaaaaaccaaacaaagagaaagaaacacaaaaccuuuuaaguugauuagauguucugcccgagauccaggcauaagcggggucaucugaguagcccugcuucauuugugauuccaaaugcuucuauuucaccuugaauuggugacuuuuccuaagaagacauuuacaaagaucuagucaccccucacaggacacugaugacagacuaaagaauugaguccauucaagucuaguuuggugaaucagcaagcuuagauuaauuuacaggacaggagcaguggugacccaauggcagauaaauuaucuaaaagccucaccucagccuggaugaugggucaagaacuccacacucccggacggaccaagugg

SEQ ID NO: 7722 - RNA, 4849 nt, Mus musculus
agugaaacaagugguauuuuaacaaaugaguaaaagggggcagaguauuguagaggaugcucugaaaccaggcccagcaugaggaaggcaggggcaggaacugggcuuuguguguaaccugcagccugagguaaagagauggaagcuguguuccaagaggugaugggcagacagcgaugaaggacaagcaagccugaagcccaaguguucccauugaguacacacaccagugacagacgcuucaggaauggguuccccaaugcuucccuccaccccucaccccucacaauuaaagcauaguugugugauugcucauucugcuuugggaaggauguaagugcucaauaaauacuugugaauuaaggccaagacaucagcguucugguccuacguuacuugacgaucucccugcucuucucucugaaagcuccccauccugcaucccguccagcauccuccacuguuuaauauuuccuuucuauguucuaagggcugcugcucaguuuguuucuuacuccagggcacagccuggaaaauuugaaaacuguuuccugcuggcuguggugauauacuugugagcccagcuugugaggggcggaggccaggaacaucaugaguucagacacagccugagcuauguaagugaguucgaggccagcccagguuuaacggaaaccaggaaacagagggggugguggaaggagaaauaauggaaaggaaggaaugggaaacagaaggguaaagggaggggaagggaaagagaagaaaagucacuaagucccagaaaguagcuaggagugagcccuguaagggaagaacaguggacaagaagguagagucacacugagagcucugcagauccucggaggagggucaggagauuaaaguugcuccaggagagugagaggggagaugggaguaggaagacaggguuggcccugggagaagcaaaagcuucccuuugaaggggguuggucugguauugcuuguauuuaaaugcuaaauucugaaccccaagaucugguugcuccaagacaaguggguccucaccuguaccaacuuucauuuguaaaccuugcuccccaauuuaagacuauucauuaaauaaaacuggugacagccaguuacuguggggaauagagagaggcgggguuugaguuaucaagcugggggucucagguggggaccaugaggagagggaaauagaaggagcucggaggaggagaagacagagagaucaggaaguguucaugagucauaauggaccagcagcucaggccggguugaaaugccuccccaggacaccagacuccuggagcagaaauaacccagaaaauuucaaacaucaaguauuuaggauacagaguucggguaguagccagacuaaguuagagauuuagauuagggguaauugcacaauaauugcucagagccuaauaaauaaauaucauaguuuaagucucauucauuugaagcuagauaaagauuauuaaguauuauuuuacaucccauaaguagaccaggccccaguuugugucugagcuacaagaggcuuguaggccauguucauugggacuacacaauagaauuuguuuuucugaccauuuaaaaaaauggacaauuuugcuaggcgugguggugcacgccuuuaaucccagcacuugggaggcagaggcaagcggauuucugaguucgaggccagccuggucuacaaagugaguuccaggacagccagggcuauacagagaaacccugucucgaaaaaccaauauaauucugcaaucuuauuucccccaaggaaccagccccacaacaccaaaucuguauucuacuaugacaaagucugccagagucacagauuccuggcuggaugcuggaaaaaugggccucugggcaugacaacuggcccccaaauuaagccugggggcagugugacccuagauagugagggucagaaguaggagacuuguaaaguggucaggacagaaguaaccucauucuggccaaaacguuccugguuuaucccgggcuuguaucaagaauucuaugcaucaagaacuguaucaagaaucuugaugcugauggugcccaaguguggccuuugagcucaguaaccagcucuaaugcuugcuuauuucuaguaagagagggaaggaugugggaagaucaaguaugauccucaugaguaauugugguagcuacugcccaagauggucagcccaaguccucacuaucugguugguuguugguuuaguuuuugucagggucuguaaaggaacagucaaggacaccaggcuguccuugaacuugcuauguaccaaaaccaacugaauuccagauccgccugcuuccuccacugaguguccaccccagcacccaguuaugcagugcugcacugggaagcaagacugagggcuugugcacuaucaacugaguuacaccccagccucacaauguagguccgaccuuagccuuggccgguguguggucuuuagaggcuggacucccuggguccauuugcugccuguucucagagguucacaaagacacaguggaguauugccucucgcaaucaggauuccuccaacagccaguuccucucuggugggucuauccuggcucuuugaguguaucuuauggacgaguccucauugcacuaagcugccaugugucugcuucccuguguauccugucucguuugcucuaaggguagaaguucugucugauuuuucucuagaccagugugcaauccaucugccaggcacccuacagaauccuggccccaccuccuuucucaggaacauauuagguucuaaacgcuguacucaccagcucccuucacaccuagccaggaguuagggcgaaaagacagcccuggcugcuuucucaucagagacaauucucugugccugcagucucuguuagcgugcuuccuuugcccuacaaguccagacucuggcagcaggacuguaaaggacuccuuuucucugagagucugagggaguaggcuaauaaugucaagcugggcugucuaaugaaggaggagcugucuggagcagcuacggccaggaaaaauugaaugcaagccacacauguaauucuaaguugccucauuuaagaaugucagaggaaauguggccuuugacuuuaaucuuaccguguuuaaagcaaaauauuuacaauguuaguguuuccauaugaaacuuacuaguucacuugcuguuccucucugucugccucuaaauuucagaguguuuuguguuucuaguauaagccaccuagcaaaugcucagugguguguggcuugugccuuccauugcucaggaagacuagauccggaaaaccguuguguuuggagauggucuuuccugaauacuuuaaacuaucgcaugcuuacuuuccuuuuggugacuuuagggucagaugcauggccuggaagauguacccaggaggaggaaguggaagcaugggcagagaugagaugcagagguggggcaaguaugggguacaggaggaaguguugccgccaccuccucucucaccaaccgccuuauugaucugugaugcuucuuucagaguucaagguaccaggcaggaaugcgggucagcuaucagccggaguguggggauggcuuugugcacgguguacucagacgcugauuguuggugucuggagauccggcugcaguccagagguuggcauugucaagcaucuccugucucgaugcuguguaaagauuguuuuccaucaccucugauuggcuaauacagagcugaucagccaauagcuggacaggagagaauaaggcgggacuucggaucccagcaagggguacaggauuaaaaggagagaaucgaggucuccaggaaagucgaggaggacacugauggagcaguaacaggcuggaggagacuaagacagcagcaggcugggauguaggcugggccagcacaauuggguuagaauagaugagaacccugcccagcuauaaugcaagaauguuuuuauuaacuauuccagguuuccgugucauuauuucagagcaagggugagguguagaaaaaccccgacccauuacuccagaugugauggcucaagccuacacuuucagcccaugggggacugggacaggagggcuuuuucaaauguggggguuaccacauaagaccauuucucaaaaaggcagggagguggcuggggagagacuuagucaguaauguacuuaccacacaagcauaaggauuugaguucaaucucagaauccacuggggaaaaaaacccagacauggugguuuaugccuagcaauccugguccuggggaggcagggauggguggauacucagauccaacuuggagacccugucucaaaaacugaaguggacagaugcggagaaagggagucugaaguugacuuugagucugcacucaugcgcgcgcacacacacacacacacacacacacacacacacacacaagucagaucucuuccagggggaggagaaacugaguagcugacaaggguccaugggaaacugucccucaugauaguuggagguuaacaaagacccgcucagaaagcugggcauguaagauaucugucuuucaggcccauuucccacaaccaugcuggccucucccaagaccuugaguguuguauaugcuauuacuuacugucaaucaucuuguguccaaaagguguguuagagcaucuguacacagggcagccuggaagguaauuuucuccgugaggaagccaggcguugcuucagaaacggccaucaaaggucuguggggcuccuggcaagccuugaggagcgucucugcuuguuaguggugaggaagcacug

SEQ ID NO: 7723 - RNA, 1592 nt, Mus musculus
auuauccuccgccuaggacgugucgcucccugauuggcugcagcccauuggcccaguugucaucacaaaaaaggcagagcacauggcgggaaaacugccccugcacaugugcagauuauuuacuacuuagaacacagcugucagcgccaucuuauaauggcaaaugugagugcggcuccccacagagugaagcccaaagacuugugucaaggugcucaugaguccagcaugggacagucugggaaagccggaguuuauggaguuuauaggucaguggucuccagagguuggcagaugaagaugcagaauacagguuucuucagcuauuccucauauuuugaggguggcauacaccauuuugcucaaagccuguagaauagagacagaagugggggcugaugcagagcuagaacacacuacaguggcacacucguuguaacaacuccaaaacacguuuguguccagugacaaacacugcccucccccucugcuggcuccccuccagcuuccuacaauccaccacauacaaggugacaucagaccagaggagcggcucuaagacuucucuccaugaugcaacuaguguaugagcuguccugauuauccaggguccacaccaggcugcuggcuaaguaucuugaacuaugcugcugagucuacuagggagaauuuuaagaaaaccuccucccuggauuaaggagugggggagguuauguuggcuuuuuccuugcuuccuuucucccugccuuaacauaugguggagcagugugacagccaucuugugaugacaggguagcaagaagauggauauguucugggucccugauggaccgacgcugcaccaaaccuagagcuggcuuuucucugaaugcuuuagggcaugagacaagauggcugaauacugcaaauggaagccuuacuuccauuguuguuacuuucggauuaacucaagcugggagggagguguuugaaaaggaaagcaaggcucaggaaagcaggagaccuuacucaggcucaggaaagcagcuugggcugaagggaaagaguuucccaucagccuugccugcuguuaacccugauccuuccucauuccuacucagacccuuacucggcauucucgagucauuaccaagcacacuuaaaagaaaccauuuacaaacuaaaaagagauauacuugguucacagccaugcagguuuaagccugaggcugaguacucacucauauuagucugggcuucuggucacauuucgaggcaggagcugaagacaagagacucucuucucaggauuuccuuggaugacccuccuccaaccccccacccuaaccuaucugcggagacccuaucuguggaggcguuugccuuggccuggcgggaggguucaagugaagggguagggguaugagcagggagggggaaaugacuccacccgccuucuagugcugcuacuguuacugugcugucuacacccgccaagcuggcuggcgagcagagagcaggggagcuucugcucucaaaagcuucgggagagcguucucuucccaggcagugcuacagcucuugugacggaugcucucagaugauggagucau

SEQ ID NO: 7724 - RNA, 2569 nt, Mus musculus
ccaccuuccccaugcccuaaauaaacuccauaccaugccucagggggaggggaugccucagcgggggccuguggaggcagcccuuccaccucacccaccauacagcgccucuaccaacacgggugcugugccugggauuuagaaacucacagguugcaugagcucauauuuccgugcugccacauggacuuugcagccaugggauggaucucuugcuagaccucuccacccaagcacuggagaauugguaaagcucccuacucucacuggucagcauaaacgcccucuggucccaagggagggcuguugagcuugcagccaccccgugguguccuggucuucuuacugaugcuucguucucggaccucuaccccugggugagugcucucucugucucugucucucuuucucugacgguuuuucucuuggcuucucuugcacacugcugaaaaaauccuacgcuuaggcaaaccauccucccucaggcucugagccccacacacagcucgugcacuggucccgcagcucagcugcuaguucacugcguggcuggugaucuguuuuggcugccucuguuucuagcuaucacauuuguacuagagacaccggggaacggggaagucacuugcuccuauucucacccagaagggaauaucuuugcuagcacgucuccugguuaaaauuuggccccuauacccaucaaagaauaacucuaaauggccguuuacuggaacuuuaauagcaaacuuuuacaacucucuagcuagcgaucuguagaccauucccuaccccacguuuucuugcugcuugcucuccacucccgguucccugcuccccugauucugccgccaccacguacuuuccauccgccccucacucucuguucagggcggugcugccugacaauccugagcucuccacauucccccuugcugucucccucccuguuugaccugacuccacagcagccaguugacuagagcucuggcagcaaggacacagcugcagcuacggccccccagccccgccuacucaacccugccacccagugcucuguggcacggcgugaucucucgcgcgcgccccaccgcccugagugccuggagcacacuugcucuccaaccugagcagaguugcuagaagacagaacgcugcuucaggcgcugcucucuacucuugacccccaugcugauauucugcucugccaagccacaggcacacucccguagccaucgcuugccgccaagccacgccccucacgcugcacugcuuagauucaucaguauguuugucuuuguaaugcuucuguuguuccauucuaagucacacaggcacauuccuacagcuccauucuaggggauaacagugacuuuuagcgccaucuuaacuaggggaaguucugugacugucuuuguuguaggcagauaagguuuugcuaugcuauugcuucagugccaucuuagaugagggcagucauguggcugguuguagcuucagugccauauuuguuacaggcaguccccaguucgcugccuuuaggagugcagcuugccaaagucacuuagcaauuaagauacaguuuucccgucuauccugcuuugguaaauaaugauuucuaaacauuuaaaaguuaaagaccacugccuuaaauauauguuucuagccuuguuuuugcuacugccauuaaguuccaaugugcuuucuuuauuugcuagauguguucuagaacaaauaauuaaacaaacagcgguugucuaacucagauaugcauaauagauacuggcucucaaucuugucagaaaucugauaaauguaauguuaaauguuuuaacuuauuaugauagauagagacuuccaaaucuugacaguuuaccccccccccccccaggucuccgaagaagauaugggcacagugacaagauucuaccuggacugugguaugauaaccacugagaaacacugcuccauugccuugcccacugucaaagcuuggccuacacuguggauaaauagaggcuacccaaagaauuuaaugucucauauuggaucauuuuucauuucacauguaccauacccguacuuccuccacaggaaaagcuucuugucuucugcgaaugaggccagauugacuuugcccgagggaccacagggaccugggaacuguuuagguaguggacuauaaaccaaccugucauuuuaauuaauacaugacuagauuauaacuuauuauucccagauuucugauuacauugccaggucagauaacuacaacuugacagcuagaaaacagaccucuagcuccuuaucccaagguaauccaccaccuuauuagcuccauggucaauuuguuaacuagcuaagccugccagaucucuuaucaacgucagacagguuuacuugcucacagacuucacgauaaaggacacacaaguucagauguaagcuuucacagauguaaccuucuguuauuuccuuaucuaaacucaguuuccagggaccaaaugccucauauuuccucuccuugcuaugcuaucguccuaacauuaaccaauagaauugcaggaauacu

SEQ ID NO: 7725 - RNA, 2569 nt, Mus musculus
aguauuccugcaauucuauugguuaauguuaggacgauagcauagcaaggagaggaaauaugaggcauuuggucccuggaaacugaguuuagauaaggaaauaacagaagguuacaucugugaaagcuuacaucugaacuuguguguccuuuaucgugaagucugugagcaaguaaaccugucugacguugauaagagaucuggcaggcuuagcuaguuaacaaauugaccauggagcuaauaaggugguggauuaccuugggauaaggagcuagaggucuguuuucuagcugucaaguuguaguuaucugaccuggcaauguaaucagaaaucugggaauaauaaguuauaaucuagucauguauuaauuaaaaugacagguugguuuauaguccacuaccuaaacaguucccaggucccuguggucccucgggcaaagucaaucuggccucauucgcagaagacaagaagcuuuuccuguggaggaaguacggguaugguacaugugaaaugaaaaaugauccaauaugagacauuaaauucuuuggguagccucuauuuauccacaguguaggccaagcuuugacagugggcaaggcaauggagcaguguuucucagugguuaucauaccacaguccagguagaaucuugucacugugcccauaucuucuucggagaccugggggggggggggguaaacugucaagauuuggaagucucuaucuaucauaauaaguuaaaacauuuaacauuacauuuaucagauuucugacaagauugagagccaguaucuauuaugcauaucugaguuagacaaccgcuguuuguuuaauuauuuguucuagaacacaucuagcaaauaaagaaagcacauuggaacuuaauggcaguagcaaaaacaaggcuagaaacauauauuuaaggcaguggucuuuaacuuuuaaauguuuagaaaucauuauuuaccaaagcaggauagacgggaaaacuguaucuuaauugcuaagugacuuuggcaagcugcacuccuaaaggcagcgaacuggggacugccuguaacaaauauggcacugaagcuacaaccagccacaugacugcccucaucuaagauggcacugaagcaauagcauagcaaaaccuuaucugccuacaacaaagacagucacagaacuuccccuaguuaagauggcgcuaaaagucacuguuauccccuagaauggagcuguaggaaugugccugugugacuuagaauggaacaacagaagcauuacaaagacaaacauacugaugaaucuaagcagugcagcgugaggggcguggcuuggcggcaagcgauggcuacgggagugugccuguggcuuggcagagcagaauaucagcaugggggucaagaguagagagcagcgccugaagcagcguucugucuucuagcaacucugcucagguuggagagcaagugugcuccaggcacucagggcgguggggcgcgcgcgagagaucacgccgugccacagagcacuggguggcaggguugaguaggcggggcuggggggccguagcugcagcuguguccuugcugccagagcucuagucaacuggcugcuguggagucaggucaaacagggagggagacagcaagggggaauguggagagcucaggauugucaggcagcaccgcccugaacagagagugaggggcggauggaaaguacgugguggcggcagaaucaggggagcagggaaccgggaguggagagcaagcagcaagaaaacgugggguagggaauggucuacagaucgcuagcuagagaguuguaaaaguuugcuauuaaaguuccaguaaacggccauuuagaguuauucuuugauggguauaggggccaaauuuuaaccaggagacgugcuagcaaagauauucccuucugggugagaauaggagcaagugacuuccccguuccccggugucucuaguacaaaugugauagcuagaaacagaggcagccaaaacagaucaccagccacgcagugaacuagcagcugagcugcgggaccagugcacgagcuguguguggggcucagagccugagggaggaugguuugccuaagcguaggauuuuuucagcagugugcaagagaagccaagagaaaaaccgucagagaaagagagacagagacagagagagcacucacccagggguagagguccgagaacgaagcaucaguaagaagaccaggacaccacgggguggcugcaagcucaacagcccucccuugggaccagagggcguuuaugcugaccagugagaguagggagcuuuaccaauucuccagugcuuggguggagaggucuagcaagagauccaucccauggcugcaaaguccauguggcagcacggaaauaugagcucaugcaaccugugaguuucuaaaucccaggcacagcacccguguugguagaggcgcuguauggugggugagguggaagggcugccuccacaggcccccgcugaggcauccccucccccugaggcaugguauggaguuuauuuagggcauggggaaggugg

SEQ ID NO: 7726 - RNA, 1688 nt, Mus musculus
accguguucaaacuguguuaaaaauauauuguuucuaaaaaguaccuguaugggugcuuauguuauuaucuaaaauaaaauagaaucguuaaagucaguugcuaagaguggaaauaaagaacaaccaaaccuagugccguaauuuaauucccccaaaucaugugaccugcaaagguuuaauacagaaguugugucaaaucugacagcuccagugcuccaguguugacuugacauaaauguggcaaagcuuuccauacccuccuguauuuccaccacgcucauguaugggcuagaucccugucagaacucccacaaauacuuaauucucguagcagcgauuauaaaugacaccuggcuacuucgcacuguuccggaccagaagagaacccacacaaacaagucacuuucauccugcguuguuccccuggcaaccauauuaaacugcaaggauaaagagccuuuguaguagcugcuucuauugaauuacaauguaaauguugaugcuugccuagaaaugucaacgggcgacaggcuuauggaacagaugcaguaguuguuccgcagcgcaggaaucccaggcugcggagagaugcaagaggugcgcccgggccaccuuaagagucuauucaaccgaaucuccuuucuccauuaaagccacgccgcacuucauagauccaguucaggaaaggucgcucgacuaguugaaaacugaaaacgaccugcuaucuucuaugcaucagagcaggagaagaguuuguuguggauaagaaugcuaacaaugcaauuacgcaagagacccggcaauccguuccuuucccacucagcauagcguaacucuaguucccugacucuucugcccgccacacaguuuucgucccgcgagugucaaguggcagguggugaacuggccauuugguuccggguggcuuguugauuucuggguucagcauucugucguccuucgguuugacccacgguaccuagugucuguaguggcgcuccccgcuccgucucucccaucaccucuacccugccccuagucagggaagaaagccaaaaguggguagaagucagcucgcagagucuccagcgugccaccgcuccacucagguaaacuucgcagugagugaccugcacuuggagaagggccuuaccugagcgcgccucugccaauggcagcucaccugagggagcaccgcagccaaucaccgcgcagcucggcccucgggcuuguacccuuuagugaaagaauucagcgccuugcgagaaaguuaccuguggccgcccaaguccgccacuuugcgcucugugucugcccauugcagcgauccgggaggacuccgcgccgccgggccgccuccgagcgcgggccccaugugagggcucccuccccccaucccaccuuuccggcuaggugagggcgcgagcgagcgggcgagcgagaguggugaggggggacgaaagcagaauuaccuguagcucuuguucugccaucucgggcgcucucacacaccuucaccugcacagacuugaaaguccaguuucaccagaggcugaggcuccaggaaaaggggagcgaguucauuggaucaaacaugucacaagagucggacaaguaagugggucgcacgcgccggcggcggcugccgcugccccuuugggcugauggcaacugguuuguuguguuu

SEQ ID NO: 7727 - RNA, 4880 nt, Mus musculus
aggacugcaaacucaaaaagauggcucgauggguaaaaacacugacugccuugcuggaugaucugaauuugaucuucagaacccacagguaggagagccaaguacaaauugucuuguggcuucuccauuugcuccuuggcauguauccccugcucccuacaaauccgaauagugaagcacauucgugugcccagucugaaugcuaauaguuagacaggcacacuuuauguauagucacacauuagccuaaagugucucaugcgccuagguagccagcuguuuuuucauuugucucuuggaaucauagccuacagaaauggaaggcuuagugacuauauacuaccauauuaauuuagggaaucaacacauuuugccauauuuuauuagaaaaauucugcccucaggaaaacauaucuucaccuaucaagaaacggauugggguagugaguaaauaaaaauaaggcacugagcaagugccagaguaaauguauagguguggagugugagcaccagauuccugccccauguaaguagaaguagcaaacuuagggccaggaaggcaaugaacguucagaaauguggcacaggcgcugguuaugagaaacauuuuguaacacuagacuggucuaaauuauuugaacauuaguguguuugaguucaaaggcuaacaucugcuucaguauaauagcuugacuaaaacauuccauauacucugaaagaaggcaguaguguagaacauaaauacaugauuuagaaugugugaaacgcugaguuuaagacccaguauacccaaagcuguguccuaaaaggucuuuaaucugaaauacacagaugaagaaguucaaagacaauuuuguggauuugguucuccugccuuaugugaguuccagggagcaaacucaagccacaaucuuggucaccuaacauuuuugaauuaaugaauugugaugaccaacguuaacuuaggacuauguucacuuccuuugucuggugguuauccuggaugugccagugccuaaaauauuucugugggaaaauguucuucauacaguucuugaaacuaaagcagacagucuguauuauugacugcugauucauuugagcuaagugcuuuauucaauauggcuuugacaaugucacagcuacaacagcaaauacaaggcugagccacacuucuagacugaagcacaaucagcuguccaguuuagaacggaacucuucugccuacuaagaauccauugccaaaggcuuuguugauucccuagcuaccuguauguuuuuaaaccuguaguuaauaucacucauuuacugauuuaauauccuucacagcugcucacuggugaaggcauuuacacagaugccccccacuuuuuaauagacuuauucuaucuauauugguguuuugccuguauguauguauguauguauguauguauguacguauguuauauguaugucuguacugcauguaugcagugcccauggagcacagaagaguguguuaggucccuuggaacuaaguuacagaagguuguuagccuccaagugggagcugggaauugaaccuagaaagagcaguuggugcucuuaacagcugagccaucucucccacccuaggaagaugauguuuaaaacuauuaacucauucuuucuuguauucccauugccuuaugugaugcuugcacucuucugcacacagccuauucaaauuggcucuaaucucuacacuuccaaauauguaacccuccucuccacuggaggucuuucugaaugggcuaaagaaucaaggucaggguagaagagaagccacgauacuaggaaagccaacucucagugaagcuaagcaagaggagugauuucugucuugucugcuucugaaaucaaaauggcauuuguuuaugaccacugcuuauagcuuagucuuugguuacuuuuguacuucagucucucaggggcugagaagugauggaaaauaaaaaguugauuuaucuuggucucuuggacuacugugaguaacaucagcaccaaggacagagguccccacugcuucaaauuuggggugauuagcugcuuuugcagaagauacaaguuuccaaguacccuguaucuccagcuccaaggcauucaguacccuuuucugaacuccauaguuaccuacacacacagagauauaauauucauauacuuuaaaaacauuuuuaaagucgucuccuugcuuuaguguagguccaaacagguucuuccagguacuagagggaaagugcuguccaguauccacacucagcugaguggaggguugggagauacugucugcccugugagaagaccacguggaacucuucagcaagcugaagagaccuaauugaacagagcugugaaaguuguaagaaaucaauacaaauggagcaucaggaaagcacugaaggaaugcaucuccaugucugugcucugagaagggaggguuacuugggauuccucauauuacuuacuugaggaagcagacuggaauucugugccacgcuaagcauucauuuccuuccaaaauaacacauuucagggacuauuaagcaggucgccuuaucugcaucuaaaugcucuuccgugccuucaugcagaauuacucuuaaaaaaugcuuugagauguauuguuuugaugacuuugaaugaaugaauccuuguuuguaguuuauuugcuaugcaaucuuugguaaguuaucuuuugugagaaugacuuuccucccagaaaacuuuauaauauauaaaaaguuuuuacucagcauuugaucauauugcuccaagaaagauaacucgcuucagguuaauuaagcuuuagagcuuaaagcaaaauuucuauccugcuuucuauuuuagaggcuaaccaccaagcaguugccagauguugaagucauaacaaggcucuuuccagaaucuacugaaaaucucuuacuucuuuuucacguuuuugguuuuuggcuuugagacuggaucuucccaucuagcccaagacgaccuugguuucacgauccuccugcuccuauccaagaugcugggaucagagguguucaauaccauacucaacucuucuuucaccauauuauuauuuaauuuguauaucuuauuuguguuuguauacaagaagggguagugcuggggauugaacccaaggccuuguacaucaucaccuaaugagcuacagucccaucccgcucauuauauuuuucugucguacuaccauauauguaccauaugcugaaaacauagaagcaauucaaccaagaguauugccaccaucauuauucacugucuuuggcccuugcaauacaaaaguguugaaucucuuuacaacuuuaaccuuugcuuugaaaaguauccguagcaaggauauuggagucuaccguauuuugguugcuuaaucuuggcuauuuaucuucggguucaguuuaaucuggaacaugaaaauugcaguaucgacuacagggaaauaucucaaagauuaauucacauaaagggcuuagcagaauagaaccuaucagguugugaaaguucaauaaauauuacucaguuaaacaaucacaaagacuucaagguauuucccaggauuuagcuauuuuuccuacucauucucaagcuccauucacgcacacacuuucccccuccaguuucuccuuuugguugcugaaauacaagaguuccuuucuccuuggaguuuuuaacagugucgaccucccacccugcuuuccacaucccauccagugggcagcucuacagccacucuggcagucucuuggacugacugggugcaaccuaccgugucgcuggggcaccacgagggcuagggaaugucccggcgugccagucaccucguguaccagguagucuggcacaaguaggcagacugcaaauuccaguagacgcucuagaauucagagcagaugacaggcugggcaacagcgcggaagcugggggagcaagagugggcggggucaugcgacgcuaaagaacaggcuugaagugcucugguacugcggacugaacuuacgcagccgucgccggaguggggacccugcucagugaagagaagcgggccagccgaggaagcagaguucggcggcgaggggcggggccagcugagguaggcggaucucuggcggggcgggccggggccggcugagguaggcggaucucugagacgcuggguggagccggcugagguaggcggaucucuaggcaguggggcggggccggcaggaaaggcggaucuuucaggcgccgagaguagcgugccugggcggagccaccgcagagaaggccccucaaugggccggcuagaacccaggaccggcgcggcaaggcgugcccggagcaggaggagguucgcacaggacgaucugauccuacuaggauuuggucggccgcgcucaguuccucagcucggguggcucugguggagucugcgcgaugggcgacccggaaaggccggaagcggccaggccggagaagggugagguaaaugucgcagucgcuucauccuccaccccugggucacgcccggacuuuagguugcugcgagucagucgcagguccgcuguagaguaguauuuuauucgucgccgucagaaacacugugcaggccgaaaggaagcgcccucaccucaggcuaguguuggggagucgggaagggcgagcauggacgcugugcugcucugcucagggcggagcaggaacacucaggucccggcugaggaagucuccguguccccuuguucuccaaccucugcucuccagucuuucuuuucuugucgggagcccuggcgggugaaaaagggcugugacggaucuacgcaagagaggugaaccaucagaugcaguugaggaacucg

SEQ ID NO: 7728 - RNA, 111529 nt, Mus musculus
uacuugacauuucuucuguaauuuauuuaaaaaaguaaaauguaacaagauacuuaaaaaaaaaggcuagauacaaaaguaguuaagcugcucaagaacauuuaaaauucuccaaaauuuaaaauuuucaguauucaugaucuuauaaaacauuuuacaguuaucagaaagugcccaggcugaguacacauaaccuuaguacagacaucugguuagcacucaagugcagugugaccuauccaccugcacugaaagagggguacaaagaaaaaaggugacuguggcaagguacugugcgucggcccauuuuauguacagaaaagugccucucucaaaugaacacauuacaugcaaacuauuaguguauuuaguauccuagagcucaauguagcugaaauaacccacacuaaaagugagguuuuuauagguaaaagugguuuugucucuaaaauccgaaugucaagaacuuuuuacaaguuccauauacaugauacacaauugcagccaaccacaaauaacaccauaaaaaagcuaaaaugaaaacacagaacauacuuaauuuuuuauuuugaaauucccuauucccucuauacaagaaccuuugcugaaacacuuuccacaaaggcagcagugaauuuucagaacauuuuacauuuuucccccucagcaaaaaagauaaaucacaguguaaauuauguuguucugcugucaucuuuggcugggguuagaccuagaaguuggcgacuagcaaaccaucauagagaaaaggugccagugcuucucaggccuuuaagcuacaaacucagcaaggaauguuugcauuuaaucucuuuaagguaccaccggggguggggugggguggggguuaugacagcauuaacuuccauaaacuuuuauagacaaaugggaaaaaaaaucuacaaaauuagcuaguaauauuacacagcaauacacacuuuuuauacucuacacaaaaccaaaauucuuggucuuaauggcgaguaguaauuuuuguuugagaaucuguuuagaggaauagagugggacauaaagucgagaaauacaaguauuugcaguaggaagauguuggucaucugguggucuuauugugaucgagggcauaggcugaaaaccuucuucacuggcuggcaaugaugggcuagauguccagaaguaaaccuaaacaaggauauauaauuacaauguugguuuuaauagguuaauagucaccuugaauuccagcaacauaaacaaccccacuguguaaaacccaauuuaaaaacuaaagccucacuaacacaacugccuaaauauaagcuaaggacaacaacaggcauguuaauauggauggggagaaagcccaggaggcuucaaccauaaacacauuacuaucaacaauuaaggaauuuggggagcaggagaaauagacuuuccuagaaagcacucuguugguuaucgaauaccaaauggucagccuuuaaaacauacauccauccaaauaacauuauacaaacugagcaagcuuuacuuauguguuuagaaacaugagcacacagaggcacacagagcaagacggagacagagacacagagaaacagacccugaauuugaaaaagagcaagggaggcuuuggagagagaaagagaagaaaugauguaauuauaaucucaaaacaacuaacaaaaucucccuuaguuucaaaauuauuuucuuauacuaaaagaccaauaucaauuauaaugcaauaaacuacauuuaagaaaaaaugucaggauuaagggagaaaaaagggugucacauuauggguuuuuuguuguaacugucuugaggcccgaguuuucucaucugagacaggaagcuauugugucaagcuaucacuaagagccuuuacuauagcuaagaucucugaguaacuuacugggaaaaaagagaaauucuuuuuuaaccaacaaccccaggcuaguuaaaaagccauuuuauauuuuaucuacuagcaaaguaauaagaugcuaauuaugauacacaguaauuuuauaacaauaacugaauauugggaaauaucuacaauggacgaaauuucauacaaugacauauggaaugcuagcaaaaauuuauuuuggacaacacauagugccaaugauacccaguaagugucuaauguuacucuauuuauuacaaaauauuaaaaaaaaugcuucuuuacggaaauacguacuuuauaaauauaaaauacucugaaagaucuauccuucuauacauucacauaccaaucuucuaggacagaguuuaaucuaugguauuuacuuuguacaacuaagcacugaaauaaaucuaauaacuuuacggaguaacucagaaacuuaaguaauugggguuauuuucuaagacauaauuguguaagaaacaucaucuuagaacaguacagaggaaaaagaaggaacaaacccuccccaaaagaaccaggaacauagccggacucauccacucaguuaacagggaagaaaaggcuuacuggaaacagauuccagacugagauggagcuagagacugggucagcagggaauggaugcuucuccaaaagcucuggguuucauucccaggacccaaacaaugacucagaacucgaacucuaggcccaggugaucugacacccucuucuggccucugaagacaccacacacauaugguacacagacagacaugcagauaaaauacauacaggagaaauggaagagaggagggaaggagugggaugaaugaucaaccaaaguggcagacuucacagaaccuuuauccguaaacuguucuccaagagagacccaccaucccauccccgaaaacaaacacacacccaaaaaacaaacaaaaccaaacaacaaagcauagcagaccccuugcauuucacucuacaaguuuugugagacuucucacucaccagguccugccguucugucaugcucauuuucucuacuauugaccagaaccaccguuugaacuggaggagcuucucagcauuuucuccugagaauauaaauucaauguguuguuuuagauguuguuucuuuugaauacuaguaagcuuauauaaacagagauacauugaacuuuaaaauuuaagacaucuaauuccuaacaagaaacuaaagcuuuuuguguaacuacaaaccuguacaauuaauugggucauccugacucuggaugaguaagagagagugaccugucaccaccaagguugaugucagccucaucuguaaacccucuucuucugcugugacuuuaagccacagugcuccucaaaccacugagcuauaagccacaugaaaccuuuuagaagauggaagaaaaggacaccaaagagucuacauuucuacugggggguggugguggcaagggcagcgcacaccuuuaaucccagcacuugggaggcagaggcaggcggaugucugaguucgaggcaagccuggucuacagagugaguuccaggacaaccaacgcuacacagagaaacccugucucaaaaaaaaccaagaguguacauuucuaaaguuuucaaauuauguagaugcugcucaucugcuaucuuuacauaugauguuuguuuucccuucaauagacuuuguuuuaaaaugaaacaaagcccauuacauaacaaccuauaaauuaucaaccacaaaagguuaacacaaaaguaaagaaauaucaguuuagaacuuucugcaauuugaguuugucaugauggcacagcuuuaaucccagcacucagagcagaggcaguugggaucucugaggguucaagaccagccaauucuccauagacccuauuucaaaaaaaccuaaaucuauucauaaucaacuuccuauagcuuuaaauucaacacuuacuuugaaugucuaaaaaauaaaaaaacuucagggcaaaucacauacugagacaaagcuuauuugcaauuuuuuuuuuuuuugcuucuagaaugugaccuuugucuuuacaauagagugacccagucacaauucuacaaagcaaacauuaugugauuaaauucuuugacugucagaggcacaggaaacauuuauuauuuuuauuacuuuaucauauaaacaucauuuuccuaccacaaacaauuuuacuguguucuaaauuagagucaucuuuguguuugggugugaguauacacacacauauuuuuuucaacaggcucuucaaguaucugaaacagaccucaaacuucagauccuccugcuuuggccucccauaagggacaaaauuagaauaaccuaauucuaagcuaccaaaaccuuuaaaaguaguaguaugaauaaacgagcaaacccgauuguuuccagagcuugggaaacaggcucucagauccagacccucagaagggcuaugagcaagcucucaggcuuugcagugcuccuaccugacucaucauugaaagaagugaaacugaucagcaucugcacauugacuucaccacagccguucaccaagagccggaaguccucagcuguuaagucuucuaaggaauuuuuuggaagcacgucuaguagacccuuucucauugccuagagaauuuaaauuuucucuuuuauuaugagcaaugcucuaguuuccaaggcaucaguuacacuacuaccacucagugacuaauuucagaagcauucucuaacauuaguuccuaaauugaggagaaaaagagcagggcuguauugugacuucccucuuaacaacgucaagagagaaagagggaaaagcugagcacagcaaacaggcugcaguucagaaguuacuuaguguucuuacaucccaguagaaaagggaaauuacuuuuuaaauuauacaaguaacacacagacagcauaugaguauaccacuucaguuugguaaaagugcauucuagaaaacaguaacaacaaaccuccaagacucaaacccaaguucuauuaaaaaugugcccagaccuaagcugaauaccucaggugcauuaauuguucagccuuagccucauuuugcagaaggaaacccgugaacaaaaguauuaaguaaccugcuaaugugcagcuagaaaacagugagaggaggacuaacagucucaguaucagaauccccagcucaagaaucagaccauucauaguuuacagaacuuuuauccuggaaaggaaaagaacgcauuaacacugcaggaaugaugaaugaaagggccugaaugcagagcuggcccuugggucacugucuugagaacuucauguuuggaauacccucuucacugcugugacuagagcaauaagccuucugauagauaacccaauguuaguuguguuaacaauaugauagaaacaugcuuuccucuaaaacugcaguaauggaagcuggguguguagccaggaaacauuuauacaacuagccaccaauaaaaaacucaggccgugacucugaagguucgcgaagcaaugcugcacuuuagucaacccaugucaugcacugcccuauagagaacagauuacugagcuaauaaucacaaugcaaaaacacgaaguuucaucacaugacauagugcuuucuagaaaauacucacgugcaauggcuguucugcaaccaccaacauucuaugcucugcauauuuccuuacauacucauauacauucugcggagugacugguauauuuacaccauuuggaauaaguucaaccuacaaaaaaauucagcagugacauuuaaaagcaauucugacaagcaguaacagcucaugagaacuuucuaucuuacucauucuugauucuucuuugucaucuccuauaaugcucauuucguguguguguguguguguguguguguguguguguguguguguguguguguguaugcaugcaccuugucucaaucuuucucucuugguucccaccccaaacuguucuuuuuaaaaugagccuaacaacccaauucucuugcaaaagucagaaccuggguuguuuuaccuguccuccacccucuucuuuacacaggucaauugcaaaugccaaauccauugcugagaaaacagcaucagcaucugaacucugagaugcaaggaucaguugucguaaacucucauacauuacagggucgaaaaaagcaaagucaugccaguugaccugagaaaauaaucauaaaggagucaaaagaagcauccuuuuuugacgcaacaguaaauuaaaaucagugaugacuuuaccuuuucagggaggggaaggaagugauaaggauugaacccaggaacuugugcacacuaaacaagugcucuacuacugagcuauaucccagcccuaauuuuauuuaacuuacagguacagugauaaaagaauuucccacaaaauacauaaaacugcuuuaaagagagaaaaauuaauaaaucuuuggcuuugacaauucauuuaauuuuuuaaaacaggaauaaaaaauguauugcuaugaaguggagacaacagcaugcaguaguaguagucguaguuucaaaguaauugggaaagccagcacaauuuguuggauaaugauuaugugaauaaacuggcucuugacuaaauauuucauaugcucuuaauaguccccauaugauacagguccaagugauaaacuggacugcucugagaaacuugguaacuuacaaaggucacacacaucacugaguuaaacugaagucuagcagaucucaugagccaaagggucaacauauuagcauucagagcuuugguuuucacucaaauucuauguacaagaacauuuuagcugaaacaugucaaaacuuaaauugugaucgcaacaaaaaaagaaaauauauaccucucauuuuaauacccuuguuuaugauacauucagugguuugguuaaaagcaauuaauuugguucuacaaaugugaucaaauaucguggaaugagaaggucacaggcccuaguggaaaggcuucuggaauuauuuuguugaauggacacggugcacccaucaaauuguguucuaaaaauuguauauuuagugcugcugucaacuucugucaaaaaugauuuucagcagucagugugaccgaaaacucaacuggucaaaguaucaagaagaaccguugaaugucuagcuauaaauaaaugggagaucucuaucacccuacccaaggcucaguguucacugugaaagaaguuugugugcguguaagugaguguguguguguacaagucagagaaagcaacacugcagaaacugacuauggagcauagcaaggcucuuaaaauacugaacucagaagagcugugauuaccugcucaaggcuggaccaucaauacccagucaccgacuggaggggcucacagugcccacaucccccuaaccauuuauacaauuaauggcuaauauggagggacagaccauuuccuccagugguuuaaccacuggucaaguguccaugcuccuguaaacaaccuucaugauacauaaaccaccaggucacaaacaaaaacgagacaugaaaacacaaggugauuaaagggagcaggaaagggauacaacagaguggggaaaugaggugcaaucaaaaucaguuuacacaggcaaaaaugucguaauaagcucauuauuguguauaauuaguaugugcuaguaaaaccacuaaaggggguaauuaauagacuccagcuuuaacaaugcuauuuacaguagaugucugguacagccuucucuuuaaaaagacugauaaucaauacuuugugucaauuucuuuauaauagcuuuagggauuguucugauacagcuaaauuaacagcacacauuaaucuugccaagcuaucagacuaucaacacauaaagaaaauaagcugauucuaugagccagaggaauaccaaccaugucugccuuagacucuuggcccacaguggcacguguauuuuucaugcugaaguguuauuuaagacuaucuccaugcucuacugccacccacuugugacaaauuacaguggcauaggcuucugagcacuggcacaaagcuuuacaaaguugccaagagaauuucucuucaguagcaucgaggucugucaggaaccaagcauaacucuguuguuaccuacuuuacugugccagcuccccauguacaaaaacuuuaucuaugucauuaaauacuugacaauuauuuaugauuauaaugcuuuuauacaaagugaaugcuauacaguauacuaucauuuauuuugcaaaagaaaaugcuuacaauuguaaaagcaguuauaugcaucaaacuuacuuuucuaccaagcaacacuuuaauuacaugccuauucaaugugauaggacauaguucauuuugcaacagacauaguccaagaauccuaaaaauaagaacagaaauauaauuuaaauucaaaacuaauuacacaacuagucccacauacauaaacacacacacauauauauauauauauacaauauuuugagaaauucuccaagccuuauuucugccuaauauaaaauaguguacauauccaauuuaaaagauaauaauauauuuuuagccaagugaugacacaccuuugauuccacagcccugcgaggcuagcaggaagaucacaaacuugagcccagccuggccuacacagaaagcuugcggcuagaggaguagcucaguaguagagagcaugauuagcacggacaaagcccuggguucaauccccagaaccccauguccccagauccaaguaguaagaacaguuaguuuaccugccgauguuucugaaacaauucagccuugcuucuguguuuuugccaggucucggaguauaaaauccucucuucccagguugguaaaacaagggagcguugucaucaccaucaucuguguccucuaaauccauauccacuacacuucuacuagagccauggcgcuuucuguuuuccuaagaacaaaaugaugaggaaucagacucuugagcucauuuuuaaaaugaaauaguucucugaaauucgagguaaaaggaaaacagaacagcauucauguuuaaaugugugugcauaacaauauuaaagguguacuuuaauaacuauuaaagguaaagcuaaaacacacagaccuucugugcauuacaucuuuucucuaccuuuauuuaccuauuugcuaauuucuuuacucauuuauuuuuugcuuucuaacuuauuuauuauuguuuuauguguauggguguuuugcuugcauguaugucuuuggacauguauucaaggcacagcagaggcuagaacaaggcagcagauuccccugagacuagagauacaaacaguugugagccauggggcuacugggaauugaauccugguucucuggaagaggagcaaggugaucugaacugcugggccaucuuuccaccuucuguauguuaaauauuauugucuguuauucaaauaaaaacacguugggaccucaggucaauugggagaauacuugccucgaaagcagaaagcucuggguuaucuucuaaugcauaaaauagacaugagagcgcauguaugcaggagaauccccugaguaaauuccagguuaaucugggcuagaguaaaacccugcuuucaaaacaaaaugaaacaaacagaaccauucuuuuaccuuacugccucgaaggucguuuuacuagcuauaggguucuugauugauauuucuuucagcauaugaaugaugaaguucuacuguccaggaaaaacuacuauguguaguuucugguaagaaauccauuguuuuucaaaucacuguuuuccugcuuugaauauuuaauugugcuuggacaguuuuaguucacaaugcuugaagucuccugaccuugaauuuguaaaucuccaccuuagaagaacuggucagucuugacuaguucuugguaugcugaguaguuuaagagcuuagggagaguuguagcugguacuuugugaguauuaggugugacacuaaguugucuuaaacacugcauuuaggggagggggacuuuugguacaaaaggaaucgcaaugggccgauuacacuugaaaacuguuggguaugcuguuucagugcacccugcauaugcacacccgggauacuugggcaguaacugucuaagccuuugccaucuuucggauaggacaaaacaaggaucagcuugacccuccugcugaaaagacacaguacuagccaucuguccagcugaccugcucuuucuagucugcgcugcuaggcauuuguucagaaugugcacuuggugcugguuuucaguggcuacaaugaaagugauuacaggguguguuccuguaacuagcacuagacgcuaacuuaggaaacaaaccacaucaucccaguuucccauacugcuguccugugacauaguguuugcuuugcaacuucgacaucaacagcuuccuggaagaguggcuccuaagagucuauacugcuucuuuccucugcuauucaguucccuggaucucuaccgcucaauucagucuguucaaacauaaagaacaaaccaacuaaguuuucauuaaugccuagcaaucaauuuuauauuugacucuguauaguacaacuacaugucuuucucuucuguacuauauacaacaugaauuguauuugcaaagacagcucuuaaauccuggggugucaugggcaaggggaggguuuguuguuguucuaauuuuucauuaacauauguacugaaaaucccuuaccuguaccuuuucugaagagucuaauaauccgagguccaaaauacugucagcuccauuuucccuaaaaacaaaugaaauccuuugacaaucuagagaggugaaaugucuaaaauuuaaugugaaaguaccuauucauauuuauuacacauuuaaaagccaauuuagccccaaaccauggaacauguuuauaauccuaguguuugggagccugcauuccccaggaaacucaaggcuaguucuugugcuacacuggcaaggacacuguuucaaaaauaaaacaaacaaaaaaaaaaucaaaauacaaacaacccuccccccaaauuccauuagcuacacauacaauucaagacauggcaaaggcucccugauauaagauaacauacauaguagucuuuaugggaugcuaagacuagcacacagcaagcagcggcucuuuaauucugcuaucaggcccaaguguguauacuacuucuacaacuguaccuauccuguucccuauccaaaaugaugauugggaagacucguuaccuggggcuagggauguuaacacugugcugguaucuaguacagugguuugaauaagaucagccuccauaggcucauaauauauuugaauguuuugucaucagggaguggcacuauuuaagaagucuuagaaggauaaggagguaugaccuuguccagacagugugucacuggaagugagcuuugagguuucaaaagcucaugccaagcuuaguagcucucucccuuucugcugccaauagaucaggguacuaaacucucagcuacuuuuccagucugccacgcuccuuugccacgauaauaauaaacuaaaccuuugaaacuauacaccggccccaacuaaaugcuucccuuuguaagaguugccuugacuguggugucucuucacagcaauagaacaugaccaagacaucuagaauguacaagguucacaguaccauagaaauuuucauuuaaaguaauccaggcuuuaagcugguugaaagaguuagcccaaaacagaggccaucuaagcacagcagaucuuccugaugucacugugagcagaaggacuauuugauauuuuuagauuucauauucaaacaaauauacuuugcagaagggaaagaaaacacuuguacaaaguuuugagguggauuuggagcccuaaaagaaauguuguauuuaacaaaagaaguuaggagauuuccccaaaguucuuugagcguacuguagucuccugccauggguacucccaauggaggaaucugaggucuaacuucccauacacuucuuccaaauaaaauguuuccaagccagagucuuucaaguccuaucauucaugacucagaggcaggagguuaggggugagaggcuagcuuugucuugugaacagaacaauucuaaauaccaaauaccuccuauaaccuaauaagcauaaaaaauucagcuauugcacuuauguauuugaagacaccacuuuagaaauguaaagaaaguacuuuguauuuauagagauuuuuguguagugccaaggcuuagaagaaggggugagaucuucugggacuggaggagcagauggcuguuagccucugucugggucuuaggaaccgaaccuaaggccucugggagagcgacaaacacuccuagucauuggacuaccuccagccgugucauacuuguuaggacauagugaaagccgcugggucugggaauaauguagcugcugucuagacugaaaugucauuuccaccauccacauuaccguccaugagcaauaaugaguuccauggccucgucgacucucgcccucagagaaucuucacuugcuagaaggagaagcagcugagcuggggauaacuccaacagcaugccagugauuuuacuugcaaaugccuauaaaggaugagcaaauguuacuugaucaccuuugcugcuuuaucugauguuaaaagcuacaaucaaaagaacggaaagaaaugaaaagcuaaagaaacacaacugucuugugacuagcaaggcuuuuuaugaaacugcaaggucagacagcucugacacaggcggcacaggccaggaacucgcgguuuuguuggggcuagaauauuuguaugagccuuuuuaaaaaaggggguuugaauuccaagucaacauauauacaauuucuauaauuuuugucuuccucaaggagccacacaaaaucauuuaguacagaaaaaaaagggaggaagggggagggaaaagguaccuauuacuuaagacuggcuuacugcaacaauuuucuaaaauuucuguuuuacuagucuuuuuggcuacaacguauguacauaauucauaaacacaacuagcauacagguuucacacuguaugacaaaaaauugauaaaacagucaaauagaaaucuuaagcuauuuuauuaccaguaaaggacugccauuuuuucgcagcuacaacuugcuaauacaucaugucuacuucuaaaaguaacaaugauuugugcaaguaaacauauaaguaaguguaaaucacagcaaugaacacaaaggaaugcaaauuggguacaauuaaaauauauugaacuaagguaguagauucaaguuguauagcuacuuucaaacaacacaucacuccuucuaaauccccuaucucuguacagccauacauaguccucaaccauguagcggcuaaguagcugauaauuagagagggagaaagagcagaaaagaaagccauuuuaauucagaagggcaaaggaauuugcacaugcaguuaggaguggacgagugcccagcacuuacgggcugcauugcuugcacucggggguaaagccucucuccaagugccugccgaugagcuggaagagggucagggucaucacuaggauuccccucagaagcaggucugaaaggccuggugucaauggagagcugucuccugaagucucugugaaaggaagaaagguguaugacuccauuaucagcacaccuucaucacuagaaaaccacaaugcauacagauggugacaaccaugacaucaggaugguaugacauuuaaauacaaaauguuugagaaauacagauuaucuagguuugucucuaagaaucuacauguaagauauaauuuaauucuaauggagcaggaccaaacuccaaaagacuauuuaaacaaaaauaaguguaacccauuccaacaagagaaaauuaaaaguaauacaguuugccacaauuaaagacuuaauuaaaauagugaagcaauagcugcaacaaaaugucaaacguuaguaaauaaauaaaaaggcagaguaauuucaaauguccuggaaaaguuacagacuacaguucccaugcauuuguccaaacaacaaaucguacauugauuuacaaaaagccuuauccaacuugccuaaaauguugguauucaguaacaccuaaaauccaucauaccuaucccugucucuucgagauccugcacgcaagccacugcuccuccucauuucccguucucucucucucucccggucucuuucaccucuguuccucaaucuuugcauuaaaccuagaagaaaagaugaaauacaacacauugagaaaaguacaugaugaaaaauguuauauuucagucaaugcuaaaaagagaaaaacacaagaaaacauggcugcucaaaauccucugugcugccagggccuuucucuuucucuggggugugugcaguaugucguguguguguguguguguguguguguguguguguguguguguguguguguguguguauguguguaugucuaagugcacgcaucacagaugucuaucaccaugccuuuugauacaggcucuggggugugugcaguauguccugugugugugugugugugugugugugugugugugugugugugugugugugugugugugugugcgcgugugcgugugucuaagugcacgcaucacagaugucuaucaccaugccuuuugauacaggcucucucacugcaacuugucacuccacaacacagguuauaagcacauguaagccaugcccaguuuuuaauuugcuggggauuugaacuagaguccuccuaaucucacagcaagcacuauuacuaaaccauuuucuuaacuccuugguuucuaaggguuaccgaugguugcacauggcacaguacacuucacuuuaauauuugugaaccacacuuccccugucaugccaaagcuuugaaauaguaugcaacaacuagagcuagaucgauguccuuguauuugguugcgagccuagccuuuacuggcugagcccucuccagcccuugauuucauuauaaacugugcugagauuucuuaaacaauugaagccacugaauuccuuuucuuuuuuucuuuuuuucuguuuguuuuuuuggauuuuucaagacaggguuucucugcauagcccuggcugcccugguacucacuuuguagaccaggcuggccucgaacucagaaauccucuugccucugccucccgaguacugggauuaaaggcacgcaccaccaugcccggccugaauuccuuuucuaaguuuuugccuuugagcacuauagaccaccagaauauuaaccauuauuauuuuuaaauuccaacagucacucccaacuacgguugcuuucuuuccuuuuuaacuguuguacccuaacaaauggcauacaugugccacggcacauguauggaggucagacgacaacccagagaguugguucucuccucccaucauguggccccuacccuagggcucaaacucagggaaucaggcuuggcagcaagaucuaucucagcuguccuggaguauggcuucuuaaugguguuugaaaagguuauuucuaaaauguuaagacugucaaaaucucuuugcucagaucuguuaaucuucuuuuacaguaaguuaaaugguaaaagugcugaucaaaggcuggagaacacuuguucacccccuucuguuucugaaacucaugcagucuucauggcgacggaucacauauacacaaugagauggauguagccuaagcaacuucuauaaacuuccucugaccuaguacuacagucucuuauaaagcuggcaaucuucugacuauacuuggcguguaucaccaauuaucuauagcuugccauguccucacagcuauaaauauauucauugaaaagcagggaagaguccuaacccacaaguggggaguucguuuuugcuguuguuguuuucgguuuuuuguuuuuguuuguucauuuuuuucgagacaggguuucucuguguagccuuggcuguccuggaacucacuuuggagaccaggcuggccucgaacucagaaaucggccugccucugccucccaaaugcugggauuaaaggcgugcgccacuaagcccagcggggaauucauaaugaagcuacaacuccaagauuuuaauuaaguaaagcccuauuuuuaaacaagaagacaaaacaaaaacaauaaacaacaaaaacaaaacccuacugaaauuaaaauaagcacagugacauagcugguuacaugucucaagcucuuuaccucacuggcaucauagcaugguugugaaucaaugucaaaacagccugccagagaguucuguucucucauuaaauaacuaucaauuaauaaaauuagucaauuaaagacuccaacucccucacuggauuuuuaugguaacacuuaaaaucuuaaaaccugucacccuccaaauaacuaacaauugagguauccaagaacauguuguacuaaaaaaacaaauuguccaauuguuaauucaagcaguuuggucaagaauaaaucauaaucuaaaauaauaucaaauuuauagagacauagaaucaugauuaccauugcugugacaaacaagagaaauaauuaugcugcuuagaaucuguagaguacuuacuuguaugaguaccuuuguuggcauuuuggauacaaucuagauuuggcaauuuuucauuugauaaaaacgcuugugcaauggcuguauagaaacuucuugcuacaccacugcccucuccugguucauccuuaaaggugacuuugacucugugcacagccauuggcgugguagcacaucuucggccaaaaugguuguuaagcugucucauagucugcugaaugagaagaucccgaucgcgaucgaccuauuacaacacacaaguaguuaaccagggcuagaaaccacgggguuucuguuaagccuaaaacagaaucucaccuuuguagcacacuguaagccuaaaacagaaucucaccuuuguagcacacuguaagaaaucugaggucucagaggcuuuuauacuccaaagcaaagaagaauguccuauauucaagcagacuaacagaauuuaacucaaugugcacacccucccucccucccuccuuucacaucuugguauguaauucuggcuagcguaaaauuuauuccauagcccagaagggucucaaacuaacgaaccuccuauaccacuauuaccuccacauacucuccagggacagaaaguuuaagugugaaaaauugcauacucaagaaaauaccugccaauuccaucacacacagagacacucaaucacugaaugcacaucgccuaaacacugauaaacaauuucuaacauuugagggguuagcaaaguggcucggcagcuacaggcaagaacgaugaagcacucuaacuuggauauggucuacagacaaagaaacuacaaauuaaucuuaagccguaagcuauuaucaauaucauuuuaaaccagaugugguagaucaugcuuuuauaaucucaaaacuuguuaaauugaaucaggaaaauugccagaaguuuaaagccagccugagcuacauaguugaguucuaaaccagacuagguagguaauagagugaauccugucucaaaacaaaaaacgacaacaaaaaaaaguuuuauuggugauaguaauguuguaagaugcggaguaaaagcaccaaugguaaaaaaaaaaaaaaaaaaaaaaagcaccaauggugagaagcuguguauucccccuagaagaaaggaauuuucuuuccauucaaauuuaaugucucaguauaaauucacaguaauuucuuaaaaggccuagaaacacgaucaacuuaguagaauaucuaaccucaagucagagccccuuuuuaaccuuauaauacaauuucuuaaagaaauaguuuaagacccguggcaagaaaugcacaugacauacauuggaaaguaacaaggaaggcuauuauggauaauauugaggcaauaaaaaggacaaaaggucaaccagacgaacuaaccaucaauaagaauacucugaguggaauucaguacaucagaaguuuuacaguuccuguuuauguaaugaagugugugcaugugugugugcgcguguguacacaugaucaugugucugugcauacaugugugcagguuguuugcucaugcaaaugugugaaggaucagagguugacauuggguaccuuccuuuauuauauucuaccauauuuuugugagauggggcucucucacuauuucagcaaggcuggcuaaccaaggagcaagaauccugucuguaucuccccaccaugccaccgcacuuggcgucuuaugugggugcugagaucugaacucagguccuuaagcacaucaccaacugaaucauuuccaaccaaaaacucucuuuuaaaaaaaauuacugcucuaaauucuguaauuauaauuucuuuaaaauuuuaauuauaaacauguaucuaucccuaagcaauauuuauuauuauucugaauguuuaaguguggcauggcauacuagagauagagaaaaucuaaauaccuuuaccucuagugauaaaucucuugauugcugguuucucaguuuuuccaucucucuacggaacuuugauucuuuuaccucaaaaccacccaauucaguuaaaaucuuuaaaaacaaaaacaaaacaagaaaaaagaagcaaaacaauuauucaauaaaacuuguucuuagcaugcagaauacaauuaaagugcacaaaguacacaccgauccaggcucugcaccaacaucuuccaugaauacucugccgaacaguucuaaagacaggcgccagcgucccagcagcaugucaugggagauaaccaugcccaugaaacugcacugaggccugggaaaaauugaaauaaagagagaagaaagcaauuaaucaacuccuuaaaaucaaacuuuuugauaguaccuuuccugguuuuuuaauauuuugcucucuuaaguauuucaaaccaaccgggcgugguggcgcacaccuuuaaucccagcacucaggagacagagacagacggauuucuggguucaaggccagccuggucuacaaagugaguuccaggacagagaaacccugucagaaaagaaaaaggaaagagaagagaagagaagagaagagaagagaagagaagagaagagaagagaagagaagagaagacaagacauuucaacccaugucuuauuuaaugaaagaagcuugcuaugcugaucgcuccuguguguaugacugauggugccauccacauccacagcaucaggaggccuuggagcuucaacucccacuguauuucacuuccucuccucaggucaaugucucuuggauccccucuagaauuuguuaucuacaucagugguacugaauuaaaguguaacauaaauaaaauuuauuaauggccucacgacaacaauauuuccuaguaauuuuuaucaaucaguacuguuucuccacugcacagacuugaaucacauuuuccuaucuucuguuccuccacugauauaguccaacuuccuuugacaucauuuccuuucuaugccuaaagcuaauuugcaaacccaacaccauucuuccucaccagguggaaccacuucagauuuuaacugguauuucuaccucuaauucuuuucuccaaucugugucuauauauuuugaccagcuccucacauaugucuaagucuaggcuauuuuaguauagaaauuaccccaugcccuuuaugguugguagacauugcuuauucauuuacuaguuaacaucuucuaagcauaccuuauuucauuuacaaguaagcaaaaacacauugucuuauacuucuagccaaaaacuaggaguaaacaagagccaacaucuggugauuaagcaucaguauauaccuguaacuucuuauuuaauaaauaaaaaccuacaauggccaagauaccauuugugaacccuaauuaaguaagccacaaauccugaaaauuccauucuuuccaguauuuacagguuagcugaacugcugauaacgucuaaauuaauaguuuuaaaucauuauuaaacauuaagaaaaacagcaccuuaaaauacauaaaagaaaaagaacaauuuuuaauuguuaaaguccagaaaacucauuaauauuuaacuaucugauauuaaauuaggaaucacagaagaguacaauaaauuauaauaucaauauacaaauuuacaaauuaugaaaucucuaaauaaaaaugaucguaaaaguauaauaagaguaccaagagggcuggagagauggcucagugguuaagagcacugacugcucuuccagagguccugaguucaaaucucagcaaccacaugguggcucacaaccauccauaguaagaucugacauccucuuauggugugucugaagagagcuauaguguacuuacauaauaaauagagcagagcagagcagagcagagcagagagcagagggagcagagcagagcagagcagagcagagagcagagcagagcagagcagagcagagagcagagagagcagagcaaagcagagcagagcagagagcagagcagagcagagagcagagggagcagagcagagcagagagcagagcagagcagagcagagcagagcagagagcagagggagcagagcagagcagagcagagcagagcagagagcagagcagagcagagcagagagcagagagcagagcagagcagagcagagcagagcagagcagagcagagagcagagagcagagagcagagagcagagagcagagcagagcagagcagagagcagagggcagggggggacagaucacauuugaaaaagaaaaagagccccaagaguauugcuccauguaggaguaccugaaagauguaagggggggcccuucacuuuccgugaguccuaucucugcuaguaaacugcuuuucaacugggcagcaacaucaggagcggauggaccuggcuuugaacugucagcuucuucggccagcaggcucuguucuuccccuucuuucuucugccgguuuugcauguucauuacauuuuuuagauuggcagcauaagacauuuuaguuggaagaaccuauacaguauuagguuugaauaaaaaguuauauauuaaggggagaaaaaagauuuucaacuucacagcgauccacaggaaccccagguaguuaacagugcucccuuuccagagcuuuccccaaucaaagugcaaucugcgcuuggggaccugaagaccauacuccagugugaacgccagaagcgccucagaauaucucaaagcaaguauuuauaauacuaucucuggugcuucagguccuacauauucucaauaauuuuaauacaagauucuccuuaaccaauuaauuacaaaugucuauucagcuguauuucucuuaugcagccuuuaaaugcaauauuguuuucccccccagaaaaauaacaugacuuuccaaaaucuaaaucucucguauaacuagcuaugauaacugaaauucccacuugaaacucauaaucucgucaagcuuuauuucuuaguguuuucuugguuauaaagcaugaggcaguaccccagagacagaaugaauuauuuaggugugugucauuguuaacgcugccucuuuuaaguaauuuuauucuucauucaaguaacagcacaucaagggaaaaaacuugaagcuaaaauuacaaaugucuguauagaaguauucuuauuuagaaaccuaaauuuuaagcagcauguauuaguaacccucugaugugugaaaugaguugacacuaaaaaccaguaaaaguaacagcuccagucugcugaaagaaaggggcuucugacacuucuacugcgggguacauacucugcacuuaauacaucuccucauaucuggaugcgaggaaaacugcuaauuaagaaauauauuauaaacuuugacuaucuuaccucgagacaauuucuguccauuguaaccucuacuaugcauuucccacuuccggcagaugaggaauaaagacccugacuugggcgaccaaaaagaucuuccuuucuagcauuuggcuggaauuuuaacaagacacauuacaguuagauugaacauuucaaaaucaacuaugaaagagcauuagaucuguuuaguucaccugcaacaaauguggcugaucagccaaggguauggcuucagccaaaggcacuucaaauggauuuggagguauacauccaaggaaugucauagagucugaacgucggaaaaauggaugguuuuggccaguuucugcaggaagagagucgucauccuuaucauucaaaguagcaccuaaacauuaaaaaaaaaaaguaauuagaaaggguagaaauguuaaccucuucaaucuaaaaugcuuggaaucucuauuaaauauuaauauacuagaaagcaaguuaagggcuggagaggaaauucugugauagagcucuugcacagcauguacaaaacccugggccuguguuugaccccugcagugcaugcauacacacacacacacaagcacucaugcacacaaacacgcaugaaugcaugaguuaguaauccaaacuuuuggcauuuuguaggguuuguuuuggaaacagggucucacugugugacguccuuggcuguccuagaacucuccaugaagaccagggugaccugccucugcguaccucaaugcugagauuacaggccagggacaccacaccuagcuuuuggugguuuugguuuuuuguuuuuuuuuaagugacaauacaaaauaauugaaugcauuauuucauuauuuaucguauaauaauaaaaaugaaagaauaaaugcuguaaccaauacugguccauucaauuugaauaguuuccuuacauccucucuuuagauagagagaaugaagucauagauagaaugaagccaaaaauagcaguuuccucagcauaguucaggacucaaccugauagcaccaaaagcugaaggcugacuauuugcuucccaugcugaaugaacaaggagcugucucaacaauguauuuauccagccaacaguaacagaaacacuagcacaccagcaacagcucuccuuaauggaacaaaacuuuggcaggcagugcuuacuaaguuguagaaaguaaauuuuggcuagauuuucaaaaaaggaaaaaagccaaacccaccaucacaaacaacaucaucaucaauaacaacaaaaacccaaacuaguggucuuuucccuaaacuaauaaaaguacuugcugggaauaaugaacaggaagcugggcuauuuaaucccauuuuaaaucuuuaacugucaauuaaaauaaugaaaaacuacagguugucucuacaacagcgauucucaaccuuccuaaugcuauaacccuuuaauacaguuccucauguugcaaugauagccaaccauaaaaugauuuucauugcuucaucauaacuguaauucugcuacugcuaugaaccauaaaguaaauuaucuguguuuuuugauggucuugggaggccccgugacggagucauuuaacaaggucccacuccacaggaucagcugcccuuacaagacucucucauuuuauggcauuaaaacuuuucucuuaguuugcauguucaagcauaauuuacauuuucuuaacuaaaucuauuuugcaucaauauuaacaaaggcuuucauaagacuuaaaaguaaugguaaauguaaacacgaaaucaaaaacgugaaguaaaaaaaagauguauggauauuggaaaauucagagcauuaacucagucuuaauuaugaaauguauaaugcaaagauguauaagaaaagugacagaaaagguuaagagauucaacacagagaagaaaagagaaauucccaccccaacagaaaauaauguaguuaaaaagccuggaggaaauacugaggcagccauuucuuaaagaagagugggagacgcucugggcacuaacuuugacuggugucaucaucauuuucauguucugaaucuucauuaucaauacccaguuccagaaguucucguguccuuaaaaagaacaaugagugagucauuuaaauuaacacuuaugugguaugaaaaagaacacaggugagaggaacacuggagaugucacuggguaucuaacuugagugugugugcuuguggaagugugucacagcuuguccauggaagccagaggacaaucugcaggaacugaauuuaauugaacucaggugguuaggcaagcgccaucagacaucucaucuggaaccaaacacugcuguauaguuucagaaaaggggaaauaguaaaguggucugcuuaaugcauuacaauaacaaaaagcacuuaacaaaaccuccccauccgaaaagaaauacugaguguccacacaaacucccccccuccucaauacaacaauacuuaaacacaaaugucucaacuaauagguuuaauuagauuuugguuucuccuuuuaagugagcaguugcuagaggauaagcccacuuuucgacaugaacaaucuuuguucucuuuugcagugcucaucuccuuauccaaacugugaccauuuacucagauaccacacaggaguucucaaacaaaaccccaaaauauggauauaccuuuugcguuccaguugaggagugucuaauguugucugcugauucauugcuuuaauccaguauauaagggcuuggaaaacauaugccacauguuucaaugagcacacauccaauacuggaagaacaucagaaugcucaucauuaugagaucucauuaaagacagagcauaauugagaaagucuccucgagcagacaucauucccuggcgggcgcucagcaauguagcacgucuauaggagcaaaaacaaaugaaaauauuuauaaaaaccacaaguaugaaauuucauaaauauguaaaauuuagaauugaugacuggacuggagugaccuuaacugaugcucaucaguuaagagcacuugauauucuugcagaggacccaggugaguucccagcacauaacgugguggcagucaaccaccccauagcuccauuuccauggggaucagacacccuuuauggccuccuuggauacugcguguacaaagcacucaaacaugaaaauaaguaagucuuaaaaagagaaaacagaacauuuauaaaugaucuuuaaaaauaacacugauuaugacugaaagaccuacauucagggugucugcugccagucuuaauaggucugaaucugcauuucuaacaaguugucaguuaaggccaaugagagaguucuaggaaccauucugagaagcacuaccaugcugccuaguaguauucugugucaaccugauacacgcuagacucagcuaagaaggaaccaucuaaauggcuccaucagauugccuuugauuaaguccuccuuaugauugaugugggggaucuagcacacugcacauaggugcuguaagaaagcaggcugaguaaguccuaaagaagccaauaguaaggagcuuccucuaacaguuccugccuccugguucgagucugaguuccuacccuaacuccccuggaugacugacuacaagcuguaagggcuuggaaaauaagcucuuuccgcccuaaguuacagugauagaaaagggaccuaagacaauacaucaaaaucacaucgaaugacaggcaugaugacucaucccagugcuuuggaaaugggaggcugaaagaugagaguggagcagaccugggcuauguaaccaaauuugaugucagguuacuacacggcaaaauagcuuaaaauuaucagauagacagacagacagauggauggauggaaguuaccaaaacccacaagcagcaaagaaaagugcuaagaguucuggacuaauaaagaagagggaagaccaaaggguggauacugcauuccuccuuaaaauagggaacaaaauacccaugaaaggaguuacagagacaaaguuuggagcugagacgaaaggauggacuauccagagacuaccccacccagggauccaucccauaaucagucaccaaaccccgacacuagugcauaugccagaaagauuuugcugaagggacccuguuauagcugucuuguaugaggcuaugccagugccuggcaaacacagaaguggaugcucacagucaucuauaggaugggucacacggcccccaauggagaagcuagagaaaguacccaaggagcugaaggggucugcaacccuauagguggaacaauaauaugaacuagccaguacccccagaggcucaugucucuagcugcauauguaauagaagauggucuagucggccaucauuggaaagagaggccccuuggucuugcaaacuuuauaugccccaguacaggggaacaccagggccaagaagugggaguggguggguaggggagcagggcggagggaggguauaaggaacuuucgggauagcauuugaaauguauauaaagaaaauaucuaauaaaaaauaaauuaauuaaaagaguucuggacuuuuacuaaaauuagaaauguuuguacuucucaaaggacaucaacaaguaagugaagauagcgggugaaggggcgggugaagaggcaggucagaggugaaaagcaugagcugcucuuccacaggagccaaguuccaguccuagaccccaaguaaggcagcacacagcugccaucaacucuagcaccaaaggauccaaugcucucuuuuuugguuucuacagugacauucauucacacauauacacaguuuuucaaaaaguaaaaagaaaaagaagauagcuuaagaaaaaugagggauaauaaucuuuuuuaaaaauuugauaagaaacucugcuaggauauuauugugcacuguguaaagauuauauuauucaaaugagauagagacuggaucuugguauuguuaagcacugccugccuuagcuuuguuaacaauguucucugucacuuucugauugguuaaaauaaaacgccuauggauuuuucuauuucuaacuaagccauguggcagaacuuagauuaguaucaacaggauaacugagguagugggaaucaaugccuaccuuuaagaccaaaagcuuauaaauaaauauagucuccaugucauuauuuggaaacuauggcaggcaugaaaaggcacgugguuauagaauucuuauccaaaaauauuaaagaacuuauauaacaaaauaaaaacuuuuuuaaaaagaaagcaaauuuacaguugcaugaagaagcuaagcagacauaacugcuaaucgugauaaaauguuccaacauuacuacagcaaaucaaaaccacagugaacucagaucuguaauuugaggugcccccaccccucagguaggaggacaguucaauguuguauuacaccaacuaggaugccuacaauaaaaaagauagagaaacugauacacacuuguguaagaucuuugccuauacccuagcacagccaagguggcuacagaagaucagaaggucaccugcuacaaaaugaguuuuaggccagaaaggaggguggaauggaagaagaaaauauagagaaauuaaagcucuccccaauacuacuauucagaguauuuuccuaaaaggaaaauagucuggcagcaucucaaacuguuaaacacauaccauuuaucaugugaccuagcaaacugacaaguaguuaaugacaccaaaaguuuauggccacacaaaaccuuuaugaaaauguacaacaucaugcacaauaugaaacauuucaagugucaauuggugaaugguuaauauuuuaaaaacauauaauacagugaguuaagaguauuuuuaaagcguaauugacacaugccacacauaagugaauccaaaaaaccaucauguuaaaugacagaaggcaguccuaaaagacaaugauucuauugacguguguucaaaaucuacagguagaaaauagggcaggaauagccauuaagauguguaagauuuccuaaagagaugaugaauauauuuccaauucuaauuagacaauuaaccacauuccuuaaaaaggaguaaauauacgugauuauaaugagguauggagggagagacacaacacugacuccaaucaagaucccacaucaggauucuguguuuuaguuuuuuaagaguauuuuauguaugaggguuuugccugcauguaagaaagugugccauguggguucacugccaguggaggccagaagaggguauuugaucuccuggaacugaagguaaagaucguuguaagcugccacaugugugcuaggaauugaacccagguccucugcaagagaaguguuauuaagcacugagcuauugcuccagccaugguauccuggguucuuuuacagcaacugauuaagucuaagaaagacaagaaccucuguccuuugugcagcaggacuucuagaagaacugcuauucccaaucucccaaggaaggugucucuaccacccagcccacuaaauuuguuuccagucccuaaauguucagaaguauauuaauuccauuccuagauuuucuuauuuuccgguaaguuguuuagaagcaaguauuaaacacaaucuugucauacccuacccugucucaacaauuauuaguauuucaauuuuuuuucuuuucaucuuauccucucuugcuguccuccagaccugugucuucuaacacuucuuuaucugccaggaacaguaagacccaaagccccagacucugcugcagacagacccucacucucacuggaucguacaguuaguuauuccucugacugcaaugccgggccaauuccuaguccugagagacggucuguguaacugaacacagagcauauacaaauacauaaaugcauuuuaugauuaaacaagauagugccugugcacacauguguggugccgaccuaaaagugauagcacacuugacccuugcauuccuguccagccuuagucaaaaccaagucuuucagagaacaugugccugcuguaugaagggaggcagaggaggagcaggacacaaagcugacaacaguuuucaguauagauuccuaggaugacauagacuaguuugcuucaacugccuaccaaguaagaugagacaguuaccuucuucuuugccauuaagaugaggucagauguacagcaauuaaaaaccucuagccuaggcuuuaggggcuuucuguuccuauacaugaaugcauauggaggacugcauaccgucugccuucaagcguucuuagacuggccucuucccgugcagucauccucucucuucgagcugaauucugagaggcaugaaggggaugauuuggguguccugggucaccagcagaugcuagugcagaaccauaacguaauugagcuucaguagaauccauaacacugaccauccaguuccacguaggaauaagcuuuucuucuacauaguucuaugaagaucaaacuaaaauagucaaaacuauccaaacagagcuaauuuugauauaguacuaguaugucaauacuuaagcauuugcaauauccauuuauauugaaauucuccuaauugauaggcaaaacaauaaauaacuuuucaguagaucauaccuguaaguugacugcaucuugguaagucaauuucacagcugcuggaaucugagaguauacuaggugauuauacuuagggauaaggcccaucaaguccgagauuugucugaugacaaugcuguaagcccuggcuaaacugcuugcagauguuaaguagcugcuggcauugcuagcuuccaaagcagcugcugccgcugcagcacuuguacugauggugccgcuccggcguaaauuugaaggaucaauauaaaucaaaccugcagaacuugcuauaaggagaaaggacaauuaccaugagcuuauauaguugcuaacugcuagugacauuauauaggcuuauacaaaucuaaauggucaacuaauaauauguacaugagcaaaaaaguauaccucuccuauauaaguuugggggaagagaguguuaagguggacaagaaguuaauacauuaucauccaggaauaauucuguacuucauaaccacuacaaaagcaagcaucuggcaaugugugcagacacuuuuagcuguuacaaggagagucgugaagaacacagggcugggaauacuacugaugucuaccagauaaaggcaauggguguaagcaacaccugacaaaagaccucaaagauaagaaucacccagcccaaagcaacagugcagagaguaagaagucuugauauaguaagguuuauguacuucuuauauuugauacucaacaaaaggcauguuuauaaaacguugcugucuagauaaacauguuggaacacuccuagaaaugacacgaguuuccagacuugccugcuggcguagaugugcuggacggagcugugcuugcugcucgcugaugcugcggauuucggacagcccacugcauggagcgaggagccugggcagcaccauuugcaugggagcuauucguuguccuuucuaguggcucaucgagcauaaaggucuccugcucuaugucaucacucugacugcuacugcugucagagucacuugagucauuugacugagagucaucuucagaaaaaaaggcaggaacacugcucgcuccuaaaguuuuaauuuuuaaaaccaaaaacacuguaaauucauugauaauuaacuuuacaaugugccucucaaaauauuauguucaacugugacagguaauauauaauacugugaagccaucauaaaaauauuucaauuagaaaagaacucuuugaaauaaacuuuaaaacuaauccauuacuaaaacaaaagcuaauaagaacugucaaagaaaaagaaauaaaauuacaaaaagguucuggcuacccaucagacauacaauuauaaacucccuuugaaaacagcuaacccauaaagcaacaacauaccugcuucugagccagcaguggcugcggugacaacacuucugcgcccacuagcauuaucuugguuacuaugguuacuuucacugucacuuuccguuucagcugcugcuaacaaaucuagcuccaugucacuuccuagaaaaguaguaaauaaauaaaaagggcaaaaguuucaccaaauaaucaauauaggugugaaaagcuggucuauccuacgaguaggaacuaagaaggcacagugguuaagacagggaaaagaaaucagagagccagcugcucugcagaaaaaaguacuggcugcucacgauggacaaauuacucaaguacuguaaucaguagacucuggcacaacaauuuaguuccugcccugcagagccccagugucugggcagcacccacauccaccugcccuguuuucaucucuuuuucuucaagaaagaacuuaaaaccuuguuuuuuaacuaacaugucaagauaaauaacauucuaauauugcaguucagguaccugacuuacacagagacguaaagacuguauguacaaucuuuaggagugcauggggaucgccaacacaaaacacugacuguaagcacacagccgcuaaaucuccggagauuauagacuccuuuccuguucucuccacaccaaacuuuccacugcugaaucaugacugacuuccuuuagagggaaaaaagucagacaggcucuugcuauguugcccagacuggccuuaaauuugaaacccugccucagcuuccaaagugcugaauauuuuaccacugaaguaguuuuuaagaaaacaugccggccaggcgugguggcucacaccuuuaaucccagcacccagaggcagagacaggaggauuucugaguucaccgccagccuggucuacacagugaauuccaggagagacagagaaaaccugucucaaaaacaaaaaaaaaaaaaaaaagaaagaagaaaaaagaaaauagacugcgugggcuagugagacagcucagcgcacaggcagcaguaguacaaggucugaaaucagaucucauccagugcgagggagacaaaauacuacauuguuguugaccucacacgcaaaugcauacuuauguucacaaacacuuacacacacauaaguaaaugauaaguaaaugaauaauaaugaacucaggucacaggcuggacaaugauguccuuacccacugagccaucaaccauuuccccauuagaaugaaagaaaagaaggugggcuagagauguaguucagcugguagagugcuugcucgaugcgugugcgugugcgugcguguagcucugacuggaucuuggcauagucaugcacaccucuagucccagcaguugggaaguggaagcagaagggugagaagccuaaggccaugcucaccuccacagugagucugagggagaccugggguacacaacacccugacucacacaaacaaguuccuuuagcaaauacaauuauuugauguauguugacuuacuuccuaaacuguaaaaauacuacagagaaauucagaagaaaagaauucgguuacugcagagcaaacgaggcugcucuccaggcaccugacuccucccacucccacguaccgucuucaucaugcucaucgugaugucccucagccucagcauucucuuccccgugcucuuccuguucaucaugaugauccuccucuccagccacgccuuccaccaccucaaccugaacccacaauuuuauuuauagaucaucacagcacauaauaaaccugucucuaccaguuuuguccauagaauuaguaaacuaaaauuuuaaagcucucuaaaauaaggguuucuaaauuuguauuaugcuguuuuaaaaucauuuacuaaugacaauucauuaugaaaauuuccaucagcauaucacauaguuuguaauuaguaucuaaaaacaggcuucaaaauuagaaguauaaaacuguucugggaaauggggaagggcugaauuuucuauacuuucaaauacauugcauuaaacuauuaaaaaaaaggccaacaguaaaacuaucuuuagucuuagucuuuagguaaaaaacaaguuuauguguccaauuuccuggcacucaauaaauggaagcuugcugacaucacuguaauauauacagccacaaaugaguauaacuaaugucgacaaguuggcuggaacacaggguaguuucaaacuaacacgaucaagacugacuucuaagugacugcucuucccaccaaaguuugucaccugcacuuaaaacaguuaaaaguaccucuuccacgucugcugacacaauaucauccugcuccucgucucggccucugacgggcugugacuggcugaugcgccucugcuguggguuccgaaugauguaagaugacugagacugacuggagcuguaaggagucagggggagggagagaccacagcugucaagauggcucacacagcacacugcucucugggauccuuuuugcagcucaaugcuuacuuucuuucuuuccuccagcauccucagaugccaagaguacugacaccaacauucacacauuaaaccacaguuucuauccuguacuugcucgcuucucacugacugguuaguggguggacauggcauagggaaaucacaucuacaaaucauauuuuaaaacagaggaacaaccaaaagcagagugaucaaagcuucacgucccuucagaucugacuuagacauagccaaaggcaagugcauccacacaaaaggaagcaaacaaucacuaaauugaguuuuaaagaaaccaaaaacuagaaacgugauguuuaacagcccucuggucacuucauuuagagauucaagaaugagcuaaaagacauuaaaauauaaagcuuuuagugucuuucuccuuaacagguuuccugagaaaugagaaucaaagaaauuauucgacacaacuaggguagcagugccuuugcauaagcacacagguacuuaccucacaaccagggcuuuccaggaucugcuaagacagaugcaucguuacagaggcaaagaagaagcugagaggaaaaucuuuuaauuucaaaaaaaaaagaauuucuuuuuucuuuuuuucagacaggguuucucuguguagcucucccuggcuauccugacucacucuguagacauggcuggcugugaaaacugagaucuaccugccucuguggcccaggcuuggauuaaaggcgaucaccaugugugaagggggaaguucugacaggaagguccuauucugcaauugauucuucuuuugucaguaaagaaagccaagggccaauuucugggcagaaaguuugggcaggauuucugggucccaagaggaaaagcagauucaaggaaggagagggguuuuucugccaugcuuuggaagaagaacgcagcaaccaugugagcucucagggggagcuggggccuguggccacuacuacaggcaagaggucagggcuagguuagggcagguagagacaggaaaauaauaaaucgguaagggugggcuuuuucaggcaggagauaucagcacccagcaauugugccaagaaggcaaguagugaaggaauuaacugugugugugccuucugucggaggacucaagggaagccgggcgggagcugaaagcacuagccacuuccuggagcaaaggaaguggaacauaaaacgacuugcaacacauuuggcuacguggcuauuuuuucauuuaguagagagguguuccaauuccaaaaguuuguaagcuuucuguuguuaauauuuaguuuuaauccauggugggcagauaaguacuaaaauauuauacuuacauuaggugacaaaauuagaauugugaaaaucauuucaacugcuacuccaaagcacagcuuuaauaagccagauaaaccauuuccauacaaaacauuaacauaccugcuugccugaucugaugacggccguggugguaaugguucuacugaaaauaauucuucacugcccugcauggcaucuaugcuaguacuggccagaguaaacggugcugucggccgggcaauccccauucugacaggaacaaucagagacucugccacauuacacaauucuucuacagcauaaggaagcagugcuugaaacacacguuugcauuuuccaauuggcuguggaauaaaguugcuauagcaggaaaaaaauaaaaaccucuaaugauucuucucauacacauacuaacauuaucacacuacaaaugugugcaaaagguuuugaaaugccuuacuuuuucuuuuuggacgaagccauuuccacacuaagaaugacaaacacucuugccacagaucguagaaaccucauugucacggcaauugcuucuucccggcguccggguguguacuuguuuuggaguucuuuuacuaaggugccuagcagaguaucuaaaagcuuuaaaaauggcaaucauucuauuaaugcugagauaguucauaugaugguuaacguagucuaauacuuuuaaauauuaauaguucccaauaaaauguuuaaaauguuuuuguguguguauauauguaugugugugauuuauguauauaugugugaauguguauacacacauauaugacguauguacaugugugcguuuggaggugagagagcaccgugcagguggcaguccucuccuucugccgcguggguccagugacugagcugaggcuguugggcucugguggcaccuguuacuagcuaagccaccuugacagcccuuguaacaaaauuuugaaacaaacugaaccaaaccauuuacagguauacaccuaacuguacugauacugugugucugauagcaaauggaucccaaauguauacuaacuuggcuuuugucccauaggccuguauauacuuaucaugcauguuuagaaggaaauaucaaacauguaaaaucagaaguucacucauugaagaacacuuauugcauaucucauuuacuacuuucuaauacuucccugugcauaaaaaagauaccaacuacaaagaaaacccaauuucauguuauuuuuuuaaugauuuuuauaacaaucuuuauagcaaaacauguuccauuucauugaguauaauuaauaauuaaucuuauaauuuaagaucuacuaugguuagauucacaaaccauuuuauuguauccuaacuuuacgcaauuauuauaaacuacuuagaacagguuuggaggaagagguuagaguggcaccggacaguaacaaaccagccugcagaaaggacuaaacucaauguccugucagugccuaaggaacaaccauccagcacuggguccuauuaucuaaauuuuaguuuacauuaaagaaaaacaaauuuaaaaagggguuacacauuuuuuuaucaauuuaagguuuuuauuuaaaauaaaauucuuccaucgaaaagcauccauguuaauauacucccuuuaacuuaaccagcagacauuaucagucuuuuaagucugaccuuuaaaaccaugggacuuaagaacaaauucauguauuuagugaacucaccaaaauaucugcuguacacuugacaauaaggcaaugagugaaacagucgagccgaaucgugccgcucugcugguugagguagaccugcucuucuggcaaaagauggccuauccugcugcuggcacucagacuggagaggcaaggagagacagaauaaauuguaaaagacaacauuagcccagaaacugagaaaaauuuuuaaauguuuuaacaaauacauacggaucuuuguucucuugugacccaaacauaaucauagaucucaaagcauuccaguccugaaggacgcgcucuagggcaagcugggcaaaccuugggggcucuaagucauggucaggcauaucugaaucuaaaaaggaagaaugggucagacaaaaauagaauucaaugcuuuguacaucagcagaauuguauacuucacucaccuucaggacuggcuguuuuccuguugcgauccucccugauucguggaggccuauacugacagugcuccacugucugccuggccacggucuguacuaagaacagcaaaaggugcucuccccuagaacacagggcagguugugagggagggaggggaggagagagggggauggggagggggaggaagggagggaaggagagagggggagagggagagggggagggggagggagggaaggaaaggggguggcaccagcaugugcugaccucuuucuauccuaaccauucuacuugccuacuguuugguagggugaccagauuuguagcaguaagcaggcgauaaaguagaucaagacgagcagacuucuguccagcaaucaauguuuuacauuuacauuucucccaacaaucacaauaagcuguuggugaaguccucuugagucuguuaaaaaaaaaaaaaaaaaucacagaaaaguucaaaaaaacuuuaaauuacagaucuacauugcaaugaagacuuauaacuugauaaaacuaaagagaacucuuauugauauuuaaaugaaaggguaacugcuaucagcuacauacaaaaaaauauuauuuaauggugcaaaguucagaaagcaauagaaaaauuccuauaaaaccuaacuguaauguccugggacaguuacuucuguuguccuucccggucuccaacauacccuacaugguccucacaugggcacugagccaacucuaaccacgguaagcacauguuuccuguaugugucauaucugacaggccuguaaaugcugucagaaaaugaaaugccuggcucacccugcccuggcagcgaguauugacuacaccuaauaaauacaagggaaacucagcauccaggaggaagcugagaagacggccuuacccuuccuaugaagcagggcgagugaaggacagaggugcacuuguggcagaguauguguguaagucaggagacaaucugcagucugcucucgcuucacaucauguaaacccaaggaucagacucgggcucgucaggcucugcagcaggugcccucaccugccaauccuccucaaaaaccccaaguggaggauucugauggcccauuuuucuauaaccuacagcaucuacacauguacauuuauaacccgguguuccuguugguaacacugagacucuacaaauguuaagcuugaguuuuacugcuuaggucuguggaaacuaacaaagccagcuagaaugaccuuauuauaugagauuacugaaucuaaaaaauaaguaaggcagaguccaguuauucaucuuaacacauuaaaagaggcccagagggagagggauggaggcacuuaaaacuuuggcaguagaauacaaaugaaacuacucuguaaacauacuuuaaagcauuaaucagacuaauuuaacaagauuaacccgauucuagucacacacuacaaguacuuaacaauacucuuuaaaccagucauauuucuauauguaggaacugaaauguagaaaacuucacuuucugaauuaugccuaaaucaaggcauaaguacuuuguacugcaaugaaaaccugagaguuuaugaaauucagaacagugugggacuuacuugcaaucgugcccuuuaugacaaacccuugcacauucuguacaacaacaaagcgacuccaguaaaccacaaguccgacauucaaaaauguccuggaauugaaaaggucacuuuugagaaagaguaaucacguguauaacucaucaauaccaaggugcuugggaaguggguguggugcucacacaguugacaauguaaaaggacgaaaaccaaauagaccaaguacauguaaaguaaccucaccucacucauaggcagacuaggacuaguuagacagccugggucagagccugccaucugugcagaccacauucucauagcugcuaagcugaaucgaggaaugaauggccauuuguuuuuuguuuuguuuuguuuuuguuuuuccauccuuauguagggcucaaaucaaaauuaauucuuuggauaauuuuaaagguuaaaaguaaaaaaacaaaacaaacaaaaaaaaaaaacaacaacaacaaaacaaaccagcagacacguuuacauacuuucagcucacgucaaaggaggggaaagggaauccugaaaccaguccagauccagggagcguuugggucacuuaccugguuaaugugcucugcuccaguccagguaaagcugcaggugucguugcaacauaagacauacaaaggggagucgucaggguugguaccugacgggcaaaccauucccaugaacacaucuuccuccuuuucacuugcagauacuucagcuaaaauauuaaaaacacagaaauucauucaucuaucaagaaaagauuuaaucacaaccgcaacugaagaaccuuaauauauacuuaguauacuuaguaguaauauacuuagaaaucacuauagacuaauuacaaugauuuuguuaguuaagucuggcuggagaggcucauccacagcaccuaacacucacauuuccagagaucuugcauacuuccugccuucacaggcaucaggcacacacauggagcacagaaauacagaaaugcaauaccuauacacuugaaagaaaaucauuugcuuuucuuaaauuucaaaagcugggcuggagggauggcucagugguuaaagagcaccacugggugcucucccagagguccuugaguucaauucccaugguggcucacagccaucuauaaugcccucuucuggugugucugaagauagcaaugauguacucacauaaaauaaauaauuaaagaaaaaaguuuugaaagccaauguguuaagaaaauccaaccaaugcuggaacaagcagaacaacacuauagcuuugugugacgacaacaagcuacugcaauucuuagcccuggguccaacagugaauacccaaguuauagccagaucugaaagugcacaccuauaaaccaagaggcaggagaucucaaauuagaguuuagucuguacuauacagugaagcagucugaaaaauacuaagacucaaucaagccuguuucacuuaguaaguuauagaccauaucacaauauauuaacaccaguguuuggaaaagaauaauucaucuuuuaagaauucgaugccaagccaggcgugguggugcacaccuuuaaucccagcacucgggaggcagaggcaggaggauuucugaguuccagaccagucuggucuacaaagugaguuccaggacagcaagggcuacacagagaaacccugucuugggggguaaaaaaaaaaaagaauucgaugccagaaaucaauauugcuucaacuccuccucugacagucuguuauuguuacauacuuuuaccauacccaucaagcaacaguguauuacuuguaugaagauuuuacacuaugacuuauaaacaugguauuuuuauuuuuuuuaaaaguccaaacucuauaccaauuacuuuuuugauaaaacguuagaaauguaugugaaaagcauuaacaaaacuuuagacauauaaaacgaccuugacagagucucaaugauaucauuuauauacacagaucuaguuugaauaauuccagugguagauaugaacaaaauccauucaaauuuuaaaaugagaaacuuccuuaggccuugcucuacauucauaccuuuggcaaucuucugggcuguuucuaggauggugauugcagcaggauaagcccggccacuuacagcugacauaaacggggucauuccucuugcaucccuaaugagaagagauuauacgugaggaucuuaucuucuagaugaggugugaaggcagaggcagaggcagagagaucucugugacuagccaaccuggucuacagaauuccaggccagccaagucuacucaguaggacauagucucaaaacaaacaaacaaacccauaaauagauguuaucuuccuauuuuacugaaaaagaugauaaucauucaugauaaucauuccacuuagcucugucugcaucacagaaagccuacugugugauccucuagggaaacaagcuuaaucguagccuacugaugaggacccuucugucucagucuccuaagugcuuggaugauggccaggccaacaucauucuguguuuuucuuccacagaaaaacaugcacacugauucaacuaacaugaaaguuguucucuauucauucaggguguguucucugaugcugaccuuccacugaagaaaauuuaguaacagaggaaauacaauccugaugcuuuaaauucauauaaacaguguuuuaguagcagaggaauaauacugauagauucuaauguuuuuaaugcaucacaggaucaauguaaacaggaagucuguuaugccucuuacuuggcagaaagaagcucucguagauaaggcugcagaaccgcacugucgcauaguaauuuuaauaugaaaugugcguuugccuuucgauccuuggauucuacuacagauggcucuguggaaggaccuguaauaaagcagaaucauuuaauaccaaguuaagcaagagagaguucugcaaaccuaucagauacguauuaaguccaaagaacaauauccaugaagauaaauuaacuuauuagaaaauuuugaagcauauuaacauauuucauaaauuucaagugauuucuuaauguaaauaugcaaauacuacacuguaaugcauauaaaauauagaagauguacaguuuuuaagcaaccaaaaaaaucugacaaaagaacgaaacuuuacuuaaagcccuauaugaaguguguuauuuuuaauucaaaaagcccaaguagacauauaguauauagucuuaccuggaaugguggaggugcuggguccuugaccacugccagucgcugcugugguaagagaucccacagcgggggccaggauaaaaucaauaucaccaucuuucgguaaacagaacagcaggaugcauaucauuaugggcacauaccccuaaccauuuucuuaacaggccuuaaggauuuucuccguaaaccaguggucaaauccaacaaaagguuaagugggaauuucuuuucaagacuauaggaggaauccacugugugaaucauucauuuauuuugauguauuaccaaucaagaggcagucuagccuuuuaaaaguacagaaauaaauuaugucaagaguaaguucuaaaaaaaccaaacucuguaagccaauuuuucaacuaauccaguuguaguguuuaccauacuacauucacaaguuuuuaaacauuuuacaaaauguucagcuuuuuccuuucacaaccuugccuuuuuauuaaacaccgaauaaaacaaaagagcucuuaccaggauccauugaaggagggucaggaacccagcuagggggagcuauggggggugaaacuggauccugguggucacuggaugaagcuccagccucaugucuacccaaaccagcugcucucaaugaacgucucaucauuucucguaaucucaaacuagaaggacauggacaaaaucggaacucauuaccguggcucaccuaacaagaggcauguauauagaagcucucaucugagaaggucaagacuggucuauaagcaaacacuccaggcaugggaaugaagggcaaaugccaagucuauaauagcucacagaaugagucaguagaggacagagaugaagcuagggagucuagcauccagugcauuacaguagcucccuaaagacuuaagcaaaggaaacaaaagucucagugaagaagaauuagaaauagucuuuugugcauuuaggauaaaugaacagcuagacauuagaagaguguuucaguccuauuuccuaaaaauuaaguuuaguaacgaauaucaauaaaacuacugauuaguacaaaaugaaauuagucuacuaaaucccuuuucuguaacucaaaagcaauuaaacuaauauccacaugagcaauuuuaaaaccaagaacauuaaguguuuuaauacccagaagucccccaaaaccaaaaacaacaaaacaaaaccaaaagccucaauagcauaauucacaucuucaagaaauuaaacuaaaaguguuacuaccuggggcuugauuugguuauuuuuccuucuguuauguaaaaagaacacuguauagcugguuuacaccacuaaaacgauuacucacgacuucauugugggaccuggugccuuccuacacaaaaaccuguauuguacaugaauaaaagcuuccaacagccaugcagucacgcuuaggaauaauagaaauuaaaagagccaaaucccuucauugagccacacuuuuuaaagcuucuaaauaaaaacucaauugucaggguaagauaacacauagggacuucuguuuuccaugcagccauaaucccaaagacaugacuucuagugugagaucugacacuuugagaugagaacauaaaugacccuaagugauuguuaguguuugagucuccaacuguaagaacuauuuaaucucugaguaaauguuuuuccacaucaaccuaguauugcuuuugugagauagaaagggcauguccaauucuuuuauaagaugcuacuuccagaauuucagauuguagaagcuuauuugugcuauacuuuuuugaauaaacacugaaagaccccacaaaguaaauuuuaaugucucaaauaauauauuacuuauuauaauauucacuccuauaaauauauauuaaacaaucccccccucaccaauuuagaaauuuaauuuaauuaaaaguuuuugauuaaaaguuuuuguaagacagaagagaacagagugccaugacuauuucagucaacgucacuucucaaagucaucacuccagagaaaaaaaagccgcuuucuuucuucccccugacagaaucccccagugacuguacacugugaagauggggaaaaugcaguaagaaccugagaauagacgugggccuggggcuucaaggagcaugcucauuccaaguacacagugagaugccuacuggguaggaaauauacaggaagugacuguaaaggcaagucaggcgugagguaacacaggcaguggcaaacuagagguauauauacauggucaucuaaaggcauucagaucuuaaaaaaauuaacacuacauaggccaaagaaaacacgugugggguauucuccaacugcuagcuuagaguacauuaaaaaggaaggaaggaaacugagagcacagucucaucuugaacuugcaaacucccagcuuuguuguugugauguagucaauucaauauuaaugagggggucauucuuugucauguuuuuaaauuguccuuaaccuuuuucuucauuaggucuugggaacauuuaaguauauugcccagcuccucauacagauucuuaaaaaauaaaaaaacaaaaagaaaaagaaaauucaucuucaagacgcuguacacaauucauggauucaccuggauccucagccacugaggacagcacugaggcgaggccaccuuggcugccaagauucaggguuuugacauuucuucacaaaggcuugcccggagucaucguguuuucugacaauauggaagaauucaaggaugguguaauuuccucuuuguaagcacguuauguccaugcuacagaagccuuagaauccagucauguucaaauauaccacugugacaaaaaagugaaggucaugugucuuccagauuaacaaucgcuagaguauacacaccugcaaucagaugcaucaaccaagcuuuccacuaaaucugcccuuugaacucaggagcuauugagucacaugauagcaucaucagaagucauuacaguauuccuuuccacagugaaacugcaucagcucugagcucacagcucaggaaucccagccugcauacucaucaggggcaucgccuagaaaauccauuguaggcuaguggagggucucacgucagugaagcagucugugcacuuccuacugcccggcgaggaugaauagccuccugugcugccaucgguucagccggcagcccugaguuugcacuggguaagagcacugcaguggaaucuucggcaaaucccucaaaggagcuuacucugcaaacuuaucucugugagcaacucuucgcccacgcuugaagcuccuuuuagucuuugccuucaaaauaauccuuauaugaaaaaagauggcaguauuggcacugaaccaaccauaccagaguccaaagugauugacaccugcaauuucccugaggaagugaaauaccugaaauaauucagacuaauuucuucaugaagaauuuaaguuguuuuccauuuugaagucaacacuuugcuuaaugcauuucuaaauaaauaagcugauaauaauuuccauucuguguaguauacauaaaguuucuguacuauuuaaaauuauaauuugaucauccacaggauuuuuuuaaguguuccuuuuggaucuuuuugagcucaggaaccuaucaaccugguagccuuccuaaugccaauuuaagaagaaaaaaaaaaaaaccaacagcacuuugaaaggggaagaugagguucagcagaaaggaggcaaauagaacuugaucugaagcagcuugccaccugucacaggaccacccaggcaucagugcuucaccaaccacuugucaauaaccaacaacucugacuuaaauaucacaaauaaauuuguuuuuccuacagaaaacuacugaacucuuuauuuaucacguagccaaguaccuaacaauuuuaaauaaguuauuaaauagcuuauauaaaggaccauccauccaacagcucagaaaacauagaaaauuuuaaaaucaagcauucaaaauacacaccagccuuucauuucuuccccggccauuaagacaucugaggaauggaccuaaagaaaacaacuaccuaggaagaaugguaauuucagaaaagaugaagucugagcuguguuuucaaaugauccugcuuaucaagugugagagauccuaguguucagagcugaacucuaauuagucaggcauugucccaguguuauuggaaggagccaaaaacaaaacaaaagagaacccaucaauucaugcacaugacaguaagacacacacugcuuucuguacuuggacuuuuuuccuccaauuaaaguuuccuuguaaaaaucauauuaccuucgacuauuugaugauccagcccgauuaccugggccguuacuugaaacaacugauauugcauuugcaauggccuccacagcagaaagccuuucagcaaauguauuucuuucugagcgcucagcuucugaaacauaagaaagaaauuuagauuuaaccuuuggaaacaacugacaguacacauacuggccaggaaauacuaagucgugugugcuagcgcuucaaguaacaaaguaaccaugcucuuaacaucaucaaggaugugagagacuaaaccaggucguucacucaguuucuuuacucugccuuauuucaacaacauuuaaacauaaacuuuaguggacuuaaauuuuuuuuauuaaguaacuuuuacuauuaaguaaaaauaaaaagauucaaucauuaguauaucagucucaguuuauaagcuacuuauaaacaaacccuagugauuuugaugacauuaaaaaugaaacccacagucgcauuucaaaaugcaguguccacaguagcaucagcagaauucaaaauaauuaccaaguuguacuuuagggucuuccuucauuuaacuaauaaaaaaauccauggcaaaaacaacaauaacaagaaaccccacauacucuuauuuuccaguaacauuuuuuagccuucuaaauuccaagcaacagaacaaaaacuugaucuaggaggcuuaaaauaccacauuccuacuguaaauucauuggggauuacaggugggaaguggccggauagacaggcagcucacagcuauuaagagcacuuuccauaucacaggacagugguagcacaagccuuuaaucccauuacucaggaggcaaaggcaggugaauauuuauggguucaagaccagccuugagucucaagagccacaaagagaaaccuggccucaaaacaaacaaaaaccaaaaaccgagcacucacugcucacguucaacuacagcucccuccgaggagauccaaagcuccuggccucccuagaacuggcacacaugucagauagacagacagacauguagauuaaaaauaaagguuuaaggggguggagagauggcccagcaauuaagaauacacacuacucuuccaggggacuaaaguaagguucucaacacaauguggcucacagcugccugcucuaaaguccagcuccauccagggaucaaucgggacuucuccgacaccuagcacucaccaauguacacauaaccacccacagacauacacacguacauguaauguaaaauaugaagguuuuuaaaguuauuuguacuuauaaaauuagugaaguacauuuaggaucaacacagaucaaacuuauuaucugcuuccacaucuaacccuuagaaauauuuuuaccacauaauaaaagucagaccuuccaagaccacauaaaguaaaaaggauacaaguucuuucucuacaagagucuucuuuuccuagaguucuugcaaaggcuuuguuaugguuccgaaucuuacccucuucuucuuuaguuuccuuauugcugguuggaaagcaaacugauacacaagcauguaaaauguuccgguucccaucacaucuguggcugaugaacgucuguaacaucugcagguucugcucuaaaaccacggcuugcuccagauucacgagauacugucggcaggccucguagucacaucugagaaugugcugcauuaagguuugcuucuguucucgggcaaaagagggcaaacacuucaaugaaacuaaacaccaaauaugucaaaaauuacauacaugagaacugccucauggccacuauaauauaaugguaucuucaaggaaauagaaauugaucauaaguggccuggcaaaugaacucaucuauacucugugaagagaguaugcaagcgagaacaaaguaaagaacacgagggaaaugccuucaguauuccaaaccaccucaaccuguagccaguagaaaagcagucaacacgcugaguagcugaacgagaaugccugcaugugauacacaaccgugccuggugacgcccuggggugcacuccagcuuucaaauuacaacucuagcaauacugucagccaauuaagcaaaggauguauauuuuauuccagacugauuuuucagcaccucguuguuuuaagaguuacauuucagggcccacgagaagguucagggguaaaguacuugcuaccaagccagaccaccugagaucaauccccaaaacccacauggugaggaaaauuaacucccacaagcugugaucuggcuuccauacauaccucuauaaccacaccacaaucauggguaugcacaauaacaaagauuuauaaaaaguuacauuauguuggccuagugggccaucauugggaagagaggccccuuggucuugcaaacuuuauaugcuccaguacaggggaacgccagggccaagaagugggaguggguguguaguggagcaaggggggagggggaccuaggggacuucugggauagcauuugaaauguaaaugaagaaaauaucuaauaaaaaaaugugggaaaaaagauacauucuauugugauacaugaaauacaaaacuuuugacucucuaggaaucaugauggguguaaauuccaaagucaaugacagaucuacaaaagacauuaacgaugcuguaagguauacauagaaaauaucauuagcugucucacaacaaaaagaaguaguuugauuacuggaaagauggcucaucaauuaaaaauagaugauauuuuugcaaagaacccagaaugaguucccagagcccauagccuucuguaauucguagucccaagggaucugacacuacucuggcuuccuccggcaccaacacacaugcugcacaaacacauguuugcaaauauuuauauacauauaaaaucaaaucuuuugaacaaacaaaaaauaguauagaaaugaaaacuaaaauuauggaacccuuaauagauuauaaagcacuuguuuuauucuaaaaagcaaacucauuuuuuguacaaacagguauguaugaaaauacaaaggcacgaagaaaagggcacugaaccuugccagaaaccugccuaaauaaagucucccuugccuagacuuauggggaagaaggggcccuagagggcucacuguccaaacgggacaguaaaucuuaaaggaucuggcacaugugagaaagccguuuucacucugggcaaacugaggcgaaagacaaacccuuugcagaaaccaaaaacccaguaugugggcagcacgugguuuccuuuccuucuguguacacagcauacuccucaugguacauggguaacacuuguguuuccuugcuuuguguaccaggauauacagcacacuagucacuuggcuggcaccaaacucuacagaaagcucauaaccauccucugaccuaaccccgacuggcacugucagugucaugcuuagcuaugcugcaagacucacccuauagcaaagggcacaggggauuaaaaaaaaauccgcagcucuacccaugucacauuuaaaucacucaacuugguugucucucucagucuucagauuucugauuuucuuguuuauuucccauugcccuuguagauauaugauaaacauccucaaggucacaugucuaaaagcaaagaaccuaugcuaacucuaccuccuaaacuucuuuagaugcuccaaaaauagcagcuucauucuugcaaaccuuuggcugucaagauagcccagcagagagaaguguucuguuguggaauccugacaacucuggcuccauccccagaacccaaguaaaaagagaaacaacucuacaaagcugcgugcugaccucuaaauguguaccuuggcauacauguacacaugugcaagcuuauacacauguacacacacacacacgcacacgcacagauagagauaauuuugaaugaauaauuaaaacaagaccuuuuauucuuucuucuugaauuugaucccuugcauuuagcaaauuuaaauuuacugauucuauuuguaaaaccaaaucaaaaucuaaaucuacuucagcuaaaacugcauggagagcuuaguaagaacaccacuacuacagcucacagccccgcaccucaccuaagugaggucaucuccccgaccuuccuccacccacucaccaccccagucccaagaguaaacacaucagacucaucggcucucccuagacuaccaugcaaauagcaagcuuaacaguuucuaguuccuucaaguugaucaaaucucuccuguccccuuuucccauuccuaagagugcaaguuugcuuuguuuuugacuuggauuaaacauuagccuuuaucugauuugcuaaacaucugucuucugccacgccccuaaagccccaguacuuuauuacuaaucuuuuaaaaaaaaaauaugucauucacaacucaaaguucuucuguugguauucaguucaaauuuaggugcaucagguaaggagagucacccuaagcucuccccagccaugcuaccugcuccuucugaccaauaccacccucaucuccuggcuaaauacaucucccuaguaccacagacagcaaccucuucauccucaccccagacaucacuuccucaaaagcuugcccagccugauuucucuucaucaauaugcuauccaacaguauuuauauguacgccuuuuuaaagacaaauuauagaaaucauaaucaccgacuuuucuaaccucguguuauauuaauaaacuauuauagggaaagaagggauaaugaaugaucuuuucaugaauuuaagaccuauuuucuucugauuuaaaauaccaaguaauuucaaaagguagauuaccucuacagccaugaugauaauagcugcuuucuuuuugauuguugaguuggcaggaagauuuauuaaagaauguacacccaucccaagacuacugauuggugggagaucaagccagucaggaucccguauuccucccaugcaauccuuggccauuggguagauaguaccauuuccaucucgaagaacaauaggagauuccuacaauaggugaaagauaauaaauaaugcuuguuccaagucacagaugguuacacaagccuagugugagcaagaaugccccgauuccaguacuuggaaggacaagauagaacaguucaaguucugccuaagcuugggacccuuaucauccccccuccccaaaaaggggagggggaguagggggagacaaaggggugagaguaaaccaagauggauuuuacaaaaaguguacuuauuuuaaaauuaccuaaugcuauguuagaaauaacaagcuuucagaaggugcuaaguauuauaaagccuucauugauucucuaguaggcaaacccuaacgggcacaaaagugccaguuuguaucugcucuuuaaaaaaugaacaacaaaaaacaaaaagauaagcugagcuucuuaccugcccagcagugaagauagcgacacuccucucauccugaccaagaaaagcaacacugcuuguugggaaauuauucucuuguucagccuucccuguggcaagaucaaagacacaguaccgaacccagcuuccagucuucagaacagcauggacaccuuucaaaggcacagaaaugaaaagaaaaauaacaaagucuuccacaguucaagcauuuaacaaacuuuaaccucucccacaccaguuguaaaaacauccagccacauuucacugucaaaucucaaacaauuguacccuagucccguauguuucaaaagaucuaaacuguacacaacuauaaaaggcuuaccuuuggaauccacauuuacugcuaguauuucagucuucucggguauacaaagcuuuuugggaguccucugaaaacagucgggaacuuuuggggugccgcccguuuugacaaccugcaaaacaacacacauaauuuugcucucgcuguaacacuuucaaugaguccaucaccacauucucucaacucgcguacauaccugcagcucaucaauucgaagcagccugcaguccugcaggagcgaggaagggucggcgucuggaccagagcuguucugacaggugguguuaguagauguuccuggaaacuuuacagcgacauaggcaccaucuaccuucagcaccuagaaauaagagauagauacaguuuuaguaaauauuuuaaaaggcuucuauaaaagcaugcaaauucugcuuuuccaacugacaauacuaaagacacuuaaauccuuguaaacauaucaaugaauaccacauuguaaugucaacggggggggggggggggggcggacacgggacacagaacuuugcuguuuauaucaacaaaucacaacugaaagaaacaacucacacagccacuaaucacaacaaguguuaagccauuuacugacccaaaacuagguucacccauauaaaccucuuaucuucuguccucauugccuaagcagcaauaucugauaaacaggucuuuuucagguuucauguguccuacacaggucuucaccaugcagcugaauaauaauagccuugaauaauucuggguccuucugccuccaccuccaaagggauggcauuacagaaauacaccacugauccaucccaacacuuucugcauccauauaugucagcagccuaggaagccacaaggcucuucaaaugggauuagcaugaccggggacaaauauauguuacuaauauuuuauuuaauaaauucaaauugccagauccacagcuuguggccacagagcugucaaacuagaaaucagaucaacaauggagacagacaagcacagggcuuggaagcaggacacuugaaucucaccucuucuacuuauuugugagguuaagucagugugauuuucccaagucaagcuacaguuaaucaaaggcccuuaaaaauuguagaucuugguuuacuaucucuuuccauugaguacagaugaaaacaaucauauuuuaaaagauuauauuuuacaaaacuaaaaagcaaucagaaaaccuucacugcccagauauucuauacuguagagaaauuuaaauucuguacugagggacaaaagggucaauuaaugacauucaaguaaauggcuuccauuuacuuggcuucuuggaagaagaaaaagaggaaaaagaacaagguaguucaaaggaaacagagcuuagugcuacaaaugaacaccuucugcagcuucagaguuucagugacuuuaucagaaagcacugugcugggacacaagcaagcuccgcagcugaggacucacaccgcacaguccugagggccgugugcauguaacacagaagcaucauacaagggucugguaacccagguaccaauggauucaccacacagucaggcacacacgccugcacacaugcucaugagugcaugcacacacccaccucacauacacauaaauacucuaaauuuuuaaaaagaaaaauaguaauguaucucucuacagcuuuucuauccaucuaaacuuaccacaaauuaaccuaaaaacaacuccccaaggcacacgagauggcuauuccugguugucaguuugacuacauuaggaauuaacuaaaacucagggggcuggguacaccugugaggaauuucuucuuaauuaagucaaaugaagaggaaagacccacuuuuaaucugggcgacaccuuccgccuguagccuacaaaaaggauacagaagggaacucugcccuuugcuugcuugcuugcucucacaaggaaacacuuuccuucacuggcauuggagccuucuucauaaaauuccaguauacacagaaggccaacugagacaggcagccucaaggacuuaauaacuacuggcuccuuggaccuuccaucaguaggcggucacugcuagacuagcuggcccacauaagucauccuaacgaguccuauguauauuccuguuauggguucuguccucuggggagucuauacaccacagcaucaccuccaacagagacccaucuaaagcacaacucagacucaugaaaccacuaaaggcagccuugaagaaaggggucucagacacuaaccaugaaaaccuucaaggaaccaaaaugagguaguaaguaacuaauucucagcucuuuugaacaaaccuugccaacaggaacguucuuaacaucuucaacaaaaacaacuucccgaaggggccacugcuccucguucaccuucuccucuucucucggggcaggaguugaccgacgucguucuuaacaacaaaagguucaguaucagagggaaaacauaaaaacaaccuauagagucuaucuaaccauaccaguaaagacagcuggcaaaggaaugaaggaucuucaagucaccccuuucugaauagagcuuauaacauaaaacuguuauuucaaauaaacucacacuaagcaaagaagagcuacaacugguuacugcuuaacuagauuaauauuauuacaaacaaauacuaaaaugagccaaaaugugugugcuacauuuaaaaaggaauauauccuauguucuuaaaacacuauguggcuucaaucugugacuuucaaggagccugaaaucuaggacacaguucuaaacccagguuuauaaauucuaaaaacaaguugaaaucaugucauaacuaauauacaaaguaguaagguucucaaaaggaacuguaacauauauucuauauauguagugugugugugggggagguguuuccauugauguuucaaagaauuuuauauaucuuuaacuauaaaaaaggaaacaauuuggaucauaaaugcugucuuuccacuuaaagcugggggaaaaaaaaaaaaaacaccaagggaacacacaacaucuauaaagagagacuuuugaaaugcugugaguuggcugucugcgugggggcuugcucugaccauucacaacacacacagagcuuacuguauggcauggaugcacugcuggcaauugaggacgcgucgcugcagguggaugcuggugaugguggagggcccauuucuguuuuuacugguuccugcuuacucucgggccugaaaugagaaauguaaaguacucuccuuauaacuaugaaauaaaacaacagaaccuuucaaacaauuuacuggaacaaguuuauaaaagagcaaaauucuuuuuguuuuuuuucgagacaggguuucucuguguagcccuggcuguccuggaacucacucuguagaccaggcuggccucgaacucagaaauccgccuaccucugccucccaagugcugggauuaaaggcaugcgccaccaccacccggcuuaagagcaaaauucuuauuaaugaauauaguuuuuaaacaucaaguguauuuuaaggcaacaguuccguguaauaaaaacagauacauggugcacauaaggaagauaaacacaauaaacaaagcuguccacaagucaggccggcagcauagacagaccuucucuaggagacgcaccuaaaacuacaacucccugauggucugucuacaggcagcacacauuuauauaaaguauaauuauuucuagacauaacuacuuaguugcucacaaaccuuuuaaaauuauuuucuguaucacauauaaaaaauaauuugagucuucaccuuaacccuccugcuuccuacugcucucacugugaauuucaucugaauuuagacuaaaaaaguuuuuagucuaaaugaaaagaaaaagaaaaaacaaaacaaacaaacaaacaaaaaaccccaagagggucuccuucuguaguccuggcuggccuggaacucacuauacuagagcagccagcacauccaucugaacucuagaaugauucuaaagugagaguguuuuaccaccaugcucgaggcagucagcacugccgcucgguaaagagagaugcgggcacagaccaaugacugauggcuagcauacucuaaaugaagguuagguucuucaauggcaggcaggaauuucuacugaagcagaaaaggcucuguucucaacauagaaucuuacuuaacuuuauugacagaaauugcuaaauccaaagaagacuuugaaaaauccuuuuacagagcuuaaccauauucuguucaucuuauguacagguuauguuugguuuuuuauuuguucauuuguucuggcuucuuugagauaagaguguguaugugcuacugacuggccuagaaaucccuauguggaacagacuggcuaugaacuugagauccuaacacugcuucccaagugcuagcuaggguuaacuacaggcauacacccagaucaucacacccaaauaacugauacugauacaucaaagcugggccacccccuaguacuauauaaaguacaauuccuuuacagaguucagaauauaugaaaaaguauaauggucuguccuuauuuuuauuuuuuauauauauauaucaauauaacuaggagacucaccuaugaaucuccuuuuuaaaaaaagcacuaaaacuauaaaucuuagguuuuagugucauagguuuauuuuuuuguuuuuuugucuuguuuuguuuuugcuuuucaagcuagugcuccucuguguagcaguggcuguccuggaucccuuucuguagaccaggcuggucuugaacuugaaauccagaguacugggauuaaaggcauucucuccaccacugcccagcaguuauauuuuuaacuuacugacaaaccaaccucugggcuuccaagcuucagcuugcacuuuuagcaucacaagaaauaacaaucagaaguuaaucauuacauuuguuuggacaugaaacacaaaacuuucagaacuuugcaugcauauauauauauauaugguggaaacacgaguuuccauguguaaaaugguauaauguacucauaauuuagcaaaaagaacacacucuuccaucuuacgauggugguagcacacuuuuaucagguuacacuaacaacuuuccugcagaggaugaacagucucaggaacuagauuaacacugcaaaacucacaggcuaaugaaaacaaacaaacaaaauagaguaagacaucaaaagagaaccauucugaccaccaucaggaacuguaacaaugccuucagaagaggcucggccguuaagagcacuuacugcucuuccaaaggacuaggguuggcuuccagcacacacagcaagcaaaacacacauauacauaaaaucaaauguuuuaaagaaacuguaacguacaauaaacaaaaaauauuucagcaaguuccccaauucuuuaucaaauuuuugaugaucauguccaccauauaaagagcugaggugcuaacagaggucccaguacucacuuugucucaagaguuuugcuggcuuuuuccaugcucuucaggcucucuggagaccgaaguugaaaucuacagcuaucauucauauuccauacugacuccaucaagacaccaacuuuaggaaugccagcacuaauugaaaaggcaaccgcuccagcaugguagagaggguuauuucucaagcacaccuagcaaacaaagaaaaucggucaggaugacagauagaacgagaaucaguucaaacgugcaggaaaguagacuugcuguguuuucuaacacaaacucaaaagcaacaaggauguacuguacccuucuccauccaauauuccuauaacuaacgagcagugccgucagccugucugcuaggaaugaaucacugaauucacagagacagugucagucauucuaccaaagggaaauuaagcacaagagaagaaaacaacuacacuuuucucugcuccacgucaucuguaacuuuuucuccuuaauucugaugcuccauaggcaucucuagggauguuucccuuagccuucaauggacaauguaaucuuuuaaaggagucuggcaugcagcucagccuguaucccagcauucacaaggauaagauagaagaaaugccucaguaaagccaaaauaaguaagacuccuaaauaaacaaacaaacaaauaaauaaauacuaaccuuggcaucagggguuuauaggucaggucaauugccaaugaccuacaaauuucucacuguaggaccuuguagaacuaaggcuauaauacucuaaagcuuaaaaaaaagccagagguucauucauggggcaguuauggggcgggcgggcagcuggccuccaaaguaacacuggcaaacaaaccacagcagugacucaguucucaacaaccccacaucaucaacuacagguuuuggcauaaauagucucuaaagcaaacuuggaacuuggaaaaaugucuagccagaaacuuucgggaaacauuuguccuaacugccaccuuccaacacaaaccaaaacuagcuacugcaaaguaugcugcuaccuucucuuaaacaucucucccugacauuuagugacugcaccuaccuacauucauacuaaaagcuauucuugccaggaaugauggugcauucuuuuaauauuagcacucaggaggcagaggcagggacaucucugaguuucaggaggcagaggcaagggcaucucuuugaguuucaggaggcaggggcaucuaaucuacauggcaaguugcaagcaaguuucagggcagucagagcuucaaggugagacuccauuucaagaaaauacacaaaacucccccacaaaccuaucccuaauaaacuccaacuuagccuuacuacaaaaauaaaaccagucaaagcuuagagccccaaaaauggucaacaaaagcacuuuaacugaaauuaaaacuucgacuauuauuaacugaaauucuuuauuagcaucuucuuacaacaaaugugccucaaagacaagaaacaaaucaaagucugggccagcaguguuuaauuaauaguaaaugcauaauucucaacuauuaagaucuauggaugcaggggaccaacaguucuuucuguugucagaaagucaauguguacaauucuguggcuccauaaaccucugguuuuaaaacaaaaucuuccuuguaccucaagguacuuugauguguucuauccuucagcgguuuguuaccaacuuaaaauuucccuuuggucuagagcaguggucaucaaccuuccuagcacuucaaccucucuccuauuuggagucaacccauguugugaugaacccaaacuauaaacuuauuuucauugcuacuuugugacuuugcuacuguuaugaaccacaauaucuguguuuuccuaagguauuaaaugauugcuguuaaagguucacucggccccaaagguuagaaaccacuggacuaaauauggcucaacaauuaggagcauuguuccuacagagaaccuguauuugguugcaagcacccacauggcagcucacaaucaucuguaacuccagauccaagaauucaacauauucuacuggcuucaaccagcaccaggcacacacaugaugcaauacacacaugcaggcaaaauauucauacauauaaaauaaaaacagguaagucuagaacuacauagaucaaaccuguuuccuucuucaagcuccuuugucccaccuccccugccagccgugaaguugucacuuguucuuuaaacagcugcuauguccugucuguaagauuagucacuaauaauuagugcucacauagaagagaccuuguucaaagcaccuuagggaagugcugaaaacuacacuuagggaaaacugcacagagcugacauuucuaucugggagaugaacaacucagaacaagacacuaauagauuaggcagagguaaggagacagagccacaaacaaaggaaccaguccaggaaagcugggacucaguaugacuauuucuugacacacagagagugggguaaugguacauuuuagugcugaaaaggaaccugaaaugaaaaugcagcaugaggagguaggcaggcuguuauguaauaaaauuccauacuugucccaaaucucauggaccaggacacacuugaagcuuuacacgguacacuugcuaugauaaauacuaaauuuuaucauaaaagauaaauauccaucagucuccuucugcucucacacaucaauauccccaaaaucuuuuaauucuguggguaauaucauuuuaauaaugaguaaauauguuaguaacuacaacuaaaaagcuuuaaacuguuuuacaauagcaauaaaaucaaaagcagcaaaaauauuaguggcaacaguucaaaguuacuuuuugaugaucucuucaaaacucuuugcuuuuuuuaaaauuauguauuugugugucugcauggguaugugcucaugagugcagguacuugcaauguccagaagauggcgugcaagcauguagagcaggagccaccaggagugacaagcugccaaacagggaugcuccagaguggacacuucuaaccacuggguucucuccagccuuucaaaguccuuuuauaucauacauggcaugcacacaugccaugguguccauauggagauuagggacuugguacaaguguuuuucucccucuacucuauggagcuccagauucaaacucaggucaccaaauuaacagucauugacaacccauuuuuacuaaacucuuacuaucuuauugucucccucauucaauuugcuguacucugugugaggcauucagagauaaucaacugcacauaaauaaaaaacugagaaauaaaagggacaugaggccuccaaggcuccuacacuucgauuauguuagaaaauauauuccaacauaccaccucagagccuugaaacaacaauagauagaaagaaaugcagggauuggaagcggccucuuccugacaaugccccccagaguagacuuucagccugcucaccucuaagacuccccuaggcugucaaucacauacauacccaggcucacagcuaggacaaccucagccaauacucuuauaagagucauucaggcucugcaauggaaaagcacuaaguaauucuugaagcuaggccaauaaggaaacccugcucuguaggaaaacuccuacagucaugaaacaagaaucuacagaauguugcuucucucucugaaagaaggcugauacagcucugacacucuacgacccucuacucaacccagaacgcuuagcaacgcucaccuacagaaaggcauaaggggagacaauugguuugguuuuuuuuuguuuguuuguuuuuuuaaagaaacagccauuuagacaggcucaauucuaaccacuuaccugaguuccaacagugauguuuggcauggaagaaauaccagcacuggauuugggcuuuuuauuuuuugcucuagcuuucucuaacauuuucuuccuuugacugaaaggaacaacaccccuggggggggaggagagacaaacauaaaugggucaaaaagcagcaaagcaguccguuaaggaaaccuaaagugacuuagucguguaaguacugcuggugugcagcuccucagcaaugucuuucucagcucaggacggaccugcaacuucuauuuauuuacaccuuacucauaacuuuauuaguaaauagcugcauccaguuucauucaaucuucagguuuaaauucuauaggaaauacaaccaauauucucuuuacaaugaacuuuuccuacaaauaauacugguauccccuaaaaauacacuuugaaagguuaacuuuagagccuuauuuaacuaacauacauacauacauacauacauacauacauacauacauacaacacuauugaggaaaauucaugcaaugaaauuguaaauuacauaucccauaauuuacaauuauguaauaacauacuacauauguauauguugaagaaaaggauaaaaacuaccugcaaauacuagccauaguuaucuguagauaggagucuguauaauuuauucuacucugugcugucaugaaacuuaauaacaugauugcuaagcauacaguguuugcauaaauguauucuuaguuuuucaaugcaacggcuuuaaagggaaacuccuuccugugucuacacagcacugucuucaaugaccucacgauggcauuuuuucuucaaagcugcuuucuauguagcaacaauauuuugugaaagacacuuaccaccaauacaaauuauucuccagcugggcacagguauaaagggcacagcaauguaaagaaacuauccguucuccuugaaguucagaguaagucugugcuguguguucuaacuuagaagccacagaacuuaauguuucauccacccauguagcaaccuaaggaagaugauaggagaggcuuaaguaagagcuguggucaacacuagagcaaggaauaauguauauucuaacgacuccaggucuaaaaugcuuggaguucaauacaacaaaaauaaaauccuucagacacuuuaccuggggguuggagagacugcucagugauuaaaagcacuuccuucucuuacagaggacccagguucagcucccagcaccccauggagccucacaacguccuuaaauccaguucuaagagauccaacacccuccugugaucaccacugacacauaugcaggcacucauauacucauguacaucaaagacaaaaagcuaccacacuuuauucccaaccauuccgaaggcuccaaccaugugcuccucuaagaauacuuaacagaauccaaucaaucgccuuaaagucacacugaucaccugacgugugauuccaggcuacagccauaccaugaacaugccugaucgcagcugaaauggaacaucaacacaauuuuaaccagguuuuccuagcuuaaaagccccuucuccuuaaagugucucuuaaacacuuuccuuucucacuuuucuuggguuauuuucuucuuuccucaacuauagaaagccacuuuaaacacugaauaauauacauaagcuggcaggauggcuggggaaaagugcuggcccuuaaaccuccaaguucagucagcaggucccacauguugaucuggaaaggacuggccgucacaugcugucucucaccuccacacauccccauacacucacacaacuacaguaagcaacuuugaauuauacuauaugccagccagcaaagacuaaaugcagauuacugcuguaaauuuucaaaggcuuuuaccauggaccuacaucagacugaaagaagaugggaagaggcagagaaagcaagccacagcuuuaagcgugaaacguccaucgaugcaaaaauggucccuaccuuguuauuuucaguagcuacaguugcucuuaugcuauuugcagacaagaggacuaucuuuucauuggucaaccccaaaaauguugcucguggaugaugcaaugaaggauucuuugaaagcauaagaaaaaaugauuacuacuucuuauguagacauguagagucauucauuccaagacuuacuguauauaacaauauaccugggcauuucuguaaggcucagauucacuccauuuccauugauaaaguucuccuuugcugcugacagcaagaagcucagaauacagagccccaaugcagguaaauuuuguuccauccuauaaaauaaaaauaaagcaaaacugugaauacaaaaauugcccaauuccuugauuuggacacugcuuguaaucacuacagaaauccaagcugccugcacaagcagaucccccucaagcuacagcauccucccgccucuggcucccuuccacaaacgcuccuucagcagcccugggcugcuuccucuuuccagacagaugugcaccaggacacaagcgcagcacuugcuguugucuuggucuucccuaugaggucauccauucccucuccuccaucaagucugugcagacucucagcagugcugacagccaagcucccauccugacacagucucaguucacaguacaugucccaccaggauauuuaccaguuuaucucacacaaacggaagaucuuauucaacacuguaguccagagagaguacucaauaaaggugcuaaauaaaggggggaggagggaacaguaagauucccucccugcggacacuucaguccugcccagacccugcugagaacaauuucccuaguuuguuuuuugugguaaaaguucauuaacuuuuaaagugaaagacacaauaaauuaggaugcaauuauauuuacaaaaaagcaaugacuguaaauaugauuuuuuaaauguaacacaaugacugaacucagaaggaugauacccagacaccuuaaagcaaaacuuccaauagcagcuacacugcugaccuaacuuggggauaucuaucaaggguucuaagcaacagguuauaccucagaauuuacaaaaagaucacuaacuuuaaucuuacucgaucugcucuaacuacguccacuucaagucacccuacagaugguaccugaagggugauacucaauacaacuucaauucuucaaguuaccacagcccuuucucugccuggaggcccccaagggccugcucucccuguaggguugcacugugucuuaccuccucugacucauucccacuucucaauccuuuaguuaaaauuaaauauaaugaauaguaucagcaaaugggaaccaaaacccaggcccacuuacuaaagcaaccuagguucgguuauguuucucuaaacccauucucacaucugaggugacuguauuuuaacaacuacugguuugggggagaggaaccaauaugcaaagccuauggcacaaguucuuacucagauuuagccaaguccaggcugcuccccacuucaccuuccugcauagccuucccugucacacaauaaaaucaccuugcuaauuucuugagcacccuccaucuccagucaaagaccuacuuuaaaggacgcacacacaggcacacacacuaaacacagccucuucuucugccccuuuccccauaaccauucaauuggcacauccuucagugucagccuagugguaaagugaccucguucauacuuacgcuauuucaucuugcaagguuucugaaacaaauacaauaguacuucuaggugccaaauggauaccccauaaucuaucaaucuauucgcucuaaaauguaugguggcaugaaccuccaguccgaaugcucagcuaggagaauccagaggucaaggccagccugagcaucagcgcuacugugcccugcuacauguccucucuuuuguaagucacuagcagcguuccuuaccacaucaucaguccauuuccuccaaacuaugucacuguccccuaaggcuccaccaucagccucaccaaauuuugaaauaugauguccacauuaucuacagaacucuucuacucucugcugacaucguuuauuuuuuuaaaaagagagcugugauauaauaacauaggcauaaggguugagagguacuaagaagaaaguaagccauccacacccaaaaccaugaguauggcaccucauagaagagagauggaaacugagcagauccaaauugguggguauggcuucugaaggacagauccaucuccacaagacccacaucaccugcagucccccacccuacugauggcccacuguccacaguccagcgguggaucucacauucuucucuuccuuuucucucaucagccuagcaacuaacaaaggaacgcugcacuugucaaauuccuugcagucuucuguccucuggaccauauuuuggcuaaggucuccacauuugauucaaaaauccuaccaugcucaaacugacuaaauuuuccuuuuccuguuccucuaguucucucaugauuccaacagugcucucuucuuuaaaaacuaacaaaaccucaccaaucauagacuuucucuagagacucugauagaccauuagucacugaagaacaauacauuaauucauuggcaaguugauccucagccauauacaaucuaugcuaucuuacuaucucuacuugguaaauuacagcagcaauccuguacauucacuguucuacaaacauacuaugagcuuucaugacucagaauccaugcaugauuaugguuaaugccaacuugacauugcuuaaaugucagauccucugugaagccuuucuccagacucucaagucaaguuagucauuucccauucaaucccuacagaacuuucuccauacauagcuucaguuuaguggugauccuacuaacacaucacacuccaugguaaaggcuccucaaugagcucuacccuacugcagcucauaacacagggcacaucaaucaaaugcagagugaaccaaugaaacaacuccaaaacaggaccauccugaaugaaucauccuaacuguaaaaauacuuauuuuaaaaaugacuugcuacauccuuccagaauggcccacuguucaccaagacaaguccuaaaugagccagcuggguagaucaggaccuggaaaucggcuauggaucaaugcugaggaauggcgcaauaaccagccuaaggaaggaaccaaaaggucacuuacugggacacucacugaacgcucauacaguaugcagcacauacagugcuaugaucaagagucugcugugccacuugcucagcuaugguucuccgccucauccucucucuccuaaugacaucccuucuguaaugcuucuuucaugugacccagucuuguuuugcucauuaucaaauuacacuucauacacuuuauacauuuuuuugucuugcuggccugguauucauuaugauauucaagucggaaaugaacacauggcacuccuccugcagucugggaucacaggcaugugccauaaugccugaguggagcgaacauuucauagacaguucuuagaaauuccuaagugucaacaaaccaagcuuacauuucuaaaacuuuguucucaugcgcauccacgugugacccaagguaaagugggcaaugagcauguuccaguagcagcugccuucucuaggaagcacucaccacaugccggccuccuuucucugccauuagagagacagcacauaacuucauauguaaagagcugcuggcaggaauaacauacucacuuccccuaaccuuucugaaaacagauccagaacaguaagggaugugacugcuaauuaacagugcugaucuggggaucacuucuguacuccucccauuaaacaccacugagcccuuccuccgagcuuagcaaaugaauacaagcauccuuuaaaucuaaaguguguuuugucagagcacaaagcaaaguuuuuauguucagugaguuuuacuuuuuauuuauugcacaccuuugaaguuucaacacgauacuacagcauauuacaguaaaauaguugcccugguugagcagacucaaacugaucaugucacagaacugaucauaucacagaacugucuucgaggcagcugacaccacuucuuuagcuacugucucuagcggaagugagaaguucaauauuugugcccugugugcaccuuuauaccuuccacugugucuuccauucacaccucaucuauggcagccaacuucacucugccucacaaugucugcucuuucuuuucugaagacaauccacuuaagagaaaucaugcaguaugcauguuucuaacuguuccacuuagccuacuuuccucuaauucuguuccuacugugacaaauaggauauuuuguuggcuacucauucccguguguguaugugugugugugugugugugugugugugugugugugugugugagagagagagagagagagagagagagagagagagagagagugugugucugugugugugagaguauuacuuacauaccauuaacaggcaguuuuucuauauucuggcuauugucuguaacacugcaaugagcaaaggauuguacacccuuuuacaaggugacauuauucccucuuagcaccuauccugacagaguguauagucuguugaccucuaugcacacuguggcacacaaccauccacaaggauagacacaauaaauuaaucaaauggauaaauguaaaacagauaaauuaaaggagagucaauuaaguaauucuguaaaauuaaaaaugauauaugaaaauuccuaaucagguuacugacuuuacuauugaccauagcacuaacaaacaacaugagcacuggcaaaaauaaucagucuaaagugcuuaaaaguuuacaacaaauaagcagaagagacagcucaguagucuacccuuccagaggacccagguucgauucuuagcacucauggcaucuaauaaguuuccaacacccucuucugauuuccaaggaagccaaaaaagcacauaguacacaaacgugcgugcagggaaacaccugauauacauaaaaaccaaaggaaagaacgaauaguucagacauaagcuauaaaauuccaaugacuauagauacaaaguuaagauuaccuuuuccuuugcugauaagcaaagacuguagaaacacauucuaugaaaugaaagagcuaccaaaauuuaauuuaaaaaaaaaaaaaucuuagcacaauuaaaaaaaaaaucacauuuaaauaagcaauuuguaccagugguuuuaaucugucucuugcaauagaccugaagguuucuuuguuuaguuugguuuuguuguuguuguuuguuuguuuguuuguuuguuuuacguuuucaggacaggguuucucuagcucugguuauccugaaacucagagaucugccuaccucugccuccugagagcugggaguaaaggugugcgccaccacugccugucuuagccuugaagcuuuaugagaaaagguuuuagugaucacuauagaccugcuauguagcaaagcaacaguccgucuagcagcacucagcaagcaucugugacacagaagggacaagauggguccaugcuuuucaucucuucugaaguguuagcuuaagcacauuuccaacuguccugaguuggggacuccaaggccuucuuuagacgcucacucaguucuccaccaaauaccaaguggaucccaauccuguucuguugcccacuuacuuccuucaacccucucaaguguuccccucaaaccuuucacucaggaaucacaauccuuaaccaaacaccaugacagagcucguacaaccagcgaaagacacagagcaauggcauccaacuccacaguuagagagagggaugauaggagggagagggggaggggcaggggagagagguaggaggagaggagaauggggagggagaggaggaaaacaagaaaggaaaggggagagugggagaagggcagggagggagagaaggagaacaacagaaugguuuagacauucuaucacccauuaccacccgagaaggaagcagggauguuuccagugcuauguuaagaacugagagaauacaauucaggccaagucugguagcucccaauaaaagcaauccaaagacaaggguuaaaguugcucgccccucuuguauucaaguuugaccacaugacuauggaagcaaaagacacauuaacuguauuaagauuuauaaauauaaaaaacauaagauauggaaguuuuaauauccuugcaauuuugaguucaaauaaaugaaaaaaaccucaggucauacucuucaucugcuagugauuaacuuccaaggugcaccgaugcccuuuccccuccuugagacagggucucauguggcccaggcuggccugagucuccugcuucccaaacaucagaaucaaagguguguaccaaaaauccaguuuauuuaugcuuaagaauuaagcccacucaaccaucuguggaaacagggagagaaggagggcauuuauuuuauagcaugaaaaucacggauuucucaaaaaauccagugaaaaugaauucaccacuuaggacaauggagcacacaccaucaacagauucuacuuaugguagagauggaucuauaaacauccaaaucaacuucgccaaucuaggugguggugccuucuagaauuuaccucuugcucuauuuucugccccuccccuacucucauuuggccuacuccuuugucuacuaagcaucacagggucuaucaaacguacuucauaaaauggaaauccauagcccuuaucucgucccuacaugcacccugcaucaaugacuagagcuugcccuguagaaacuaggguccauuugacauuucaaaccuggcagagucaaugccuaccaaagaauguaacaauucucauguguuacugagacuaccaccccaauccucuaauucauuucaucaagcaacaagugcaugugguaccuagcuugggaaugcaccagaagaucucuaguggucugcuucuaaaacaaagggcagauaagcacuuuaaaacugaugccucuuuucaacaguccuauaaaagucucauucaaucaaacagaaacauuuaauggagugaaugguuguuaggacucuaaugaaagguauaaacuuuucccaaauaccuuaucaggccaccacuguaagucuucucccagagacacuggacucugaacaggcguguucuucuuauccggguuugacucucccucuuugcugguagagccccuuucauuaucaaaugaggcuccaucaagccaccgccgcucccguaaacguagaacagacucccguucccgcagaagcucugagucucucucuaagggaagaaggagaacugguaugcaaucgggucacaccagugggauaaaaguaagccacucuaguccacacccugcaggacgcagcuaacagcacuuuacgcaaaaugcacagucaguaucuaaaugauuuggugggcaguuuuuaauggauuuaaugauucuggaauuauauuauucauauaaaauuacuauuucauauuucauauauucauuaaaaauacuuaguauaagauucuuugauuuauaaauuuuaaaaguucauaaauuagaauuucaaaacauuaaauacauguaagcaaauugggcuggcuaauuuuuaugucaauuuggcacaggcuagagucaucuggaaagagaaaaugaccccauagagaacagugauugccaugaaagggcccagcccauuguggguggugccacaccagguaggugugguccuggguacuauaagaaagaaggcugaaggaguccugggaaacagaagcacgcuccaugcccucugcaucagcccacaccccccuccagguuccugcccugccugaguucuggccugacuucucucagauacuauaauauggaaguauacccugaaauaaguccucuccaacuuaaacugcuuuuggucuuaguguucuacaucaacaauagaaauccuaacuaaggcacaaaccaagaguauugguuauaaauccuuaagguuuguuuuuuaaauaaacagaaaaacuuaaauagguugaacuauaaauauauuaguauauauacaaaaaaacuugauaacuccaguccuuguuaaaaauaaauuuacagaauggauuuuaugaauaaauuguauaaaauguuuugagaaacggacuuuuuuuaagggugaagggaacuuucuagaagucuucuuacacuuuccuaaaaagugaccucaaauuaucuaaagccacagccacauuuauaguuguuuacuuuuuaaaauagucaaaauaaucaggcaugguauugcacaccuuucucuccugcaccugggaggcagaagcugaaucucugauuucaaugacagccagggcuauacaaagaaacccugucucagaaaaaauaaacgauagauagauagauagauagauagauagauagauagauagauagauagauagauagauagauguaaaauauuaauaagguaaagauaaacuuuccaggauuaagagaacagauuagaaauaauccauagcuaaagcacacaacaccgaugcacaugaggcuagaccugaggcuagaccuguagcucaaaguaaagcacucguccagcacaugggagguuuggcuuccaucccccaacaccacuaaaacaucaaaaaaacugccaaauugccaagaucaaagcaguuaagugcuauuucacaugauucaaauuacaagcaucuacacagaauaaccuaagaaacagguauuuagggggcuggagagguggcucagcgguuaagagcacugacugcucuuccagagguccuggguucaauucccagccaccacgugguggcucacaaccaucucuaaugggauccgaugcccucuuucuggugugucugaagacagugacaguguacucacauacauaaaguaaauaaauaaauauuaaaaaaaaaagaagaaaaaacagguauuuaggagcugcuaauguuagaaaauaaauauuugaaaauucaauaacugacaguuuuaaagcaauuuuaaguaugcauuuaccuuuaaaaguuuaagcugcaacauguucacauguuaaaagguccacagauauguuauuuuaaaaaaucaacuucuaaguaccaaauauauguaagcaaguccagccucagcacaacacggcaucuuuucuagcuuauaauaacugcuaacuauagcuuauuuugucuauuauuuagauaaagcaguuuugagcucuggaaaguagauagauagauagauagagagagagagagagagagagagagagagagagaaagagagagguaggcaggcaggcaggcaggcaggcaggcaggcaagcucacuaggaauaauaauguaagcuaaagcuuacauaaacccaucagagguuggcuuaaguggcucaaaaucugcacuauauaccuuuuaaagaucucagacuuguauaaauagcauauuaacaaccuaacagaucuguccauuuaauacugaucggccccuuucuccuaaguuuucuuuuucuuuuuuucuuuuuugguuuuucaagacaggguuucucuguauagcccuggcuguccuggaacucacuuuguagaccaggcuguccucgaacucagaaauccgccugccucugucuccagagugcaggaauuaaaggugugugccaccacgcccagcucucuccuaaguuuucauacuccacuaucuacgcacuacuuaaaaugaacaugauuagauuguuuuaaucaaauuaagaaguauauuuuucugaaugcugcauguugcugaaacuagcauucuacuuuuaguucaauaucuaucucauagguaaaagcauacuuccuaaaucaccgccuuugcuaugcguuacacaagguuaaagccuaguuuuaaagccaaagucccccccccccccgcgcccccaaagcacggcuauguaaugacuucgcccuacuguaagaucuaagcucagauacagguggguuuaucacuagcucuccacacagucagcccacaaucaagaagaaauaaaugcaaaauuaccucgugaugagccuagccuagagagugaugaacgacgaaaagaaggauaaccaaaauagcuaauguccucagaaaacauggcaucagcaucaauaaugacacuugggugggcagagugaaugucagcgucaagaagagacauaagaucuucuacaaagaaaaacaaauaaauauaugaauaaaugaagcaucuacagauaaugcaaucauaaaccgcuaaaagaucucuggaaauuaaaauacauuaaaaccacagaccuggggcagggggaggagugucccccaagaucuaagaaauaaacugagcauuagaaacacagaccuuaaggacgaacagucugcauaacugcugcaggcacuacuuccuaaauucaaaaccucuuuuaagauaugauacuuaaugacgucauugaaacaaaauacagaugaaaacaaaugcaauucaguaaguaccaauguucagcaaugauauuaucaaaaaacaacauccuacaugccagccagggauaaaucuaugcaaugccgucauaucuuaauuaggaucacaccaaauccacugaguaaaaauauuuccccucaaaugggacacuauaagcaaccuguauagcuuccaaaugacaauuaucaucaacuauaaacucccaagcucagucgaaggaucacccaagcaggagcagggagagcaaagcacugaccucccggcagguaagauucacuggcugugucaucaccgucaucuccauccucaucaucccggcucaguaaguuauuuacagcaagguugacaucaagauuuguucucugaaguucucgaauaaugacacuucucgauuugccuuguagaacaacuugugccuaaaauaaacagaggauagugcuaugcuaauuuucucuuauuuccugaagucuucuaaguugguaaacaaaccacauuuucaacccuuaggagucacuagaugagcgagcccuuggcucagcccggccucccccuccauccacccuaagguucucaaagcacacaccugugauaucagcuccucaggaaugacagaugcuggaauaacuggcuggggcugacugcccaggaguccagacccccgaucccggccaguccgaaugacucgagucugucgccgggaaucacgagcuccagcagacgaccgaccagaggagccuccuccacuuccccccacgccagaacuccagcggcuucuaaauauuuaauaauuuuuaaaauuaaaaauuuuaaaccauuuauucuuuaaagucauuuugagucucauucuuguacauuagcuauaaaccuuuaaaaaagcugucuaaauuuuguaauaaauaugaauucacuugaaauaauaaauacacuaucauuuccaccuuuguugaauaucugcauacaaagagggacacggaaguguuuccuuguaaucccaccacucaggagauauuaaagucuagccugggcuacauagugagacccuacccaaaaucaaagggaagggcaggccuggaaagaugguugaguucauaaagaaggacccccaggcuuucuuggccagccuagcuaaggaaggagaugaguccaguucagagcccugcugcacacaccagaccagagugacuaaggaagacgccugacacacaccuuuagcauccacacaaccuacaaaaggcacaggcacacaaacacccacaaacacgugcaaaccgugggagaaccacaaugagucuaaaaacacauuaaccaaagcaacuugauuucccagaugaccugggaagagggucgccuuaagccuacuguuugaaccuaauuguuaauuucacagaaaaaugucccaguuugguugaacacagcggaaugaccgccauuccuaccaagugacauauacaauuuucucccaagcaagcaauggcagaaaccuaucuaagcucagguauccauccgugcuaaucuuacgagcaucacaaacuaaaacuggcaggaggcauaaacaggugacauuaaaaacaaaaacaaacaagagugccaagaccgagagaacaguggagaauaccuaccuaccuaacaguuguaacccagcaccgauagccucccgucacugcgcuguaccagcuggcagucugcaaucugccccacugccugugcugagguuaccuuacuucuccaucccuauaacugcugcuaagggaccuugggagccccacuguuuaacagaucaaaauucaaacaauaccuacuccauaacccuaacuacccccaagcauucuucugaccaacuuguuuagauaaagguuguuauacuaagcacauaacgcugguugaguuuuacuagugggcaacaagauaggaaugaguuaauuucuucuaauauuaguauguuagguuuuuuuaauagaaucaaaaaccaugacucuacucuguacaacuacuugucaaauuaguccuacaauuaauucuaauccugccguauaguacucaagguacacaaaaggaccagaaaucacacauaguauuauuaauuagcccauagcauacaaauguagagccuaugaaccaaguauagugcacauaauugguaaacuagcuuuaaaacuacauuauuuuuuguuuguuugagaaacucucccagucgagggaaggaaagaaaaagaccaagccgucguggaauccuacgcggcaugagauaauagcacguccugaagcucagcacucaaugcucagccaagcaggaaggccccaguucagauccacacuacacaaagguggguguggcccuguguauaacucuaaguccccagcuaugugggaagagagggaacauggagugcuagccuagcugaugcucuggaaagagacccugccucaaagaaguaggcagagaacaaaaagggggcacaccugauaauggucuccugucugggcacaugggacggguaaauaccuacucuccuuuuacauuccaaagcccaagguguauuaguucagaugaaauccuaaaggacugcaucgcucaugccaaccaaaagaagcuuaugccuaacuuacuuguuaaauagcaggaacagauuucugacaaucaaaaauccuuuuuuagccuuacuauuaaacacaaacucucuucucccagauuggcucuuacuuccaaccugguaugaaauaaauuaacaaaaacaauaggaaguuucugaaacaucucccaguauaaauaauaagcaauuauuaaugggaaaaaaccagcagcuagcaaucuagaaaucuuuaguccacaaaacugcuacacacacacacacacacacacacacacacaaaaaggaaaaagaacucuaaaaggaguucuacagucccaagaugaccagcgaggagaaaagagccccuuuuaacucucacgcugacaggaggaaaagcaugccaugacccaacacaauggggaagagguccaggacacauaaggacagucucauuccuacuugguuauauccaacacauuuaugauuaaucaugucccuuugaguacucaagaucugucuguucugaauucucaaaugucauaacuuucaaacuuuaacacuuauuauaauuaauggaaaaguagggaaagaacaaguaaaaaaaaaaaaacuuaugaaaaugauuguagaucuuuguaagccuaauacauaagccagcaccagaaugccccuuucccaagucugaucagcagcucaauguguugaggggucugggguugaguaggagcagguagggaagaacugaggggcagcucaaacauaaacaauucucugcauuuuaaagccauaaacccagcuccaguccucuuuggugguuuauuccaggccaggccauuauugcuaucuguugcaaguuucagcuauaaaccauaaaauuccacugccuuauaugucacucuguaagacaugucacucuaacuagcuuaacaguuaagaggauuuaaaucagggggacaauuucagcaacauaguagcaguuuaugaaugagagagagagagaaagagagagagagagagagagagagagagagagagagagagagaauaugaauucgaaaaaccagaguaauaaaaaaaggacuuuuaagcugagcgaugguggcacacaccuuuaaucccaacacuugggaggcagaggcaggcggauuucugagucucccgagugcugggauuaaaggcgugcaccaccacgcccagcaauagacaauucuuaaaucuaucuuuuacuuugccuaccaguucacacuguauauaguauuuuucucucuuaauuaguuuaaagcaauuucaacugcauuuaguuauuuugaucagccucugaauauuauuauauaauuugaccgagcagggaucuucuaaucauugaccagguguuuucagaacuguuggccauugaggcuggguauggcgcugcacaucuuuaaucccagaaucugggaggcagaggcaaccagaucccugggccuucaaggccagucuggucuacacugggaaguugggaaguucaggacagccagggcuauguagacagacccaaucucaaauuccaaaauagaaccaaugaauaaaagcacaugccuagaauuugaaaauggcuucuuugacaguauauaaacuucacauuaaaauaauacgggggggggggggggggaguuugggguuuuuguugcuguuaaaacaaacaaacaaaagaagcuaucagauuuggauaccaaaaaaaccaguaauguuagauuuucauaauucacaguaaauggccaaauauaaacuuuaaacuuucaaaugacacaacagcagugaaugacacggugaucuggauucuguaauccgguuugcauugguuauuuuuauccagggggcacagugagcuagcucugagcccugccauacugaugugcucagucaggacgucugcaacuggaccaacuuaccccagaguguugccugccaaccugcccagagucucagaaccugagagaaaccacggggagucacuuguccuuccuggccuagagguccucccuguccccgagcugcuguucaguuuugaccuagggaaaaucaagagaaaauaucacaugacagucucacaccuccaggcuuccuguucugcagggcaucagccucacaagucccaggcugugccgccugacauggcaccagcuggcagccaccucacacccuugcacucacucccaauacacucugcucaaauuccaaauaugaauaaaaauaguaguaguaaacuuucuuuauauuucaaaauuaaucauguuuuucuuagaaacaaccaaguaaaauucaagucuuaugaagcacccuuuaaugcacuguaacuuuuuaaagacuaaaauuugaaaguggagagugcaggaacuugacugcuuucaaaaugaguuccucuauuucuaacuaucagagacaagcaugauauguaaagucauuucagccacccgggcauacaagcauacaacuauauaccagcuacuuaggaagccaaagccacagaaccucuggagcacacaaggucaacagcagccuugaaagcagauuaaggccugugccaucuagcaccacagccaaccacugcaagugaaaucccaugugacugacccagcauguagugcuauccuucuuauaacuuagcauuccuaggugccaugccaauuaacuccuccgcaauuuguaauguaagcacugucuauaaacuauuucuugcuuaaaaauuaaacucaagaacuaggacugagccgggugugguggcacacaccuuuaaucccagcacucgggaggcagaggcaggcggauucugaguucgaggccagccuggucuacaaagugaguuccaggacagccagggauauacaaagaaacccugccuugaaaaacaaaaacaaaaaauaaacaaacaaaaagaacuaggacuauaggauagugacacaaugcuuccuuagcacgccuagggacacgccuuuacuucgcagcuaacaaaccucaucaauuuaacuaaaaaccaaacuaaccauuucaccauauuuuaaacuugauuuuucugcuaugccucuuuuuaaucuuuugaagauaaagaagaucaaaaccuugguuuucuauaauaccuucuaaggguuaaauucauacuguauuaauugcaaaauacaggauaagaauguagcuaggcgguaaagcacuugucuacuauauacuaugcucuauguuugauccucaacaccauaacacacacacacacagagcaaacaaaaaauaaugucuuacccaucauuauuaucagguuuacccaauuccagucugucugguuguacugaaaaaccaauccuacaaauucugccauccuaaaagcaaaaacaaauuaauuuuuaaaaaaguuaaauuuugcaagagaagacacuaaaguuuuaauuuauucaauaagcagauucugccugucacugucaacucagaagacaaggaaguccccuccagacacgggugggagagucuaacacacaguaacaaaaggcuacuaagaauucccuuaaaacaauacagucuggaagaauucagaguaaaauuauauaauaacuacacucaggagucuucccaggcagccauuaacuaguuucaaguuccaguaaaucauuuacacccaauugauucucugagccagagaacuuaacaaaaggaagcugggcauaacuaacucucagugccuucccuugacaagaaacaaagaacagaugcagaguuuaguuuucaucuccccaccguaugguaaaucauuuaccucaagaagaaacgcggcgugauugggucccaccacacacuguuuaauaguagccugcuccaguacauucagagguggguggcuagggaacaagaaaaaagcaugcaaguaaaacugcucuuuuaauuauacacaaaaagaacuaauuccuaaguggaguuuuaaagcaauaaauaaaaguaacugauaccuaccagaaucacuacaguugaaaggucuaccaaaccguuuuaagaaucagcauuaauggagacuguaauuuaaaugaaccuaacuuugauagaaagaguagagaugugguaauacacaucuuuaaucccaaaacaaacaggcgggucucugugcugugaguucaaggccucaucuacacaucaaauuucaagacagccagggcuacaucuccaaagagucuuaauguaaucuaauucuuaaucuaauaagucauauuaaccacauaaagaugaauccuuuuccuaagaaagaaaacacuacagcuccaugguagggcugaaacacagcccaugaaaaauggcuuaacuuaaaacagcuuaaaauguuuuaccuguucaaauuguacuuguucagcuucucugaaacuucccguaaccuucaaacacaaaagccaaguguuaauaaacccagcacagguccugcacacacaagauggcuccagugggccugcaccagcacugggccgauucccaacaguaacacacgagcaacucuuaaggauugcaagcaggcauugcauuuaccuucccuuucuaacccaucagcagcuccaggaauauccaaaauaaccccauuuccaaacaggaaagaaaaugaggcuucuagaguuuacguaacaaacaccagucguagagcuacugagcucugagcaaauaccuaauggaaaacuccuuuuuaaaaccugcaguuaacccaggcaugguagugcacaccuuuauaccagaacucagaagacagagcagucagccuuugggggugggggcuaugacauacaaccacagucuacgccaaaagacauucugacaguaugugaauauaaugaauugaaaauaaaugggaugcagagagaaucugugugcacgguguggaaacaucaccuguugauaaaaagcugacgggccacuaggaaaacagcaaacuagccagaaguaauuggcgggaguuucagcagaaagacuaaaacacacacacacacacacacacacacacacacacacacacacacacucucucucucucucucucucucucucucucucucucugggagagagucagagguguuguguguggucuauagacacacagacucauacauauaauacucauacauauaaauaaacuuuaaaauuuuuuuaauuagaaaaaagccuacagaaagucacagaacccuggguaaauguucuaagcacuacaguagguagaaccaggcaucucugaacuuuacccggcaacuauaaagccacucacuaccuacugaggcacaucaaccaugcacacugacugaugcccaccaaagcaccuaagugguuagagguuucaacugguauuuucauuuuuuccaaaaacacagaaaugaaaacugcuaauuucauucucacuacugugcaccccacccucugaacucuccucucacuagcccaguuuucucucuuuccuaacaacauauucccuugguucuggaggucaggccuuuccacuaaauuccaguuugcucaauuauauagcacauuucuguuucaaaacgagauuaaaugagaauaaugcauaacggauuucauaaccuguggaagaaggcuaacuaaaaaacgaaggcaaaacagccuagggucuguugcuccagaguuaacaggagcuuugggagaccuggagcagagauagaacucuagacuucccuaggcuaaggcuuaagugccccaccacagcaguggcacaaaggaaaaccuauuuauucacuagcaugucuugucaauaacacaaauugggggaagggaucaucaaaaaaaaacaaaacaaaacuggacaauagcuaaaacuaaaaauuaaaugcuucuguagcuucaaacagcacuucagguagaugcuuaugggacuaaacuaagcuuugaggaugucaaaaaaagcuacaaaauaauuuaauaacucaagagcaaauuacagacuaccaaagagagagaaaaugguuucugauaucagcuaauuuuaagauuaaaaauugaucugaaaacucaguuaaaaggggccugggaaccaaggcacagugguauacaccuuuaagccagaacucuggagacagagaugaguagaccuaugugaauucacuggacuacagugaguuacaaagaagccagagauugugaaacugucucaaacaaaaauagccagucagacagcucacaaaguaaagggguuuguuacaagcaaacaagccugguaccaggacuccaaucccuggaacccacauaaaauugaggaaaaccaacuccaaagcagucccccugacuucacauacacguucauauauucaaccuguccgaaaaggacagcucuccacaacccagcaugcucgcacaugcagaaugcaggaggcaaaaagaggagggucaaacuuguuugaggccugacuaaugugcauggugagcuccagggaaaccagaggugcaagagcaagacugucacaaaauaaaucuaacacucaguguuucuuuaacaaaaguuaaagauggugagacucuacacucaaagcggccaagaaaaaugacagugaguucuaggacagcuggguacauaacaagaccaugacucaaaaagaaaaaaaaaauaaaaagaaaggaaaagagaacuccuaacaacugucccaggcacgcagaaaaugcucaccagcacccacaacauagucagaggugcgggccucucugcucucugucuggcucagcucugcgaguucucaucgugcgaagaagaacuguuaguuauucugcugcuucucagucucagaauucuuacuaauacauaaaaaacaggucuaucagaggaucaccauauggaauguuuaugaaaaaguagcauuuacuaggguccacaaaauggcucagcacguaaaggugcuugcugccaagucugaugaccugaguuggauccacaaaacccacaugaugggaagagaacuaacuucuucagaaagccucuguccuccugagagugccaugacauguacauacacaauaaaugguuuuuuaaugaauuaaauagcaucugauauaucaaaaauccuagccauuugaaauuucauaugagcagauuuuauaaucaccuagaauguuaaaccaaauauuaucaacuugauucauaaauccaaucucaaaaauacauaaacuggaugguucuuucacuucucggggugguuauagucaacuggcuccagagcacacuggaggaaagccucccgcacacaugggcucuacuaaggagagccugccucucucugcaggacacagcccagcugagcagccacaggccacaggccaagacagcccacugccacggcuguuaacacaccagugcgccuauguaaccauguaaccaccgcagcagucugcuguaaaggggcucaggccagaagaugaaacacguucuuguaacaguaacacaguaaauuucucuucucaaaaaaaaaaaaaaaaaaaagccuaaagcucaucaaauuucacucacacauaaauguuucaauaaccucauaacaacagcagacagguaagccugugagauggcaguaacacacagcugggcaggcuggcaauaagucuaugacaacccuaucugcuguguuguucaauacuaaaaugugccccauauuccaacucagcgccucggugccuguuugaucucuuacacauauaauuuucagaugcagagacuagaaucuuucuuuuuuaaugugaguacacugucgcugucuucagacacccagaagagggcaucagaucucauuauggaugguugugagccaccauucgguugcugggauaugaacucaggaccuucggaagagcagucagugcucuuaacugcugggccauuuugccagcucgagaaucguuaaguggcaaacugacucuuucuuagcaguaccuauuaggagcuaacacuacuauuacucuggaaagcccauggagccugucccacuguccccaacguaguagauuucaaagguaacuuucacagauccuacuuaggcacagcacauagugagguucuucaguucuuaaacucugucuacuuacugccacaaaccagaucucuaaauagucagacacagcccaaaugcaauuauaauuauauucuugaugaagaacacagagguaggucccugaagcuuuggcucuuccucauaucccacccuccaagugcugcuucccacacauguggaagucuaagaguggagagcuugcucgaguguggucugccuucagcacacuuccccgaggccguguccagcucagacacccauguuuccuggcaguccuaacuuuuucccacagacaucugcagcuugccuuuccucucaaaucucacugugaacauucuagcuccguguucuugucuccaguguccucacacauacugcaguggacuugccuccagagucuuucccuagccucccaugcaaucccaucagucaagaguaagguacuuuauaaaccguuucagaaaaaaaaaaaaaaagagauucuuggucuuaauaccaaaagaauuaaccuccaggcuucuaccuuaaagaaugacaauuaacuguguaaacauauaaauuuguuuugagguuaugucauuaucugcccauguuaaucuuggggagcuugggaggaguugcuguuauugcuguuugagacggguucuccuguaaccuaagcugaccucaaacugacuaucugccagugaugaccuggagcggcucugauccuccugcauccaccucuugagugacaggauaauagaugugugcuucucacacaugguuuguaugauacuggguacugaaucuacagucuaccaacugagcuacauccccagcccccauaguauuuuuauaaguaaaucauagcuaagacagagacaaaacucaauaacuuaccccuuaauaaccacuuuagcaaacagccuuuaaagugaccccacccuaacuucugacuagcuaucauuuguggaaugauguucuuaucuaaccacaauuuuauuuaagaauaaaggauuuaauucaaacaaaaaaauuuaagaaaagccaagaaagguuacugugucugcagaccuaaauuaugauuaagagaauuuuaaacucaucuuuugguauuccaccagagaagacauccauugccaagacaaauacagacacauuaaaaauuugggagaagauacauucuuuuuugcuuguuuguuuguuuuuugauuuuuucaagacaggguuucucugucucccuggauguccuugaacucagauccaccugccccugccuccagauacagcuacaugugugcagccuagcuguagcuacuuauuuuccaagagacugcuggacaccuagggugccaagcaggagacuuccguacuagcagagcauuucaguaucauuuuuagguaacuaaaugaugguuucugaaccguucagggcagugcugaaucuggcagugacccaugaauccaagcaagauucaucuauagaggcauaugcuaucauguggaaaauacuuuugcaaagugucaaaauuauuacugcucauguuacuacagugucaggcucacaaugacaagcuucccagaguuucugagaaagcucaaauucugguuugaaaacuugaugauacuagaaacaaauaccauccaguuguucuuaaaauuuguucuaaaaugacagucauuucaauuuuuuuuucgcuuuuuuuuuuuuuuuuuugguuuuucgagacaggguuucucuguguagcccuggcuauccugguacacucuguagaccaggcuggccucaaacucagaaauccacugccucugccucccaagugcugggauuaaaggcgugcgccaccacggccagcugacagucauuucauuuuaaagggggagaaaaaucuguuugaaccccagccuggguaaccaaauugucagccuggguaacccuucaaauuaaauagucucuauaaagaaagucacugguacaaucuaaucuacaacuguaaaagggucaccaaaaagcuucuuucuccacacaacuacugaucuccucaauucaucaugcuaaguaaguguucaggugaucuacgcugagacacaaagauucacaagugaauacauuuuugcugccuuauuaucaagaacacucuaaaaugagaugcuuucccuccaauucuaaggaagcccgugacucuuggcacagcguggguaaugcuucaaucucucauuaaagaaccauuauuuuacccacaacugcaucugaacuauacuucaaaugugaagaugauuaugaagacaaucccagcauuacggugaacucuccaggcgcuacaaaucauacugcugugggucuacacuagaggagcaugcagugugggagcaaaggguuugccacacaaauauggagagcugcaaucagauagaccccccagcaccaacaaaagagcagggaggguguaacagcaugggauacugacuucauacagucacacacaucacacacgaaaccacacgccugugcaaauauauccauacaccacacacaugaaugcacauguacacacaguuaaaccaaucaauaaaugaaaauuuuaaaauaacacacacaauggcaaaagucauuauccaucuucucaugagcaaucacaaaaauuaaccaaaauaaccuggcaaugcacuuaaaaaaaaaaaaaaaaacuuuucaaaggccaggcacagugacacaucccuuuaaucccaccaccagggagacagaggcaggugaucuuaauaguugaagccauuaccaaguuccaagccagccaguaucaaaaagagagguuggggaugcauagcaacuagcucccauacuacagcagugaccaaaugcccuuugcugguuuugguguggagccagcuaauaggaaaggaccacccuacccugccuugaaaaggccauuuccuugguggugugcaaucugauugcaggcuucaaauccccacaagccuguccacauuuccucccuuuauguuuggucugacaucaugcuaacccaucuaauuccugccuccccuaagagaaccaugccgagcaguaacuaauaccugacauuacucuucacugagcccuggucacacaaaggauagcuuuuagagggacacuuucagccuagucuugccuucugaaucaccacucacaagcaggacuuauauucgcuuuaccacuuaggaagaugacaaaugccaaccuaggaaagacugucacuuuaugucacuuaauauaaaugacaugagacaaucucaagaugcaucaaggugaaaagacgcguuucuaaauauguacugugaauacuuagugaugcaaguuuguaaauggucaucuuuucauauacauccucuaaaaugguuuccaguuaaaaccuugaagacuuuuaugaaaugaaaauggcaaaauuuaggucauaaaaaccuucugcaaacuacaauaaagaaguacaguaauuucuuuacaacacaaauaauuucuucccugaaucuaauuucuaugauuagaaauuccuacuuaauguuacagauacuguaagccaaggagacacaaauccagagacacucugggagaaggaauaccaaacacacaaaaaugagucauuuuccuuuaaacuaaaauguaccauguuauuuucagcuccacucuaaacaggaaaauggaaagaagucucaugccagacaaaaaggucaacaauauggccuucuuaccgguuacuuuuugauaacuuuguaagucuugccucaucucacuucuuuauucucccccuccuccuaggcaggucgggccucacuggguagcuagcucuggcugaccaggaacucacuguguaucuagaccagacaggccucaaauucagagauccgugugcuucugccccaugagugcuggcuggcacugaaggugugccacuacucucaaguuaacuuuauuuuuaaacaauaaacuaaacuacaugggaaccaaacccugucaacaggacaagaccacgucacagcucuaguucaaaagauaugggaaccuugcucccaggcaagguucccauauccugauccagucuacaucccugcagccucauucacagcaaagucuccaccaacugaagauaauguguucuaauuauucuagacccaguuuuaauucuacuuagaaauaaagucucauaacagacaacuuuauaauauagaaaaacuuuuauccuugacauaaaccguaagccacaauaaaauacuuguaaugaaaucugacuguucaggggauuaaggccauccauucaccugaccaaggcucacucuaucagcuucucagaacugcaggcuggcuuccuuauuuaggcaaguagcagcuuuuugucuuugaaauguuccaagcucuuaugagagacagacagcacaagugaguauucugcaguacaaagcaagccugcgccaggccccaagcccacugugacuuuggcuggcuuuauagccuuacagaccuuagaaagcuucuucuccuggucagugggaauagaaccaccugucugguagaggugcuuacagaacgauuagaggugauucuuguaauguaucuuggaaagagucagucauuuaaauguucaauaguagcuacuauaucaauauuguaaacuucaacuuuucauccuuauauugcaugcucuacugaacuucaaaucugcucacacuagcuuaaacugguugccaagccaaauauggcccaauuuagacccugaaaucugguaggacucugaggacgcugaaacagccagacuccuuggcgacagaaagccgcagcuacucaguagcccuccaucccuaugccugaguccugggcucauggagagugagugggcuuuguuugcaugauuguugcucgcauacaacguuccuaauccugucuccucagggggaaccucuaauccaagccuccuucaucuugucccaguucuucucuccagcacacuugcucagccaagccaucgcuaacucagcuacuagaaaaccagucauccugaacccuaggaagccaagcacuuacucaaguccaauguucccuccacggcacuguguucacuguugcccuugucuggcaaacucuuaaaaaggaaaaagaaaaaaauccacuuuauuaauuucuaaauccuaacuggcaaauacauuacacauguuuacuaacuauauaaauucacaugucuuuaaauccuucauuauuucaauagugagauccuagccuuuucuuuccuuuucaaaaacaauuuuaaagaguuuacuaauuuuauuuuauguaugaguguuuugccuaaauguauaaguauaccacacucaggccuguaccuugggaggccgaaaauaggccugugauccuauagaacuagagccacagauggcugcagccacccuaggugcugagacucuaaccgaaauccuuuggaagaagagcaugugcccuugaccacugagccaucucuuaucacucuccagcuccaucccauccccuccuuggcaauaauguaaaacauuugguaagggucuggagagacugcccaauagguaagaacacuugcuaagaaagcuugaagaccuauguucaaauccuuagcagucacauaaaagccuaugccugcuaauucauagugagaacagacagacagaggcugagaggauuugacaccaguuuagccagcggcacacuucugacucagugagaaacgcuaucuucagagaagauggaaagcuauuaagaaagaugcauagaagauccguagcaaaacacacacacacacacacacacacacacacacacacacacagaacgguucuuuaaagcauaccaaaggaguguuauccuguaagauaaccacucuggaauacaccccaaggucagcugcuguugcaacaguauaaggaauuuucucggaaaaaaaaaaaggguucaucaaauaagacuggaaaaacacucagcaucacuguacagugugguaccagugucauccgcauaggggucagccucuccacuuccaaacccugcagcuaaauagacuguuccuagggaaaugugccgaagggaccauggcagaaccagggaagggcagaauaucauuaggacucggaaucacaaguaaacaccuauuguguuuaagugaccugcccugagccuuacacugugaaugagggacagucugagcacugcgcaguuucuguuggcaauacacacauuauguucuaacaucuaagagaacaaaauaaagaauaauuauaguaaaaaaccgcacauaccaaguucuguugauuucuugaagcuagagauaagcucaacaguuaagagcacuuacuuggaagaccacuguuaucuauuuacacaccgggaauuucaucccacaugaucauauugccaacucaaaacuuuaagcagccagagugauucuaacauuaggucagucuaggacuggcuacucugaaauaucauaaagguacaaagaauucucuuggcccugaaucaaggcuacaguuuacugaagcuguugguuucaagcaggagccuaaagaaauaucuuucuauggucuguuggccauugcagaaauuuguaagucuaauggccaauucauuagaaagaaacaucugggugaaaaaaaaaaaaaaaaaaaagaauccucuaaaacauucguaagcacaaaaguccgugugaagagacuaagcgcagugccuccacuugggagacugguuuaagacaggccuucagaaacucaccgcucacaagccuuaguuaagcuucuguaagaucuguaacacagaaaucuauuaacucugcugaaucuuuuguucccuaaauugaaaccaaacagaaacucucuaauaagaucuuagggagauagggacacugacuugacagcuaaggcaacccaagaguuaagaagaccaaaacuuuuccaucucuaucccagaaccaugggaaauuugaugaauuaauagacuuccucucaaagagcaaugacaacugcucuuuaaacaauaacaacagauccacuuuucuuaucauuuaaccaacugaacacaauguguccccccuggcucacuguagcccugacuguccucaaacucagagacccacuaccuccugagugcuggaauuaaagguguauaccaccacacccagccaccacacccagccuaaacagaucuuuuuuaaaguaaucaacaagaacaaucccaccugaccuaaaguuaaauuauuuaaaaaugugaaguaucuguauugcaagaucauuuugaaaagcagugucucagcugucaaggagaucgcugaccuccuggauucucugcacuccuuccauucccaagugcugggguuaggaguaugugccguaugugcagcucaaacugcauucuuuaaacugaaauaauauggcagcaaacagcucucaggcagaucuuuaucaaucaaaaucaaccugccuuuaagaagacagcaggauugccacagguuuucccuggacucaggcaaacuuuacucaaauccccaagacuuauauuauauacucagaaugggucugaaacuuauaccaaacgcucuuugaaaucuuuaccuacuagaguucuuaacaaugaacuucuaaugcugaaagacuuccuuuaguauaauucugguacauagagcacauaaagaaaauaacuauuucuuaacacaccaaagacaguuaagauucacaaaaaacacuuuuagaucacauggaggggagaauucuaagauuugauaucacauucagacagacagacagacagacagacacacacacacacacacacacaaucuuuucuuaaaauguuauuaaacauuaagagaaauuaucaggggauugauugucuuuaaagcccuaauugugagaccuaugaaauucucacagaauucauauaaccuuacauguaaauuguuuauuuaaacuagccucuauauuaaaaaaaaaaaaaaaaaaaaaaaaagucugaauugaggcuguagagauaaagacggcucagcagcuggcuacucuuccagaggacagacaaccauccagggccccaaaguccuuucuaaccaaaucuaaaucccggcagcuuuaagagaaaggaaagcauccagaagacacuacacaaauacaacauuuagaauccuuaaaaugcaaacggagaagaagggagacacucagauuccuucaaaugcaaauggagaagagggccuggcugucagccagcaggaggugggaagguaccuuaggaagaggauuuccagaggaaacaaaggucaacaaaaacuuacaaguacaggcauaccucuaaaaaaaggaaaaggcaccauuagucugcugagcuugcaagucuuuucugcgcuccacuuaaagcaagucuaaagacuccaccuuacacuucucuaaacucuucuaguuucaagucauuagcuuggcagagucuguaaaguagacaacccagacaaauucuaagcacaacaucuagagcuuaaaaaagccuggccuuuaaacuaaauccugguguugaucugaaacacucaagaguggcucucccccuccucacacaccaaaccugauccuuaucauguguccccaggaaaacacuugcaaauaauuguaaauuauccuuuuauuuuauguguauguauauuuccccugcauauuuguucacuacuugugugccuggugccacagagggcagaaggugguaugggauccccugaaacuggaguuacagaggguugguugugagcuuccagauggaugcuaggaauuuaaccgagguccucuggaggucuuuaaaaucgcuuuuuaaagucugguccguugaaguugaagaggaugaccaucauguaugucuccccuaccuaagguuugaugaaggagaggggaccuaguguagugacaauucuuaugaucaaaugaguaaagcaggacuugcucaugucugacaccagugcuuaguugugaugcuuucuccauccugaaaugcugggccugagugugggcuggggacuauugggaucauuagagugcuacgaccagcuuugagcuuagaaacugaaagcacaguacucuaaugagcuucaguucugucuaguguugacacagcuaucaaaugccucuuaaguucuuuuucuugagacaguaucucauuguagcucucauuaggcacaacuuguuauuuagaccaggcuggccuauaacucaaaagaaagccuccagccucagacucuccagugcaaccaagccccucuuggugcuuauuuuuaaaugaauaagugguacauggauucaucuuuguucucuucauccaaaaugcacugcccauaaauaacaacaguugugcccagcaccccuuggcccucuagucgguuccuauucagcauacccugcucucaucugcagggguaaaauagaaacagcaagaacagcuagcuaaucugccccaguuccccaccagcucaaaugucuauguaaacuuugaucuaauagagaguucauucuagaauaauggcacacacccacaaugccauaccagcacucaggaaguagaagcaagaggaccacaaguuccaggccagccugggcuacacagcaagacuaggauagaggagaaacccucaccacccacuguaucuaucagacccucuaagcacagagccccgcucacacuuacuugaaaggacuaccauaaaacaguuuugcaguuuuagguuuugucaguguacaauuucacauaaaagaaaaaguauuauagauuauaaaguccacaguccacuggguuuaacuaucucuagcaccaaaaaaaaaaaaaaaaaaaaaaaaaaaccuaaaacuaccucagaccacaauuaagaaaaauauuuucucugauauacauaaugcucacugaaauuucucagccauuguuuaauuuggcuuaaaaccuaaaagcagacuuuacuuaauuggucacuuccuaucacugcccauucgaaauucuggucagucuagacuuugaacuucagaugcagguaggcccgaggaccugccuauggcugugucuuccaggcaacagaaagccugaagacaggacuucuuuuaauuucaaauagaugaacacaaaacaacaaagggaacugcgugagcaaaauaaauacugggucuuucuuuucauaggcauacaacacuuacuguaaguucacugcauguuuuauucaauuaaaagcuucaaaaacaugaaaaaaauguaugaugaauacuacuuuuaaaauuaacuacaaauauuagaacaccccuuucagcaaagcuacaguguccauuucgaguaaucccuuacccuuuauaguacuuggaacugauccuagaaccccaccaugaucggcaaguacucuaaacacugagcacuccccggcccugguucuaauaaacuccaaugugagcaaaugcugucuucuuucccuuguggggaagcuacauuuauuacaguaauaaccuacuaugcuggcuagucuuaugacaacuugacacaagcuagaguccucagaggaaggagccucaacuaagaaaaugccuccauaagacugggcgguaggcaaguguguagggcauuuucuuaauugugacucaugugggagggccuagcccaugguggguggggccaucucugggcugcaagucuuggguucuauaagaaagcaggcugagcaaaccacugggagcaagccaguaagcagcaccccuccauggccucugcaucagcacgggccuccagguuccagcccugcgugagugucugcccucacugcuuuugaugaauuguuauaugaaaugcaagugaaaugaacccuucccuccccaaguagcuuuuggucaauggugucucaucacaguaacccuaagacacccacccaaagagauuucuggaauccaaucuccuuaugaaaccuacugaacacaaguuucuuuucauauuauucaauaccugggagaaagucaggaacacagaugccacagaacaaauacacaacccaguagagcaaagccaucaucucaggucauaugucugcagagaaaagcagccagcccugagucugaccaaucaccacauggaacucaugggaaaggaaaggcuauuuucacaguaaaacaguucaauacuaaccacuggccacauuccgucuaagucagggaagaguauggcccacauuccucaaugagacaccugaucaacccccugagguagcaccuugcuucucuacccuacgugcuuuugggagcucuguaacauuucaaguccacuucaacacuuccaucuugaagcacuccauucacucgagguuacacuuucaccagacgugucauuuacugugcgaucagugucaagcugcccaugcuucuguaugcaaguacagagucucggccuguucaggguauccaaucuccuucucaacaauucagucuacuaccauuggcuuaucaccgucuagcaguggcucagaacaaagucuuagaugcacuugcccuacucacucucccucagcaccugugccagcucagaaaggguguucgucaaugaagucauauggcccaagcuuaagucagacauaaaaguggcccccaaccugggccccaacccgguucuugagucuuccauucacugagcugccacaaaagaagguuaagguuccuuguggucuccacacugaagacacaccuauggagccacuaugccaguauucaggugcaaaugcauaggguagaccagaauauaugacccaagcggcugagcucuguaaauccccaaaaugacagauaauaauagcaaauggccuguguuguuuuacccauuaagcuugaagugacuauugauacccagaccauaaaagccgagugacgaacgaacgaagaggaacuggcuguguccucuggcuucauucccacugccuaggaauaaagcuucagcuaugcuuuggacaucuuccugucauugaguuacauuaaaaacaaagccagggacugagaggguggagcucaauguccauggcauagcauuugccaaaggugcaggaggagacccuggcaccaccccugcacugcccaaaaaaaaaaaaaaaaaauccuucacaucauccacaccgugaacccccuuauacaauuacuuaaauacauucuuuucaaauucauucaaccgcaaacucaacugaagaauaaaucucugcacaaauaaagaccauuccuuaaagagcaucaacagcaauaaaacagcuucccuuguccacauugguaacuagcacagcaccaacaagccaacaacugcacacaugguggcaggauucccacaacagucugacuccucacccuaacaggauccugcaaaagaaaucaagcuaagacccaaaccuuggccacugguucaucucuuagaaaacaucucuaaacaccuuccagcccaacacugcaaacuggacucaagcaguggcuggguguaagguguuaucuaacuguaacacaguccaauauaaauauuuccaaaguaaaaguggaaauuacacaaggcucauauuucacuaggucuaggaaaaaaguaauauugggaauacaucguaacacacaacacugaaccaggaaaaaaacuauuacacacaccucagcuccgaguuaaugaggugggugcagugacacccugugaucuggcacugggaaggcuguagcaggaagacuguuucagaucaggauuaucaagaccagaggaggcaugacaccggucuuuauuuuuaaaggagaaauguuucuaagauagugugugugugugugcguucugugcgagaaugcaccuaccuguguacacauggauguagagaccagaggacaacuuccaugucauuucucaucuggcucucccuucuuuucagagagcaucucucagugggaucuuggccuugguagcugggaccuucaccuccuccaugcugggauuucaacccuguacccccauacccagcucuuuucguuugguuuaguuuggucugguuuuagacacauacucaacuuuuuacucgggugccagggacagaauuuaguuccucaugcagagccagcaagcaauuuacuaaccaacuucucucuccaacccugagaaauuuuaaguuacugaaaacagaaacuguugugcuucaagacuagaauggugggcuggugguggcaguccuuuagucacagcaaagauguggaggugcaggugaagucuaugacaugccagagcuagucucaaaaaauaaaaagaaacagccugaauacagacugaaaagauauggccguaaagaugaauguaaccaaacauuuuuguaaaaaugucuucaugauaaaauucaaaugaaaaauuguuuugaaaacugcuuuauaucaacauuaaggagaguagaaaaaauuuaaauauacaccauuuacugaaugacuauccuuuuuuuuaauucuaagguauaagaauggcaaaguaugcuagagagugcuggcgcacaucuucaguccuacacucaggaggcagagaucucugaguucaaggacagccuggucuauauuagagugaguuccaggacagccagggcuagagaaaccugccccccccccaaaaaauaaauaaaacgaaguguuuauauagaaaaagauccacauauaggggaugaaguaucagacucucaaacaauucagaaauugugauauaugcauucacuuugaaaacauggaaggcacugaacuaaaccuaugaaguagacuagccgagaacuuacuggauaguuuugaauuuuucugcauguuugaaauacucauaguugaaccacagaaaaaaacauuuacugauucuuuuguuuguuuguuuguuuguuuguuuucaaaggaggucugagucuagcccaagcaggcaggcauaucaaccugucucagccucccucccucccucugcacuguugggauuacaaaccacagacaugaacuccuacuacaccugacugaaaaacuucaaaaagucacuaucagaaaaaaauacauaacuacaaagagaagguccacagguuggaaaugucuucuccauuucacucaaagaaagacaaagaaacaaaguuaaaagcagaaauaggaggaggagauagagaaggcagauggcugagcuggcuccacggguuaaaaccaacagaaaccacugguugcgcuggcugcagaguuccugagaacucagaguagaagagggugaacacugacccuacccacagcaccccugcccgccaccaagcacgggcuguggggaaacauacacgugugcccuccaccaccacacaaauaacaaaauacaacucucuaaaucaagaugaaagucguucuuuuuuuuuucccccuaaaaaaaucagaauauagaugugggucucaggcccuaggauggcccaaagcuugccuaacaugcacaaaguuucauccccagaaacuacauaaacugaacaaaaugaugcaugcugaaaguagaggcaguaguaucaggaauucaguuacacaaugagucugaggccagcccagaacacuugagacucugagccagauugcucuauagguagguaggcgggucagcaggcaggcaggcaggcaggcaggcaggcccugaggacaugauggugcagccuuuaaccuagcacugagaaggcagaagcagguggacagaucuguuccauucacuguguagcccaggcugauaaaggugcuucuuucugccuuagaagaccacuucccuaccaggcagcucccagcccuccaucaacccguuacuuaagcuauucacuaucccaucccagcuucauuuucagucaagggucccuccucccaaaacuaggaaggcgaccgccucugaugaagaauccugaacucuccuacagcgaccaaccauauuuagggcuggcaugccccacccuccaacccccagaacuagacugacauguagcagaggccccaaaauccugcuaaauuaaugacaaaguccuauuuuaaauaaauuauaucaaauuagaugcacacacacacaaaguguguaaaaauacaaucuugaaauacugcucauaacguauuaauuaaaacuaacuaauaauagaagggucagaugacucuuggucucauuuuacauaucucugugcuaugucauuauugucuacaggacgggccaacugcccacagugagcaagugagcagaagggcaugcagagugcaagccccgcccccaacaccaucuacucucuuccaagagagugaagcacuggccaacagcagccaggucucacaugcagugagccuccuaucaucugcagacaaacaaaaacacuguugacauguuuucucaugcacacacaggaagagcucugaacuauaaucaaaauccuaauuaucaggccagcacucaggaggcaggaacaggcagaucucccucaguuauuauacagucaggucauaucucagcucaacaauaauaaauacaaaaguuccuguuacugcaaaauuaauaacucucaaaacuaccugauagaaaacaauguaacuccauuuguuuccuuggaggacaggcacaugugucugugccauccaaagguggaggucagaggacagacagcuugcagucuccucucuccuuucuccacguggcuuccagguauuaaacucaggucagcaggcuuggcagcaaacaccugcugagcccucagccagcucaagaaaacguuauuuucuauugcuaguaccuggacaaaaugccaaaacccacacagcauaauuacauggaaacucuauuacuccugcaaccucuuaccagucuauaauugcuucaaauaaguaaagaaaagugauccacagcccaaccccacgaaguuacuccuugaaaugucuaaccuuugaccucccucuuccucagugacucagaaaaagcuuccaacacuucucaacccaaagagcaaggaagagcuggucugcagcuguuccuggagauguuugcugugagagaggcaaacgggaagguggccugcacuguccuuaagcucugacagcagcucagcaagcaacugcacaggcucccuuaccaaugcuccacacuugccacuugccuguugccuuguucuucuccacccaagcaguaagcuuccugcugacuacccggccacccugggagaggcuagaccaguauaacuuaaccggaucuuguuggguuuccaggcagggucucucuguggcuguucuggaacuugcucuguagaccaggcuguccucacucaaacucaagagauucaccuuccucuaucuaucuccagagugcugggauuaaaagcaagagccauuuccuggcuucuuuuuucucaaucuuaugguuaaaaacaaaaugugaacaaaauauuauaaauaauuccuugcauucugcucuuauccagugaguguguaugaagacacacaugcacacaaauacacaccagaauauucuccuuuaaaacccgacagcuauggacugaaagcacgggagacaaagacuaggagcagcggagucccagcaaguuuaguacuuaaagcuugucgucaucggcuaaucuuguuuuccagugcuaaggauggcccaggccugagcaccacgggcaacccucuccuauaacaaggacagcugagagccuuuucaaugguguccuuccuucauacucugugcuccuaaugacacuggucgguggucaucagguacccuaagaaagcagcacuauaggaaacuaagaccucuaucugaaaacagccacaaugaccuacuacaauccaacuaggauaugcugcuuauacaauauucuucagggaaguggucuuuccacgccaaaaaaaaacccacguuugggggccacagcaugcuuagacaaguuggucauaccuguaauccagcaauauggaggccaaagcaagagggcgagggccaaggauagccuggacuacacagcaaaauccuauuuauuuauaaauaaguaaguaaauacuucagccaagauaacuaagagagacuacucugaaagaagacacaagcuuccuagcaacugaaacagaagucacagaaacacccacuuuccacccuacauucaagagcuuugccaaacuacaucuacucaggaaguacaguguggccucugacaccuacugacucccaucugcagauggaaaugcucucagaagucauaggaaggugagcaacugccaagaggaccaacacccaacacugcuucugcauucccuaggcagugacugcauccuaacagagauuugaagagucuguuguggcaaucuaguucauucucugcugcugaauauagaagacaaaguaguuccuauaauucucucagagaagagucauccuguccacagcacucaagcauuccuuccugccucccuucuucuguuccucccucucuccuucccucccucucaaugacucuaaccccaagcacucuucagaacaccugucaaaagaauaaaaucauuuuauagggagaaaaaaacaaaucaauguguuuuaaaagauaaaaauuaacuuuaaacucuccaucaaauuaacuuacuucauagucucaacuuuuuuucuuaagauuuacagaauccacuaauuuuuucccauuaauuuucaauucucaaaucccagcaagcacgcucucauucuucccaccccaccgccaacacacacacacacacacacacacacacacacaaacacacacauguacacuuacacaaaacccucacagcucaguguccaccaugccucuuaaauaagagucuuggagaggcugugaguaggcugcaguuugggauauugguauuguuugguuaagguuuucuggaggguguauaggaggguuugcccacagucuuacucuauaucuauagcccaaguuagccuagaaaucauggcaaucuuacugccucagccuccaaaugcugugacuacacacaugagccaccaagccuaucauaauugguguguuagcuuggacaaagaugugagacugcucauaaauguaauucugaaaguucaguucauacuggagcagaggcaagcuaucacaaugaguggguucucgauacuuuugguccuauaugacaaaaauauggcccaaacuaauggggaagaaaauauuuauugauucauuaaguuuuguaaacagcaaucuagaauauaauuacuauaguugauagaaauuuuuucuaauuucuuuauaaaaauguaucauuuaauuuuuuagauauguuuugccaccaugugucuguaagccauguucgugcccaauccaagggcguuggauccucuagaccuggagguaaaaugccugugagccacacgguacuaggaauccaugucuucuggaaaguagacaguaucuuaacagcugagcacuucuucacccccaauauaauauaauuuuaauguuuuucaugaacuauaccaucugaaacugaaaaugguauuucugcuauguaaacaagauaaagugcacuuacaaguaaaauagcauuaaauguuacugcuuuauuaucauagcaagaauguaaaugcuaaaagaacugucugaggacuuaccguacuuggaagaaguuuuauuauuccuauacugacaagaguauaauacaaaaaugccuuauuaaagaaauaauuucuacuggucagugguggugcacaccuuuaaucccagcagaggcaaguggaucucuaugaaugaggacagccuggucuacagagugaguucuagaacagccagggcuacagagaucuccugagggaaaugaguggguucuuguugcucuuaugccccagcacccacacgguccauagcaaagggccagagaaucaauguacgugcugcacacacacacaagcuggcaauaauaaaauuaaaguuuaaauuuaacaaaaaggggcuggagagacggcucagugguuaagagcacugacugcucuucggaaggucugaaggucaaaucccagccaccacaugguggcccacaaccauucguaaccagcucugacucccucuucugagugccugagacagcuacaguauacuuacauauaauaaauaaauacaucuuuuaaaaaaaauaaauuuaacaagaaaugucaccuuauuucuaacauauuaagacccaacuaacuuuauuaagagaaaguuaucaaucauaaagacaauagaaaagaucugaacagguguuuacgggcucaguguuguaaaauacaacaaaaacuugcccauuaauuaaacuagcugacagaggcugccuacaucucagcuagugaagaugcugcaggagaucccgauaaccugucaauuaugggaaggggacucacauaguggaaggacagaacccacuccucugagugugcacuguggcacauguacaagcaauuguacacacagugcaaaaugcaaacugauaccccaccccacccccggucggggggugggggguacuuuuuuaaaaaggacaaagggaacccaacaggaccaggacugaaaucggcucugagcuguaacuacugaaacugguaaugagcccauggaguucauuugacuauuuuucucuacuucugcacauguugaaauuuuccaaaagacucuuaaauacuaauauucaaggguaaguuuuaaagccugcuaacaaaagacaaucaacaauguauaaucagaacaagccaaaggaaagcuuauuuccauaagaucaaaauggcaagacaucaagcacgcaagcaagcacgcacgcacguacacaguaacugcuauuuuuuuccucagacauacaaugaaccgaaaagaauacaaaguacaaccugcugcaacauaacucugugugugugugugugugugugugugucuaaagauagcuaaaaaugagguccaacacaaaacuaaaccuuuuaaagauguauuauuuuuaaaaaagcauguuaugucuguguggggauaugcuguguucuugggugcaguugaccucagaggcuagaggaguugaaucccucugaagcuggaauaagcccccugcaaagugcuaagaauucagguccucugcaagagcaggacacauucuucuuagccacugaaccagcucuuuauccccugguuuugguaauuugauugcaguuuucaagagugagcuccauagaugccugucacauaugucauauugaaauguccaaaagcugggacaugcuugauagauagagaggacuagggagauagcucagcuggaagagugcuugccuagauacacaagaaaauccuggguuugcauaaggaaaacuuagauguaguaacuuacgccuauaaaucuccugggaggaggcuagaggaaauaaaggcaaggucauucuuggcuacaaaguaaguuugagacuggaauacuccagagacagaagcaaaaguauaaaauguuaaaggccggccugaaagucauacauacugauacucugucucaaaacaggguacuuagaggccccacgugcgauuaauccaaggacucagaaggcagagucagggggaucucugugaguuucaaggcagccaaggcuugagaccuugucucaggaaaaaaaaaaaaaaaagggaggggagccacugcuuaucccuuuagagccuauucuguaaguaaccauaacggcuaaggaaccccucccaucccaccugcucacgcccaacguacugcagcaggcccugccuauacauuuuuuucacuagugugucccugcccaggucuaugacucaguaacaaacuucuugagcuguaagccaaucuauccauuugucuuuucaacuucuuguuuuccuauucuacaauuuucaaucucuccuuuaagcaacuaccuuuaauccauuuauuacacgugauuucuccuuuucuucacaauguuucuaguauuucuagauaagaaucucagucaucaaugagauuuccugggaauuauauagcauucuaauguaacucacugccuaaaacuuggguauuauuauuuggggacauagacuacuaacauuucaggcaguuuuaaucucuacccaccaccaccuuuguccaucccucacggcuccuaggagcacaaagacauaaaaccaacaguccuaaaaauguuuacgcuuagcuuguuacacguagccaaucccuaauucuuggcacaaguacuccaauggaccauuuuaacugcauuguccuaaauggaauaagaauagcuaccuguggggcuggugagauggcucaguggguaagagcacccgacugcucuuccgaagguccggaguucaaaucccagcaaccacaugguggcucacaaccauccguaacgagaucugacucccucuucuggagugucugaagacagcuacaguguacuuacauauaauaaauaaauaaaucuuuaaaaaaaaaaaagaauagcuaccuguggucuucagauaacuugaaaucugucuacucaccaacuucaauuugaacuagcuuucaaugaucauguuuugagacuaacuuagccugguuuuuucaugaaagucacuucuguucuuuagucuaaucuguacugaagauaaccccaacccaggugucuccaccucacauaguugacguuuugaauuaugauuccaggcugugggcacaguccuguucuuuacagagagucucagagucucuggccuagagccacuagaggccaggagcaauguccuagcucagagaguccaagugagagguagagcccgugcucagcugccugcaggcuggggacucacugcuaagcucuaacauguagaaaugaaaaugucugcacauacugccaggcuggaaagcuaaaacugcugucagcugaaauggcaggcuuaagacuaagagucuagaguuuuguuuguucaagacagggucucacugagucaaguauccuggaacccaaaauuagaguaggcuggccucaaagcugcugugaucaggccucacucccaggacugcuggccaggagccucggugcccauacuguuuuccauuaaauacuagagauauuuucaggggcuggauggagauggagcucaggggucuggcacuuaccucgcucacauucucaagugccuggggucaagucucccacccuggagaagggaaggggaggaagaucgugggagagggcacucuaggacaacuuggguucuugcaauuuuuuugcaugaauaccacacagucauauaaaaacaaucaaaaguagccauugcuucauaauauuuuccagacuaauauuugugguuuucucauucacuaucucaacugcucuucccugaccuugagacaagcacucagccuaccaguuucaaauuccugccuauucuaucuuguaccuuuucagcccccggagagagaagcuaucagagaacccugguggcaugaccaacaagccuaaucacaccugauuacacaacacauuacacugcaaaagccacacucucaggaauccugugcacgaugagaacugcuuuguauuaauacccuaaggaguauuuugagaacaaguuaugucauauccacaucccuuuuuguaaaaggccgagcacuagggagagguuaagaaagucaauucucagaccaagaaaaaaaaaagguguugggcauaagcugucaaacuccagaauaccaaagucugcugacugaauacacuuccaauaauuuugcucuuuaaaggugaaaucaacucaccacaaagaaaguacaugccacauauacauauggacuguauaaaaucuuguugggguccuggugcccagguucagcaagcguaugaucuccuaaugaccucaguuuguucccuggaacccacagcagaaauggagaacagaguccugugagccuccacacacauccuguggcgcucacucuuacacacacaucauaagcauuuaaaaauauuuuuuggugaaccagauaagaugguucacuggguaaagauccuugccugacaagauucccagaacccaaacuguaagggcagguguuccucugaccucacuccaccacugugcuguguggcgcacucacauacacacauauuuuuaaauggcuuugaaaauguuaaauagaacugguuuguuauauauuacacagaauauguaauuagcaaauaaauuucuagcaaugaguaaaaacacugcacuucugggacaggugugcgugcuaaggcugaggugccuguaguccaaccaaaccaagugggaaaggguccaggcggcgguaccccacccaccgugcauguuucaacuguagcucacaguccaucucugguuccauucuguaaaucccuucagcucacugugaggagaaugaccuacaacuucucacuucucaggcguucuccaaggcgguacuuccagauuucccuuuaguccuugggcuucaacaggaacuaacacaaauucacugggaggcuggggaauggcucuguagguaaaguacuaccuacgaaccauggggguccaaauuccauuuccagaagcaacauuuaaauaaaaauggacucuucugccacaaaccaacuaccucaggccaugaacucuacagcuaagcaucacaguaacaggucuccggucuuaccuaaugcacuucccuaguuuuacuuaucuaccaccuuaacaaucauauuuuaagugaaagucacuugucuuuucccuuacuucauaaaacacucgugccaggggccuaaaaagauggcgcagcaguuaacaacacuugcugcuuuugcugagguuguggguccauuucaucacccguauccagcagcucacaguauucaaucuccaauccggggaucugacacccuauucugaccuccuccuacaccagcugcacacaugguacugauggauacaugcaggcacucacauauacacauaaaauaaaaacaaacuaaggacucagcccaagcguugcugcacacguccauaaucccagcaaccaggaggcuaaggcaagaagauugucaaucaacccagccugggcaacagagacacugucugcccgucuacuuaucuagauagacagacacagauacacacacacaaagugugcacuccgacaacaaagucacaagcaaguaccuaaauauucuuaauacaguacaugggcuuuaggaaaagcugagacucggaaaauaacagauuuuuaaaaagauccuguguguaaauuucucaaacaccugaaguuuaaaaacaaaaaaacacuaagugaggcagugguggggcccgccuuugaucccagcacuugggaggcagaggcaggcggauuucugugcucgaggccagccuggucuacagagugaguuccagggcagccaggacuacagagaaacccugucucaaaaaacaaaaacaaaaaacuaagaagugauucaaaagguccaacacacacaggagauauaggacaguuaguaaaguaucugucuggaagcaggaagcccuggauucuauuccccagguaaacugggugugguggcucaggccuguaaucacugaacuggggagguagaggcaguaggguaggaagugcaaggucauuauccuacagauacguagugaauucuaggccagccaggauucugccuacauaaguaaauaauaaauagaagauugguagcacaaagacuaagaucuuggcaugcacucucaauaaauacacuaaaauucuugguacauaaaguuaggaccaccacaaaaagcaugcccuacuucucuggugcaaauuucaaaguuacaagcaaaaugacucaaacaugaccaacacacuucucuaaauggcaguagagcuuuccuccccacuaaucugauucuaagauuuacaccccccccccaagccuucuguugaaguuguaagcaucucuaaugaaaguaagucagaguaaggauccuauaacaaaauguuuaaauuaaaaaauuguuaacuauaagacaacuccaaguaguugauuuuuuuuuuuuuuuuuugguuuuucgagacaggguuucucuguauagcccuggcuguccuggagcucacuuuguagaccaggcuggccucgaacucagaaauccgccugccucugccucccgagugcugggauuaaaggcgugcgccaccacgcccggcucguaguugaucuuuucaacaggcauuuugaguuuuacaaacauguauuuaaacaauaggcuacaguaaagauuagacaaauccccaccccaagccagaaacuagacugccagcccaggaucuaaaagcugccagaccaagguaaagguaacacucacacauuagaggccaagcuaggucucuuccucucuccgggaagagcaugacaaacugggcgucacacaacguaagucacccggucacuuagcaaaaauuacaccuugaaucuaaacuugauggccuuccacacgcaaaagaaauaugggccagcagcgacguaugcggggagaaggaagcuuaaaacgauccacuuuccgaccuguaaacauuuggcccaucauuagaugugaguccuagaucucaagacaugcuuuaauggaggccucccucaaccuccgagucuguuuugcaacaguacagggacuuuuuuuccugcuuuaucuuaggucccagugagcauguggcccugcaacucaauucaauauccuaaagugguaagacacaguggcagagcgaaggggaaaaaaauccaaaucaaaacagccuuaagagauuuuucaaauauuuuaaaucaaaauuccuccucugcccguaacaaacccaacccagaaauucacagcgcguuaagcagcacugcgaacugcaaaccgaagaauuuuccuuugacacuccacucacgguuuucagcugucaaauuacaacuccagaaaacacuaucauuagaauaaaaaaggaaacaaaaaggcucucaccgcaggggcccaggagcaguuuggcaguaccaaggcgaaggaaggagagcaaagggaauccaauccacuuccccaacccccgccugacuucauuccccucccggggcagucaaccucacugcaggggcucaaaucuaauaauaauaacaauaaucauggcgcucccucccuccucccccucccaacccgcggucugccgggaaucucucccccacccccaccccgccuccccggggaaacccagcccccgggacacgacucgcgggagcccccgaacccgccgcuccucuucccucucuuuuccaccuccaccaucccccauccgcauugucugucucaauucaacuuugacuaauauggauuccucgggccugggccgggagcccccggcuccgccgaguucaacgaggcuccucgcgggagggggagggggcagcgcgccgggccgucuacaccgcagccgcguccacaccgcgccggcccccgccccgcggcccgaggcucccaaguuuggcccacaccgggccuacagggggcgguagggcccccggcgcggccgugggggaggggaaaaaggagggaggugccccucccccgccccauuaccugucauugagcugguccucggugcccggcagcggguggaccacgaaauggauggacgucaugguaccgccugcgcgccccgcucccgggaacgagccgcucccgcugucguccggccccccgauccccuucccguccccggaucccacggccgccgccaccgccuccuccucccgguccccaaacggagggccgcgagcgcgcagggaccgccgccuccccgccgagcguguguccgcggcccggcggcccggcgcggcgggcgggagggcggaucaacgcgccgcccgcucggccggccacggcgcgcacggacgagggcagcccggagcgcggcgagcggcggguggagaggugccggggcggacgcggcggacgcggggagcggggagggacagcagcccgcagcgcgcgucacuggcgacgaaccgccgccgccagcgccgccgccgccaucuucacuucugccccaguuucuccgucucgcagccu

SEQ ID NO: 7729 - RNA, 18211 nt, Mus musculus
auucaaauggaaacuugaggauaauuuuauuaguguuuaaagaaaauuccucagagcaggcaagcuguaaaucccagcugcuaccuggaggaggagagcaggggggaaacacccuguugaagucaacucagagauggucagacacuugauggaugagcagagagagaggcuuuagggaaaguaagaaagcccaaaauaccagaaauaguucauuuaaguucuggccagcaucugaaagaacgggaaaggauauaccccuugcuuugccaccaaaucccccaucugcaaacuccugauguccaggcgacugacugccccaucagaauguuaugucuccgcucaggcccgagaguauccaugugagcagggguuccuaguuuagugcuaguccaacagcuucagcauggacacgaaagacuccaguuggacuucagccuucucuguugagucuugguguggcuugaucccaacacuggccuccgauuuuuacuuagcagcugcaaggauucuuuccagagcuuuuggagggaauauggcuuugcugacacgucuguucuguaauuucuaaaagaagagaaaauaaauuugcauuguacuaugugccaaauuaguggucauucucuacagcauugcuacaaaacaaauauauuuguucuuaucccaacuuuacacaagaacauagcugggcaugguggugcaggacugaaaucucagcacugggugagaaucaggacucaaauucaagagcauccuuugcuauguaggaaguaugaggcuagccugggcuauaugaaacugucuaaagagaagaguuaggaggagagaaaggagaggagaggugagagaauagagaggaugacggggagggauggagggacagggagggagggagggaagggagaagggaaggaaggagggggagaagggggaacaaucuugcuccagucuguuuuuaaagcaaagaaccaacuuugaguaguugcaaaugaagccacugagugcccacuagagaaaagaucagacgcuaaaacaaaauuaggacaaagaaguaguuucagauuucugccagagaaagaaaaacaaguucgaaucauuucauuuaguguguggcuucacacaaauaccagaacucauuuaauugggucaggagaaaccaacccucuugaaaggagaaagcuagaaaauagaagucaagcuaacacgaaaaacaguuuugcccugcccuccacugaagagaccgcccagccugaagcagcccagagcagccacugaaacgacauucacaaagcaaauaggagcaggaagcaggcgggccucuuaaaaucugggcauggaaucauugcguacaauugcuccguuggaaggauggagucacaggcuugaauuucauuguuucuuucuuuguggagccgcugaaauggcaagaccaaagagcauugaaugcucaugguucucugagauguaaacaucagggaauccuuaauccuugaaguccacccauuccccaaagcgcccaggaacucugccugcucggggagguuuaaucaacucccagagcacaagggaccacauucuccuaacccagaucauucucaugagccuugccuuucuuggaggaaaagaaugcauuuuuuccccaguuacaaaauaacaaacaugcaacagauaaagacuggaaaacuugaaaaggcacaagaaaagggugggggggggaucacugcuauucuaacucugauauaugucaugucugguuucaagagaaaccagaacuuuuaaaaaguauuuuuaaacuaaauuuaauuuaauuugcuuggauauugcuauguagaucaggcaggcucaaauucagagauccaccugccucuguuccugggugccaccacagucugacuauuuucauuuaugugucugugugucacguguguacuagcacccacaggagcuggaguuauaggugauuguaaccucucugacccagguacugggcaccuaucuguggcccuggggaagagcaguagcacucuuaacugcugagccuguccucugccccagagaguuaaaugugugacuuuagaccaaacuaagagcaaaguguggugacacacaugugagugacauagagaugagagcacuuguaaucacuauauagaagccaaggcaggagcauggagaguucaaggucaggcuggaccacucagccagacccuuugucacaagauaaaaauaacagagcugggguauaguucugcagugaguacuuuaucuagcaugugagugaagcccucagucuucacucacaugcuagauaaagccaggcaaggaagaaggaaggaagggagggagggagggagggagggagggagggagggagggagggagagagggaggaaaggagagagggagggaggaaaggagagagggagggaggaaaggagagagggagggagagagguagagagggagggagggagggaacccauguacuuacucacauggcucagaugucccucuuuccucucaaaauggcauagguagcaaguagcaagcaugauuauucccaguuucucuucuggucagaccagacaucugucagagucaucaagacuucuuggauugugauguccugagugaaagauaccggagggagggaauggaaguaggaggaggucgcuucugcccgccugagaccaagccugugagagcagucucuucuggcucugagccuugagagaaaggaaccagcuugaaugugcuccacaccccaugcagugguuuggggaaauggcugcauccugcuuuugaccugggacagggaagaagaaagacaaaccucuuuucagcugagggugagcuugaauacuccaucugccugacacugugcuguucucuaaaaaaaaaccuagacuaaggagaccacccacuuuauuuaaguccaaaagggcugaugaccucaacugacaucugggagugagaaauacaagcauggcucuauguacauguguguuaucuguaacauguacauuuugugcauuguggaaggaaaaaaaacauguuuaaagagaugugugaagaugauuuaugccugcugucccagacacuaaggacccugagcugugcugagagugaagggcucuaacagacucaaguguggccaacagcuggcccccaagguucauucucuaauuuggccacugacucuuuccugagacuaaacacccagguccaacaguuaagauucauuauuuggcuaacauguccaaucagaauuuaccagcuucuccuagcacagacuccccucuuuuuccuucaaaacccuuuuccuacaaaaagugcuuguucuugcugccuguguugcccaccuacccacuaggauaauacaucuccuuugugcugagaauuugguguuugcauguguccuauacagacuccaugggugcugcccucacuaauagaggguuucaggccagccugggcaauuuaguaaaauccacacucacacccugagccugcucacacaccccaacccucccauccccaccucccacccccaccaaaagggccagcuccacuguuuugccugggugagaacagagcuuugcucucccaagugcugcugccaguaagagaugaggccugcucuucagagugccauccagugaggggcaaggccaguccugcacagccucuagacauccgcauggucuccagcagcugccccaaccccccauguucucucgugguaauauaagccaugggcaucgaccaccgaccccugccaccgcguagccaccagcucaagcccucagcagcagcucaggcugagaccucaccauagccccagguggcagggcuggcugcucacacacuccacccuugagucuccaguuccaucuuuauucacagugcucaaacugcuccacuucuguuuuccaucugacuaugcacauugugauggcuccugcugcaggcuggccacacagcuggugagucccuacauucuccacccaugcuguguggcgugguagcaagcagguaucuauggccggccugagcugugcacuggagggcaggucugugaguggcauggugguccgcaggucucugucuuccuccucucucacucugcugucugcauuugcuuugcuuugauuuuuggguguccuaggcauaagacaacuuuggccaccaugccaggcaucaaacugggaugaucaaaggccuggcaucugcucugcccaugacugacagauauaugaacaccaccagcaccaaggugucucuuugcccauugcaagaaggacuaauauguuuuaauaacaucagccaaacugcaauaauuugcuugacagguaucuuguuuggguaauuugguuuuuuuaaguucuaccuucuguaugaguuuguguauaaaaucuguaagcagaucucugguuugcuacacgcugcugucacugaugagggccugacagaaacauguaguacagcaaagcugagagagcaaagagcgucaacaaagggaggggugugaagguguaggcuggacauaaggaaaccagcuagagacgggaaacagugccucagcaugccucuaugcccacaauaguccauuaucuccauuggcugcucuuacugccaagagucuaauacuuuguaucuguauaguuguuccuucuggagcuugcgguccucucugggaggcuuguuuucuguuugauuccuggaacauuuuuacuuuguaaaaauguaaaaaaauaucacuuuugcucuguugucccaaaauuuucuuaguuaggguuuucuugcugugaagaaacagggcaacaacagcaacccuuauaaaggaaaauguugaauuggggcuggcucacaauuucagagguuuaguucguucaucaucauggcagaaaggcggugaaauguaggcagacauggugcuagagaagcagcugagaguuuuacaucuugagcugcagguagcagaagagacugugucccagacugggcauagcuugagcacaggagaccuuaaugcuacccucuagugacacacuucauccaacaaggcuacacccacuccaaugaggccacaccuccuaguagugucauuccuaggggccuaacauucacucacacacaugagucucugggggccauuccuagucaaaccaccacaguagauuuauacuuuucuucuagguaguucuugcuguuuugauacacaggcgucuagaauagugguccugucuauucaucuucaucuaucguuuagaaagaugcucuggagguuggaaugagaaacauuccccauagacccauguauuagaacaucuggucucuaguugguggugcugcuugggaggcugugaaacuuuaggaugaaagucuuguggcggcaaguaugucgaugagaacaggcuuucagaguggguagccucuccccaugucuaacucaagcucugccuuuuguuuguaguugaaauguaaucagucacuuccugcuccagcugccugccuccaugccuucacacccuuacggauagcuagccucuggaaccauaagccaaaauaaacuacgcauuaaguugccuuugaucaugaaguuuuaccauagcaacaaaaaaguaacugccacagaugccaguuccagaaagacuauaauggcaggaguugucuauuuuagaauugccuucuggaccuuaaaguguaucuucuuaaucaaagcuagaguuauggcuuuucuagugaauuaauauuuaugcuaagccugaauaagacugcauuugucucuucuuccuauaaaauacuuugaauuuuucaaacgcaaguugucagcaugaaucauugcauuucuugaccugaaguuagaaaguaugacucugccuuuucuuggugcugacaauugaaaccaaagccuuguacaugaucagcaagaacugcagcauggagcuacagccccaguaccggggugauggucagcaaguacuguagcauggugcuacagccccaguaccggggugauggucagcaaguacugcagcauggagcuacagccccaguaccagggugacagucauuguuacuuuacugaguuugguucugacacugcugccuguacauaaagucagagcccagaggcuaaguccucagugccacaggacaccucaacuucagaugccaguuacaaucugggccucugguacuucugcccccgcaaucaauaagucagagauuccauuuaaaaaaaacaaaacaaacaaaaaaaaaaaaccuuaggcaguuuaagggauagcuguuccaagaucacugaaguagucaaauccaaggaugcacaaguccuggauaaagauggcacaucaguggcucuauagguaaaguucuugccauccaaacaugaagacuugagcuuggacccccagcacccaguguuggggauauagagacagguagacccucugugcugucuggacagcuuuuaguucagagaacuuauuucaaaaaaaauaauaauaaggaaggccaagagaagucauaugacuuccucccucuggccuucacauacaugagcacaaauguacaugcuaaagaacacacacacaccgggcagugguggcacacuccuuuaaucccagcacuucggaggcagagacaggcagauuucugaguucgaggucagccuggucuacaaagugaguuccaggacagccagagaaacccugccuugaaaaaacaacaacaacaacaacaaagcacacacacacacacacacacacaccacacacacacaucccgcagggcguuuguguguaacccauguacauaccccauauacuuuaaaucaucuggauugcucauucuauccaaggcaauaugaauguuaugucaauuguugcuacaucgugucauuuggaauacugacaagaaaaaagaaaucuguacauguucaguauggucaaauuuuuuucuuacuuuucuucagaagccagaagaggguguuggaucccuuggaacuggaguuggcagacaguugugagcugccauuuggauucuggaaaccaaauccuagcucuuuagagauauagccagugcucugaacagcagagccaucucuccagccuugcacccuuccccccacagcacuuauaaaacuauagauucacugggcagugguggcgcacaccuuuaaucccagcacuuggaaggcagaggcauggggaucucuggccuauagagccagccuggucuauagagcaaguuccaggacaaccagggcuauacagagaaaccugaagccucguacuucuuuguagguaaucgccucaucaccaaaauacauccccaaccucuaaaauguuucugaucuuuguuugguugaauccauagaugcagaaaccauggauacagaggcccacuuugugcucacuuucacugugcccuuuagugugaagaggcauuuucagagacaaaguacauagacuuucaucgcaggucauuacuaagaaauggcuaauucaggcuggagagauggcucagugguugggggcacugacugcucuuccagagaggccuuggguucaaauccuaucacccauaugguaucucacaacugucuguaacuccaagaucugagacucucacauauacacacguacaaggaaaacaccaaugcacauaaaauaaaaguaaacaaaugaaaaaaaaagauuuaaaaaaagaaauggcuaauguggcauagauuuuggugauggaagguacugacugagccaguuagcuuuccucuccaagaauuuuauuuuuccuauuaguagacaaaaaguaauuuuuauauuaugcuaauuacaucuggaauuuugucagcauaaauuuuguggggauauauuuuuuugucuuauaagcauguacagaauaaacucagcuuuaccuuuagucaacgaagcucugauauuuucuaccuggcgcuuaacagaguguggaccuaaaggcuguucagcaaacuauagcugugauguuauuguuuaugguuagaacaacguguuuuauauagauaucuagcaugggcuaugacauugacauuggauguacaggauagccuacuagucagcacaaaaugaccaggacacccaaauguaagcagcgauaugaucuguuguaugacuacuuugucacagccuuacuuuugugcaggcuuuguauagauaagaccuugaggcaagcacugaaugccugccuuggcuucccuaguaugaccgacugucaccuggaauuacaagcucaccucaguguuugucaggcugccuuaucauagcagucagauguaccacauaguaccaguggguuuaaaggguauggaagauuuucucuuauuuuuaguuuauaugugugaacauuucccugcacguguauguggacuaugcccggugcccacaaagcucagaaucuggugucugaucuguuggaacuggaacuaggcauagccaucauaugggaucugggaaccaaacccugauccucuguaagagcaacaagugcucuuuaccagugagccaucucuccagccccauuuuuuuuuaauuucuguguuguauuuaauaugaagggacugcaugugcacagacauggauucuuuuuuuaaagaguggaacugugauguuccuauuugaccauguuccaggaaagacauagaagaauaaaguaugugcucaauaaacucuugccaauggaggaaaugagucagggccacgcugugcacaagugugugcuaucauagccuccacugugcugaagucucacccagagcucaagagcgugcauguguguuuuggaguuucagagacaaugugguuucaggacucagauucuugaauuuugaaccucagcucuaccacguaccagcuauguggcuucagggaaacuauguaauuguaaugcuuugaggaucauggcagcacugguuuuguggguaugccuguaaguuuuauauuaguucuauuuuuagaccugauguaaguuauuuaacauacaauugaaucccaucaucugucaucucuguucccugugugguguggguuuuguuuguuuuguuucuuaauucacugacacaacacauuccacagugcuuaaaccaccccgaaagguggcacacaccuguacauuugcuuucucugacuagccuacccagcccuguggacggcugaaaggaagagaaagggggcguaugcccaccccaccuuccuccccugaugucugagcuuagagcugccaccaggcuacccuuccuuuagaggccuuguucaccacuuuggaauuuaccaucuguucucuguauguaaccugacacacacaccugaaccuaaggucauaccaugccaccacauacacaucaccaagacucugcuagaauggucaucuugugaaacaacccucuuguucucugucccacugaccuaagaccuaacaugcacacggugcuuaaucacaggaaagucuaaaggcucaagagaagccuuaagagcaaauugggggagggguggauaacaaucugacuugacaaaagcuuguuauuuaaagcuggcacagccaggcagugguggugcacaccuuuaaucccagcacuugggaggcagagggaggcagauuucugaguucaaggccagccuggucuacaaagugaguuccaggacagccagggcuauacagagaaacccugucuugaaaaacaaaacaaaacaaaacaaaaugaaaguuggcacaauaauuaacaucuacaaaagaaauguaaauuggaaaaaaauaguacaaaauucuguaagguacccugggauuucagcugaaagucugggcaauucaugccccuucugugauuggcugauggguuacccauaaagugggacuuccuaagacugcgcugaucagguggcuggagacaacagaacugugguuuauuacagagcuggaggucagaaaccagaggacacuccccuagcauccugccuccgcagcuuuuggcuuacugccucucuuugacauucccugacuugaagaagccuccuuuguuuucuagggcagaaauuauagguggauguaagaagggggagaaaggggaaagagagaaaaauagcaaacgucuucucuuauacugaaaaucuagguuuaaguacauagaugcaaauacacacaagcacaugacacuauagucaauucugaagggaaagccugggguccagcggucucaccugcuaggcucagucacccauccccaaugccaaccaaggagguggguggaaguucagugcggucacauuggggagaggucuaaugauccacauccaucuuugguauacugaggcgagcauuaggcuuaaauagaggagggaccggagcgagcagugggcgagagcugugcagaacugagcaguucugucaaggucagcucucaguggccauuccucagcucugcuucagcaaagugggcaaagcacugaagugguucucaaccugugggucgugaccccugugcaggucacgugaccuuuacacaggguuaacuaagacuauuggaaaaugcagauauuuacauuacuauauauauauauauauauauauauauauauuuuuuuuuuuuuuuuuuuuuuuuuuuuugguuuuuucgagacaggguuucucuguguagcucuggcuguccuggaacucacuuuguagaccaggcuggccucgaacucagagauccgccugccucugccucccaagugcugggauuaaaggcgcgcaccuccacaccuggcaguugagaacuuuucaaagguguuuuauaagcaaucuagcucucagaggaugacuccuccugggcuggagagauggcucacaaccaucugaaauuagucgccuuccuuuggccucugugggcacugcaugcaaauggugcacagacaaacauucauacacaaaauauaauaaaauauuuuuaaaaugccucccccaaaagaaacaaacaaacaaaaacucuagagcugguuuauuacagaaaagaggggcagcagguuaggucucucucccaggcccauuuaccuacaagguuuccuggaaagggagaagacuuucacuaucaugggccacaugccacuuugcucagaaugugccugcccuuguguuagaagucccucuguguggagaccucaucaugcuaguggguucaaaggaaagcaugcuaacacucaggauuggaucugggauuuuggucuuugucuagguuaagauuucauugcugugaagagacaccaugaccauggcagcucuuauaaaggacgacauuuaacuggggcugacuuacagguucagagguuuaauuuaguucaugaucaucaugacagaaaacacggcagcaugccagaagacauagugcuagagaagcagcugagaguucugcaucuugaucugaaggcguagcuugagcauaggagacuucaaagcccacccccacagugacuuacuucuuccaacaaggccacacucacuuuaauaaggccacaacuucuaagagucccuaugagccaagcauucaaacacaugagucuaugggggcauacuuauucaagccaccacaaugguaaccggugagucuaugcaagaggcugcugcagcuggccccaugagcugcaucucccagucccaacucuguguccacacagccuuccgucuucaucggcagcuuccuucucuucacaaacuuuccccucuuuaauuuuauuuuuuaagaagguuauuuuuauuuuauguguauguuugcuguauguuugcaagcaugugugugccuggugcccaggaagaccagaagucagcagauccccuggaacuguaguuacaggucguugugagcuaccacgugggcucugggaacugaaucuggguccuugguaaaaguagcgagugcucuuaaguacguuuauuuuauuuuuuaagauguauuuauuuuauuuauaugaauacacuguagcugucuucagacacaccggaagaaggcauuggaucucauugcagaugguugugagccaccauaugguugcugggaauugaacucaggaccucugugagagcagucagcgcucuuaaccacugagccaucuccagcccuccuuacuuuuauuuuuaaaauuacauuuaugcauauguguauguauuuuguguguauauguuuguauguauguaauauauauguauguguauguguauguguauguguauguguauguguauguauauguauauguauauguaggcauccacaugcccuagcaggcuuggacuggucagagaacaacuuucaggaauugguucuccuucuaccauguggacucugggaacugagcucagauuguggcuugauggcaggcaccuuuaccaguugaguugacuccaauuuucccucuuuaaaaaggacaccaaacagaaugggugacagucccuuuggauggucuuauaacuagauuugccuguaucagagacccugcuuacgaauagaucacauuuggaauuucaccgguaugaauuucaacauaucuuuugugggagcacaauuuaacccagagagauagcauugagcuaccaucuaagucugaguggccuugaaguggugcugccucagccgagccaaaggacccucugggguguggugagacuuauauuuugcuuuuguuuuuuguuuauuuguuuguuuguuuauuuuucaacuugacagaagcuagaauuaucuggguagaaaaacuucaauucagaaaugucagggcuagagagacagcucaguaguuaagaacacuaacugcucuuucagagaacccagguucaauucccagcacccacauggcagcucacaacuguuuguaacuucaguucuaggucaccugacauuuucacagagaaugcacaugaaaaauaaagggggagguuccauuauaaugcuuauagacaagucuguggaggauuuucuugauugcuaacugauaggaaagggcacccuccugggguaguaccagaaccgaggugauggcccugcugugcuauuaggaaguggguugagcaaaccacaaggagcaagcagguacccaguucucccuccuccaggauccugccuaccuucagugauggagugugccuugagauguaaaagcagaaauucgcccuuuccuccgcaaauuaguuuggucaugguguauuaugacaguaauugaaacccugacuaggacgcgggguuugcaucguuucagucccugcacuuagcugcaggagaacccaggaaacagcugcuguaguagugugaauuuguuagcuaauaagggaagcaggugcccuuaggagcuugcaagccuccacuucacaguguaggaagcgucccgcccucugaaaggcaguucacuguaccuucguuauuucuuuuucagcugaaacucuuuggaggaacuuauaaugagcuagucaacauuacuaagauacucugacucauaucguuuuagucugguuagaguaaaguuggcucauuauaauaccgaauuacacauaucuaaaauacgugucuucccccacccuccgccccuguacuuuccuuuugaccuaugaccucaaaaugagcaugcucaaagauguacgccugaaacugcgcaugcccagaacugugccccucgugccuaugcaugcucuuuuacguuacucugaauggacccuucaagcuucuccucuucagugagagcagcguuugggaaaauagccccguuucaguccuuacuggcuguagaugagacaucucucuccucuuuccuguucuggcaugugguguuuguaaucccugaggugggccccagacauagcagacacauuguaggacacuuguuacuguuugcuucacagagcggaaacaggccuaauggccuggugaggucagcagacaaagauuagaucccccgaggacuccaacgguucugaaaggugggacuugucugcgucacugccaccccuguugguccucccuguccuguagcuagguaagaaccagccaaucagugguuggguauggugacaguccagucuccgugggucacguggcucacucagccuuaacuaucgucaucacaggaaaacaggagugaaauguuucucccccuggucagacuguuacaguccuuggguuuugugaugaauaccauggucaauugaggaaugaucuggaaaccacacuagggagcccugugucaaagauggcaaucgccugccccccagcccuacacauuaggaccccagucuaggcaugggcuccagcuuucucaguuaacucccagacaauguuuaauagauuuuaguauuuccacucuguuuccauuuaaaagagcugaagcccauggcuaucaaggaagugaugguaaagucccugcugcaagacacuacagucucccagcacgcgcagacacacagaggggagaggggaggggggggagagagagagagagagagagagagagagagagagagagagagagagagagagagagagagagagagagagagagagacccucacucacucagcagcgcuuaagcucaaaauagugcaauggccuucaccuugagagagcgccccuuugcucuccaggaaccuugccucucccgagugguaccacagguuuggcucauugcucacugaccaucaaagcaaccaacaaagguccuccucugcuucccuuuguuuacccccgccucugccuccgguacuccgccuccgccacacugcaggcuuacccagcaccuuuuauuuuuaggaccucaaaauguucagaacaagacauuuuuuuuucuuauugucuuguguucaugacuuggaaaauggaaaucacagacuauuaugagcauaaugacuccagugauuaugcaacaaagagcucaagauaaaguaccggaggagaggcuccuccuggcuccggccgugggggagggaucuggcugccaacaagaauaaacccagcuguacuucagcuuccaaagccacugaccaagcuccuacaggggacuugcuggucaacugcuucuuccuagcagggacccgagugacaggcagggagccauggacugucuggacuugagguucauccaugguagccauuucaucaguuauuuuaaaagcauugcaaaucagaagagcaguucggcacguucucugucauuauuuuuuucuaccagagacauauuaauauggauguggcuagcaggcuccaagcuuugaauugcucucauuaaaucacagcuggcugggaacucgcggcaguccugcgccuuuauuucuuaagccgauuuuauaaugaaauuaaaauggacuccuccugacaucccuucccuggaagccagcagcuuagcccucugggggaguggguucugaugacguucuauucucaaaagaaaugcauaugcgauuuuaguaauuaaaacauuuaauuuggugauuaccuucacaaaaagaaacugcuggaauugucucgguaggggaauguuccauccagcuguuacagcuggggggcucuucccuuuaugagaacagcccaccugcuugggaugauguccuggggccacucaccacauccgggguuuucugagaggaaguaugucuaaccagauagccccaacacuauuauuuuccucugcugacaugcauaguugguuucugagacauaguaucuauuuuuuaccaagagguaaggaaaaagcugauucauuguaccuccaagggaaucccuucugggaggaucauacccagaaggaggauagacauugcauagaaccgcuuuugcacuuaaauaaaacuagugcccugagguaaauucacccaggaagcuuguuagaugaagggauacuuagaccccacccuaauacccgcugagccugcaagagccuggcuuggggauggcggcgggguggguggggggagagagagaugggggauagagagagggggugagggggagcgcgggggggaggggcgggcggggagcuggcagauacucggaacucuggcuacuuaacaagcucccuuaucgauucauuuguucccuguaguucgggggccacagacacgggaggcaucuacagaucagcaguuagggugucacccugagucacuuagggaauggugguguuucaccuuugauuaggggcagcugagcuuaucuaccuggaagacugcuuuguuuggaaaugacaaaguagaaaaugaggugcaauuaagcuuuucacaaagcagcuaaucaucucaucccuuccaguaccacagagccagccuuccugucccuggauaguuaggaaagucaguaagacuccauauugugugggcuggagggagggcgugcaaaagccccgacauuuuguagccagccccagaguagagcagaccccucgggucucuuagucucacccccugcuguguucagacucuuagaaacuacagagaaagagucugucacguuugcuggugguucuuuuuuuauucuauuuuuaaaucuuuuuuccccuucaguagauuccaaaugccagcucaagggagaccugggcugggcugagccuaucagccucccgggagccaauuaaaaauauggauaccugcacuauuguuaaauggcuuggaagcugcacucugaaaucuggugccaggcuuggcacuugggaacugcugugagcugagaguacuuguuaggucaugguguuauuagaaauaauuucacagagaaauguugugaagcaaaaggagacuuccaugucagcaggcgggaccugaccccggugaggucaaccagcuguacccauaggauauccuuaccaaugagagcucaaagauucgcucuaaggagaggccgugcaacaccuguccucuauuuagcacuggcaacuucuugauccuaauuucauaggcugcuaucucuuauauuugggggcaggguggauggagucucaccugagcagaagcuguaauucaggcuagccucgaacucauaauaauccccaugcuucuaaauuacagauguccaccaccagguccagcuccauuggaaaagauuuuuaaagcagauuucuuuuuucuuuuuuuauucuccuaagcagagagaacguaggucuauuaaggagaagugagaaagagcuuuagagaguaggagaggugccuacucuuacagagauguuuuuguguuugguuaggugaauacucaggugugcaaucagagaggaaaagaaacagcccagguuuguacugguuuugguuucuuugggauggauacuccuugugugguagauuuccucucuucuucuuccuucccuccugucccuuuucuuucuuucuucucugucuucuuccuuugugugaguguugaggccuccagcucucuaaacaguccccaccagccccaccuugacagguucaugaccacaguuugagguggcauuguuugacucuggugccucugcucccucacaacucuggauaguuccauacucccagaagaucauccugcagacagucaucugugugucacugugguaccaugggcugagcgcucccaaacccucucucuagguuugcugugaggagagcucugccccaggggcacuguuauggccaacuccuuagcaagcaggguaugcagaaggagcaggagcuaagagcuuauggcagugaagguagacaugaggacacacaccuaugagcccugcacuugugaugcagaaggaggaggguugcuuccgagguccaaggcaacccaggcucuguagugagagcagccugacaagagccacauagaaggcuuggaugagaacaaacaacagaacugaaagagggagaaaggguguuugugaauucugccccugguaacgcagcgaagauggaguucagagaaaaggaaauggagaugcugccugcugccucagaaugcagggagcugagugcugagccagcugcagccagaaagaaagggggggcggacacaacaagacacagcuagauaccacagggagaaagagugcgcacacaacacggcuagagugugguaacacuuaccccuugagguagaguggaguggaauauauccaauuaaucauucaaauuuguuccugaggaaccaggaugcucagauacaaauuucaaaaacuuaaaacugcucuaggaugugaaaccugugauagauaugaaauuaaca

SEQ ID NO: 7730 - RNA, 719 nt, Mus musculus
caugaccucucagauucgucagaauuauuccaccuaaguggaagcugccuugaaccgccuggucaaccugcaccugcgggccuccuccaccuacagaucucugggcuucauuuuugaucuggaugacguggcucuggagggcguaggccacuucugugaauuggcugagaagagugaggguaccuagcggcuucucaaguugcagaaagaucgcgggaugggaggaggggcgugcacucuucaggaagugcagaagccggcucaaggugaaugggguaaaacccaggaggcauggaagcugccuuggcccuggagaagaaccugaaccaggccuucuuggaucugcaugcccugggcucugcccgcacagacccucaucucugcuacuucuuggaaagccacuuccuggauaugggggugaagcgcaucaagaagauggguaaccaccugaccaaccuccguaggcuggcaggaccacaaccagcgcagacuggcgcgccccagggaucucugagugaguaucucucugagcgccucacucucaagcacgacuaggaggccucugugccuuccaaggggcuccccacucugcucugcaccagcccgccuugggaccuccaccugaaugaaucucucaagccacuagacagcuuuguaaccgcucuggagccucucucaagucuuggaccaaguuaaaauaaagcuuuuugagacagaaa

SEQ ID NO: 7731 - RNA, 9603 nt, Mus musculus
ggcucuccgcaaagccuagucgccgccaccgcgccucccagcuaugccccgccgccggcgccgcccccgggcaugggcggaggacugaaggcuaggguugggcgaggggcgucacggagucaggugguccccggaguuccccggggcuggaccgagggaacacggugccucggguuguguacacgcuccacugacagagccucuugcagccgggcagccgcugaucacgcguggcucugccagcucauuggcugaggccucacacaccuuugccgcugauuggucgacacuaggccccgcccucuaccccgcccgcggcgcggggcaggcagagcggcuaccugcacggggaggggggcagacagcgcggagcgcgguggcgucgacgucuagugucucagugcucccgucuguggcuaacuaagcagccagcagccaggcagcucgcgaccugcggccaggcagccaaccaugcucaacuucggcgcuucucuccagcaagcuucgguaaguuaccugaggaugcugguccuuuccugccggucaguguaggggagccagccggagcgcgaagcaugagccccuaaauaagccacgccugagaacccaggcugcagcggggucuugcaagggauuuccucccugcaggcuggaauaucaucgagggcaugugcaaaaaaaaaaaaaaaaaaaaaaaaaaaaaaaaagggucggaagaagccugggaccuggaccaggggagagcgauccuggguauccaggagacaaggaggacucucagggagaccccaggagacgagugagcuggaggggcugucucccuggaagcgcgguuuagauggagggggcgcccugcaccuggcucuggcgggagaugccccugucugcaccaggaaugcgacccggggugacaaggacuacucacggucugccuagccgagaggagggcgccugcucuucgggggagggggaaacccugccagguggagaccgcggggcugggcuagcccggggcugggggaggggauggccggcuucgcgcgggguauggaaggcacgcggacucugcggccgccaggggagccgcggcgcccccgcagacgucgggaggggacuccccauccgaggcggaggcagguggcugccuauagauuacucuuggcagggggcaggguccugccuuggagcccgacagcuuggcgggggagucgggaccgcgagacgcgggggccgcgugucgaggcgggaaccguggggccgcgcgccuggagcccgugcugugggcgccgcacgucugggagccugcagagacugcuugcgggggcucaggcugccggaaacagcagucggacgaaugcugcagaugcggguaggcugaggucccgcgggccgagugggcggagugccccaggcuccggccgcuccccggaggcggcgagcaggaggagggcggcggucgggcuuccgcggggacccggccccaccucccgcagccgaggcggaggccagggaugggcggcgaacgggugcacccggggagcuucucguccccgagugacccagccccggccuccgccaggggcgggaacgaggcccggcccugcugucgguuccuaagggaaccgcggcucggaggagguggaaggggcgggcgacucgggagccgacaccgcccagcccucgcgccgcccggcgcgcacuggcgagcgguuggcggcggcgcccgcggccccuccccggccgagcgggggcgggggcccgugcucaggaaguaggggaaaggugacggcgcggcaauucccaguucacguuuccugcgccgcccggagcagucgcugaucacgcuuuguucacaugccucgcccccuccuccucgcgcccccacccugcccgcccagccaauccggacgcgggccgcgggccggccggccaauggcaggggcggggcgcggggacgugcgcgcggcgggcaguguucccggugacucacccgccagccucauugagguuagggcggccccaucggucgguccccgccagcgaggaucucccccgccggccucccgcgccccgccccgccccgccccgccucgcuucugccuccacccggcuucccuuuccugccucgcaccagcucuucgcucccucccggcuuccccucccggcucacauucuucaccccuggcugccuuuuuucccaccccucuuucuuugaguuggugacuauaggcuuuuuacacuuacagucuucauccauugcagcuuacauaaaggcgcgaacgauuaugcaauuacauuguuagugauguuucaagaaccgugucuuguuuucccacacucagcaggaagauaggcauuuuuagaaaagcguuaagauuaucauugccauuuuauuuauguauuagguuuuugcuuugucuuuaugaguucaggcuggcccugaacuaguuauauagccagaguuggccuggagccuuauauuccaggcucccccacuuuaugaggcuuuucauaauuuuugcaaccucuacuuuaaccagaagaauuuggaaguucuuuuuaagaggaaaguagagaugguuggugauucuuuugaaauucaggucauggaacuuuuaaugugagacauuaggucgaagguguugcacacagagcaugaucgguuaucaaaucauguuuuaauuaaauuaaaaccaacuuguacucgggguuuuuuguuuguuuguuuuugcauaucccaagaacauauuuuaugccugucuggucccuuaugguacagaaaagcauuguguuuaauaaaucugauaaaaaucauagauauuaagagauugagacuugaccaaaauaaaauauuuuuuuccucuuugguugcuuuguguguuuugcauuuugagaugcaacuuccaacuucuuggccuccacauuccugagauuauacauguaucccaccaugccuggcuguauuuguguguguccacuuauuuuacucaaucuccaccguaugugaugaaguuaccaauuucagacuuuagguaacuagauaccacuuuaaccuggaaguaguuuaagucaaauuacauuuuaagacauucgucuuaauucccuuacugguaauaagguggccuuuaaccuugaaauaaaauagcaagcauugggcauuccugcgguuuggauaaccagauaacugauuagcuucaacuuuuguuuuuguaggaggggaaaauggaacuaauuucugaaaagcccagagaggggaugcaucccugggacaaagcugagcagagugacuuugaagcgguggaagcgcucauguccaugagcugcgacuggaagucucauuucaagaaauaccuugaaaacaggccugucacaccagugucugauaccuccgaggaugacagcuugcuuccagggacgccugaccuucagacagucccagcauuuguaaguauuuucaguggguagaagugacagcauuuuuuaagaguuuacauaauggaccucuaauuccucuccuugcuuguguuuguauuuguaguguuuaacgccaccuuacagccccucugacuucgaacccucccaagggucaaaucugacugcaucagcgccaucuacuggccacuucaaaucuuucuccgaugcugccaagccuccaggcgccacuccuuucaaagaggaggaaaagaauccuuuagcugccccuccucuuccuaaggcucaagccaccagugucauccgucacacagcugaugcccaacugugcaaccaccaguccugccccgugaaagcagcuagcauccucaacuaucaggacaauucuuuccggagaagaacccacggaaauguugaggcuacucgaaagaacauacccugugcugcagugucaccaaacagauccaagccugagcccagcacaguguccgauggugaugagaaggcgggcgcugcacuauaugacuuugcugugccuuccucagagacaguaauuuguaggucucagccagcuccuucguccccagugcagaagucaguacuggugucuucaccuacaguauccacugggggagugccaccccugccugucaucugccagaugguuccccuuccugccaacaacucucuuguuagcacaguuguccccagcacuccuccuagccagccaccagcugucugcucaccuguguuguucaugggcacucaggugccugagggcaccgucguguuugugguaccccagcccguugugcagagcccaaggccuccaguggugagccccaguggcaccagacugucucccauugccccugcuccuggauucucuccuucagcagcaagggucacuccucagauugacucguccagaguaagaagucacaucuguagccacccaggguguggcaagacuuacuuuaaaaguucccaucugaaggcccacgugaggacacacacagguacugaccgagugggcucugucuuugaaguggguguguauguggaguuagacuguggacacaaaugcaagggagggugagguagaugacucauugucuuuaaaauuagucaguuugucccuaggccuggugccacacccuuguaaucccagcacuugggaauuggaggcagaggaagcagcacaucugguaauauauacaugauauauauguauuuauuacauuauuuauucaggcgggguuucuuugugcagcccuggcuacccuggaacucagucuguagaccaggcugaucuugaacucagauuucuuucugccucuaucuccagagugcugggauuaaaggugugaaccauggcgccaagcuuugauaauuuaugaacugaccagcuuucaauuuuaaacucugugcgucaauguauaguaaccaucuggcuuucuuugcuucaggggaaaaaccuuucagcugcagcuggaaaggcugugaaaggagguuugcucgcuccgaugaacuguccagacaccggcggacacacacaggugagaagaaguuugccugucccaugugugaccgucgguuuaugaggagcgaccauuuaaccaagcaugcccgacgccaccuaucagccaagaagcugccaaacuggcaaauggaaguuagcaaguuaaaugacauugcucugccuccgaccccugcuuccgcacagugacggccagaagauggagacgcagaauaaacuuuggucagagucaggagccagugauggugucaagugcuucugcaaggcuguggcccuccaaaagggccuaaaguagaagcccuggccugggggaggccccgccugggugaaaugacaagaagugcuucagccacaggcaggucacagaggacagggcucaguucuuaccacagagagagaggagaacccuuuuauuccucccuuauuuuagucuggaaaguuucggcugaggugagcgcagcacagguuuugaaucacauacacauuggggacuuuguuuuugccauuuauacuugagaccagcuuugcagugugauucuuucaaaggauugguuucaagaauauagaggcuggaaauuacgguacagaaauggagcuagaaaaugaguuuguguuacacagagaugucaucuucuccuagaguuaucuuguuucuuauuccuagucuuuccagucaaauccguggauguagcuaaguauaucuaaaacucauuuuuccacuauuguugguauuugaaguugaacagcuguacauugcugugggggagccaaaggauuggaacccucauuaauuuaauugcuuggaaaugcagcuaaaauucuucuuuggcauuuuguuuugaaaguuuaggcauuuuacucuacuuuagauuuuaguuugcuugcaguuuuuuguguagauuugaaaauuguauaccaauguguuuucuguaggcuuaaaauacacugcacuuuguuuagaaaaaaaucuggagaugaaaauauguauuauaaagaagagaugucaagaauuugagauaacuccuugagaaaguuggcuuuaugucaucagcaaaggacacuuaacgucaagcauacacugugguuuuuuuguuuuuuuguuuuuuuuuuucaaauuagaaaguuuaaugaccguuacagauggacagugucuuuuuauuuauaggaguuuuucaggaugucagaguagauagguaggaaaauuguuauuagaacauucgcuucuaccuugaaaaggauguuaauguggucauguucuuagcaccacagugucugggcaucugggaaacuccgagacuuuuuuaaagugucaugaugugaucacaccugcaguuuggggcaucgaauccagggccuugcaugucuucuguaagagcucucaucgcugaccuguaucccccgcaagagcaaugacuuuugcuaacaguauuucuuuucuguuguaaaguggacagaugauacacuuggucgcaaagguaaauuauucaaaauccacagugaaaaccucaccacacuuucccauuuaaacuauuuccauaucucagagguuucugacaugcaaacuugaacccuugaaagaagaguuuucuuaaaaauuauaaaaaaucacgaguuacaauuugcacaauauuuuuuguugaacuuuauaccuuguuuacaauaaagacuuuucuuugguauacacagugagucuguuguauguguuaaaacccauucuccaucucaccuucauacugaccucauucagaucagaaccugaggccagauugcuuuaagaugauguaacugcuaugaccaacaagagaaggcugaccugucaucuggagggacuuguucaaguuguacucacucagaccaggaagagauacucuagauauaacagauaaacugguccuuaagcagugugagaggccaggccaccucugcagagacacuugcuagucacuuaggagcguuguaaguaggguaugacuuuuuucuuuuaauaaggucacuauuuuaguuggcccaaaagucucacugcucuugagaaaaucugcaaaggccccugcuugaacaccuggcucacuuuuugagacaaagucuuauuguagcccaggcuagccuggaacucaaauagcccagggggucgcaauucuucugugccucuggaaugcuaggauucaccacgauuccuuaccccaaccucuugauuuguuauuuuuaccauccuuguaugaaucuuguuugaggcaaauuauugugguauucuaauucuuuuguuguauauuuuuggggauucuauaggaaagacuaguuuagucuccuuaguuauuccugucgauauggauuuguggagacauauaucauucucuuaaguuauaaggguuuuguuacucagcugucccagugugauccuugguuucuuguuuuguuuuguuuuguuuuguugguuuuucaggacaggguuucucucuuuuuuguuuguuuguuuguuuguuugugagacaggguuucucuguguagcccuggcuguccuggaacucacucuguagaccaggcuggccucgaacucagaaaucugcuugccucugccucccaagugcugggauuaaaggcgugcgccaccaccacccagcucagugugguccuugugaacuccugacugguuaaccauuuugauugacaaagaugggaauucuaugauccauccuauccguuccuccggaguaagaguuagugauuauucugaggagugaaaaagucucccugaaacaggcuggccuugacccugcuacccacucucucagccuauaugugcuguggauuugcuuccuuuuuguuuucuaacauagucuuguagccagagcuagagaguuuucucuuccaguccuacccugcuaccagccugucuaaucuggcaucucacagccccucccugguguucugucucuagucucuuccugcuaauuagccuuucccuuuggaaaagggaaaccugacagaggcuuuucuguguaaaauacuuuaaagacuuccaguacacuuggagaagucuagauguuucuuucucuccuguguaacuugagacagguagucaaggcuggccuugaacuccugacucccggccuccaccugcugcacgcagagagccuugcugugcaccacggaacuccuuccguugguuuucauagaacaggguagguuuugcucuguaguccuggcuggcuucaaauuaguugcaauuuugccugagcuuugccugguggaaccccagguaugagccacugccugcaacagcacuguauaucaaauaugugccacaugucauuuaaauuuuccccuucccaaguaggcuugggccuacuucugauuccagcccuggggagagugacugugagugcaagcucagucugguuuacgcaucaaguuccagguaaggaggacuacauaaugaaacccuaucuuagguuauuuucuaguagauacaucaaaaagauauacccaaacuauuuccacaccgagucaguaucauggcuaagaauccuaguccaucucuucugaaguuacccuuggaacccacucuuacaugcucauagcacauccuacuugggaccaaccacauuucaagugcuugguagucacagguggcagguagcuagcugcuuggggcuccuugaggguccccaguauccugcaccauuaggcuucugccagccccuccccuccaguuccccuguacccugugucuaagaugcgagccuuacugcugugcuacuucauguguggagaaugauuucccugaccuucucccuugacauuuccacuaucaccgcccaucauuucccuuuacugaaauugccuaaugccucuguuuuuuuccaggacaggagucucugagucuugcccucagcaucucgcuuagcgucuuacacauagcagggcucagucacguugcugaacugaaagggagccugcggagccucaggaggggaauaacuggauguuauauaacauacaggauacagccaccggaugcugaagccugcccuuugauuccuuguugguucuggaagggaccucuugcugcauguuccagacuuaaagaagacugauagaguuuauugguggaauacuugucuaacaugugcccagcaucauagaacaaaaacagucauggcacaucuauuuuguuuugggguauuuugguuuuuuuguuuuguucuucuguuuuaaacagggcaggguuaagauuugaaagggguggcacacacagguccuucagcagagucaaauuccuugccuggaacugcuuagaaaugucaccuugguagucccucugcucuuucucauugcucucaggaagcgccgagaacgaugaagacccucucggagaauuuugggcaggccucuuccugaagaugagugggaaggcuucuuuccguggcagugcugcuaaugcccuaguaccuaaauccaguccugguggagaagccugggcuaagacaugaccuugagcugacucacucacagcagagcaucuccaccagagagcagaggaaguaucagcgaaagagaucagcuugagagaccugguguccuagaauucucuggggaaaucuaacuaauaaaacaacauuuuauacacauca

SEQ ID NO: 7732 - RNA, 1320 nt, Mus musculus
agaaugacuacagcucuagcucaggcuacugaaugcagaaguccucugugcucugcgagaccucacugacccagaaauggaccuggaauccagucugaaaguaacaauaagggacuccacgggaaguguagcucaacuccugacucaauucuccauaagauuccagaacuacguucucuucccagggaagaugugagcccucuuuuguguuuuggaucucucuggcauccaagaaguauacgagcuuuuucucagauaccgggaaaugggggagguauaacauaggggcugcgguguagcucagucgguagagugcuugccuagcauggucaaagcacaaaauaagcuuagcgugcagaggcgggcaagccgaaguucaguggcauucccagcugaccagcucuggagcuagccugcuuauccgaggccuugucuaaaauuaguauauacaugcuuagaagguuucuaguucugguuuuuuuacaagagaauaaugggggggggaggggauaugguugaaaugcauuauauacauguaugaaaauguuauaacaaagcccauugcuauguauaauuaaauaugcuaauaaaacaauuuuauaaaagcauaagagaaacuaccaaggauuacgaaaggaacguaugauacagaaagccauuucuuucuucauucauucauucauucuucaggggaggguagaagucagaagacaacauuuaagagacagugcucuccuccccuguggguucugggcauugaacuugggucuucaaguuugguggcaagcacccuuauccacugagccaucuugcuggccccccucucucuuaccaugcaugguuauuaccacauuguaaacccagccugugguauccuuuaauacagcugaugaaagagcacaugugguaaacagcaugugaagaggugugcggcugggaugugcuaggcaagugucugaugucuccuggugugggucauagaagcuacucuucccugagacgagaggaucuucucacaaugggggaugcucugucccagcagacaguggagacggugaagaccuuguguucaucucaguucuuggacucccugaauucucuuuuuaaaaucuuuguguggagcugaagagaugguucugcaguuaagagcacuuguugcucuuguagaggaccuggauuugcuuuccagcaccugcauacaaugguggcucccaaucaccuguaacucccguuccaagggaucagacaucuucugauuuccucaggcauaugaugcccagacaaaauaccuauaaacguaaaauaaaugucuuuacaaau

SEQ ID NO: 7733 - RNA, 1281 nt, Mus musculus
cgccacacacgccgccggccgccauguucgaggccgccggcugcggggcacugcggggacaccgagggcggcguggcccagcccaggcgccggacccucccgcgccccuaaguccgguacucacgugagauaacggcccaaagagucggguaaagcgucuucucuuuuucggcggaauuuuuaaagagggaugugguuaccuugagcagaaauacccaaggcggccugggccauaggcugcggggacgacgugggggaaacgcgcggcaccgacaccagcugagcagcaguggcggcggcagccgaacuggagaaauggagcggcgcgagaaaaagaagaaaggcgcgaacuggguggggagaggauucagccucgucacuccgcagagcagcagagcgagaaggaugagaagagcagagcaggagacaaccagagagaaaaacggaaacaccgcggcgagaguugagccagagagugugggaaggcggugccagagacgccaguauuuauacucaggggggcgggggcugcugacgucacagacggccggucggccgcacgacggggguggggccugugccgccggggaaugugggaggggcggaaggggaaggacagccuugugcaguuagggggccgaagggcgggaccaccgggccuggcaggugcuggcccggcgcucgcuucccgcccucgcgcugcagccgcuccccagcgggcugcuaguuucguaggcggggcagagggcgcgcggcccagcggaucgcggaucgcgcccucgcccuugcggcgccugcgcgccacgcuagcagccaacgauccgcuuugugagccggcagcuaguccaugcugacggcagccuucgggaccguccuggguccucggcuuaccgacuccaguauuuuaggagaggagggugugcgccaucacggggcuuucucggugcacuaguuuauguaacaacuguauacuaugcccggggacuguauuccgagggagagguucccgccucuccauggguugcggagcuccguuaugaaaaugaguuccccguggccagcaagaaccaguccggugugguuacugaggcuuugaucguaccagaauguuccuccguguucgcauguugcaauauggugcaguagauuuuuuuuuuaaauguggcuuuucuuucuuugucuucauuuucaaaaaggguugaugcagucagacccagcccuauuaaagcggggccaguguugcugaaguuacaugacuuaaaggcacaucucuuuaauccu

SEQ ID NO: 7734 - RNA, 1281 nt, Mus musculus
aggauuaaagagaugugccuuuaagucauguaacuucagcaacacuggccccgcuuuaauagggcugggucugacugcaucaacccuuuuugaaaaugaagacaaagaaagaaaagccacauuuaaaaaaaaaaucuacugcaccauauugcaacaugcgaacacggaggaacauucugguacgaucaaagccucaguaaccacaccggacugguucuugcuggccacggggaacucauuuucauaacggagcuccgcaacccauggagaggcgggaaccucucccucggaauacaguccccgggcauaguauacaguuguuacauaaacuagugcaccgagaaagccccgugauggcgcacacccuccucuccuaaaauacuggagucgguaagccgaggacccaggacggucccgaaggcugccgucagcauggacuagcugccggcucacaaagcggaucguuggcugcuagcguggcgcgcaggcgccgcaagggcgagggcgcgauccgcgauccgcugggccgcgcgcccucugccccgccuacgaaacuagcagcccgcuggggagcggcugcagcgcgagggcgggaagcgagcgccgggccagcaccugccaggcccgguggucccgcccuucggcccccuaacugcacaaggcuguccuuccccuuccgccccucccacauuccccggcggcacaggccccacccccgucgugcggccgaccggccgucugugacgucagcagcccccgccccccugaguauaaauacuggcgucucuggcaccgccuucccacacucucuggcucaacucucgccgcgguguuuccguuuuucucucugguugucuccugcucugcucuucucauccuucucgcucugcugcucugcggagugacgaggcugaauccucuccccacccaguucgcgccuuucuucuuuuucucgcgccgcuccauuucuccaguucggcugccgccgccacugcugcucagcuggugucggugccgcgcguuucccccacgucguccccgcagccuauggcccaggccgccuuggguauuucugcucaagguaaccacaucccucuuuaaaaauuccgccgaaaaagagaagacgcuuuacccgacucuuugggccguuaucucacgugaguaccggacuuaggggcgcgggaggguccggcgccugggcugggccacgccgcccucgguguccccgcagugccccgcagccggcggccucgaacauggcggccggcggcguguguggcg

SEQ ID NO: 7735 - RNA, 30545 nt, Mus musculus
gcauaguuuugcuacacuuuauucaaaacuggucccacuucuuauuuaagagagcuaaacgcccaguguccaaauauaaauaucaccauguguuggaaaaauaaccuucugauuugcgcucugacccaaauuuggcacaacuaaauccuaugcgagucagacaggagugcucagagcucggcagcagcagccccugaagcagcccaggaggcggcggccccuggagccucucaagucacacacagcacagugggcacagguucuuuuauucuguccuguggggucaacagugcugacaagauagucagagcauuccaaaagcacacaccugaacguugucacauagcacuacaucacaacuuaguaacuacucaacaguuaugucuacuaauacagugaaugaaaugguaugcuuagaccauucccuguaaacaaggcugugcacaacaguaacacacagaauuaugcauaccaugauaucaaggaggaaaauaccucuuuaaauaaacuauucuauuuauaaauaaacucugauuuuuuucaguacacauuuacagaccugaucaauaaaaagaaacaauauauauauuuuucuuuaaaaagcaaauguugagauauggaccacaugagaaauucaucuaggggaaggggaaggagcaagcagagggcgugagaguuaugagaguuacuugugugagcaacaccaacacaaggccaggauugacugggaggagcucaguuuacuugaauuccagcaaguugcaaucaaucuuguaauacacauagggguaguauuccugcugacucagguuuaggccagggauauccaugggagccugcagaaaaaccacaaacagcagucagcugcuuacaaggucuuuuacggauaccuggucuggcugaagucaugcauguacaugaauuuaaucuaagucuucacuuagcuguaagaacaggaagagccuaugccugcugagucacggagagggagccaggccaggcuccgccccaaagccugucugacugacugaaccaugacuuucccgguuuacuauguagaacuguaagagguaacuuuuuaaaucuuggguuuaggacacaaggcuuuuaaaacguaguaucuaaauaaaccaagugugguuugaaagauuccagaucuauuugugccuuguaagaauuuagugagagcaaaauuuguaccaaagacuuaggauucuuaguuucuccaagauuuuaagauaucaaguuauuuccuacauuuucucuuaucaagaaaacuaauuuuucauuuuuccuauacacaagaucauaaacuauagagaaaaccagcaagaucugugaaauuuaaacuguaaaucaaagcccaagaauacagugaaaugauaaccacacacacacacacacacacacacacacacguacacacgcacgcccuuccaaaauaaauacaaacauaaauugcuaaucuacuauuacuucuacaaaacaaaacugaaauaauuucauauuuccuuccuguccgcaaucuacaauuuuuaaaaacaauuagaacauugguuguuccugaacgucugcaacuauaaacaucugauacauauaacaaaacaaugaugagcuucuagaaauacccagaacagcugcagcuaguauauacagccauggaacguuuaccuaagaaagggggugcucaggggacacaaauggccugguguccaugcuucugagaauccucaugcagucuuuucuccaccucccaaguccuacugcccuaggcuaaggugcacucacgucaaugauggcagccgcacugcuguccagaugcuuguacaacucgugcagcacuucucuuagcuucuucacugacuucuuauucggcugaaggagcauugcuuggaaguucaccggcaagccauaccuuagagagcaacagagacagugcacagcacaagcacagagagccauuuuccuuguagagcaaacagcgucccgcgucucucuucauggacacaguguguucuguguuaaauacucccuuuccaggucugucaccagccacagaugcuuccacuagcauggaaacacaaaccuccaagcccauuagugcccuuucaguaaaaagcaagccacuuuaaggggugugagcucaggccugcgaccccaacacuggggaggcugaggcagggguuguacaagcuuaagguuaaucuaggcuguagaggaggaaacccagacaagccaaucgcuaggaauuaauuaguauucaauuucacaauaaucuaugaauaugccaguauguaaagacaaucuacggcuagaagaucuguuuguacuuaaaagcugagacuuuccaugccuacuauaagcacuugaaauuuaaaacuuaaaacugaggggcauggcugcauacacagcucaaaacuaauggguuuccaugaagcuggagagauggcucaaugguuaagagcacaggcugcucuuccggaggaccuggguucaauucccacaccuacauagcagcuaccaacugucuguaccuccaguuccagaggaucuaauggcucuucuggaccucacaggcacugugguacacagacaacacacaggcaaacacaaacgguggugcuccccccauuacaauggaguucaacauuucuuagccuagagcccuucauugcagggcaguccuggguuuaugggggagcuggaguacacaaaccugccccuccagggaagucccacauacuggucagcaccaagaggccauguggagcacacaugacagcacagaccugcacuuaggagguugaggcaggaagaucaaaguuugagccagccuacgguaaaacugagcuccaggucagccuagagagacuacaucaaacaaaacaaguggccauggugagugagcaacugauucguacaccaacuacacauaacuacacaguacauugugugugccccacaaugaaaucgcuaacugcucacaccgacucuccuuaaacaguacaugacuaaaugugagagacggagcagugugggucucuuuuccugaaccugguguuaaagaaccagauaaauaugcacuugacaagcugugugacccugacagccacuuccuccuaacuggcucuuuggcugguccaaaucaccuucacaaggcuggacugggucaugagagaggcacaccgaacucugcgacuccagcuuucuccauaaauuucuuaccuuaaaacagacuccacaaaaacccguaaugcuuuuauaugaauccacgcaauaaacgccucacugaaauucacuuuaagccaccgcacaaguggucccuuugaaaagagaaacacaaaauuaccacaaauuugguuuucaaauggcaauuagacaagucaggcauucuuuuuaagugauuagccacaauaugaaaguuucaaauauuauacuggauacaauuaucuuaccaugcucuuaaacgaaaggguaagccacuacucaguagccucagcagacucuagagugaacuagguacaucaagagcaagaggaacaugccuucaugaaagcaguuuaaaguggacuugaaagcuguagcauaaacacuugagcacacuaugauacucaacauucuuaacacacuagcagagaagccaaccugcaaauucucaggagcacagccauucccacccagagucucugaaaccugcucaugauuuauauuuuccugauucuaugcaaugcaagcucuuguugaacuuaagucuuuaguacaauuuaagaacuuugccccuucuuagaauugggaacaaaacacccauggaaggaguuacagagacaaaguuuggagcugagacgaaaggauggaccaucuagagacugccauauccggggauccaucccauaauagcuuccaaacgcugacaccauugcauacacuagcaagauuuugcugaaaggacccagauauggcugucucuugugagacuaugcccgggccuggcaaacacagaaguagaugcucacagucagcuauuggauggaucacagggcccccaauggaggagcuagagaaaguacccaaggagcugaagggaucugcaaucauauagguggaacaacaauaugaacuaaccaguauccccagagcuugugucucuagcugcauaugaaucagaagauggccuagucggccaucaguggaaagagaggcccauuggucucgcaaacuuuauaugccucaauacagggaaaugucagggccaagaagugggagugggugggggagcauguaggggacuuuugggauagcauuggaaauguaaauuaaauaaauacccaauuaaaaaaaaaaagaacuucuucaaagaugucaaacaaugccucuuccugucgaccuacaaagacaucauugacuuaacaccuaacuuaggaucauuuggauguaccaaacaacuauguuuaggccaagaggauacaauaagcucugauggaaaugucugcucuuugagcuuccaggcacacagcaugugacaucugccugcuaggaagcagagcagucagugggguaagugguugugcagcugugcagggucaaggguucccuggugucugaggaaagccugggcuggccugggaggagcugccacaggcaucuccuucuuauacacaacccugagcugcuggggauggacacauauuuaauuguacaucuucauuaccuuugagacaagcucucauguaaccaaggauaaccuagaacucccuuacccucugcucuucccccagugcugggauuacagggugugcccccacagccaguguuuggcacuguggcacuguggcuuugugcacguuaaguaagcacucuacugaacuacaucuucagucccaacauuuacauuuuucaagcaccaaauuauaaacuacauuuucauauuuuccuccccuuucaguauccccagaauguauuuuuccauuuuccaagaaucaaaagcaaaauaagcucuaaaaaaaauccaaugaagagacuacaaaaggaggcugcggcucagaggugggaccugagguguaaaggggcugaggcaggcauggacacacagcccagcugugggagugcugacagagggaccuggcacuugcuggcugccuauaaucccuacacucuaaagcugaggcaagagaguccccgagcuccagacggcccugggccacacagugcauuccaccugaccaugggaugaaacugucucaaaagaggaggauaguaaaggaccucaaacccuagucagagacagcagcacugcuucauccucugcugcacacugacaacacuaaggaaggacacguacaaacugcuucuucuugucaguagacagccuggucauuucuucuuuaucugcuuucaucuccuccucguuauacuggaagucacgaacuaugaaccuaaauauggaggaaaauccaaauuugucuacaccacauauagccaagccaacacauuuaaaaaaaaaaaaauauacaucucuguauauacaugagacagauuagacagauagacuuacuuguuuucucuggcuuugugucugaaaucaucaacugcuuuucuaaacaaggugacguuacaaagauaacugucuugguccucugaaagaacacuaaagggggaaaaagucauuuuaagcucuauacuuaaacagcagaauugagaaacaggaugagaagggacccucaccucacuucaucugcaccaccuccaacgggaaagacaaugggcacuccugacagacaggccuucacacccucuaccacaccuccuagcuaacaaaguuaucugcucacacucuggagcgugcaguucaacuucuagcaccagucugcuuggucaaacugucucuucuugucucaugaacuauucuuccucuuuccagucuaauccagccagcucaccagggucugccucaaccacucuggacugcuaucaacuccugucuccccacccaccacacccccaaucagaacuugccagcucgguaacagaacccagguacucuccuaaccacugagccaccucuccagcccauaguauuuauuuauaauauggugauucuaaaacagaagcaagacugaugaaacugaaaggguucuugaggaauuuaaaugcuuucuuuuuaauuaaauaaauuaaaauuagacaaaguauuuuaaguuucauuuuccccagaagccuagugaacuccucauccguccaguaaauucaggugcuaacuacagagcucaccuaaaggcuggcuuuaagaacuaaaucugcccuggcucuugaccaaucagcuggucagucacuugaggccaccuccacagcacaggacagggagggccucaccgccaucaucagugaagugcuccugauucagaacacugacaccuccuucccuaagccacccuaugaaaugaucgccuaguucuuuuccuagugccuuucaaacucagguggacagugagccacaggaaggguuuuaaugagagcuggagagauggcucagcaguuaagagcagguugagguugaggucucagauucauaacuacaguuucaggggagccaaugccuucuuugacaucccugggcaccaggcaugcacaugguacacauguacacacacacacacacacacacacacacacacacacacacacacacacacaaacacuccuaaaagaaucuuucaaauuuaagaauauuaguugaaaacaaauaaaccuggaugugauggaucacaccugugaucccaacacuugggaaucugagccaugaagaucauuaggaguacaaggccagcccgggccacagagugaauucuaagcuagccugcacuacagaaagagaaucuuucucaaaaggaauccaaaaucuagguaagaugauacccacguaugcacuaucuagcuaagaugguauuacucagcccuugggaggcagaguugaaaggaucaugagccccaagccagaccuggcuacacauaugucaagcuuggccugguggaacauacagcccuugagagauagagacaggcaaaguaugaguucaggccagccugggcuacaugagaaacugucucaauagaaauaaaaagaaaaggaaaggagagagggaaggagggagggaggaaagaauagaggaagggaaggagggcgggcaggcaggugaucaagugauacuaucuauguuuuuuuaauacuuauuucuauuuugaguacugguguuugccuggauauaugucugugcaucauguguguguguaugugguaccauuggaggucagaagagaccuccaauguaacuuaaguuacaggugauugugagcuaccauguaggugcuggaaccaaaccuggauccucugcaagaauagccaaugcucuuaauggcuaagccaacucuaaccccaucacuaugauguuuugccugcgugaauguuugugugaugguaacagagccuuuaaaacuggaauuuuaggcaguaaugaacugccaugugggcacugggaauugaacacagguccacugaagagcagccaauguucuuaaccacugagccaucucuccaacccuacuacccauaucuaauuuacuuaguuugaguaaaggcuugaaacaauaacuaccucgggguaacuaaaauuuuaguuaaccgagaugaggaucagagcaggcuacuugccuacuaugugccaaguucuggguuuaacccccaacaccacacacccaaaaugaaaaauguuagcuacaaggcaaacaaaaaucuuuaucaagccagaguuccuuccugaauagugggugccagagcagggcccugaaggccuagcuggcuugugugaacuauaugcucugcccauugcuacuuggcuagcucuauguucuccauggacauugaugccaaaugcacuuuacacugugagguggggcuggggauccaaaaggccauuaggacaaguacugccuggauuuuacuauccuuccuuuaaauuauuaaagugauuagcaaacaaccuaacucucugaaaugguauaaaguccuuucaaaaucagagcuuauucacuaacuuaugcagucccccacccaaccccgaagccugacuucuacaugucuaccacuagaggacacugugcacugagccucacccuccuccuggauaccugcuuccagaauacuguguugaccucugagcucaaaugauguagagaaguuacuacuggucaggaucgacggcccaaaugagacugcauguuaagauacaaccacugucuucaguuugccaugugaagaguuggcuuuaauaaaggguauuacuccaaauacagggggaaaaucacaaugagcucagauuugugacuuauuucucaauacuugucaaaugucaacgauaccuuauguuuuauauacucuaucacgucuuaaacuaacuuccuaacuucuuugacauuugagaaaagacagugggacccaaaaguucaaagacauacccaggcaagcuagaagaagaaccaucaauaggguccaugauuuuccauuauaccaaacuaacuccuguauggcacaaugagcuggaaaagaaaguacuucuggccugagcuuacgaaguucacuuucucacugucuuugauaccuucucuuuaacaaggcaugucaugcagcaauaacuggccacagacuggugauauaggucacaagcuacaaaaccauugucaacccugccuugccuugccauugggcacuuggaaaccauaugcuuuagaccaccuaaacacagccuccuauccuauguagaaauuagcuggcuaaagugccucacagcacugcuguaacuaauaaauagacaaugcacauuaaacucauaacucaaaaugcuuacuaaaaaggcaagcauucuguggcuuuuuaaagacuauacagaucuggccccaucaucuacucaaacaaaauuugaagguucacacauuccaggagcuaccugauaugacuccuuugcuagguaaaugaagacuuaguuccuagaggagacacagcaacagcggauggaagcuucaaggaggcaacaagauguagcagaagccccauagcuggcccuggccaagcuccuuaaacccauggcuggcccuggcccuggcccuggcucuggcccuggcaucaucuucccgguaaguguggcucuggccucaccuuauaguccucacaccuccaucuaugaaaaugaggggucaagccagguaugccacucccuucuagauaugaaauggugauaacuagaguugacaauuuaugaaguaaaaacaagggcucuaaaauuacagauuuacugcaaaggaaacacagaccacaaagagauuuccuaaucccacaagcuguuggaagacuuguaggaaacaaagcacuguugcaagauggcuacuuacuugcuugaccuugguacuaccauuucugcgagcguuucauacugcuuaauccagucauugugguucagccugcagaaaggacacaguaaacaucaggaaggacagacaagucccauuucugccauguccaggaagagaaaacaugggacacaugggaaauguggcuccaauaaagcacaucauauguguagcaaaacaucagucuccuacugagggcgccucacaaacacggaaugaagcaagaagucuggacugccucccgcacagccagggacuguugcgacagaggcacagcuuggcuuguuaacguggcaaagcacaguacagauucuacauuauuuuuaaacugcauggcuggaaaacauuaauuuauaccucauuuaaaaaaacagaagaggccaugggaaauuacuaccauuugguggccauuacaaaaggcuaacuaaaacccuauuuuacagaaagcagggcguaccucaggaaguagcgaggacacaguaacaauaaaggagacugccucagaacacugugcaacagcuuucuggaaaggccacuggcuuuggggguguggagagauaaguaugugugauuuacaguaaagguugguagacacagguagcugacuauguaaagugaucuacaggggcucuuguuuacaucuuaugguacaaaaagcugaaauuuucucaacacaauuuuaaaauaaagccaaguaagaaaaauaugggcaaauauaaauaggauuuuaaaauaaauaucauguuccaauguucugggaacaacugugcaagaaaagcauggagcaaagcuuugcacccugggcacagugauguaugugugccugugacuccaguacuugggaagugaaggcaggagcagggcaagccccaagccagucagaccauagugccaguucaaggacagcccuaaagaaaaaaaaaaccagaaaaauccaaaagccuacacucugaggagaaaugcuccagucagguaccauuagggaaacugauucccuuacuauuccucuccauccuccuccaggagccaguguuucucuuuuauucccaauucccuaaccagauaaaauacagaacaaagaagguaggcuucaugcagugauauucuaaaaaaacaaugcagccugucucagcuuagaauccccagagaugucagcagugcaggaccugaggccacugaacgugucucuccaacacaggcuuuuacgcccuucuuuugaaacagggccuuaccauguaucuggcuggccuggaaucucuugugcagccuaggcuagccucagcucacagagaucugucugccucagccugcccacugcugggauuaaagguguaugccacacugugcaagccacccacucaguucuacucuuuacuuucuacucuuuagauucuccaaaacuacacauugagcaaacauucauacagaagucaaagggagaccucaaaggguuauuagauccaaaggugagcaaacuaugugcauuuguguuaguaagcacagugcuuuuacuucgccuguucacagacucugcggcugcuucagcucuaacaaccaauugccacgguaaagcacagcaguuguuaagaguggcaaagccaaaaagacugcccagcccuuuauagggaaaaaacacauucuucacuuucuggggucuuucuguuguuuuuuuuccgagacaggguuuucucuguguagcccuggcuguccuggcacucacucuguagaccaggcuggccucgaacucacagacauccaccugccucugccuccccagugcuggcauuaaaggugagugccacuauggacucuugaaacagacauacuugggaacuaccaccagcaaugugacaagauacuccgaaucaagaacaaagucaucuuucuucacgauuuccgccaggcuucgcguuagcaaacuuccccugaagaguaagaagagaaucacuggugaguacauguccaaaugcuucuguaacccaaggaaagaagggcagggugaucucgugguaaaugcaccucagaggcaucagucuuaggaaacaguuuugcuccauaagaagucaacaguuaggggcuggagagcuggcgacucaauucccaacacccacaugguggcucagcuaccagguaucugacaccuucuucugaccuccaagaaagagcccuaggcaugcacuugguccacauacauacaauaauacacagaaaauaaaaacuuuuaauuaaaaaaaaaauguauauaagaagucaauaguuagccagauguauccuaucccugcaacccaagaagugccaaugccugucaaaguuugacaucaauguccaacucugugcuuauuuuaauuaccauagcucgguucuucucuuaauuacauauccuggcugggacaguacgaguuaccagauaccagagucuauuucacuguaauuaugaaauuaugucaucuaagcacaaccucugcuuucucucuuuccccagauauaaugugauacuauuuggucuuccauaacgaaaaugccuguccuguuuguaccacagaccaucuccauccagcuuucuccuuggaugaugauacaacuuugaacagcuauguacuuaaaacuacacuuggcggcuagaaagauggcucagugguuaagagcacuugcuacacaaccaugcagaccugaguucagauaccagcauccauguaacaagcuaugcacaccuauaacccaaagaaguggcuaacaccaggagggaaucugaugacuccccuguucuccgcauguacacacacagacucaugugcaauucucucaaauacaccacauacauacauacacacacacacacacacacacacacacgcacacacgcacacacgcacgcacaaggaaacuaccaauaacaaaacagccuaaaacuacacuugcaauaauacuguaagaucaaccaaauaagauuccaaguuaauacuuuaaaaaaucuaaaccuagaaacagagaaaguagaaaauaaucauuauagcacaauuacauaaaaaaaaaacuuugaaccagcaagugauugcuauguaauaaauaaauugauaaaauaauuaacuuuacacaaauuucaguaaaacaucaaaugcauuaaaggaacuaaaccauagcucacgugacaagucaauuuauaaacaguuuaauaaaccagcaaacacugauuucuucucauuguucaaauucuguaaaauuacugaacuuucucuaugaaauacuuuagaaaucauaagaaguauuuuccauguguguacacguaaagaaguguacguauggcacacaugcgggagccugcagagguuagaagaagaaauccggaucaccuagauaugaaguuacagacaagugucagcuacacgcgagugcugggagccaacucgggcccccugcaagagcagccaacacucuaacugcugagccaucuauccagcuccccacaaaucauucugauuacagaaacagcacaaacuagaacuuucuaaacccuaauggugucccgcacaacaugcaugcaugcaccacacacacacauuuagcauccacaaagacuuacgcguucuuucgcucuaaauucugaagauucccuuucagguuauuguaugcagacgcccgagacuuuaggucauuaucgaucugagucacucccuucaaaagagaagaaaaacgggcaaguuauuucuagguuugccucuaccaauauaauuuaaauauuuucuggcauaaaaauauaugauuucauuaaaacuuuaaaaggacauuuaaaaaauaaucaacuucacugccuuuaaccccacuugagaggcaaaggcaguuugauuucugugaauucuaggacugucuggucuacagagugaguuccaggacagccagggcuuuacggagaaacccugucucaaaaaacaaacuaacgcaaaacaaaaacaaaacuucauuauuaacaaauuuccuaugaaucuuuuuuucuuuuuuuuuuuuuuuuuuuuuuuuuuuuugagacaggguuucucuguauagcucuggcuguccuggaacucacucuguagaccaggcuggccucgaacucagaaauccgccugacucuaccuccuaagugaugggauuaaaggcaugcgccaccacgcccggcuccuaugaaucuuuuguacuacauuaguccacguaguucauuuacuugcuauugccacauuacuuccuaaaucaagugacccagcccacuagguggaagauuacuaaacaaaaaucuucuaaggcuagacaugacggcacacaccuuuaaucccagcacucaggcggcagagguaggagaaccugaguucaaugacagucaggacuacuagagagacccugucucaaaagacaaaacaaaggggcuggagugauggcccaaaaacuaagagcacuggcuggcugcuccucuagaggaccccaguuuaauuccuagcacccaaaugacagcucccaccugccuuugccuccaguguaagggguucugacacccucacacaggugcaagcaaaacacaccaaugcacguacaauaaacaucgaaaaaaguuuaaaaaaggaaaaaccuaaaaaguauuucauggcgcucucucucucucucucccucucucucccccucucucucucucucccuccuucccucccucccucucucucuguguguguguguguguguguguauguguguguauguguauguaguguagcagaauuuucccuguccaaucaauuuaaauauuaauacaagaagcaugugacuggacagagaaaugggagacggagcuaagaguuuuagagacagagacaggagaaggaaggaagauggaacaaguggaagaugauccagauuccaugugcuuuaaauagccccagguagcuaugaauaucacaaaggauagaauaauugggauagcuugucuaaucuaggugggcaacuuguaucauuaucaauuggcucugaaauuauuguaugggcaucuugcgacuugagaaucuacugauauauaaaucuggcugauuacuuguaaguuucuagaguuuugguuuuaccaggcuacugggauuugggaccacuaaccacagggguggauggcugggaaugggagcagaaucuacagaaagagaaccgugaugggucgcugcauguggcaagccuagaggcagcgagacagugggcagcgaguagcagggaauagcgugggauggugccaauuuuuuaauauuucccacaacauguauguauauauguauacacacacauauauaugacacauauccaugcacauacauaauuuaaacaaaucuucuauaaaucagugugcccaucugccucauuucgugucuuaccuuggcaauuauuucagaaauauuuuucagagacugcuugauuggauauuuagccauaucccacuggaaccuuguuauguaaguaaccaagucaacugaaauaagacaauaaauuaauuacugaagagaaguagcagcauuuucuuguggguuuuguuuguuuguuuagauucuuucaagacacaguuucucugaguagccucugcugauuuagaacucacucuauaaacaaggcuggccuuuaacuuagagauccaucugugucuaccuccugaacauugagauuaaaggcaugccucacuaugccugagaguuugcuugcuuuuaacacaggcaaagauaugauuuccaaaggguccugauuaaauaaaugugaaugagauuagaagaacacuaaacuuaagauuuauuuuuuaaucauguacaugagguggagggcaugugugugaauaugaaugcaggugccugcagaaggaggccagaagagauucccugaagcuggaauuacaggugguuauuagcuacccaaugugucugccaggacucaaacucugcaagagcaguaugcccucuuaaccacugaaccaucuauccagccccagaaaacuagaauguuuaaaagugauauuguuagauguggugaacacccuuuuucuuucuuuuuuuuuuuucuuucuuucuuuuuuuuuuuuuggagacaggguuucucuguauagcccuggcuguccuggaacucacuuuguagcccaggcuggccucgaacucaggaaucuggcugcuucugccuuccgagugcugggaucaaagguguacgccaccaugcccggcuugcugaacaccuuuaauuccagguaaagguaggauaacuuccugaauucaaguccagccuacucuacauagugaguuccaggccagccaggaaaucggagacugucucaaaaacaaauuaauuaauuaauuaauuaauuaaaaucaauaauaaaugaauaaaaaucuucuuuauaaagucaucaucacugagcaggcucaauauaaauauuaacuuauagcugcaggcagauaucuguaucuauauagagauauggauauguauaaauuauggguacuaagacagcaauacucuaacuuuaauggaaaagaggcauuaccauguaauaaaaucaaucacuuccuggguacuauuaaguagaaaacaggaggcaucuagcagcaauaaaacugggauguccagcuuuaagucagcaaguaguucccgacggagcuaaagaaacagcgcuucugcaggaggccugaugccgcaccuaacacuacauguaccaccuaagaguaacauggaauuguguuccagggggcagaugcagcuaguaaaucaccagucauacccucccucagagccuugccaaagcagcccaccccccaucugugauuuaccguccuuucugauguuucuaagcacgaugucacacacuaguaaccaggaaucauaacuaaugagcucaccuccgcuggccagcaaguucuccugaacuuuaucuuugcuguccuccagcacaucagccauguacugagccacuuucuugaccacacugggaaauuaaaaaagaaaaucaucauuuuuugaaaaaaaaaaaaaaucuuuguuacauagacuaucauacuauacaaugaauccuuauauaagacauaaaaaaugaaguggaucaagauuugguugugcgcaaaaagcaacugcacaaccguaggguuuuacagagacuacauguaaaauguuucucagucuagaaagucaugaaaacuggucacaguggcacauucuuguaauccuagcacuuucaagguggaagcagaaggaucaacuucaagaccauccucugcugcauguggacuuacaacccucauccuaacuugauacuuuuuucuccuucaugcuuuuucguuuuagugggcaagccccugaccucauuugaggcuuccccccagcuugguucuaugacaucauacagugcaggcuggcuuaaacaggcaauccucaugccucagcccugcaagaacugggagacagaaaacagguguacagcauggcucagucacucaccucuucuacacacaacuguugccuacaacaggccuucuuuucuugccuucaauauuuuagaaaaccaauacaauauugggacuacuuucuuacugcaggcucuuauuuuaaaauaauuucucaaaaugagcaugguaguguacaacuguaaucccagcacuccaaaggcugaggcaguaggaucaugaugaacugucucaagcaaauaaauaaauaaaaggucaagggagggccuccagagauagauggccgagaagcuaugaaaaaaaaaaaaaacauaauucuagagaacucaaguucaguuuccaacacacccacgucagguggcucaccaccaacugcaacuccaguuccaggggaucuaaagcccuuuucuagucuccacugguaucuguacucauacugcacauacacacacugacaacacauauauacauaaauaaaaauauacauaaauaaaaauagguccuuacaaauaaauaaauagaauaagccauacaucauuaguuagaguaacaugaaugaaaaucagaauguggccagucaggacaggccuuuagucucagcaccuggaggcaaaggcaggcagacuggccuacagagagagcucuaggccagccagggcuacaaaguauuccucugucuccaaaacaaaacaaucaaaaacaacaaacaaacaaugagauacugcuuuguacccaccaggaggguuacaguaaaaucaguucaugguagguccuagcacaaaugcagcaaaauuaaacugauucagcacugaucacacuuguagucucagcacugggaagacggaagcagaagcacucuaagugcugggccagccugagcuacacugugaauuccaaggcagcaugggcaacaguguaaaaaccugucucaaaaaacaagaacaauaaaaucuaauaaugcaaauaggaacugguacagccacuguaaaaacaguucuucauaaagaaccaagaaacccaaugacuccacucccaggcacacacacauucaagaaaaacagaaaugcagcucacaaacaguacauaagccagaaagagaauaaacuaaauguucuccaguugauggauuaauaaggcuugauauguaguggauaagugauaauaucagguauguuugcaaacucaggguugggaaagcagacaggaggaucccaaagguuuccuggucaguggcccaauugaaucugcaagcccuggggguuccaaugagagaccuuguaucaaggaaaaaaacaaacaaacauacaaacaaacaaaaaaaaaaaacccaagguagaaugugccugacauccauguucaccggcacacacagugcaugaacaugcuugaaccauaggugcacaugugcacacauccauacauuauacacauaaaauauucauauacagagaaaaauagucaucucccaaaauccuucagcuaguguagcauacacauggacuagaacagugucuggagagacucucuagauagccugguacugacaacugagucucucuguuccaccccauacaugcauauacauuacccuucuacaaaugcauccaguuuagccaguucauccgacaagccaaccaagacauccaacgugccaaccuacaagggaaacucagcuuaguacucagcuuuugucauguccauccuuuugauugaagagggaucgucugcuuagcucugacacugcucuuacugugugauccagaugagccuggggcucccauuccuccucucucucucuucagugcugggauuacagccuacaccaccccacccagcuccacaucccuuuacuuuuuuuuuuuuucuaaauagaugguguaucuuuaucugaagggucuacaaaucuuuuauuuuccacuuauuucauaaaguauagcacaaaaaguuuguugaacauuuaagucauuugaauguaugaguuaauucugagucggaaagcaccauuuagaacaugaaaaucuggcacauaaugaacagaucuguauucaacaagcccaggaacaguggcaaugugaagcucugcuuuacaaggcccuacgaugggucuaugaauguguaucacuggcagguugauuacuggucuucaaugaauguuuaaauacauuaacuggauuaaauaaugccuaaguagguacugugguaacagaauaugaacuuaacaacagacauauuacugugauauuuaaaauauauauacuaagauuuuucucuucugaaaaucccacuuugugauccaauaucuaggcuucccuauaauuuaugaaaacagaagacucaaaacaagaugugacuucagugguguccuugugauauucacagacucagauccacugaaauuaacucaaccgcuagaaaagacugacuuuuccucucaaggaacaaaaaccucgauucugccagagcggagagaaccucaccgggcuccugacagacucacaguccucugcacugugaagucaccugugaccucaccuuuaggucaggaauguugaacuuggaagagacggcaagauuauuguucuugguggucgcugcauguaguuucucccauguuugcugacagguuuucuccccaggagcagauaugagccagaacucagucauguuuguuaccucuuuggcaagcaagggagaagcuguaauguuaaaacagagcaguaacauuuaauguccuacaguacaaccuuacagcaaacacuuaggaucuaaaaugccccagaaaccccaguguccaaaggcuugauucccaggcagugagacuacugggagacuauaaaacagguguaggggugagaccuuauaagaaaaaguuaggccacuuagaaaaugcacuugaagcagauauuaggacccuggccccucccuccuuccccugucuuuaucuagggucugauuauucuguccaagcuggccucaaacuuuugagcucaagcuaucuucccacucuggcucuccaaauggcugcaguuacaggaacaugaugucaucaaacuuggcuucucuuuuuugcucucagcagcaugaagaaaacaauucuucccagcuacaacagcaggcuugaugcacugagacaccagcagccccaacggugguuggccucuucacugcuaucuuggcuauucagccuaggcuauuuucccaucaccccagauacuaaucaggagacugucuugacuacacaaucaacagcuuuuaucagagaauuaccuguaucucuaaggcucugguugcuugcuuuguguacauacaguauggagcuuaaagcaggaccucaagcacuccuaugacugaaccuuucccagugguccucagacagggucucacuaaacuaaguuggccuugcacucuccuauagcccaggcaggccuucaacuuuuaaucuuccugcuuuggcaucccaaguagauaggauuacagcccuguaccaagucuaaaacaccuuuaauaauacugauuuccuaggugaccacaguuuuggggaaguggauguuuuauuacauguuauaccagcagaucuggugaaguguacuuguggguguauuuucuacuugcugucucuccaaagggcagguaaggaacacaacuguccuuauucuuccugacagcagugucacaucugcugagcuuagccuuuagccucucucuaacacugugagccagcagaugccuguuccaccauucuaaauaccuuucuuggcccacauauguccaaaagacucccagaaacaggagagaaaacccuauuuucucagcuguaaauaccugccucuauacucgacugaguuuuuaucagcauaaaaggaaauaaugucacaaaucauccuauacacaguggagcagugucugggaaagucauagaaagcucucuaagucuugcuuuuaacuggagcccuuuuaaggaaaaggccacuguacugcauacacagggcugcacacugucauguuccauucucacaauaacccuauaaaauaaacacucacagagcuuagucauuuaccuaagggcacaacacacaacugggaucaagucuaacaugggacaccaaaggccacgcucucuaaaggacucuuuccuaggcugugcuaggaaagaaugcuggugugugugugggugugugugugugagcuagcacccacugcacauguguggaggucagagaacucaucuugggaguugcuucccuccuaguuuauuaggcaaggcaggguuucugguuucuguugcaccguguucucuggggugaucuccaucuccuuccagccccauuacaggggugcacugcugcaccuggcuuccagggucaugaaguuugugcagcuaggacuugccuucacccacuuaacaucuucaaguacuguugaauacugcugaaugaauaacccugaggauuaaaugaacuaacagguaaacugaauuauaacuagucaucuucuuucccuuuccuacucuugaaauauaaucuacauacagugaaacacacccaucuuaagacuucaaucaguuccugagccauguauagacuuguugagcuaccaccaaaacuaaaauuaagaacaucuguaguaugccuagcucaugccuuuuacccaccccaaaaggguuuacgugugugcaugcacacaccccuaaucaaucaaucaaucucaaucucucucucucucucucucucucucucucucucucucucucucuuacacacauaccagugcccucagaugucagaacaggacuguggaugccuugaacuugauagaguuaugaauggcugugugaacuccauguuggugcugggaagugaauccaagaguucccuguaagaagagccacgcucuagcccugacuugguuggcuguguggucugccauucucaucugauaacauuguacuucacauacacuuuccagcuuuaaguucuaucucuuacauuuuuccauuuaccugcucauuaugauucuuuccaguaaaaucacugaucauauuucuaauucaucgugcuacauuauugauuacugcacuguauacuccuucugagauggugggagggcugaacagacggcucagugggugaaggaaugaacacaacaccaagcuucaugaccaagcugcauccuuuaggagggauguuuccuacaagcuguucucugacuuccacacauguucaugcacaugcaugcacauacuagcaugugcaugcacacgugauacaauuuuuuaaaaaaauguuugagauaggaucuuacuauauaucccuggcuggccuggaguuuguuauguaaacuaaacuaaccucaaacucagagaccagcuugccucugcuuccuaauggcugaaauuaaaggcuugugacaccaagcccagacuuuuuuuucuuuuuaaagacaaugcugugcuuuguucuaaaucccaagucuggauucagaaaaagacagggguggggggggcaggaaggagagggcagaaagggaagcuauuguacuggcaacuauucagguaccgcugucuacucauucuucgcucgacccacuaucaagagcccuacaaaggcugcucaugcuucucuguggacuuuaccugccaauuaccuagauaaacuuucaucuagccugaugucagcaagauccacggcuacagugcaacacaucuucgagaaaucaggccagcuugggcaacacaguaaguucuugucuugagugaguguggggguggaggugggggauagugaauuuaucaagcaacagauggcuuaaugcccacacuguuuccucgccagguaacagaaggcugaguagcucauuacacauaugcaccaaguucugguuccccuuggaauggaauuugaaucuacccucaguccuugguuccauuuuuccugcuuuacccucacaaacuuccuggauccuccuuuuccaccuuaaccuccaguuugcccuuccuucucuuuccuauugugcuuuuugguucaauucauuuugcacaaacucugccuauaaaaaccacccaagccauuuccucaacuaaguccaucuauccaccaaaucaaucaacauaugcccaacuacaucucucucaauccacaggcacugaacucaaguaaacauguuaacuauauuaaggcagacacauaugucuagucccuuacuauuuaauuagcaauuguuuuccauuuaggaucuuauuccccucaaaucccuggagcuguacuuguguuugggaagcaaaacgaaugaaauguagucccugucaucaaggaacuugaaugauggccacagaucucuaugagaaggugggaggguguaaguagguagagagagagaugagagggaggcccaugcagagaucaggacaagaaaacaaccucagcacaauauauuagcagcacaagggcacaaagcccaaauacaaagagggaaagcauagguccaaagcuccgggauugcuuaauuacuacaucucuuaccuaggguaauuugaaggcuagaauuauucuccuacuacacugauauaaagaaaaaaacaacaguguaguaacuuacauggcaccacaaaaggugggguacuagcccaggcagaucagaucagcucgcagacaaacucaaagagggcaaccacagaaaacaggauguaccccaacccuacacugauuuucaugcuuucaagaaacaacacuguaguccagcugugguggcauacaccuauaaccccagcgcuuggaaagccgaugcagcaagguuggggcuauccuguaugacaauggugacuuccaggucagcuugaacacaguaagacuuugucucaaaaggaaggauggauaaaggcaagaaggaaggcugcuagcuggcuggcaguacacuguuucucugaaaugcacucaucccuaacaguaagugcaauuccauaugaauuaaggguggaagauggucuagaugcaaaaugacuuccuuuuugguccuucaaauuacagucagucagucuuccacacccaagguguccuaucuggaggagagccagugagauggcucaguggguaaggguauuugccaccaagcccgaugacccaaaccccaauacacaagaacuccaugaugagagcacugaccacacaccacacccacacucuacaggaacuccaugauggagggcauugaccacacacacaccugcaagucauaugaugaccuucacaaaagcacugugacacaugcauacauacacacauacacacauacauacacacauacacacacacacacacacacacacacacacacacacauacacaaacaguuuuuaaaagucaaaaaauauugugaggacauauguaccagugauauccaugucuagauauggacucuuccuuuaucauuauuccuuaaagcagaacaacaacuuacacagcccguccacugcacauuuaacacugacaguuaauacuggaugguuuaaagugcacagggcauguguguagugacaaggagacagggaagagggaagaugcugacggccaagcauacuaaagcaguuuauuccaacaggcguaggaaauggcagguugagguaacagcacaacagcccuccaaacagcacuccaccuuuacagaggggucaagaugagacaaaguugucacaccuacccuuacaauaccauuuauccuauacaaagaaguguuuccucucugcauguaaaaaugcuacccuucacagcagaagcaucuuagucauaacugguggaggggaacuuguuccugacuuguuuaauuguuucuagcaacuaaaggagagcuuaccuuucaauauuuccaagauauauaugagaucuagaacugacaaacuauguauuaucaauaaauacaucuuaacuuuuucaaauuuuuaagugaaacaauauuuacuuaaagacuaccuaagugucuucagcacauuuagauaugaaagaaagcaaucucuaaucaguuuuguuuauaaacagcuaucuugucaucccacugucaagaaauagauuuguaaacagagaguuuugcagacaccuaucaacaaguaggaagacuccaaggcauguuaggaccagcagagcaaauuuccguuacuaccccagcccgcuguccucuuggaauguacucaaaacccauucuuuggagacgaagaaaguagcucuguuggcagaguacuugucuagcaagccugaagcccuggguucuauccccaacaccuccuaaguuaugugugguagguagcacaccaguauuccuagcaccugggaaguagagacaggaggauccaaaguucaaggucauccuugauuauauuuaguucuaguugagaccagccuagguuacaugaggauauuucaaaaagaauaaaagaaagucacuauacaaaauacaauguuggaaaguaccuaguaauuucugguaaagcuauuauacuugaauugacacaguggccaacaagugcaaucugucuaucauugaaagccauuaacuagagcucucucaaccugggaaagugacucaccuuuagaaucucagcaucuaggagacuaaaaggugagaguuuggggcuagcuuggacuuuauaaggagcaugaggccaaccugggccagugugaaacccuagcuuauaaaacaaaaacaacagggccaaggagagggguaagagcccuggcuguucagccuggggauccaaguucuguccccagaaccugaguaaagagggcagccucgguggcacacaguguaaccccaguaaaagaugagaggcaaugacagaagacucacccagaagcuuacaagucagccacccugguguacacagugcaauagaaaccacaggaagaaaucaaugcucaaaguugucuucugaccuccacacaacccauaccucaagagccccugagcccagcucucaggacuucccuuuucuuuguggcuggucauuuauauaaucauuuuuaauuuauaaugaucucucagauauacuauguucaagucugaaauucaaguuaaaggucuaaaaucagggcuagggacauggcuaacauauagaauacacuccugucuagcuacacacaagacucugucugauucaauuccucacaucgccucccuuaaaauaaaaacugcuucaaggacaacacauacugaaucaugaguaaugaaaagcacuucaauauguuaaacaauuuggugauaaauuccucuagagcagaugcuucacugcuccuuuagagcagagaacaguuaaugaagauaucuguccaaagucauagcuaguaacuauacuuacugagacugauuucauccaucuauuuaaguucucauacaguuaaaaauaguaaaauguguuucuccaguuaauaguaaaaaccauaaaagaaaaacugaauucacaaaaguauuacucuuauuuucuguaucuucaauguugaauauuugccaaaguauguaauaacagugcaugcuuaucugucuccgugagaaaugcacaggacuauuucaaguacuagucagaaugugguggacggacaugucuaaacaugggagacuuuugucuaaaauaauguuagcauuauaguucugaagcccuaaacugguacaaccucaauggugaaguuaauaggccaggggccggagacggcucaacaguuaagagcauuugcugcucuugcagaggaaccagguucaguucccaacucuccucucagcucacaaccaccauccaguuccaggggauccaaugcccuuuucuggcuuccaaaaguaccaggcacaagugguauauauaacauacaugcacacaaaacacucacacacaaaauaaaaauaauuuauuuuaaaaaguuaaugugacaguuaauuguguuaacuuaaguagccucuuuauucagucugcuuuaaucgcuuaguaaaugcccacucgguaauauauagcccuggcugacacugaacucagagauucucgugccuuugucucacaaguacugagauuaaaggugugcaucacaaauggcaucaaccucuaucuauaaaauguucauccaacauuguauuuucaaacgcccaccacguuccucacuucagauguaugucuuauccugccauaacagaagcaccucuccuccacugacuacuggacucaauucucugaacucgugugugugugugugugugugugugugcgugcgugugugcacacgcgcgcacgcgagcgcaugugcgaacaacaagugcauuucccuggcuuacagaugagagaggaguucggugaugcagggcuguaaauugauacuuaggaggcacagguagaaggaucgggaguccaaggcucaccuugguuuaaugccuugaacaccaugcuaaugcugucuuuaacacugauaauagugggugcguauuggcacauaccuuuaguuucagcucucagaagcagagucaggcagaacucuagagaguuugaggccagccagggcuguuacacaaagaaaccuugucucaagagggaaaaaauguugaugaaauggaaaucaaaugcaaauuaauuuguaguuaaaaugaaagagcucuacauccaaauggugaaaacaacacaaccuuagacggaauacagucuggacaaggcaaacuauagcagacacuuagucaaaacuacuguuauuccaagcaaaaucaaguacaaagggggaaagggauuacagaacugugccccagcucaggccgacaguguuccaggucagcaggauacacaagucaaaaggaaggcuuacugcccaccaagggacugguggccugcagaggcccuuugccaaaguucacuguggcaugcuggucuugcucuugaccaauggacauuauccuacaaguuaggacaaugaugcagaauccuaaguuuuagguuuaagaaaaacgaaacaaaauaacuaauauaaauaagaaggcuaagauuuauaaacaugcugagugguguaggccagccuggucuacagaaugaguucuagaacagccagggccaaacagagaaacccugucucaaaaaaauaaaaaaauguauaaacauaaaaaaaaaauuauaagcacgcacaugccagcacucagaagcugaggcaggcugcuugcuggauuggaggacaaccucguauacauaaagaaacccugucucaaaaaaaaaaaaaaaguaaaaaaagaaaugcacacacacacacacacacacacacaagucuuuaaucccagcacucaggaagcagguguauagcugugaguucaaggucagccuggucuauauaaugaguucgaggauagccagggacccugucuccaaaaguuaaaauuaaaaaaaaauuaaaaagauguguguguguguguuguguguguaaauccugcccuguuuaaaugcagacuaagaguagccccuagcucucagcauucaggaugcagagcacuauuucuugagauccgaucugguaccugcaaaguaaccaaaagacaaaaggauccuguaguuuugagcagaaaagccgaggcuccgacuucagcacaacgagacucacuuguugccagacuuaacugcgauuaucaccgugagcacuuuagcucaccuuagggcucuuuaucuccuccagcucgacagcacacagaaacccaaagcacucucacagagcagcucuggcuggccugcaacucacucuaccugccagggcggcucaaacuguggaggacuugcagggccacacacagucugucuccagcaccuaugaucuucacuggauucccugagcagucugacuccagcucuccccacacacaggccagucuguccacaucccaccaccacaccuuucucauuccagguucucugcaaguucuggaaaggcacguuccuccucucacuucaaggccuugacaaacucuguucccucaaccuggaauguccuuuucacuccugccugcucacccccuuuucacaccaaccucuucucagucauauccucaacaaagccuucuuugaaucuuccacaaaagucauauuccugggaaacaucucuguacugcuccauuacuccuucggaguagauuuuacacacacacacacacacacacauuuauguauauguguguauauauauguauauauguagauguauauauauauguguguguguguguauacauauauauauagagagagagagagagagagagagggagagagagagagagacaaguggucucacuauuuauuuagcuuugguuggcucugccuccuaagugcuaggacuaaagguuagugcucuaucacacgccaaaugcacgacuauuaaaaccuaucuccucugaaucugucuggaagcucugacagcagagucccugucugcuuccuaaaccuuagcacucccauaguaucagccauagagcaugcaguauaugaacaaguaucaccagacuucaaaacuauuucccacuuuuccacaaugcagccuacuacaaaagccuggccuuuggcaccccuaaaucaugucuucuucucucaucaggcccucaaauaacgaggcuuucacugaguaaaaaguucuccucuguugccuccaaucccaccgacuugccaagacccaaacucaaguuuucuuuccuccaggauacuuuucuccuccuucuguuuuuaccaguucuauacaaccucaucuuuccccugugacuuaucuucccaccaucaaugugaacuuuuagggcugggcuauucacacccgaccauuucauucccggggcaccacuaaguacagaguagacaauuuucccccugauaacauuuuuccucugaaaagaacacaagcuucccucuuaugccucauaggugauucaaucugccuuauaagagacucuguccaccaguuccuuuucggggauguuguuuaaccucccccaaccccaaucuagugaaauguuuuuaagcugccuguauuccuguuucauccacugccuacaaugacccccguguccucugugaccgcccccugccugcagugggcaccccuuccgcccugaaaacuguaaucccuucuauucacauacaggcguaaacacccaguggagacugcacacacacgccggugaacccugagccucaccugaggcauucugucacuguccaccuucucacaagugaccaggacucgcugggauucccacccaagaaggacccgaauguacaacacuucucccuucugccacugaguuccccgucugggccccuucccccuccuucuucuuccaaagacaccaacccuaggcccugagaugcggagagcccgcacccaggccgguugcagguccgacgccacagucuaggcccccgcgccgcccccauccuuccccggcggccacugcagcgucagcuccccgcagggcuaucgcucacugacccgaggugucucaggaggcggcggcggcgacaggugcggaggcaggaagccugguagacguuaaccgcucagcgcuccaucccucccggaccuaagcuccggccuuucggcuuccucgaccccugcgcccagagcaagucacgugccagccggagcagucagcugaccgcggcgcacgccg

SEQ ID NO: 7736 - RNA, 2297 nt, Mus musculus
aguagccccgcgagucacgcuccaauaugguccgccgagggcgcgcggagcuugcagaccaugucguggcucuucggcaucaaggguccuaagggcgaaggcacagggccuccgcugcccuugccgcccgcucaaccuggggcggagggcggcggugaccgcggugcgggagaccggccaucgcccaaggacaaauggagcaacuucgacccgacgggccuggaacgugcggccaaaguggcgcgcgaguuggagcacucgcgccaugccaaggaggcacggagucuugcacagaugcaggagcagacacugcagcuggaacaacaguccaagcucaaggaguacgaagcugccguagagcagcugaagagugaacagauccgugugcaagccgaggaaagaaggaaaacccugacugaagagacacgacagcaccaggcuagggcccaguaccaggauaagcuagcucgacaacgcuaugaggaccagcugaaacaacagcaacuucugaauggagagaauuuaaggaaacaagaggagucugugcagaaacaggaggccauacggcgagccacuguggagcgcgagauggagcugcggcauaaaaaacgagauguugcggguggaagcugaagccggagcacgggucaaggcugaucaagagaaugcagauaucauccgggaacagauuugacucaaggcugcugagcaccuccagacaaucuuggagucuaucaggacagcuggaaccuuguuuggugaaggauuccgugccuuugugacagacugggacaaagugacagcuacgguggcuggguugacacuauuagcuguuggagucuauucugccaagaaugcuaccucuguugcuggucgguauauugaggcccgauugggaaagccguccuuggugagagagaccucccgaaucucagugcuagaggcauugaggcaucccauccaggucagcaggcgacuggucagcagaccccaggaugcauuggagggcgucauccucaguccuagccuggaggcacggguacgaaauauugccaucgcaacaagaaauaccaagaagaacaaaagccuguauagaaacguccugauguaugggcccccggggacuggcaagacacuauuuuccaagaaacuugcacugcauucaggcauggacuacgccaucaugacaggcggggacguggccccaauggggagggagggugugacugccgugcacgaggucuuugaaugggcaagcaccaaccgacgaggccuccugcucuuuguggaugaagcagaugccuuccucaggaaacgagcgacugaaaagauaagugaagagcucagggcuacucugaaugaauuccuacauaggacaggacaacacaguaguaaguucaugcugguuguggccaguaaccagccugagcaguuugauugggcuaucaaugaccgcguugacgagauggucugcuuugcccugccauagcgggaggagcgagagcaccuggugagaauguauuuugacaaguauguccuuaagccggccacagaaggaaagcaaugcuugaagguggcccaguuugaccacggaaagaaaugcuaggaggucgcccagcugaaggaggggaugucaggccgggagauugcucagcuugcugugguguggcaggccauagcauauucaucugaggacggaguccucacggaggcuaugauggaugcccgugugcaggaugcugugcagcagcaccagcagaagaugcaguggcuuaaaguagugagacccgauucccagaccaacaagccgccacauccuucacuccucagcuguugagcuggaccuggacaccuuguacaccugacuggggacagccagucucuaugaccacacuuacugcucccuccuuuccugucuucuuugaccucuguaagaggucaacauugcuccaaaugccucugcguaguugugggauacuggaggugucagcuucucugccucccacaccuccuugucucugacucugagugcuggcagagggaggcauacugccuuccuuuaccucaguacacuggugagacgucuaaaaccccagagcagagcagagagugugcagagugccguaccacaagccaggggcuaugccagcaggacuggggccuacagggaucaggcuaaaggcacagggggcccucagcuuccuggacauuacuccuaccauauacacaucugugccaagaauuggcccaguccuuacuugguaaaguggaucuggugcuagacagcacuuggccca

SEQ ID NO: 7737 - RNA, 2297 nt, Mus musculus
ugggccaagugcugucuagcaccagauccacuuuaccaaguaaggacugggccaauucuuggcacagauguguauaugguaggaguaauguccaggaagcugagggcccccugugccuuuagccugaucccuguaggccccaguccugcuggcauagccccuggcuugugguacggcacucugcacacucucugcucugcucugggguuuuagacgucucaccaguguacugagguaaaggaaggcaguaugccucccucugccagcacucagagucagagacaaggaggugugggaggcagagaagcugacaccuccaguaucccacaacuacgcagaggcauuuggagcaauguugaccucuuacagaggucaaagaagacaggaaaggagggagcaguaaguguggucauagagacuggcuguccccagucagguguacaagguguccagguccagcucaacagcugaggagugaaggauguggcggcuuguuggucugggaaucgggucucacuacuuuaagccacugcaucuucugcuggugcugcugcacagcauccugcacacgggcauccaucauagccuccgugaggacuccguccucagaugaauaugcuauggccugccacaccacagcaagcugagcaaucucccggccugacauccccuccuucagcugggcgaccuccuagcauuucuuuccguggucaaacugggccaccuucaagcauugcuuuccuucuguggccggcuuaaggacauacuugucaaaauacauucucaccaggugcucucgcuccucccgcuauggcagggcaaagcagaccaucucgucaacgcggucauugauagcccaaucaaacugcucaggcugguuacuggccacaaccagcaugaacuuacuacuguguuguccuguccuauguaggaauucauucagaguagcccugagcucuucacuuaucuuuucagucgcucguuuccugaggaaggcaucugcuucauccacaaagagcaggaggccucgucgguuggugcuugcccauucaaagaccucgugcacggcagucacacccucccuccccauuggggccacguccccgccugucaugauggcguaguccaugccugaaugcagugcaaguuucuuggaaaauagugucuugccaguccccgggggcccauacaucaggacguuucuauacaggcuuuuguucuucuugguauuucuuguugcgauggcaauauuucguacccgugccuccaggcuaggacugaggaugacgcccuccaaugcauccuggggucugcugaccagucgccugcugaccuggaugggaugccucaaugccucuagcacugagauucgggaggucucucucaccaaggacggcuuucccaaucgggccucaauauaccgaccagcaacagagguagcauucuuggcagaauagacuccaacagcuaauagugucaacccagccaccguagcugucacuuugucccagucugucacaaaggcacggaauccuucaccaaacaagguuccagcuguccugauagacuccaagauugucuggaggugcucagcagccuugagucaaaucuguucccggaugauaucugcauucucuugaucagccuugacccgugcuccggcuucagcuuccacccgcaacaucucguuuuuuaugccgcagcuccaucucgcgcuccacaguggcucgccguauggccuccuguuucugcacagacuccucuuguuuccuuaaauucucuccauucagaaguugcuguuguuucagcugguccucauagcguugucgagcuagcuuauccugguacugggcccuagccuggugcugucgugucucuucagucaggguuuuccuucuuuccucggcuugcacacggaucuguucacucuucagcugcucuacggcagcuucguacuccuugagcuuggacuguuguuccagcugcagugucugcuccugcaucugugcaagacuccgugccuccuuggcauggcgcgagugcuccaacucgcgcgccacuuuggccgcacguuccaggcccgucgggucgaaguugcuccauuuguccuugggcgauggccggucucccgcaccgcggucaccgccgcccuccgccccagguugagcgggcggcaagggcagcggaggcccugugccuucgcccuuaggacccuugaugccgaagagccacgacauggucugcaagcuccgcgcgcccucggcggaccauauuggagcgugacucgcggggcuacu

SEQ ID NO: 7738 - RNA, 32161 nt, Mus musculus
cgcuaacucugaucucagcuaccacucacuacagagcagauccccgcggcuaaggcuccucgcuuccagaacggaaagugugcucugcagggcacuuccccaacggccugggucucacgccuggguccgcggugcgagcggaggcgacagcucggcggcccccgcaccgcggccggcugggcugggcggggcgcagggccggucccgccgccgcgagccccaaccugcccgcccgaccuggcggcgcagucucgcgggaucgcccagcucucgcuccccguugcggccccggaggcggucgaggcccggacgcugccccccaccgaaagcucgccccggcugucugggguggcggggccgcgcgacgccgagggacagccaccuuccucugccgcccgaggugaggcguccccggcccgacggggcgggcgggcagcggccgggaucggagccgcaggugcgucgccucggagucccacgcaacuccuggaaagugacucuggguccccgcaggccggggacggagcugcucggcugcaggccgggaacaggugcccgacgcgggaccccgggggcucaggggagccucccgcaguccccaugagcugaccguggaagguuugcgcuggguggaauucgggguacagggggcacggggugagcgcguugaaggggaaagugcuggaggugaagaagcgcaaaggagucaccacccaggcccacucuuccuagggggaccucgcucaaccccagcagacugauuuucgccuuugcgaaaacaggaaaggcacauccgcagaagucugcgauuguagagagagcuaaaguugaagaacucugucugggucacuuguccucauuuuccccauauagugagauggccaaggggccccuagacccccuuucuucuaaccaccaucaccccuuuccucgcuccaacuugcuuaugccgugccuccucuuacccgguguuuuagacaguauaacccuucaucagcaguucccuagaauugaggcuuccuuagcaaagugauacauccgcgcccgggcagguggauaugucucuugcuaggauggaauuuuccacauuuuuuucuuucuuuguagcauuaguuaccuagcaugacauuugacuuggauuugacuuugugacgaauguuacugauaacacacuuuggguuuguuuuuacagcaguugccccagaauucauuuucaggaaacagcuucuaucaaaaugguacaaagaaugcaaugaggaauuuguacauuuuaucucugauuugagaaucuuuuugaugcggaaaggagcauaagaauaauccaagccaugugguaaaaucggagucuggcaagauggaaagguccccguuucuguuggcgugcauucuucugccccucguaagaggacacagccuuuucaccugugagccaaucaccguucccagauguaugaaaaugacuuacaacaugacguucuucccuaaccugaugggucauuaugaccaggggaucgcugcuguggaaaugggggugaguggauuuucaugccuauauugaaaauuaguuuauacguaguauuuuucucuuaacuauuacuuuuuaaucuuuaaacauaguuuuuuucccaaucauauuuuuuaaaguaguuuugaacauuaaguuccccuccucccgcugucauauuuugucuacaguuggacgguuaguuaauuugcuuauaaaaagguugcauucauaaugaagggugcuuacagauaauaaaaauauuuugcuuuuuugaauuugugucauugcuucuccaagacugugauuucugaauuuuuaaauuuuuaauauuuauuuguuuguuugauuuuucaagauaaggguucuucucuguguaguccuggcuguccuggaacucacucucuagaccaggcuggccucaaaacucagagauccaccggccucugcugggaugugugcgcuaccacgcucggccccaaauucugaauuuuuuuaaugguugacugaacauauaaucuauauugcuugagcuaaaaugaaacuuaaauguuuuuuaaaaguacuugucaaauucauuugacuuaguuuucccaaagcuaauaaauuauuggaauguuuuggcgcuaaagagaauguuuuacuaaaaggugacuuucaggcauagcauguaaguguuuucuuuauauaagauacuugcuaaaagaaaguccacuuguagggcgaagggcagugugacacuaacaaucgccucaggcgccucaguuaccugacucugguuuagagauaugaaaaugucccaggaggugugggaagaaagagcugccuguagagacaggaaccugccacacagaucugcuggguugauaaguuucaugaagaaaaaaaagacaaggguauagguuuuguaaucuuucccuaaaaaagcugaagccaguaaagguuuuuuccucagguugucucugagagacgaaacuccuagaaauauaaucuagagagggguuuuaaacuuaacuguauuugaucuugcagcuuugaaggucuuccuuugucugcuggaauaguuaguugucugacuaccucuuuguagacagacuccugucuggguugggugguuuuuaaauacuaagauauaauuuuaaaagauguacaaguuauaguguuuuaaucuuugaguaguuuuucccaacuagugcaaaaccccccucuuuuuuaccagauggguggggcacugaggacugagcacugagccucucaaauacugcaaggucucgcccacucagcuacauccucagcccugcaaggcguucuguugaacacucuacaaagaauacagggagacuuccauugauaaaucagacccauaaguguauaguggauaucaucacgcaauaauuacauuguucagucuggccgccucugaugauaauguuuuuuaauacaugcuuuaguaaggguucagaaagcauuuuauuuuaaucugguuuccucucuuuauaguagcuacauacauuuuagguuugaaugcugacagugaccuuagaaaucccuaacauuuacacuuaguguccuuaacagcuguggagcagauggcacaucagcuguuuuaaagggcucugaaggaaguaauaacuaguuuguguuucaugcauuauuuuuuuuaagaacggguguuucuguuguacuuuuuaaaagcuuuuugcuguuguuguuguuuguuuguuuguuuuaacuuaccuaguuagcuucccagguaguuucaugucugacaccaucaggaagguuuuugguucugagugcggacagcaccagucucuuccugguauauggucuucacacaccaagcuuuggggcuguccagguuuucuguuacauuuccaguaaauuaguuugaagauagaggcugaagaaucacaugacgguuuuggcagccacuuguuccuuccuucuuuucuugucuuuuuucaaagaguuuugguuuugagacagggucuuccuuaguugcccagucugguuuugaacagucucguagcccagguaggccgugaacuucaaaucccccuuucauuuccuucccaguggcagggucuuugccacuagggcaggcuugcuuuuuuuuuuuuuuuuaauuaacagggucuucuuguguuucccagaacuucuguggccuggaacuugccauauagccugggcugguuuugauuucaugaucccccugccucuacacucugagauuauaggcacucaucacccugccuaccgcaaauguacuuuuucagcuaucaagaauuccauguaagucaagagauuuaucuuauuucucuucuaauauuuaauuuaucguuguaugugugcauaugcaugguuugugugugugugugcacagaugugcugugcacagugccaguguggaggucagaaaaccaugugugggccuuggcuuucuccucccaccgugaguccugaggauguaacucagguugucaggcaaaugacuucacccucugagccgucucacccaguccuccucucacucuuucugugccuaggcuuuuguuuugugcuagcuagcacuuuuauugcuacguugcuaaucuaugauuagauuagauaggacaauggcucucaaaguuuaguuccugggcagcagcuucagagcccauuagagacugugauuccugagaacaaugcacagcugcaguaacaaacuguccccguagaugugauuguuaaaguggaagacccacuaagugaaccuuuucugugaagggccacuuacuuucaguuuuauagaccaugcagucucugacacagcuauucaccuuugcaguuguggcaggaaagcugucauagacaguaugagugaauuaauauggcuguguuuuaguaaaacuuuaaugcauuugcaaaaaugggcuguggcaggcuugugagcuguacuucacuaaacguuuaaguacuugaaaguguuuuacauggaauaaauaagcauuauugcgcaugcuuaggaguauguuacccaggaucuaucuuacuuuccauaugaauuauuuuauuauuuauuuauuuguguuguguagggggauacagaggccagacagaggaguauguuggcugucuuucucuauugcuuucuaccuuacugucuugagacaggguuucucaucgagcuggaucuuacucaagcuaggcugucuagguagcaagcccuugggaucugccugucugcuccuguugcugggauuacagggacacacagccacacucagcuuuuuauguaggugcuggggauuugaacucagauuuccaugcuugcaacucuugcugcuuauggugguuugaaagagaagggccccauaggcuaaugugugugaauacuugguccccaguugguaaaacuauuugggaaggauugugggugaguuuugaaguuuaaaaaaacuggcacauuuuuuccucuuugucucugucucucucucacuuucucuugcucucucucccucccucucucucucugccaccuacuuguggaucaguaugugagcucucagcuacugcuccagcaucuugccugccugccaccgugcucccuuccauaauggucauggacucuaacucucugaaacauaagccccaaauaaauucuuucuucuguuaaguuuccuuggucaugguguuuuaucacagcaauaaaaagaucuuauuauaugucugugucuggcuuagaacuugcuauguagacuaagcuagccuucaacucauaaagacccacccaccucugucucuggagugccgggauuaaagguauggaccaccacacccuacuccauauaaauguuuaaagucaaaguuaucacgagucaaaaggaucugacaagaauaucgugguucuucaauuuugcuucagaaauuacgugaaauaagaaauuuuaguccccaccccccauuuuguaacucccuucaugaggacaucuguauuacaaagaguuaaguucugacucugaauggaacuuggccuuaugaaaaggauauugcccaguuaaccugucccuggugagaaagcaaauggcagcuggcuguccacucuguguccuuuguuuucugucgagagcuucaucucagagcuuaggagguugacauccugugagaggcugacuucauaccgucgaacugagguugauccagggaaaauggaaacaggaauauuguauuauucuuuguugagguccagagucauguauuguguuuggaccagcaggugcccguguaucuuuaaacaguugaaaggaaguaagccauaaaaccuuuuccuuucccauguucacauguacuauuaaagugucaauauucaauuuaaaauaaaagggacagacagggagugggucuaugaaugucuaagagaaacaggcuucuguuguaaagugacuuuuuuagacauuugcagguuugugccuuuagaagaauccagaggacucuguccggcugucauuuaccaccucucguucugugcuuacacccagggcucuaaaagagaguagauguuuagcuugauucagcuauuuuguuuuuuaggguuuacuguguaaaauggcuguagcuaucucacaaguaauauaggagucacagaggugaaauaaaugcuucaaaguguccucagucagaaguguaccauggaggugcucuaacgcucccaggaucguaggaucagaggugaggaggacacaacaucugcuccaucaccugaaguaacugggaccagcgagacccagguacccaggaacuucacccaaccaauggcacaggcuccuucuggucuggucugguucccugagcagaccuugggugcaaacucugcaccuagucccacaacacccagaauaagcuccacuccuaggcgcucuaacacucccaggaccccaggaucccaggagcuuggucacacuaggaucucagcaucccggaggcagcuugacucccaggaacucugacacacccaagaucucaggaccccaggaucccagagacagcugaauucugaggaguucugacacaaccaagaucacaggaaggacaggcuccagucagauagagugagggcagguagcacuagagacaaccagauggcaggaggcaacaaaaaccaagguuacuuggcguccucagaacccaauucuuccaccauagcaaguccuggauaccccaccacaccagaaaagcgagauucggaucuaaaaucacuucucacgaugaugauagaggacuuuaaggagaacauaaauaauucccuuaaagaaauacaggagaacacagguaaacagcuagaagcccuuaaagaggaaacaaaaaucccuuaaagaaucacaggaaaauacaaucaaacaggugaaggaaaugagcagaaguguaucguggcugcuacagcucaucuuccuucaggauggcaugcuguagaugcagggaaaguaccgcgggucugcagcauaugggagaccugcaugugaacagaaagggcucagagcuccucucuuguuucuugguaucccgcggucugggaugcuguuggucacacccuccgaggagcccguccacgaggggcugugaggagaucguggucauuguuuuuucuccuggagaauggagagugcagguagugguaaguuuuacuucuccuuuuguguauuuguauuguggccauuaauauucauugaccugaauguuuucucagaauuauagcuuuccauguugggcaguugccauauaaaauaugggauacuaccauaucaaccaguaguauguauguuuuuuucaauuuuccaaaggaaauaaaugaaauguuauaaugcucccugccaaaaaauauuuucaaauaacaagccucacauauagaaauagugugcacuuuuaauuuuauuguuucaaguuucauuuuucauuuuuuuuaaaagcugacuagcugagauuauaaaaguaagcaaaaguguuuguagcgcaguaauaccguaguugauugauuuucucaaagcagcgguucucagccuguagguugugaccucuuugcggggguuguggggggaagggucaaaagacuuuccuaaggguugcaugaaaccaucagaaaacacagauauuauauuaugauucauacauaguaguaucaaaauuauaguuaugaaauagugauaaaaauaauuuuaugguuggggguauccccacaacacgaggaacauauauugaaggguugaaacauuaggaagguuaagagccucugucuuaaacaggaguagggugcggugcguauguucuaaacagaaaaugagaaucuguaguggcuugccaaguaccagcaggguucugguccaugcuucaacagcaggauaacuguuguucagcacuaauggagacaagacccauccaaaacacugcuagggaccccuccccacccccgcuuaggcuaacccuuuauguuuuucucaaagggaaaaaaaucaaacaccuuucuucuuuuuuaaagauuuauuauuuuuaaguuuuauuuaauuauuuugcuguguggauguuuugucugcauaugugucugugcgccacaugagugccugauacucuugaaucuugggauuuacagacaguuauaagcugacauguggcugcugggaauuaaacuugaguccucuagaagugcucuacacugcugagccaucucuccugcccugucaaacaccccuuucucucaguaccucaguuaaaaccauaguccacacuucucaguaccucaguacucuguuaccacugaccccaggcccacacucugguuuccccuguuaucacugugaugugggaacuacagguccuuuuucuguaucuuucacugaggcgaacugguauccauccauucaacaaaauauucgagugcauacaucaguaaaugccagagacacuguucaauuauuaggcauacaauaaugaaucaauagaccugauuucaucagagaauuauaaaacaaucuguuucuuauuuuucauuauaauuuucagcaaagguuuauauucuuagauugccuuuugcccacagcugcuuguuaaacaaaaccaagcacacauuuagauccacuuuaauauuauucuugcuuugaucauugcuucauuucuuuuauaugcuuuuugauuauuuguucucuguaagaggugccuccuuggguuuuuauuuucuuccuaaggugggguaccuggacuacuuagacagaaagggaacaacuauuauagcaguuggcaacuuacaaacuuaggaggcagaggagaauucugcccaggcuccaaggagacaaggcccacccaagacccugacggaggaggagucugcuugggagaaccacacacagguuuucacggaggacagagccugaccagaagcgaucugugcucugaaccugaccguccacguggauguuguggcacaguaagggcuuaagaggguuugcugucccuauuuuggcaucuugaccacuuggcaauagccucaaagggaagucauacuacugaauuuaggugucccuucugucaccgugaccccuuuguuacagagccuaacaaucaaaucuugaaauaaccaggaaaaaauccugauugacaaccacaaaguagauauuuagucuacauaguuaagagcuuccucugcauugaaaucuuuugacuugcauucacacgcagcaaaaacauuggauauuauaggcucauuuuggaaaaaaaaaguuagcauguacugcuuauaucacauacugguuaugccauuaaccauaccuaucagcgcgacucuaccucacugucuuucugcugauagaauggauaagacauaaaaguuaaaguucugcuuccuagggcuaucugaauaaagcuaacaacauguaguaguuugcucuuggcuggaccagcuuguauaaaccuccuuguuauugauccucuugccauuuggucaaagggaagccuccacggagccuucugcacugcugccggugcguuuuguggugcuggugccugaaugcagggcuugcgagggccaggcaagcuucccaagguugagcuccaccaaugacucuaggaaaaaagccguaacaugcagaaguagacacucugggaacgugcacaguaugcuugugcuucugccccacaucuuuaaaauagaaagaugggaagcugugaggaccccgacaucaugagcagguggcucugagcuccuaguugaggagaggugaugaagguuggcggucuagauguuacuuagauucucuagauaucccauuguuucguucaggauccaguaacaacaaaacuaaggugaacauucccuucaacugaagcccguuuauuaauucuuggucuuaccauggacugggaguauaggucuauggccuuaucaguuuuacauccucagaaucauggacugcucugacaucugugauguggugaugugguucagggucucuggcagggaacuugagaugcaaagcugaagagcugacuucucaucugaagagguuaccaaguagaucucuggcuccaaccagaugugugauaggauggagaaucuucuaagaagcccauggcaguugcuggugcuguugaucuagagacuacucuuugggaauuccuuucuaugacaaguuagcccagguguaccacuggcccuucugugugcuagcuagaaaccuggcaggcuagaguggcaugugagcuaguuugcugcaguaaaaaaacuacaccugaaaggaaccuucgccaugcagcuagaguugcuuaagacaccuagacuguuaacacgggcaaggagcagugauuacuaguuuugguguugcuagucuccgaaagcccuauugaucuacauuauugacuuguuuuaaguuuucuaucaugcuagagaaaagaccuuuugcugaagagcuagcuggcucagcuguuaggagcacuaacuguucuuccagagguccugaguucaauuuccagcaauacaugguagcucacaaccaucuguaaugggauuugauugccucuucuggugugcaugagaaauaaucuuaauaguuuguauuugaguuuucuucccaugauaauguuuguagaaaaccaguaugguuugacauccauauguuugcuuaauauggcuauuuaagacauccaugaagagauuugguagaugacagugggcuggauuugaaggucccuugucaaaagcgcauuuacugucugaucuccagaaacgcuguuucugcagcucacauccagucuagaaucucugagaaacaagcccagaucaauguauaaaauuguguuccuucuuuuuuuuuccucuuucucuggccccuuagaaguaaaucucaacagugucuugcaacuaauuuuagcuuuuuguuuucagauuuuauuuugauuugacccucauaccaggucauaccagaguggaccucuugguugaagcauugcagagugaugaggacugaagggaaagcuauuuacuuucuucuuacaaagccagccuuuccaaggagcuuuccuccagggcugugggcuuagagccucacuccaaaccccuggguuccuuugcuucccucccacggucacggaugauuuguguaagagagaaacaggucacaccgauaggacuugacaaccugccggaacaacucugcauuugguuuucacuugcuuacacucucaguccuuuguaaagcuuguguuuuacucauaugaaccauucuauucucugacuaaacaguuccuuagagcccucacuucgcacuaccauccuuguguaccaaggagccgagaggcuggaaggcuaauucaguuuguccuuuauccaucaaaugguaccgcauuucaucucuaaaugagaauaggaugcuuacugcuuuggccuccaguuaggccuggaacucaauuuuagauuuuuuccccauguacugagaucacuuacaauccauucuuuauggaauuugcauacuagucagucuuuuuggcuuauuuaagcuaaaaagaaaggaagaaaaacaaaacaaaacaacaacaacaacaaaaaccagauggagcuugaacagcuaguagauccaugacaaggcuggggaaucaaauucagacuaucuggaggagcaaaggagccagaacacggauaagauugugccagaggacguuugucacccacaccaggccuuuggcacuggacccucuuuauggcaccgcagaggugguugguccccuguaacugucucaccuaaucuguguguaucucucuuuugcucucuuucuuucuaaaaaccauguaccuaaggcguucaaauggucaggccugagucugcugccagaaugcucccugcaccuccuuuggcuccccagcgucuccucuggcaaaacugcugaacagacagacagugaagguucaggcgagggcucagugugagacaguugcgagacaguugcuaccaagauuguuuuguuauuuugcaguuuaacucugcugccugccucucugcuauguucuucauaaacuugagcuaucaugaauguccuuauagaucaucuaggcaucuugaguuuaacucugaagauaccccgagauccagagacagaaagucaccuauggaaggugacacaggugguuaacgaguauuuaggauucaguuagaauuaacguacuggcagcacauuggcuaagaguguguaaagcagcccuguguucuguguucuuggccucauuagccaucuuuccuaguuucacugcuuucauuuuuguucaucagaacagaauagagguguaaaucccucauccagguuucugccaguccuaacaguggcagcucugucuaggguggcugaggagggcugacccuugaaggaaccuacuuuucauuucucugaggacuaacacagcaguuagcaggguuguuuuagucgucauuaaacgccagacccucaaaaguguuguugauccuucucuguuacugugugaguuucucugagaauucaauagaaaaaugaaaggugugugagugcauccugaagccgggccugcggagggagcagacucauuucacugagcaggagaaacaaaaagacuagagcgaggaguguauuuccucugcucagagguuuacaugguguguucuaugaaaauacucaguuguagcguggacuucagaguaucaaacugaagaaauaccacaggucagguuuguagucuuugccucuaaagguuugguuuccagauguggaauuugaacauucugugggaagauuccuaacaagauuguacucaaaagguugggacaacauugacauccuguuggugcugucaugugacugcuacguuuuuucaacaguggcugccccauggccugaagucguucuuguuucugaaguauuuguucccagguugucugugcuucugcacacuguuagaauaguaaacacagcugaggcuuugauguaugaccugugaauuucuguuguuuacaacuugaagagcaauuucauguaguucccaauccucuucugagaugucccuccuccauccuuguuggaugcggcuuuuuugcuugucuucugguuugagggauugguuguuugagggaguuauuuucagcaagaacuggguaaggagucaagaggauagaccgaggucacauggacuagagucuccuuaugucucugucacuauacaaggaaacuuaaccucuuagagcuugaccccuuaucugcaagauuguuucacaggguuauuguaucugaaaagcuuguuauaaguauugauaauaggauacaguuuauaauauuauaauaaguauuaauaguauuauaagauuuauaauucacagcucagguauuguaacaauaguaaugagucuggaauaaaaacauuuagauucuaauuaagcauagauuuagaacuuccaaaauaauuuucaguaagaaauugacacauuuuucuccuagugaucugaagguugccccggcuggguuguugugggucugugcuaucgagguacugugaggucacuguagugaaggaagccaggaagagcggcucagcagggaggguuccuucugggccagagcagcugugccuuuguuugcuuacuagaucaggguucuuuguaacuucccacuuaacugucucuuggcuagaugagguauacggagaugcuuugagaauaaccaacugaaagguccuucugggcuccgagacuaaguccuuugucuguuagucugaagcaguugaaacuugguggcucuguuggaucugacccaaagacaugauuucuuuaucaugcacaguauuguaaauguauacauuaaaguggugagauucaaguuuugggggcuuucucacuuaaaaguuaagguucucuuuucuuguguaugcaaaauggauaugucugacaauucuguucucacaccuccgagcacaggucagccagguuggaauauucagggccugcuguggugggguugcugggcucuguagagacaguguucugggcauuccuguguuuuuuacacuggcaucuagacaccagguauugggaagacuguaaauucuaggugcugauaucuugucuuuguuggcuagguguuuuguuucuugguuucuguuuccucucugugguggccauguguugccugguaggaaauucuucaggaguguggccccuguaggcuccagggaaacgugucuggcuauuaggagcugagguuuaggaugggggggggggaggaaaguagggguuacacccagaucugcuaagucaguccucuggauaugggggcagagugaggagaggccacagcagaugcuugcuaaggagcugggggugagacugggagacuggacuuugaggaauggaaggagaggugaagaucgcaguuagcucccuugcuucuuuggcaggaguggccuguggguucucaggcaaugccugcuggauuuguggcauagggugggacaaagcaaggaguugugggggagaauagugcaggggacgcugcuacccucucugugauccacuggagaugcacaggagggaggggaggcugcagcagucugcugcagaccuggggcugagacugaggggcugccuuggaggagcagagggagaggugaagaucuguaguuagcccaucuucgucccugcccaguguggccuguggguucccagggagugcccgcuggaguugggggcugggaagucaggaggggaagaucuguuugauacacuggagguaggggcagagagaaguuggggcagggagaaagggcggcugcaguguugcuguguugcugagcugcggaugagacugggggguuugauuuggaggaacagaaggugaaguggaggucuguaguuagucuaccuguuucccuagccagaguggcuaucagacacccagaaauguuauucuagaauuaggcuuguugaggacagcauuaacaauggcguaaguguaccagcuguucacgccuccuugccuugccucagccucagaagaggauucucacguggccuggcauuuuccaugccuggugaaaggcugaccauuaagugcuccuuuuaauggcaaaggcucagggguuuacagaauaccagcugugggcuggagagauggcuaggucauucuuaaaugcuuggcccacaaccagaaugucagaauaccaacugugguggcccuguuuuugugcagucacuuugccucauuaggucaggugaacuuuccguggguccaacauucucuaaagcuauuguugggugauuguuggguguggguucugcaaguuuugagaugagaucucucuguggaguguaacuuggcccucugucugugccucauugugaccauggaaucauccaucucuccuuuuuuuccugguuuuuuuuuuuaaugcucuuuauauuuuaagaaaauuuuauuagguauaaguugaauugagcguaguuuaaaguguauuuguugcagguuauucaaaaucuaaaugguuuaugaccuauuuuaguuggucauacugaagaaaacacaaacccuauuucuuuuuaucuuccagaagcuucucaaaucuuauaauccaccagcaagcuuuuccuagguuucuuugcauguuugguaauauggcuaugacuuuaggcaguuuuuguuuuuuuuaaugugucgaugacaacaucuucuuuucuguggggaaauuaugcuaauacguagguucaguacauuccucucaaaucagaaguucaguccuuucauacuucaccuucucuaugugugaugucagcuuuaugcugaugaucuuaagaguguggauucuuaaagcuauaucuuauuguuuauucauguauguacaugugucuauguacauagacacacauaguucugugugugugugugugucucugugcuuugagggugugugugugugugugugugucugugucuguguuuugagugugugugugugugucugugucuguguuuugagggugugugugugugucugugugucugugucugugucugugucugugucugugucugugucuguguuuugagggugugugucuucaggggcaugaaaaggaauuggauuaucuggagccaaauuacagacaguuguaagcuguccaguuuggaugcuaagaucugaacucagguucucuggaagaauggcagaugcucuuaccugcugagccgucuuuccugccacaaaucuauauccuuuaagcaucuuaucuacaucacucuuuuaacugccugcuaguaguuauucuauauucaaauaucccauguccccuucagacugucucauuaacagccggaugaaugaguuaacgaaugaugaugugguagcacagugugauagauacuacucaguaguuagagggaguggacaacaugggcgcaucucagugaccugggcuggagagcuagcucagcauaagaaagaacauccuugaguccugcauccuagaguccugcauccucuaguccugcauccuagaguccugcauucuagaguccuguauccuagaguccugcauccuagaguccugcauccuagaguccugcauccuagaguccugcauccucuaguccugcauccuagaguccuguauccuagaguccugcauccucgaguccugcauccuagaguccugcauccuugaguuaugcauccuucuuuguuguuuuccuuuuucauauuuucaucaauguuuuuauuagguaugcuacauacucuacuuucccccucucuuauugaaaguagauuuuuuucuaucacaucauauaucuugacuaugaucuccucucucuacugcucccagcuccuccccccucccauccagauccacucccuuucugucucaauagaaaacaaauagaauauaacauauuauaacauaagaauauaauuuaaugugauaaaaaucaaaacuaacacuuccgaguagaacaaaacaagcagaaggaaaagaguccaagagaagaugcagaaacagugacccacuugucugcacacucaggaaccccaucaaaacaguaaacgggaagcccuaauguauauauaagggaccuguaggguaaaauuagagaagaaaaauauguaaguaaaauaaaaugaaaagaaaaacaggaaagaggaaaggccagccugagaguguagcacaaggagccuccacagacaccguugcgcucuguuuccauggcaugcaccacugggcacacagcccaccacuaagagugguuucuuuucccuagugagacucccuuggaggaaacuacauucuuuugcagaugcuuaucaauuggagacagcuucuggguuaggauggagacauguguccauuucuccauucugcucuaggaugccaucugacacugaccuguguaauccugugcaaguugucccagccucuguucggucacaugugcauagauccuguugauucagggcacuuuguguccuugguguccucugucuccucugaauuacaguccuuccccccccccucugccucugcugagguacccugauuucugauaggagggauuugauggagacauuaggaucagccaauagggcugguuauccaaggucucucacucucugcauauaaugucuggcugugagucucuguauuuguucccacugcugcaggagggaccuucucaguacauauucuacuuuuaauuugagagcuaauuuuuaaaauucuuuccagguccaaaaaucucauuauuuuaccguaaccuaaauaguuggcuagauauagaauucuuuuuuuaaagugacuuuccaucugaguuuuagaauuguuccuucauugccuuccggcaugugacguaugugaaguguucagaauuauuuccuuugcauauucgucccuggaacugcggcugugcucuuucuuucuggucugauuguuuuggcauugucauuguucauucuuuccaucugcaaggcguucauuaucccgugauauuuagcauuuacaagagaugccaugggguagcagacaccacacuaggcccugaggauacagcagcgaacagaauaaucagagguccuucuuccuuuaauuuaauccuagugggaaggguaaacguuaagaaacacaugguaucuaaugaugugguagauauagguagggacaguaaaggguggaacaugacagaauccucucaccgccugcgcaggugaaaggcaagcagaagucauggcuggcagagugaagggugcaaagcccaaggcaggagcagcauggaaagagaagcaaaggagagcggguggcagaagacagacuggagccaguguggggucuggggucuugaagcccgcaggcuugguaaagacuuugacauggucugguggaguccuuggaccuagguuucagauaaucacauugguggaacuauggagugguggauguaaguuuagcaagcgugggaugcagugagacccacaggaggcuuucagugggccaggaaggauacggugccuuugacuggguggcagcaguggcaaauggucaaauucgaaauauaucuugugaagggagaaucgcaagauuuguugauggacuggauauaaugugaaaggaaaggguagagguugggucccaagguccgcggccugagcagcuugagcaccgugagguauggauaaccgugggacuguuuggaguaccagggcugagugugguagacagacggacggagugugagguguuguuggugacaaaugaaguugucaggaagcagauguucacauguggagugcacagagaaauggggcuggugguuuuuccuggagcaguguucuggcgggaguguuucgggaucuaugcucuagggcauuucccuugcuuagaaguaagaagaucagaagagcagcaaugaggugacauccagaagaguuaguguccucuaaaaccaaaggaaaaaucuucagaaacuggaguuguggcgguuggugauguaaauagagcaaauaccggaauuuaccacugggcuucgggugguggcugucacaugcaguggcacccgcuguccuccacucugccagccauuucuucugaccucacugauucugcucuccugucagaauagcugcacaggcauccucuacucccaucuaaaggauucugucauguuccacccuuuacugucccuaccuauaucuacaacgucauuagauaccauguguuucuuaacguuuacccuucccacuaggauuaaauuaaaggaagaaggaccucugacuauucuguucacugcugcauccucagggccuagaguggugucugcuaccccauggcaucucuuauaaauauuaaauauaacugaauaaugaaugucugugcagaugggaugcaugaacaaugacaaagcaugacuucuugaaaaagguacauccuauaacaucauaauuuccaucuuguaugaggagcucauacauaaauuuaacagaaaguguuacuaccucaaaauuuaaacacauugaaagagaauuuaagacucauuucgaagguaggugaaaaaguauucucuuuaagcauuuaugauuaacauuuuccuaacuggaucucucuauuuuuuuaauagcacuuucugcaucuugcaaaucuagaauguucaccaaacauugaaauguuccuuugccaagcuuuuauaccaaccugcacagagcaaauucauguaguucuacccugucggaaauugugugagaaaauaguuucugauugcaaaaaacuaauggacacuuuuggcauccgauggccugaagaacuugaauguaacagguaagugauucuuuccagugagaaugaaaacuacaaauacuaaagacaaauggcacuuuaguauuguuagcgcgucaacuuacgacucacucuguuugacugaugguauuugcuccacccucauagguaggcacggugggggugagcaccguagacuucugguuagccauacgagaacguacuggugccuacacugggauggggaguggucaagaggauugacuguugagcuaaagaauggaagauaaggcugaguuacuuaggugauggagaggggacgaacacugcaggcaacaagaacagcuuguccagauaccuugugauaugagugagcucgaccugugagaaacugagcaagguggggcaugccuacaucucagugcccaggaggcugugcuaggcaggucaagagcucaaggccagucuaggcuguagcgugagaccucgccucaaaaagaaaauagaacaaaacagcaaggcaguguaccuauagcagcacgcguaagaaaagcuguggugcaagcaacggucaggccccucagcuccaucuagcaugacuuccugcucagagcagugagcucacaggugugugagggugggaauggccucuguguagaacagggcacucauacuacugucucaugaggguuguugaaaagcucuucauggcaguuugucucaggacuccaggccaccucauuuucuagcuuugcugaggaggaagugagggaagauacagagcucaccucaacagccucugaguuuguuugucaagaugucaaucauuuggucccaauugaacuaauaaggaaagugggaaaugaauguguguccagaacagagggagggacccaguggugaggaaguguccgacgggccacucucggggagccuucacuuuuacuaaagugguggggcgaaggauaggagacagacaguggaguuugucugugguuggggucguacuggacagguuuaguaaggaauaaaggagcaaggacugacuaagaacuuucaggaucaagggaaaggcaggcagauagaagguagaggagacagucccuagaaguugucugaggagaacacaggaucccgagcgcaggguagcuaguaggguccuccacuguagcgaggauggaggucaggauggcucagaguaggaggaucauguggucaccaaggggccuaaaggaauccuauugggaauagcuggcgucugcacugcauccugcugagucuguacauuugagaagugacagguguguagaguguguagaggcacuaacccuucagguaaugugggugauccugaggguguagugcacacucuggucuguugaaacauguggcaacaguggugggauacuugggccuguauauuugggaaguagauauuuggguuuaucugugguugaaguucagauggauacagugcaaagauaauaugaggggcuggagagauggcuugcaguggacucagguucaauucccagugcccacaugucagcucacaaccacccauuagaccaauuccaggaaaucugaugcuuucuuuuagccugcgaugucaccaggcaugcacaggauacacauacaaacauugagacaaaauacucaugcucauaaaguaaauaauaggaagaagaguaggaugaaagaaaacugagaaggggguugucucagcacuaauuuagucugcgacuguuuuaaauggaugaggacugagguggaaaaauuaaaggauugucauguagaaaugggaugucccagugagguauaaagaagcauugcagaugguuucugauaaacacacuguaaaaucugagcuuacagaccagggacaggauaccugaguugauuccugugucauaacuagagacagccaacguggcuaggggucaugacuggggaagagagcuaagcagccagaguuuacugauauguccacaguaugcucagaucacuaaggguggcagcuugagggaacagggggacauuugaaucuguacccacucacugcguucuuacugugugucuguccugucauacacaccaaagaugccacagaaaagaauucccaucaucaggggucuuacagcuuaguggcaggaaaaugaaaucaguaaauucuagguguucuugacgguaacaucugugggcaagauguuugcucuuggugggauugugucaaagcaggaggggucaugacucccagaaucaugcacuggucccuaagcugacauuucccccuuuuuggaguuauacucuguaaaguuggauuuuguugagaacaaacauuguuuucuuacaccaagucaaauuuguuuuguguugggacuacuugauacauugccauaggaaguggaaucuccauuuuuaaagaaauuauauaaaccccaaaucaaaccauuucucacuucuguaaagcagacgaacacuucuuuuuaaacuccauuuuauuacuacaaauauucuaacuucuuccuagauguaaaaacagucuucacagucugauagcaucuuauuuugcaaauacaaaagcaagagagucucugacuagagcccggguccuggccugcugaaggauuugacagcuacacaggcgcuucuguuugccuuugggacacuggaacaauggcacaccuuaggcucucagaccccaggacggugccucuucccugccaagugccuuugcuuuggaacaagcagaaaagcaacccaguucuuggcggaagcagguuccccagcuugucaaggcccaggcacacauuuuaugccagaacuguacagcaaagucguggcucugggcacucucuugagaguuugucagugccucuucuaacucuguaccuuucuccccauccuuucuugcucaccugccuuucccugcagcacagccuacucaccacagugcaaggguccugggaucuggcuugucuugcucuuucuuucccuuauuuucauagccacccuuuuucugugugccuguccuguuuucaagaagacacacuuuggagcugacacacuuuggagcuggagagauggcucaaugguugugacauguaguacucuugcagaggacugggguuucguucccagcauccacaccggguggcucacaucugccuguaauucacaccaguauuacuguaauauuugggcaggguaaaauugucuuuauuauauauaagaaucucaggaauacacuuuuuucaccucaguuauucugccuggcccuuucuaugacagugaauaaaugugauuaaugugauuaauauuuuguagguuugaccaauugcaguuauaguucauaguaagaaaauagauuuugaaagccagguauggugguacauacauguuaucuuagcacuaagggcuaaggugggaggaucccaaguuggaggacagccugagguacgaaucagguuuaggccagccuggucuacauagugacacaccggagagggucuuaagcacaguaaacuuauaaauggucuucaucaguucauugaacuuugcacuuuaauauuuuguuuccuauucucuagacauuagggacuuagaauuuuaaauauuuuguuuauauagugaaaccucacacaguaacuuggggaagacugguuuuuugguuuuguuuuuguauuuuaucucuaggcugaagaaaguauucucuguagaguucacacauucuguuagaugcauaacuaucauccaaaacaauggaauaauaugugguaaauugaaaaugccccuacuccuaaaucuggaaaaaucuauagaaacuccuaguagauucugagccaccagcaagauuguugguuaguccuuuuuaaaaauucauuaugacagguggugugugcauguugcagcacuuguguggcggucaggggauagcuuguggguguuggcucucuccuuccaccaugaggagccuagacagcaaacuuagauuguuagguuuggcagcaagcgccuguaccugcugagccauugcuggccccuuguguucuaaaguagaaaaauacgugagcauccuucacagaggagcugucagcacucacacauugaccugcuaucuaucacacagugaaauugaugcagcugacugacaccugucaaucguagacgaaaaacuaguguuaucaguagaaagaaauuaguggcaugacuucauuuauauaaaguucagagccugugaaacuacuauauaagguugugacuaguaaauaauauaguaaaauaccuuucaaugcuugaggagaauaaaaaccaaauuucuggcaauuaacgcuucugagaagagagaaaauagaagaagaugggaaagaagccguggccguccaugcugcuacacugcuuuauuuaaagguccuaagcagaaauugaccauguuaccauuuuuaaacaaagccaaaagaucgugaguuuucguuuuacaggaauauauuucuaucuuucugucuuuggagacagggucucucuauguagcucuggcuaaccuugaacuaacuauguagaccaggcuggucuccagcucacagagaucagccugccucugccucccaagugcugggaucaaggugugugguacuaaggucagcucuuacuccucccucccucccucccuuuucucccuuuuucucucucgugagcugaggcuucauaaacagcacaguuuccagucagucucuaauguucacccagcccaagagaugucuacucagccuugcauguaugucucccaacaucugugaaugcagcaaagucaugguuuauacuuggaaacauaggauaaaauaaaguggggaguagaucugagaggagugaagggaagggggaauauuaucaaaauacauuguaugcaugugugaaauccucgaagaauuaaugaaaauauuuuuuaaaaauuuaaaaagugaugacgugacauugaauuuuuguaaacuuuacagauugccacacugugaugacacuguuccuguaacuucucauccacacacagagcuuucugggccacagaagaaaucagaucaagucccaagagacauuggauuuugguguccaaagcaccuuaggacuuccggggaccaaggcuauagguuucugggaauugaacagugugccccuccgugccccaauauguauuuuaaaagugaugaacuagacuuugccaaaaguuucauaggaauaguuucaauauuuugucuuugugcaacucuguucacguuccuuacauuuuuaauugacguuagacgauucagauacccagagagaccaauuaucuauuacucugucugcuacagcauugucucucucauguacuucgugggguuuuugcugggcaauagcacggcuuguaauaaggcagacgagaagcuggagcucggggacaccguuguccuagggucaaagaauaaggcuugcagugugguauuuauguuucuguauuuuuuuacaauggcuggcaccguguggugggugauucucaccauuacgugguucuuagcugccgggagaaaauggaguugcgaagcuauugaacaaaaagcagugugguuccaugccguugccuggggggcgcccggguuccugaccgucaugcugcucgcuaugaauaagguugaaggagacaacauuagcggcguuugcuucguuggccuguaugaccuggacgccucucgcuacuucguccuucugccucugugccucugcguauuuguugggcugucucuccucuuagccggcaucaucuccuugaaucauguccgacaagucauacagcaugauggccggaaccaagagaagcuaaagaaauucaugauucgcaucggagucuucaguggccuguaucuugugcccuuagugacacuucucgguugcuaugucuaugagcuagugaacaggaucaccugggagaugacaugguucucugaucauugucaccaguaccgcaucccgugcccuuaccagguaggugcuagcauuggaauaugccacucuuuaccuucauguuccuagaagugcacuugucauggucauaaaaguagacuuuaguuaaggagagcuaucagacacagggaguaagccccggugucguagccaggcuggggacuggcccaggagugcuuucuucaagcaguagcucuguuacaauacagcaagucuccuguaaauauuucaaacauuaaagugaaaacaacaauuaagucgguguaugaaaagcagacuaugaagaauaggccucaucauaagaaaagaaaaaguaucuacugaauuggagaggguuuuuuuuuccccaccucuuugguuaguaggaaaccccuauguuugggcuuaaccuuuugugcaguguguguaucuaaaaauagacuuugccuuuugcccagcccauccugccauucuuaacugagaagaacacacaauagaaaguacguucccugugucugaggcugaggauuacuauaaggggcugcguuuuuagauuaaaaauuguaaauuccugaaaauauauaauuuguuacagaauuucauugaauuuuuaaaugaaaguuuggggauuaaaaaaaauacauuuuagcaguaugcauugugccuauauacuuaggaggccaagggagaggauuguugaguuuaaagucagccugggaauguagcaagacucggucucaaguaaauuaauuaauuaaaguaaacagauuuuaucuggcuggagaugcagcugaguggcagaacaguagcauggcacggugcacaccugacagcuuuccuuucugcacccucucccucugccuacccucccucccucccuccaucucucccucccucccucccucccucucccucugccuacccucccucucccucuaccuucccucccucccucccucccucucccucugccuacccucccucccucccucccucucccucucccuacccucccucucccucugccuacccucucucccuauuucuuuuuuuuagcuccuccugaagaaucaauuuaagugauauagagaugaacacugcaacauuauuagcaguuggaauuacaugggaacuaaccuaaauauguuuaaauaggggcuaguugaguaaguuagaacucacaaagaaacaaaccuucaagcaaagcuugcucugugcuggugugggugggguucccagggguaguaguuacaaaaagcugugcaauauguguaauacuuuuacauuugaacacuuacaauaauguuugaaaauauuguuauuuaauaaauauauuaagacuagcaugcuuuaaacaaaagugugacuuuacuuuuuaucaaauuuguauacuuuuacaucuuacuaauacuuguuuugugguagccaaucaaaauuuaauauaaugugcauuaaugcagaaagauuauaaaauaugaguuuaacuguuuuuauguuuuaauuuuuacuuuuugugcauguaaguguuugcaagcauguguguauauacaucacguguaagcuuuguaccacaaagcacagacaguucuucuaaacuggaguuauagacagcugugauccacgguguagguucuaggaacugaacguggauucucugcaagagcagcaacugcucuuaacugccgagccauuuuuguagccccuaaacauauuuaaauguagacuauaguaaagaaaaauaaguaaauacucacagaccaauaucuucgcaauucugagaggacagucuaucaauaggaaagagcaauagaucaugccaagguucugaaaacacucauaaguauuuuuuucuguuaacagccauauuuugauacacauggaaguuucguguucagaacuucauaaaaauguauugaacuuaaaauuguuguucauauaacuuauuucaaaccuuuugcaauaaacagacuaaaaauguauaauuuguucaagcuuuacuuugacaaugcagauuuuucuuuauauuuuaaguauguuaguauuuguuuuguuuuuguaggcaaauccaaaagcucgaccagaauuggcuuuauuuaugauaaaauaucugaugacauuaauuguugguaucucugcggucuucuggguuggaagcaaaaagacgugcacagaaugggccggguucuuuaagcgaaaccgcaagcgagaguaagagcugauugguuaucuuaugauugucuuaaaguaaacagaucgaaaugcuaauguuucaccuagaaugauaacaauccaaaccaauuaaauauucugugauaucaguucauauuuaugaguaaauaguucauuuugauuauauauaguguguauaaugugcuguguguguauacacacacacacauauauauacauacauacauacauagauauuaauuuucaauugauuugacuacugaacacaaauuucauagcuauagcuggacaagcagaacuuacuuuuagcaccacacuauguaaccagagggcaaggcaggaggugaggcucaccuggauagcaagacccugccuccaaaauacuuuaguucagaacuauaugucuuacuuacucuauguauagcucauaucuguguucccauauaacuuuacuauaacuugucaacgugaauguuagaaauaaaacagaggccauugcuuauacugacugugucccucccucugguuugccauauaguuagcaauuucuaugauacaaauauagucagccccagaaugcuggugugugcuucauuuccuucaaaacuuugauuuuuggccauuuaacuucuuacaagugugcugcuucuguuagugaaagcaaaguaggugcuugcacaaaagacuucacuguagaggaaucucagaucuccuagauaaugcgaaccacacagaacaucucacuaaucagaguggacuuagggcaaagguugugucuguagcaucuaagauguacugagcggauucucucccugggucccucgcagccccaucagugagagccgccgagugcugcaagaguccugugaguucuuccugaagcacaacucuaaagugaagcacaagaagaagcauggcgcaccagggccucauaggcugaaggucauuuccaaguccaugggaacuagcacaggagcgaccacaaaucauggcaccucugccauggcaaucgcugaccaugauuacuuagggcaagaaacuucaacagaaguccacaccuccccagaagcauccgucaaagagggacgagcagaccgagcaaacacucccagcgccaaagaucgggacuguggggaaucugcagggcccaguuccaagcucucugggaaccggaacggcagggaaagccgagcgggcggccugaaggagagaagcaauggaucagagggggcuccaagugaaggaaggugaggucagccggcuuugaaggagagcguuacucaucuuuuccuggcacauaccuuaucuggaacagaagcaucuuaugaugaguuaccuauacuucuaaucuaagggaguuugguuucaauuaauaauaugcuacuaauaguuuaauucuuaguuuugaguagaaucuuaauguaugacauacaaguuggaaagugauguuuguuucuuaauaguuguuagugauauuugacacuuagguaaguauuuaaaaugcgucuggaauacaggacaaacugucaccauacagccuagcugaguguggugguacaugccuggaaucccagcacuggggagcuggaguuaggaggcucaugaauuugaggcaaguucaaggccaaccucaacucuaaaaauugcaagaaaagaaacaacucaaggaaaugaaacagcauguuaccucauucugucuauaugugauauuuuauacaaagauaauuaaauguucuuaguuucugaacaugaaagaauacggugaauuuuuuccccaauggccaaacaauaucaaaagcuugggguuuuuuguuuguuuguuuguuuguuuucucagaauguugacagcuaacuguagcaaguucccaagguuuuauuacccagcccuuucagaacauacuguguucccacgaugccuccauacacccagcuguaacuagccagaugcuuucauccucacuggauuugagcugaggucuuggucaucuuuuuguuccugguccugacuguccuggaacuagcucuguagaccaacgaggcuggccucaaauucagaaauccacuugccucugccuucccuaugcuggcauugaaggugugugccaccaugcccagcaguguggcccuaaacucuuaaugcaucuuaacacugauggagccucaguagccgggcagcaggaaccugccucaguaauuguguccgcugugagacgcagugcucggccaugcaggaauagcacuugguaaagugugugaagucagcaggguugugguuugaagggcuacccaggagcugcguggguuauccccugcuagagcucuuugggaugaaugcacaggguuaggaggauaacuaacauccugucuguguuucugcugugcacauaaacacucguguuuuccaggguaaguccaaagagcagcguuccugagacuggccugauagacugcagcacuucacaggccgccaguucuccagaaccaaccagccucaagggcuccacaucucugccuguucacucagcuuccagagcuaggaaagagcagggugcuggcagccauuccgacgcuugaagaaaacugucucguucccccagaagcacauguauguuacacuggagaugaccaacugauuugucuuauaaaggccacuguugagcugggagaguagcccagugguacagcgcccaccuggaauacuugaggaccugggguugucucccagcacugcaaaaggaaaauucacuguuacagucuuccuugcacuuaaaccagcuuugucuauuguuuuuuugguuuggcuuuuauuuuuguugcuguuauuuuuguuguuguuuguuuguuuuuuuguuuguuuguuugagacaggguuucuuugcuagcccugacuguccugaaacucccucuguagaccaggcuggccucaaacuuacagagaucugccugccucagccucccgagugcugggaauaaugguguggucaccacugcccagccuuuugucuguuuuuaaacuugaaagaaacaacagcccagauuucaaaaauaauauaaugcauuuauaccuaaaaaaccaaccaggagugcccaguuaauaacacuuuuuaaauguggggaugggaagggcauuagaggagucuuccuucuauugaagauucauuaaaguauuuuaagauaugcucuuucacucuuuauauaaauccaagauuuuucuuugcugaaguauuuaaaacuuuuguaccuuuauauguagauaugaauuugaaaauaugcuuauguguauuugaacuuuugaaaauccuagagaauugaaucaaauauuuuuaugauguuuuucuacuauuuuagcuacuuugcgacugugauagcuguuacacuggauuuuuaaaaaacuuguacagcagccucuuuacaguaaaaagagugggugucacacugaaaggucuguaagaaguggucacagccaccccuaccuuccccaaaaggaggaacuugguggcaggucccucccugauuggacugucccuuucuuucugcauguuauaaaucagcagguaagaugguagguuuuuacaaguuaggccgagcugucgauuccccuuuuaaguguugaauuaggauugaauuauggccauuuguaguugcucgugccugucuuuauuuuaguauuuuauuucccgagacaggaacucacuguguggugcuccuuggcugucugguguucagucugucccaggcaggucacagagaucucccccucugcagcccacucaucucucccaagccaccacacucagcuuuuaucuguuuuaaaaauuuaaacuuaaaaaaauguuuuuggaauaguacaaacacauuguguuguaaauuucuuugaugcuaugcaaaauuccuaucugcaucuaagccugcaaaagaaaaugugcgaagggcagagucagaguugggcaggaagaguguagugcagcagaugcagcgugaagacacugaaggugcuaagacagcgucucagugcugguccuccuuaaggauuaucucgccagcgagguuuucuuagauacuuugaucccauuggagcucuguuaaaguuuaaaaugaaaauuaucauguacuguaugggaaauguaaauacuaacuuuuccacauauguaaacuucagacacaaauuuuuuuguguguucuuuucaucaauaaaauuuucuuuguauaaaag

SEQ ID NO: 7739 - RNA, 10265 nt, Mus musculus
gggggugggagggaagaagggagggcggcgcucagugaaaggcgcauugaugcggcaggcugcagggcugggccagacgcugagcagggucaggcuccugccgaccccuuuaccuccugcuccgcgcuucgcagccaccgcacaccaugcacccccaaggccgcgcggcccccccgcagcugcugcucggucucuuccuugugcugcugcugcugcuacaguuguccgcaccgaucagcgccucugagaaccccaaggugaagcaaaaagcgcugauccggcagagggaggugguagaccugguaagucugagagucgguccugaccucagugcuggaggagaagacucagccaggaucgcaccgggagggcaucaguauagauggugguggugcugaccguaggggugaguguagggcagcacguuaagaagcuugagugccucaguguccugccuguguaccuguguggggacggaucugacgcacgccugcagcagagucuugaaccgcuacgggagaucaugagaggucaccacaugcuccgacgugggucaggugggaugcccaaauccguguaagucgcccaguaauuucuggcuccaggggaggccaccguugggagaaguggggggaugcuguggcugcaacuggaguagauugaguuagucaguugauuucaaaagaaagcccgaggaagacccuaggccagcuggccgcuuggcccugggccaaggcugugcaacguguccuuugugaggaccaguggccacggucuggccacgucugccuggaggagaggcuaacaacccccacaaagcauuuguucagcuaacuugaagauuaugaaucacuuugugucaucucccugggaaauaugaacugcaguuuacuccuuagaggaccacagcuugagccaggaguggucagaggcuuugaagcugaaggggaaaaaugaaggccccacuaggagcccuuccaaggacccauuuugccugaucuguuuaaaacagaugagcagucaggucuuaaccagucaggaacacuguacucaagcuaaggggaaggaaagcgcucccaggaaagcaaauaucccaagggcuuucugagaggcuaaucugugggaaagucuguuugcuuaaaaccuuucccucuaaaagucaauaaaccuaguggagggcagagaguuugucugucccacucaaaagccagccaucgauagauuuguagucuuuggcacaucauaaacuucuguccuuaaaccaagcuauaugguugucaggcacugcgauacauaaaggacaggggacauuuacuuauuuuauuauuauuauuuuuuuuuuagauuugaauuucuuccacugacauucuaaguugagcuaauaaaccaagcuccuugacagcuaguucuaaacugauucaaaagcacugggggaaaaucccugcuguuucacgcagcagugguaggguuuuguuguuuuaugcucugauauauaauuuuccuccacaaaagcauacuguguuggagcuacaguucuauuuugagugccuaaguuguuaaaaaaaaaaaaagugccacaugaauguggcucgugugcaguuugcguauuaugaauguguaguuaagauacauaaaauagucauuuccccauaaagcuagcauuuucccccucuaaggauuauacaguaccacaacucuaccccaacuuggaaaagcauacugugcugccaggcucaggugcauccuguagauuggauuugguucuggugucagaaaaaguccacacagucauuaggaagguuuccacagauucuauaaagcgacuuuguauaggcgcuuucaaagcgugucuuucacgcucccacugaauucugcccccugguggccaacacaggaaauggggcguugggugagggaauuugagcuuccauucacauguuuucauuuuguugacuuucacuaaugauucuaaauaccuauuggaacuagcauuuuaaguuaagaaaagacaaacauacucuauguagcaucuuuccugagaggaauuuagaaauuaucaaaucauacuagaggaauuuacaacaauaaaugaaauguuaaaguaaaaaauuuaauuggaauucauuguguuuugaaaagucuaacaucaucccuguuucuaugugaacuaauacaaggauaagugcaggaauugauaagcaacgcucaaaauauuuccacuguagcucaaugguagaguacuugccugauauguguaagguucuaaguucaagccucauugauguaaugugaacaugcgugcucucucucucucucucucucucucucucucucucuguguguguguguguguguguguguguguguguguuuugagguguggucccauguaucccagacuaggcacaaauuugcuguuuugacaggauccuaaacucugggucccugccucugcuucccaggggaaagggauuacaggcacacgugugcuaccaacuguuaacuucauggcaagaaugcuuauuaucaucuucauuuuauucauaaggaaaugggcacugaaaugcugaguaaauggccuggucucauacaucuaagacgggaugagucuaguauuuaaaaaaaaaaaaaaaaaaaagguucuagaauccacgccuuuaaauucuacagcacacagaaagaaacaacagaacagagaacacuagcgcuuacagaugguuugcuagauuauuacacaccugcugaggacaggggaucacgugaaacuaacugggccacagacuccucuugaggaagacagaauggacuggagaaguucuacccacugcacuuuccucugcauaaaaaugggaagagcagaggaggugcacauacaacuuagagaugcugugauacaagacagcuacugacugcuaaaguuuuauuucacaauuauuucccuagcaauuaaucuuagggaaaucacucaaaaggaaaaaaaucuauauggccaaguauucucauuauauuaauauuuauaacaaaaaagagaaauaaccaaaaacaagcauuaaaaaucuuguauaguaauguaaaaguuccaagaaccaagucccuugauaaaauaugggauuaugggccuggcagugguggugcaugccuuucuuuaauccuagcacuugagaagcagagagaguucugggacagccagggguacaaggagaaacccugucucuuaaaaacaaaacaaaacaaaacaaaacaacaauaacaacaaacccuaaaacaaacaaauaaaaagaaagggauuguaagaagcuaacauagaaugucagguucuggaggagaaauuuuaaacacccuuaaaaugaguucgccauaauaauccauuagaacacggacgagguggguuagagggacucugccaguuuauuaaaaauaaacgcagcugugaucauuugacucucacauacuguuuauguauucaugacuguauuucuuuauuuacuuauuuuguacuggggaucaaaccuugagcauccugcaugccaggcaagaguucuaccacuggacuaccucccuaugcccuacacugagucugcauguuaaguaaugguacugucccccuuucuccuuugcaccgaaguauaauggaaugugucuacaaggaccagcaggaguucccggucgugaugggagcccuggggccaacggcauuccuggcacaccuggcaucccaggucgggauggauucaaaggggaaaagggagaaugcuuaagggaaagcuuugaggaguccuggaccccaaacuauaagcaguguucguggaguucgcugaacuauggcauagaucuugggaaaauugcgguaaguaaagcccaaauuauaauaaaguugaagcaaaauauaagaguuuguauaagucauugccaaauuuauuuuuuauuuuguuguuaaaccaaaggaccuuaaauuaaaagauucaggauagguaaugugcugacuuuuuacuuaaaaauuaauuuaaaaaaaugguaacguuucagcuaauuuuauaaaggcauuucuaagauagauaaucacuauuuuauaaagcaaacgcaaaaaguauagcuuuuuuuuuuuuuucaaauuagacaggaaccagucuuguaaaguaacuuuaaauuaaucuaauacauccugcuguagcuucagagcuaaaaguggaagaugaaccuaaaaauuaccacgugacugggaucccugcuucggggaguccuuuuguccuuggucgccgugcucagcuuaaaacugcugaaauuaggggaacugaagucaaugcuagugauuuaaaauagugacgauggugauucuguaauauuuguguaaggagaagcacgcaaaauagcaugucagggagggcauuuugaugaaugauccagggacuguugagugguccagugauuagugcuuugucuccaagaggccccggguguagcugagggggagcaugcggagccucgugugcuuaaggcccucggccggaugaagugccauuggcgaguccgggggggcggggggggcgggggggggcgggggggggggagaagagacagagcugagaaaguccgugcuguuuccguaucuucuuuugaugaccaccucuguuucugccuccuuagcuauaauuuggugcuucaugguucugcuuaccacgaccacccggaaaacagaaguuuauuuucauaaaacucuaagguuuuaaguuguauggcaucauccauguuuuucaucucaaccucuucugcucuauuuuaaaaguucaagaaugccuugauucugugugacagguuuucaucuagcuaccacauuuugguuauauauauguauauauauuaaagaaagugugauuugaaugaugacuguuauuucaacauuugacaaugguggacugccuucuuauucacaguuauucaacagaaguugccauuuccccccccccccccccaaagcugucccuuuaugguuccugcuuuuuuguuuuguuuuguuuucuuauuuuuuguuuuuuguuuuuuugagacaggguuucucuguguagcccuggcugucccggaacucacuuuguagaccaggcuggccucaaacucagaaauccaccugccucugccucccaagugcugggauuaaaggcuugcgccaccaccucccagcgguuccugcauuauuaaaacaccaugauuuuuagcagugguuacaaugaauacggaaauguucugcaaggaagagauuguaggucauaagccaauguacagauuuuugugaagaccagcuagaaggaagaaagcaaggcuagcucuuauuacugugcuguucaggucauuugucuacugugugcuguugcucaaaagaaagguugagccuggugaggugacucauaacuauaaucucaguauucaggaaguagagaccacuggaaaccucuggaguugaaggccauccuuggcuacauagcuauuucaaggccaucuugggcuacuggaaacccugacuaaaacaagaacaaccacaaccaccacccaaaaggauggagagagugaacauaauccaucccaacagauauccaccaacacucuagcaugccagcgccgugagggcggggcuuccuuugugugaacuuuuguauccaaccgucuaacauagaguugauauucaguguuuuucaguagaaaaaaauacauagguuuguuagcuaaaaguacugaagacuagcuguuuuugaagauaaauaggaagugaaauaaaaccaucuaagaaagccagaaguuggcuuuuguaucaaucugauaaguaaucuuuaucccucuauaaaauuuaagcauguuaaagacauggggagaaggcagguaaaauucacaguguauuuucagucucuuauuuuacucucuccuaugcccucuccuccaauuucucuucuauuuccucccccucccccucccacuucauguacuuccuuaaaacuccaccaaguccacuuggugcugucuaugugugucuccaggaacauagguagccucucugggucucaucucuggagaaaacagauuuugucucccuagcagccaucaguugcucacagcuccacagcuagggguggggcuccaugggcucuuccccaugcaugcugggaguuugguugauuuuguacaggccuugcacguguaaccuauugugaguucauaugugccauggcccuauugugucuggcaaauucuguuucauugcaggugucuacuaccucaccauccccccgccccacuccccuuguagucucugaacauugaccagaugucgagucucugcuuuaaucuccaucuacugcaaaaggaggguucuaugaugaggguugaagaaauguguuaauuuauagguauuaaaaaagaaaccuuaggggccaguuuauuacuauguccuuuuaacagaauaauaguauuacuuucuucucuaggaccuuaugagcuggucggauauggauuuuggguccagugaacuauagcaggccugaguuucauuuuuuugguugaacuggcuuuuaacccaaucacuaaauacaacuauuuaaugaaccccuaacacuugagccaccacugcacuaguggcaccaccgcuaucacaguucacagggugcccagcuggguaaaacacuucauuacuuuuuccuuggcagcaugcacugagccuuccagcacuaugaaaguuaaccaggaagggcgaaucuucuaugucacugacagcuuaauuuuccacauccuaugacuuaaguaugugggaccaucagaaauaggaguauuauucagcuguaaagaaaaaggaaauuaugaaauucacacguaaauggguggaagcugaaaauauucauuucgagugggaucccuccaaacccaggaagacacagaacgaagcauguucucucucaugcauggacgccagcuuugaagcuuuagauaugcauauuuaaauuaggcuauagucauagaaguuaucaaguuaguaaggggaggggguacaaugcaggcaguguggaggaggaaagggaauuaccagcacagguuagaugggagggcaggagaggggauagugucugaguacggauauacaauacugaagaccuuugaaaaaagccuacuacugcagaagcauccuaaacuauguacauccauauuuguaaaaggagcuaaaugguguuucccuagacaucauagacuaccaaguaaaaaaguaccagauaugggguaccucuuuuugaguuauugaucaguggagucucaaaggccuccccaaauuucagacuguggucauuauuauggguuagccuccauaacuugaugguugaagaaacuuuuuaaucaaaaugaaaaaugucugguugucuugcugcccuggcaggaguguacauucacgaagaugcgcuccaacagugcucugcgaguucuguucaguggcucgcuucggcucaaaugcaggaaugcaugcugucagcgcugguauuuuacauuuaauggagcugaauguucaggaccucuucccaucgaagccaucaucuaucuggaccaaggaagcccugaguuaaauucaacuauuaauauucaucguacuuccucugguauguauaauagugguguuucugagugagccucaaaucugccuaagagguuguuugauuuccacugucacaguggguaucuaaccuguuagaaauaaaccucuagcugguccauaguccucuagcuggucucuccucccuggacugcaauucacauaauuuuacagaucuuuuuuucaaaggguauagaugcuagggugucaucucugaccaagggacucagaaucucugguguaaggcuccagaacguuuaucuuaaaaacaaaauaaaacaaagcaaacaacaacaacaacaacagaaaccauaguugugauaauaugccccaaaauugaaaaucaaugauaaguuagaaacggcaagacagccaggaauucuguacagcaguggcuuugguucucagcuuuggcaauacaacggguucaucugagaaacuugaaaaaaagauuccugcccuggguacugcuccuccaggaagauucaauuaauggggauuugaucauuacaucguuugcauugcagugaggcugaugguagacccaccacaccugucuagagucuguuggcuucaggcuuaaguagacucauuucuaggguauaaggggucaaggccuuggggacacuuaaguauugcuggcaugcauuuucagcuagcaugguguagacuacuagacaaucuaagugggacuguggacucaccgcuuaccucccacuguagacgaggucuggguaugcuguagccagggagggcagaguccuuuaguucuguauuccugggccucaguugaacugcauucacuucaacuaagguggaaaccugacagggcacguaaguaccucaaagucaaccagguaggaaagcuaaauagccacggcacuacuuuaugucaagagcuauuuucuucaagaaucagccaccuccaguaaggaaaggaaucgcacuaagcacagacaucgaaaguaaugggacucucugccuguuucaagugaccaaccaugaaaucuuucuuuagaugugagugaagaacuuugguagguuggaaugcaagauguauguuagaaugugagagcccagaggguaugcguaggauacaguaucaaaccaaagcagagcaaaaagcagaacagaaaacagaacaagccgggcgugguggcgcacaccuuuaaucccagcacuugggaggcagaggcaggcagauuucugaguucaaggccagccuggucuauaaagugaguuccaggacagccagggcuauacagagaaacccugucucgaaaaaacaaacaaacaaacaacccccccaauaaacaaaaaacaaacaaacaaacaaacaaacaaaaaaccagaacaaaauguccucuuuaauauaaucauccuauuaaagggucagugaggugguuuagcagguagaaggcacucucccacccccucagagucugaggaccuguguuugcucccugggacccauaugguaggagagaaccaaccccuguaaucagcuguccucuaaucuucacaugugcacuguggcacguguguauccacaccuacauauacacacuagauagaagauagguagguagguagguagguagguagguagguaaguaggugcauacauacauacauagauguaauuuuuuuugccaaaaauaagaaucuauuuaaaguggauucacagauugaagggaugguaugagauuaagcuagaauuucuuuuucucauauagaaguccuaucuuggauuugaauagcaucuagggauccacguugaaaaggacuuucuuuaaaaagacuugcauaucuugauccaggcucugguucaggucucuuccaaaguugggaagucuuaaaaguuggaaguguaggguaaauuguuuggguaaauuguucuuugguucuaaguaucuagaacacguuuugguuugagaacacugccuauagcauagcaaucauggaaaugccuccaaaaaugucuguguaucaacuaaaaaaaugagaccuuuauuaugaaaucaucagguacuagaauuuuuaauuagcuuugcauuaaacagaauuauaaccugauuuccuauaguaaaugcaaaauuagugguuuugcuuuuuguucuuggguugugacuggcucuguuuugcaguggaaggacucugugaagggauuggugcuggauugguagauguggccaucugggucggcaccuguucagauuaccccaaaggagacgcuucuacuggauggaauuccgugucucgcaucaucauugaagaacuaccgaaauaaagccucugacgauuucagucccugccucguuggcuuuuuaaaucaagcccuugaaugguucauuuaaaugacauuuaagaaaucacuuaaaugaagugcucagcugaaugaaaaagcaaaguuaaauauguuuacagaccaaagugugaucucacacuuaaaaaucaaguauuaaccauuuuauuucagccaaagaugguuucaagauuuuuuuucauuauuauuuuuuaagccuauauauuggaaugccauuacaguauuuaguauuuccuucuauaacauauaaauguuauuucuuuguaaggacuguauagaauuauuuuauaucuguuaaauaaaaugcuucuaaaaccuaag

SEQ ID NO: 7740 - RNA, 18907 nt, Mus musculus
cggggcuaagcaagcuccgcucugagguuucuccuacuccccgcuuugccgcgggugugacuugccugcagcagcgucccgggcuccggucccggaagugggcucgcguccugcgguuccaggccccgggccgcgacagucgccacgguggcggccacuacaucacgccccacgucggcggcgcuggacgccguagugucgacgaacccggagcccaugacaggccagggccagucggcugccgggucggcggcguggagcgcgguguuccgccacguccgguacgagaaccugguggcuggcgugaguggcggggucuuguccaaccuggcgcugcacccgcucgaccucgugaagauccgcuucgcugguaagagccugcccacgucccgggcggcuucccuugcugccagccccagcgaagcacuuacacgcagaagagacauuagucuccccagacucuacuacaagggggagagccccuaagaugaugcugugcacccugcguuaccuggagcuaggauuuaggaaggggaccccggcuuucccugugucuccuaaccauaaaggauagggaaagugggugaaguuugagagaaaggagguugucacauuugacccucauguucacgagucauucacucuuugggguaauuugaagucuuagggcagccacguguuuggcuguauaaagucagacgaaaguacaagugugugagccggugcuuugucaccuucggagaguaaggucauaguuugggauuaaaauauucacuaaaguuucuuuaguuugcaguauuuaaaaauaugcauugucuggugaaggaaggaggagcuucuacacucuaaauaacuguauuaaagugugaauuaaguauauggaaauuagcacggcauuuuaggaauuaauaccaaguugcauuacauaggugagccuugguaacuauuuagaaaccauuucuguuauuucauuuauuacaaacuaaauuuuuccagaaaaucaaaucuuuagagauggauuuaguagagcauucuaauuuuauucgauuuacuugauguaugugucuuaauguugaacaguggagucgaacuaagaaguaccaacaguuucuuaucguuaggaaacuuaaaaauguaauuacccuaagauauauaaaaggauucuacacaacaugaaaucaguugcuaaguagaauaaauucaaauacaaaauaagagcacaaauaggcuauauaaaaagacuauauaaggaaagcuggggcuggagagaugacuuagccuuuccacaggacccacauugaguucucagcacccacuuugagcagguggcucccaacugucuauaauucuggcuucaaggaaaccuaacaucucuggacucugccagcacaugcacauacccacccaggggcacauaugaaauaugaaaugauaaaguaaauauuaaaaaaauaaacauagguggcuuguauguaucuguaaagguuccauauuaaaguccucaacaggauuaauauuuugacagcuagaggagacaagacauuccgugguggagaaugugugguaccuguggaguguauucuagaaaagacaccgcagagaaauaauuccauggaguuugauaugcaacuauaaauaauuguuauaauaguugcaaacauugauaacuaacuuugauugaauguauaauaggcauuuauuaugaccuuuaugaagcugauaaugguagggguugaguaaguuguccaagucacaagaugguaaauagcaaucugagguuuggguucagcacuuucacucugaaacuacccugcacuuacccucuccccguagcaccucuaagucccugcuaacagugacuugaaugugaauagauagucuuggacuucuugagaugaaggucuguggcuuggugucccucugacacagcuuucucuaggagcagaagaugaggcgcugaaacugaggguuggccagguugggauuuggacagugcuacagagcugacuaguuugaggaaaggcaguucuugguaccugagaagauucauuaccuuagcgugagaagaguauuggaaacuuguaggguagauaaagugguuaguuacagaauaagggauuaaggguagauaguaacuccuaguugaaguccuucccacagcagagcaagcguguguagugguaaagccggcaguuugacugaauggcgaaaggaagaacugaggaagaugaacagugaaagguugugucgguguuuuaguuaggguuucuauugcugagauaacacaccaugacgaaagcacccugggaaggaaaggguucauuccuuauagcuuucucauccaucauccaaggaagucagggcagaaacucaaggcagcagccuggaggaggagcugaugcagagacuggaggagugcugcuuacuggcuuacuccucauggcuugcucaccugcuucuuguguaacuaagacuucuugcagcggggguagaauugggggcggcauccccaccuccacacugugggcugggcucaucccuacuaguagucaagaaaauguucuaaacuugccugcaggccaucuggaugaaggcacuuucucaacugagguuccucuucccaaauaacucuagcugugcugagcugacauaaaccaauacagucaucaauaggcaucaguacugaauaaugccgacauuuugugcuuccauauaauuaagcccacuuauuaaaauuacugucuagcaauggugaggaaggcuaauccugaaugcauaugcuguaaaaccaaacaauucauugacuccuaaguaaacuggagcuccaguguuaacaguuaaaaaaaaaaaaaguaaaaauguuaugugagaaaggugaaggaauucguuaagcuucauaugggaagggccgugcucacugugaauugguccuaagaaaaguuacagggaugcagaauuaggccuggcaaaguagugguacccucugcaaugaaacacaaagcggcugaggcagaugcuauugaaagagguugggaaugggcauugaauaagcucagugauugacugcuaccguaggucuuaggcacauaggucauaagcucaaaaccuaguaucacacacacacacacucacacacacacacacacacacacacacucacacacacacacacacacacacacacacacgcucacacacacacacacacacacacacacacacaaguagagacaaaccauccacauagagcacaagggaaggggauguauuaacuaaguaagaaacaaggucuucaggugugaccgagaaaaggaggguaacuaagccagcacaugaaacacuuucuccugggauggugggacuacauaguuuuuaaagccaguguacuuguugcuguucuucaaaaagaauuuaaaacuuaaugucuucugucuuggcuccuucaauauaccaacuuuuuuguucaguuacugccuccuggaaucuuucaguguuaaaccacuagccauuacggugaugugcuuucaugaaauuccucaggucauuuagacuagaaacucacuguguauacaacuucuaugugacagcaggaagacucauucaggucuucaucucuuguuuucucugccuucaaauucauucuaccugaggacaccacaauuuccuuuuuuuuuuuucaaacauguuuguauauacuuaaugaaauuuuuugccuugauaguagagcaauuacuauauuucucuuuuguugagcccagaccuagccaaggcugguccuuggcauuuuuuuuuuaaauuagaaaaagaaaguagcauuuccuucaucaaaacauguaugugauuauuuuagguuccuucccccccuccccaaguaccuuuguaguuugagcugcaacaaaauaccacaacaaacaguuuggcuuaagcaacaaaaggauuauuuuucucuuagggauuuggggacuggaaggaucaccaggaucaagaagcuagucagguugguuucuagugagagcucucuccuuggcuuacaaauagcccuuuaaucuuaauuccuuccuuaaaggcccugucgucuguguaguccuguucagaacuacaacuuuaccugaacuuuggagauaaugcaguucacuccugaacagcucucaccacccuuccuuccaaacuaauauuccuuccuccaccaguccaacauuugugcccccaaaucuccaguuuucuucccaaaagauguccuaucuagcuauaaaacuuuuccaccuucugaagaccagugcguaaccauucuuaucuguuauucacacaguuauuacuaagauuaacuucuuaaaacaguaaagcaagcauugguuuauggccaugaaaagcagggguguuuaccuuuugucucacaauugaauugugagcuuauuauugagagaaaacuggaaagcugcccagaacaaggaaaucuguacagaaugagaggcacaaaacccaaggggcacaucagaagcguguaugcugcaaaaugccucuccugggcaaauaacccugcuaucugaagguuuguguuuuguguaaaccuuacaaaacuuaggaugauguacccacuuuacaaaggaggaugcuggagcucagugaggguaagaucauguaauuaauaaaggaacugugauauccagcccaggcuucugaagcccggugcacuuuaaucucauuucguaguguaauguugacagguuaaugacgaaagaacugacuguuccaccuuggcguggcacugguaaacacagaugauucuucuuugccaggcuccauucaguacaguguaggugggggcagaggacuggacaugcuuacauggaaaggacuaugauuugugugaccucuuuuggcagguacuuuucacuguauuuuaaguuuacauuuauacccuuuaaccuauaucacucccuuucuaguggcuacugauaaagaaguaauaagaaucuauacaaaucgcuuuuuaggauaucccuuagagaacauuuuacuaguaagaagaugcgcaaaccagacagagggaacagggcauacaagagagggcagugggagagaaggcugaaauagaaacaguauaaaagccgagugguggggagguggaggcagguggaucucugugagucugaggccagccuuaucuauagaguaaguuccagaacggccagggcuacacagaaaacccuaucucgaaaaaucaaaaaaaaaaaauguauaaugauauaugcauauaaaaaugcugugauaaucuccuuuuuacaugcuagaccuaaaauauggauuuaaaagauuaggaacaguugacugugagagaggagaguaagucuagaagugauggaauggcugugagagggauggcagccacauugucucaccaucuuguacagguuuaauagcaaggagagaugcuugugaagucuagagaggggagcaugcaaagcuaaaugaaguaaacuuguuauuuuguauugugggacuuuauaaugugggauguaguuuuauaaucaggugucauauggaugauacagaguguucccucguacgagauacuuaauguucuacuuccaggauuaagugacuucugaaaacagcaaagcaguuguuaagacugcauuguuccauauuguuuuccuacagccuguucacagaccuguuaaguagccuucauuugcucaaauuaucauauuucaaauguauuuuccauuuucuacagaagcaaaauaaaaauaaaugccaaauauagccaggcauaguggaauucuguacuucaaagugcuacuauuuuaugugguacaauaaaaagauauaaaggacuuuaaaaaaaaaaaaaagauuguuugauaaaaaggaaagggcgagucugacaacugguccucaguggcacaagcaucucuguaaaccguagugccuuauuguugagccacucgggugguacgagcuuugcuguagacaguugugcuguaguguggagcuguaugggacuggaaugagaacagugugggaaaguauggaggaaacuagcucaagguuagaaaauagucugacugagguguguauguguugguagagaaagaauauccuguaggcugcccuuccucaacucccuucgcugcugccccucagaccgugcugacauucuugauagaguugaagcaccugacuaggauuuguuucuuuguuuguuuuuuaaguaauauuuuauuuuauugacuauguaugaguguuuugccugaaugaaugcauauguaccaguuucguggcuaguaccuacagcguucacaagaggaugucagacccuggaacuggaguuccaggugguugugagccaccaugugggugcugaggaucacacccagguucucuacaagagcaaaguguguuuauuccaagccacuaaacaguuuccuacacccugagucauaguuucaagcgugcguuuauagaauuuauaaucuugaguaucuguaacaagcauacaaguguuuuggguuaaagguuacuuccuaaaauauuagaagucuuagugugcucuggcugaauacuuuggcaaauugacagauguucuaauuaaaaaauaccaaacauacuaaaacaauuuccucuacccaagguuuucuuggugaauauauuuccuuuaugguugauuguguucugugucuauaugugguucaugggcagcaucccuucucaccuguauucucuucaaugcagugagugauggacuggaaguaagaccaaaauauaaaggaauuuugcauugcuuggcuaccauuuggaaaguugauggacuacgaggacuuuaucaaggaguaaccccgaauguguggggugccgguuuauccuggggacucuacuuuuucuugugaguagaucugggggauuucacagaauugaagaauauccuuguuuaaaugauuucugcuuaucaccuuuuuuuaacauagguaacugaugagucaucuaaucagauuuuuuggauuggcaggacugggaagcggaguagcuuguucauuccuguccgccagcuguuaucagagauaucugacccagaacagaguucuaauaggaacaagauaacaggaugagauaggagaucugcagaaacuguugcuuugagcugaauucagaaaaguugagguguugagcugagcgcugugaucaauggggugcugacacacgaacgagcucugcuuuaguuaaagccagugcuaacucuguguagcucauggugauacuguacaacuucaggaauccccagggaccauguuaguguucuugagcacuuuuuuaacagcuaaaauagauuaggaaaagguaacaaaaccaguugucuguuagagauuuuguaaguuuuacaguaggaaccugaaacuguuuuuuaacauauaucucaauuucagucuguaaauucaauccuauaaaaugaucuauuguuaucauguauaagagauuaguuccagaauauuaccaaaguagaaaaugucuguagaauugaauagcauaguucuauauuuauccucagcuauucuagauuccagaauauuccagauuguuugagauggcuuggagaagugcauuugaugcauaauaagguuuaaaucaggaggagacggagcugggagcaccuauaagcacauauaccagagaucccuguugggaagagaaagcaaugaccugauuccuagaagaguuugagauacacuccucauagcuugguuuuuuuguugcuguuuuguuuuguuuuaaacccaccccaacaucuucauagcuuaugaucuuuuaguagucaucacuauuucgaauaacuccuacugcauuccccuuaaaagaacugcugcaaguguguuccugagcagacacacucaccuuacugagugugaaagaacauaguccaaggcaccaugacccugcaguagaggagcacacgcugcugcugcugagcgugcuucuggcuggacguuguguguccuaaucacuguuguagugcugugagaccaagucagcucuuacaaaggaaagcauugaaucuauacaaaacucagauuguguguguguguguguguguguguguguguguguguguguguguguaugagagagaaaggggggggggugagggugagaauauaucccgaagaggacaugcuaugugugacaagacuuucuuaccauagaacaguuugcuucauguuagaauauuauggguaauguuuguaaaguuucuccaaagucuuugaagaggaaagugagagcuggggccuggugccacacuagauagauaggugcagagagauguggcuuucaaugucauccuuuacucguagugaguaugaggccagcccgggucauagacagccugccuaaaaaaacaaaauaguggcuggagagcuggcucagcuugcuguucuagggagucagagcuugcuuucccacccugcauuaaacugcucacagcacccuguaacuccagcuccagcuucugugggugcacagauaaccacauacacauaguaaaaacuguauuuauaaaacaaauaacaaaagcagaccugguucauguuuccugcucagaaacaucgagugccuguguuuuugucaaacgaaacccaaaucucacgcuggcuguccugaggcugcuuucucucacuggguuauccacucuuccugucagucccauguauauauaucucuuucccuguugaaacugaaccugucuccauacccacccaggucagugccacuucuacacaguaacuucugggaucucccucucucgggcaguuucugagagccuuaggacagacacuguuacccauuagcuacuguuagaaugcugggcuccuugcuaaucucugaaaggggucugccuggggcacguucucucuuauccaucagaaagcugaugacugcuccugaacauacguuugucuggugucccuugucuuuguuugcuucuuccugaugucuauaucgacacagcaucuccuccuccuccuaguuuuuuuucuguugcuauuaauuguugaagugucaggagccguccaggaguguuaggagaggcuaaggcuagcaggugacuuucuuagagguggccacugguuuuugcauggccuacaaugucugagcucugagagacaaggucccaagagacucaggauuucuucuugcagcugauaggcuuuuccugucauuaguacauagucuaaugacuccugggcauuagcccacccuauugggcagauuuucugcagaucuacaaagauauaccaucauguaguaaugugcuauauugacaaauugauuauuucauaguuccugaucaugauuuuauagaauuccugauuuacuucacauaauuuuagaaaguuuuaagagacuuuuuuguuguuuugccagaaagauauaguaaaguuagaaucaagaaaaaaaugugcccacuccccauagaaaauaguaaguaaaggcuguauaauuaggaauacagugagcuuucacaauuacacuaaaaagagaaauaggcuuggacaaacuugggaucaaggagaaaauucuaggucagauccaaggauuaagccacaggugugcccuaugauaaaaggaggccacgugaaacuguugcuuugaacuuauaaugaaguuauagauugaaacacugcuuugaacuuaauaucaacauccuucugcaacucccucuuuguguaacauuuuauccaugagguaauuuucuaaagaacuuuugccuaagaagauauaaaaaggccagagagaaggaauaaaguguggcaucugggacucugccccauccauccaccaaauguaugugugugguuugaggggcucugcccuauccaccaaaaguauguauguauguauguauguauguauguauguauguauguaugcaugcaugcaugcauacgugcauuuaugcaugaugaacacuuacuuguagaguugagguuauugggccugaccugugugcguacgagagagagagagagagagagagagagagagagagagagagagagacuaccuguauaaaagauuuuaauucuuuucuuuucucucugguccacaaagaguuaaugaguucugagccucuuaccuggccagagagagguccuugagcaggagagaaagaaaacuauugcugauuagcacaaaaggguuacagaagagagagaaagaaagaaagaaagaaagaaagaaagaaagaaagaaagaaagaaaagaagagaaaagaaagagaaacgaaaagagaagaaaaaaaacagugcuuauuaaagcacaaauaauaaggcuauaaggccagaaaucaccagucuuugaccuucaucugaugcagugucccacccaguauggcuccccuaaaggcuggagcaggccccuggcaccaagggagucauuagaacauuucacauacauauugcuaggcauauucuuuuauggggagggugguauaaucccaaggugagccauucuuggcauauccauucuuaaaugagccuuacuuugugguuucauuaugcauugacuuuugcuuuagagaguaugcuuuuaaauguacgguugcuuuaugaugcguguucagauuaaacuuggucuauguuuaauauuuguaguuacaaugccaucaaaucauauaagacagagggaagagcugaacaguuagagccauuagaguaccucgucucagcugcugaagcugguaaggcaauaauauaauaucaucuucuaaacuuaaccccuugggcggggguuggggugcugaguauguuugaguagaguacagguccuugcucuggcccagauugggcuugugaccuuuuaccuccacaccugaguuuucuuuucuuuaaaaauaaaaaucucccaauuccuuguuaaacauuagagguuuaaaugugcucauuuaaucauaugaaguuagaaaucucuagacucagcugauuugaguggggcuggagagguggcuuagcacuuaaaagcauuggcugaucuucagaggacccagguuagauuccuagcacccccgugguaguucagccauuaguaaccacaguuccaagggaucugacacccucuucuggccucugaggucucuauauauacaauacacauggaguacuauauacauacacuauacacacacacacacacacacauauacgcaggaaaaacacucacauaaaguaauuuuuggaaaauuauuaagagaugauuuaguuaugguguuuucaaauucuguagcuuaguaacuauucccuugcuccucuauaugugccaucaaggaaaaacagugagacugaauguucauaaaaccuauuuugacccauuguguacccugguuuguucauguuaacaguucuuuuaaagcaagaacugucuuaauuuucaaauaucuagucacaugcagagacccaaaucaugauagaauuugauauuuauuuacuaaaaaauuucucgggaagcucaacaaaugaaaauuuuaaccagauguauuuuuugguagggcaggagguuggucgguuuugguugguuuguuuugguugguugguugguugguugguugguuuuuuaagauauaguuacauauaagaugcccagacugaagccgggcgugguggcgcaugccuuuaaucccagcacucgggaggcagaggcagguggauuucugaguucgaggccagccuggucuacagaacgaguuccaggacagccagggcuaugcagagaaacccugucucgaaaaaccaaaaaaaaaaaaaaaaaaaagaugcccagacuggccuugcaaugaucuuccugacacugccucccagcugcugggguguaccauguguaucugucaccagaugagauuguuagcaaaaugaucuccucuguagagauuauuaaaugugccuuauuagacuuuugaaagauuugaggaggauugugacaggucuuggguggacacaugcagcuugaggaaccauagcuugguuucuuucuccuccccuaaaccauagccccucuguuuaaugugugacuccuaagaccuagucucugccaggcugcaugguuuaggagucuggagagcuuugcucuguccuuacaaagaagcuauucacauuuuaucucuuaauuuaccucucacugaccacaggaggaacuuuuuugaccgucagaaacaaaguuuucuuuugacucuuggcagugccuaagaauccacaucucccuauuucaauacagccucaacaugccuuguucucuuuauaccuauguucagcugauuggaauaucauuguccccauuuuauuaauuaaauuuaaugcccuacuuaugcccaaugauucuguuguuguuuuauuuuuguuuuuaugacagggagucacucuguagcuugggcuguuguagaacucacuuuguagaccagacuggccuucaacucauagagaucugccugccuccgccuccgccuccaccucugccaaguucugggauuaaaaugugcaccacugcaccuggcuauaccccaguucuugaucacgugggccuucuuuaugcuuaugugcacacuuuugaaaaaaauguucuuuaucuaaugaauuauucuuaauauggauugcaugaaacaguaccuuuuugcuaauuaaucuuuaaauaugauuuuaggagccaugacucugugcauuacaaacccauuaugggugacgaaaacucgccuuauguuacaauauggugguguugcuagcccuucacagagacaguauaaaggaauguuugaugcacuugugaaaauauauaaauaugaaggugugcguggauuauacaagguaacaaauuaucaugaauauauuuugaguacuggaaaucacaguuaauacuaacuuuauuuuugcuuuugcuuuguuugugagacaaagucuugcuagauagcucaggcuagucuucaacucucagucuucccauccaagacuacagaguacagauguuucaccaugcugguuucuucuugccuuguaaaccaucuccguucuuucacuucuaaaugaccucuauuuaguccuaaaaagaaggcaaacauaugcaggaaauaauugagugaaacugaaaucuuguuuauaauauugaaauuguacucuaagcuauccuucuuaauuaccauaagcugugucuucauugguguaaaccuuugucaggugucuuucuagugagccaugcaauuagaucacccauuucuuguagcccuuggaaguugucucugagaauauaugaaaaagagaucagugagucuuaacaggaucuuauuuuuacuggcuguaaauauaccaugaauuuaaaaauaauaaccaaaagaaaaauucagcaccuugccuggucauuguuuuuuuucagugcuaggcacugaaugcaguaucuuuaaacuuuuucuuaguuggcagcaagaucuguuccaauuuuguacuuuuuucucuugccuuaauuucucuugguguuaguuggcuguggccacaguguguuuaagaaacaacuagagaagggagaacuuccauggcuugcaguuucagaggugucaucuguggggagggcaggcaggacaaggcagcuccaugcuuggaaagaaaggaaguccugcugcccacugcuuucuucucuuccaccugaccucuccagucuccagcucccaggauguguaucuguggcucugugucuggggcaugugucccacccuguacacacccacagggaucucccuggucaugcucacagggaagauuuaacugccacagucuuuuucagucucuuuuguuuauccucauuaaaauauguacauuguuuaaaauuauuaauuauauaaguauacauauauauauaaauauaacauuuaggcugaaguaauuguauuacauuuuaagcauuauaaacucaagguuauagaccuaugggcaauuuuauuugcaauuauauuauccaguucugucuucccuuccaucauuucucacccuauucuuuuggaauacccauguacaguccuuugaaauacuacuagcuuuaauuccuuuacuaaauuuaacuuccuguuuaaaaauaccaauucuugguaguguggaucuuuuuuguguucauauuguauacuauuuaaagaaaaauaaccuaugaaaauccaaacagcuuaaaaaggagaagacaguacuguucuuaagaucuaugucauguauauauacauacauauguauguauguguguauguaucucacguguguuaaauguauacguuuauaauauauuuaauguaguauaagcauaauauguguuaaauaugacuuauuaaaauauagauuaaaaugugauuuagguaaaauuuaggugaauuuacaugaagucauaugaaaauauguuaaguacaucugucauugaaaacuguuuaauuuugcuucucuucaucuucaucuuuccccucagggauuugucccugggcuguuuggaacaucacauggugcccuucaguuuauggcauaugaguugcuaaaguugaaguacaacaaacacaucaauagauuaccggaagcccagcugguaagauaauuauuuuaaagucaugucauuuacuuuugugagcacuaaguaggucgagguuuuuacaauguguuuacuuugacaacauugcuaucacaauaaauauucugucacuaauuuaacuaauaguuaaauauuuuauaagcugauggcacagauguuaaauagaaccccauauuaaauagaccucguguuaaagagauaaugguauuuuuuuagauuuuuuuuuuuuuuuuaauguacuuuuugcuuuuaaagugauccugugccaggcggugguggcacaugccuuuaaucccagcacuugggaggcagaggcaggcggauuucugaguucaaggccagccuggucuacaaagugaguucuaggacagccagagcuauacagagaaacccugucuugaaaaacccaaaaaaauaaaaaaauaaaaauacagugauccugcuuguguucucauuuuagaguacagcagaauacaucucugucgcagcgcuauccaaaauauuugccguagcagcaacauacccguaucagguugugagagcccgccuucaggaucagcaugugucuuauggugguguaacagaugugaucacaaagacguggaggugagagcaugcgaggggacaucagagcugccccaggauuauccugcgugcccagacuguucacuccauacuaguuucuaggacuugucuggccagucugcuguggaaaagaugaguguggcuguccuugcuuuccuuauacuuguauaugucaugguaaaacaaugucucugaagccugauuuccucauuucuaaaauaagacuguuugggcucacagaguuguuacugggggaaaaaaacaaaacaacaacaacaacaacaaaaaaaaccagaaauaagugcuuugaaaagauaucagcacagaauuuaaaucucaaaauauuugauuggcauuagaugugaguaggcagaaagcuaguuaaauuuguuugaaacggccuguaucuacuacuggugcugugacuucuacaaguucuugucucugaguagaagagauuaugcaugagaauaaucagauuauuauaaguagacuucccuugcauuucccuuuaauucuaaaaguccugaagagacuguguuugaauuuaguucacuauuugaagcaggagcaggggcugacucugacuacauugccugccuuuggcuccccuuccccuagcugggcggccuugucuagccucaauagaagaugagccuagucuuagugcagcuugcuucauaugccacggcugguuggugucaugggaggccugcucuuuucugaagagaaauggcggaguggauguggggcgagaggagaugugggguaagaacuaggaggagggaggaggaaggggagacuacagugggaauauaaaauuaauuauuuuuaaaaagagauccuggaaaucuauauauuaacuuacuaggcuuuuacccuauuuuagguacuaacgaaauaacauuuuauuuuuauaugagcuauauuuaguuuuguguaccacauaucaauuaugaggucauggacauacuguuugcaaacaagcauguuuguuugagauagagucuuuggaauacagcucucauuagcauggugcucagugucucguccaggcugacuugauaggcguuagacuuguagcaaucccuccugccucaucgcccuccucagaacuaagauuauaggccugaaccaccacaccuggcugccaugaaagaugguuaaguuagaucuguuuugucagcuuugucauucacuuaaaaacaucugaaugcaucacuaaaaauacaguacuguacaguuguguuuuaagguguccuugccucauaaggauuuauaaagagcucauaaaugauaucccuucaagguaucauacagugguuucagcccaccuguaaguggggcgagacuugacugccucuucugugcucugugcuaaugaagucacacuggcugcuuaggauaguaaguguguaucucuucuuuaaaggaaagaaggcaucgguggauuuuacaaaggaauugcccccaaucucauuagagugacuccagccugcugcaucaccuuugugguuuaugaaaaugucucucacuuuuuauaugaccuuagagaaaagaaagugagcuaaaagaagaucccagucuauguucuugaggcaacagcaaaguccuuuguguuugaagcgcaaagcucagaagaguucugcagagcuacauagcugguaaccccaugucuguguuacaagugaaagaacugcuaagucaucuugaugucuucugcucuuugcaucuccguguguguggagcuuggcagccucuaccuggaguggguaccaucugccugacguugcaacugauagccacggcgaaaauguacaggaucuuccauuuuguuauucagggagaagcucauuugcaauauuuguaaauaauuugaugaauguucuuuuuuucugaacucucuugccuggauuggcuuuaaaacugaccaugugcaauagcaaggaacuggcuucuuacaagaaugacuauauuucaaggguaaauuaaacuuggggaacuuauaauaagguauuaucuaacucuagcccauuuugaauggggauauuuuuguuagaaagaagucuguuauagacgugcuuuaguuuuaauccaacuggaacauacuaaguacagaaauuggagaagucauggauuucucugagaaauaucuagcaccuuuugccauuccauugcuuaauuauuuacagugagauucuggacgcagaccuuguauuuuggccauaaacacuuagugugugguuaggguguauaaaaccugaacuugcaggauccggugaagccuuuauuuagcauguguggcuacaaaucacucaucagaaaugcuggcucauguuucacagagauggaauguuugauguaagcuuguugaaaaacugaauagaaacaagcauucuaguuucccuucauuuuuagauuuaugguuccagauuccaaauaauuauuugucugcauugguugcucaaauucagguugaaauacaaauuacauuugucuguggccauuacugguuugauuucuaagucauuguagaucuccagguaaaaggccugcucccgaaggaugcuagacuaauacuaacucuucugaugagcaacugucaguacuguugcacuagccucuauuuuuuguaaauaaaucauuauaaucaaagcuguauuuaaaggguucuuugaaaauaagccuauuuuuuuauauuuugcaaauggaauuguuuuuaaaauaaaaaaugaaaagauaauuuauauuuacaaaaaugguguuugcuauaauauccuuuaccuuuauuuuuuaaguauguuuguuuauucagcaaaauugauacauuuuaaaaucacgauacacuguaacaaaaagcaaguuuuucagcauuuacaaauuccuggcauauaacucuuugaaauuuggggacaaugaaucaauauuuccaggaauucuuagaaauuucaaaauuacuauuuuaaacacagucaugacuauaucuacacuuuauuuggguaucucaaauuuuuguuacagaauaaaauacacugaauuuaguguaaguuaguuacuuauauaguaaguaaauacaaagaacuacagccuacaggaauauuuaaacaaugagaaauauaauuugcaauucagaucucccagguaaauaacuucagaauguuuuauaaauuaugcauuucguaguugcaugggguucaccuugauacuuaugucuguaugggaaggcaagcuaugguugauauuaaaguuuuagaaguagaacaaucacuugaguucuaucugccucaaauuaauaagacaauucuuauccucugaaagauuauaaacgugcauaauaaauguguuacugcagcuuucuguugacauaugaacaugcaggguagguaauacaguguccuguaagagcucugcuacuuauucagccacgaacuugggguacuuccucuguguuggggggacugcugggcacugacgggcacugacagcauagcaguaagcaagcuaauggagcucaugauaaaggacacauauaugcauaguagaguuauggguauugaaggcuauaacacaaaagccagagugagagugauguugccacguuagguaggggaguaugagaaguauccuggcccugaagcaggaauuaagcuggcuagaggagagcagauugaagauggggccauugcaguuuguugagauuacagguuggagaaucaggcucacuucagau

SEQ ID NO: 7741 - RNA, 33994 nt, Mus musculus
cugcggagccacgugacaggaagcccgcggaaggcggaaguagugugucugcgugcuggccccgguaagucgagcccgguuuaaaggcucguggaguccgacacccagagccgccaagaugaaggugaaaaugcugagccgaaacccugacaacuauguccgcgaaaccaagcuggacauacaaagaggugagaggaacuggaacagaggaaggggccuccucccggauucuuugggucuggccagcuuucgagcaguaaaaggggcgggaggccagcgcucuggucucgguuucccucuccgccuaggcggcugcguccacacggggcuggugaggaucagaacugcagauggcacauaccucuacguccuuugugagaauuuuccucuagugggaaguaguuacguauacacgccuuuaaucccagcacuugggaggcagaggcaggcggauuucugaguucaaggccagccuggucuacagagugaguuccaggacagccggggcuacagagagaaacccugucugcguuacuaaagguucucucuccucccccuagcauugcuaacgugugguauauggcccccccccccagcucccaagguguuuuacaugguaauaauuucuuuucuuuuuuuuuuuuuugguaauauuucuuaaaugaaaaguagauuuguccccagaguuugacguuaauuauuuugaaucuuugaaccucauuacuuuuuuuuuucuuccacuuucaccaaacagugcauugcuggauggagcugucaugguuuauagugcuuggcccagggaguggccuuguuggaguaggugugucacugugggugagagcuuuaauacccuaguccuagcugccuagcagaaaguauucuccuagcagccuucagaugaagcuguagaacaacucucagcuccuccugcaccaugccugccuagauuuuaccauguucucaccuugaugauaauggacugaaccucugaaccuguaagccagccccaacuaaauguuguccuuauaagaguugccuuggucguggugucugcucacagcaguaaaacccuaacuaagacaguggcuuacguuacccuugccaaugugggugcauuucaggcuuugucuuggagcuauacuuauguacguaucuuuacauacuuaucccuacaagugcccuccauccugcgcaucaguguccucuucuguguuuucaguacacauuguuuggauuugucagugcuuaucacauuaucucaugguucaugcugauuagcaggcuuuccuaucagcuugaaaagagaggaaagaauccuauuccuauaugcaguguuuagacaauaacucacauaaauagcuacuuuguaaguaucggaaugaaugaaugaaugggugacagcugggacacagaaucuuaugcuaggagauacaacucuacuuuauaguaacaucuuuuuucaacaguaucucccuauuuuuauuuauuuauuuauuuguguuguuuuguuuuuguuuuuucguuuuucucgagacaggguuucucuguauagcccuggcuguccuggaacucacuuuguagaccaagcuggccucggaacucagaaauccaccugccuccgccucccaagugcugggacuaaaggcgugcgccgccaccaccacccggcuauuuuuauuuuuauaauagaaauauaauagcaaaacagaaaauaaaauuuuuggagugcuuuaaaauauaaagcaagaaacacaucuguuauauuuuauuuaguguuauuuccuuguaaguuuucugcaggauuuaaauucuggguaaguacuggugaagcuuuauuguugaaauauccucgauaguucugaugugucuaguuaauguguaagagcaccuuacacaaauauaugugguuuuauaugaguuuuaagcuaucauacccagcgcuuaugauguauggcaggugcugcacuaguguuaguugcuucugugugacuagaugagggaaguuggaaguggauacagcgauuaugauuuagaagauaaaaugaauauuuucaaggggugugagguuuggguagaugugggugaagguuaaguccugcuagaaaggcugcugcauaggaggaaaugcaagguggguuaggugacagggagugaaggugcuugagcugagcuccaggaaguacccgaagcugaugagacagcgagacugaauuauagaagaccauaagggggcuugaacuuaguucucuaccucuacaaguagguguuuagaugcuacauuacaauacagggauacaguuagaacaucaguguggauuuucuaucuuuaaaaacaaacaaacaaacaacccaacugaaccaagcuuggugguucaagccuuuaauuccaguacuccagagacagaggcagacagaucucugaguuccagccuagccuggucuacauagugaguuccaggccagccagggauacauaguggacccuguuuacagacaaacauggcccucuaauaccuguuuaugugauaucuaaugaacuuacagccucauuucagccguauguuguguuuccggggaagaauaguguugacaaggggggacuggcuucugccuuuagaauaguguaguauauuacagccuacaucuguugugugguauagugauuuauagaaggaaagguaagauuguaaaaacauuuguuguagcagaaguaccuugacuuaauuauggcaaaguucuaagaaugaccuaacuaugaauuguuucugaaauuguuaagcuuuucuguaguuaugaauauuaaauagcaugcuuucucuuuugacuuuuaaaagaaaauaaaguauauaaucuauuccaaguucuuuucccccuuuuauuuguuuuugagacagguguguuuuuguuuuuuauucuuuaaucuuuuuuuacaguccagacuucaucccccucccagcccacccuccaacaucccacacccugccuccucugcaagaggaugucgcugcuccaccccaaccccaucagaccucccuacucccuggggcccaagccucugcaguguuaggugcaucuucucugacugaguccagacccagcaguccucugcucuauauguguugggggccucauaucgcuaguguaugcugccugguugguggcucagugucugagagaucucagggguccagguuaguugauacugcugguuuucuuauggggucgcccuccucagcuccuuccagcuuuucccuaauucaaacacaggggucaccaacuucuguccauugguuggguguaaauaucugcaugugacucuuucagcuguuuguuggggcuuuuggagagcaaucaugauaggcccuuguuuguaagcacaccauagcaucaguaauagugucaggccuuggggcuucccccugagcuggaucucaauuugggccugucacuggaccuccuuuuccucaggcuuuucuccauuuuucuuccuguaguucuuuuaggcaggagcaauucuggguaggaguuuuugacugugggauggcaaccccaucccucaacuugaugcccugucuuuuuacuggagguagacuuucuccaucauaguucccucucuccaucauagggcauuucgucuaaggucccucccuuugaguccugagaaucucucaccucccaggucucugguacauucuagaggguccucccaccccuuaccucccuagguugccuguuuccauucuuucugcuggcccucagagcuucaguccucugucuagacuggaauuuucuguauggaccacuggccuuaagcuucuacaaaugcaccugccucugccucaagagcacugggauuaaagguuuguagcaccagugcagcuuuuccaaguccauuuuaaugauaagugaggaaauugcuuuaaaaaaaaacaaaaaacugugcuguucagagauucuuuugaaaauccaugcuuggaaauguguuuucuaguuaaaaacucuuguacugaacauguuguuuauuaaugaugauguaguuugucuacaagaaaauuuuuggaaacagcaugaccuaccuucuuuuaauuauuaaaguaucaguuggagaaacagcuguugauaucacaggagaucaaacauuucuaaacacacuuuaaaaauagcuuuugcaaaccugauggaaaugaccgaaaaguaaauguacuaaauaaauauugccagcucaagagcuguugaugucagugugaacagcuuuccuauccccggaucugcuuaguuuugccagguguagucaguucucacuuuguucagcacuauaugaacuaaaccagugagagggucaccaugacugcagucaccuguacaccacagaaaaccaugccagcaagaccucaguugcugucugccagcaucccauuaacauagcacuacgcggaaaucagugaagcuuucuccacuaaaaccagauguuaagacacauuucuccaaauguguugaauuuuucuuucagggggcuuaauuggaaacaaaguuuugaugaaaaccaagcaucuuuaauacaugcuuguacuaaauacaucaguucaaaaaccauguuacagagccaggcgugguggcgcacgccuuuaaucccagcacuugggaggcagaggcagguggauuucugaguucgaggccagccuggucuacagagugaguuccaggacagccagggcuacacagagaaacccugucucaaaauaaacaaacaagcaaacauguugcaaugagacauacagucuaaagguuugaggacuacugcagagagucuuuaaaagauuuugcuuaugaggauggcaugugcuugauuaaucugauaaccguuuaaacugcugccaaaucaaguagggugaaacaguagcaguaguccagguguacgguacuaagggcuaacgcuaaguuagcagauccccuggagaaaaggggagcauuacuguugauuucagugaggaugaguguuugagcuucgggauuggagacuggagcauggaauucaggaauggccaggguuugagcuuuauguuugagcauguuggauauggagucagaaagcaaagacuuucccaagaagggaaaguguauguacuguuacacguugaguuugguuauacgugggauuagaguaagauaacuuguuuggcagacuaguuaagaaagaacaugacucagaggcagguuacuuguccccucuguaacucaguuucacaacuauaaaguggaagauaggaauagauguaacccgugagguacuugggagagaaugugaguuacagcaucguguggaagucagugaauucucugucaaugcuuucaaguaagggagcaaauguagaguuauguucuauaguaacgccacaguguugugugucucucagugcagugccuagcaccaugagcaucuagcacaagcagcauggcguuuaguuaaacagaaguucaucacaguacuugacuggguuccagauacugugcugcgcauaggagugcaacugaaagcuguguuggaaccccgacucaugugaaaggucacauacccaguugaauuugguaggacauguagaaggaaaacuaugugugugcauguauauagaaucuacuuguacaggacuauauauuucaugauuuucccauaguuuugauaagguuuguaagugacuaguguacuuuuguaucuuucauagugcuuggcaaaaaauaauaucccuaauuaaaggcuuauugaguaacagauuacaugauuuagcuggggcuuuccacaggaaguaguaaaugugaauauguuauucagagcgauuguucuuauuucagucccaagaaacuaugaucccacuuuacauccuuuugaagucccacgagaauaugugagagcuuuaaaugcuaccaaguuggaacgaguguuugcaaagccguuccuugcuucccuggauggucaccgugauggagucaauugccuggcaaagcauccaaagagccuggcuucuguccuuucuggggcaugugauggagaggcaaguugaaaaucuuguuuuaaacuagcacacucuauuacaaaccucuuuccuuuugacuacucucaguuugacuucaguuuaauucuuaaacugauuuaguuuuccaucuaaucuuaaaauggugucaguucagugguguaagguuccauuuaacaguauauaaauuuaucauguuuguaauaaagguauuugaauuuuucacaguuauuauugauaagcaaacacuuaauuuccuaaucugguagaaucagcagaauauuugacagguugaauuuucuguuguugauacauuuguccauaugcaguacauuauuauaauccaaaggauuuugguuuuagugcuugguauacagugacucauagccuuuucaauguggaauuucuaaaauauuuuacauuuagaguucucugaauuuucuguuuuaucauagguuaaaauuuggaaucugacuaaacgaaaauguauccgaacaauacaagcacaugaagguuuugugcggggaaugugcacucgcuuuuguggcacuucuuuuuuuacuguaaguguacuauuaacucauuaaggcccuucuucaacuucacaggaaagaucuaauugcauaaauuauuuucaaguucauuuauuuguuccaaggaccuuuggagcgcauuuuagacaguucauucaaccugggaaaguccuaguuuucuuuuaaguaauccagccuuacucauacuuacuauuuuuugcuuuuuuauaaguaaguacuuaacgccauugaaaaaauauccuaagcaucgagagguaugauuaaugggaauucacgcaaugauugacuuucuguggaaaauguuuagugcuaagaugaauaauuuguauuuugucagcaaggacuuacuggaaaguaugugcacagggaagaauaaauaccuaguguauuugccauuuuaaccgauuuugaguguacaauuuagugacauuugguaugcuuauaucauugugcuaccaucaccaucauccuuauccacuuucagaguguaccuguguauucauuagcaguagcucccguacucuccuuguagcccauacccuagcagcucuucuacuuuuguuucucagaauuugguuauccuaggugcuccacaaaaguagaaucauaugauuuuuguaugugcaguugcuuaggccuuacucaauuagcaugaugaagucaagguuaucugugagguagcauauguuagaaaaguuauuuuuuugaaguugcauaauauuaacauugauguauuuauaccacauuucuuaacccauucauuuaucaaugaacuuuuaguuuauuucuacccuuuagcuauuaugaguaaugcugcugugaacauugauguaucuauacuaguucaaguucacugaugguuuuauaacagaugaacaacagauucccugcugucccugcugugcuuugagaugauggcucugaaagcaguaaauguucagcuuguaggcaauguucauuguuugcauagacaauaauugggggauaccugguaaauaaaaccuauaaaaaauaguggucggguuggauaaugaugagccugucagaugacugagaugacccuggaugacagucauuccugucauggaaaggagaagccagcaguuaccagcaugguuagaggagaggaagggucuggugugaugaacuggacucacuacaaguuauuucugugaagcugacuguccuuuauaggugaaguucugggacauagaagaaaagucagaacuuacccuggcaucaucacuauggaauugaugauugagaguauaguaugacaucaguaugaggaaaauauaaaaauaaaugaugucacggguguggcacugcagcaugucucuccuuaacaaggaagcacaguggccccagagcaguuagaacugcgugacacagugaguaugccacauaugguaaaaggcauuggguggcaagcuggagcugcugccagcuaaggcuuauguucccccaguuggcauucucuggauauuugaauuguuacaauaauauccuagccagaauauuuacaauauguuuuugcccuuuuuuauggagcuggagaucaaacagacugcauaguagacaagacucuaucauuaaacuucauucucaacccuacugaaaaauuuugggggguaugugguuauauuuuaaagcauucaaaaugaauaaagccuucuuaaguauccaucaacagaugaauauauauagaaauuuuugcuguauugauauauucaaccauuaaaaaaaaggggaaauccugucuuuugcagcaguguagauggaugcuaugcuguaugauauaagccagcaacaaaaagaacacuacagcaucucacuuuuauauagacuauaaaaggucaaacacuuuacuccuauauuggaagcuacaggggaagaggcuaagaagacguucugagaauguacacuuugagauggcagaagaaguaaauguaugugacgcauuaauagaaauguacauuuuaaacuaaagccuggaauauggugcaguuugagcaucacuaauaaaucugaaaucuagaacaggccuuugagccaucagcaugaugcuggaagcggaaggccaugaaacuguuucauauacaaagaauuaaaacuguuguaugaaauaaucuucaguuaauggaucugaaaaguuuggccuugagucuccuucccaaauaguuccuuagguaccugcgugugaguacugcaaagugcagaguacuucugguuccaugguuguuuguguuauuaaccacaagccacacuauauugcauauuauagguugaguucuuacuucaucugucucagacauggcugcuaaauauccaaguccacaguuuuuugacucacuuugauuugggcugagguaacaccaguaaucaucauuauguuuccauaucucuaacuuuggcacagugagaagaugaucuuguaggagggcuucuccagaggucuguaguuggguuugaaagcugcuaagugaguagcugggugacagcagagaagggcccugucuacuuuaagauuauacaacagugccuucucaugaguauuuucaucuuuuccuuuuuugcauuuuaaaugaucugagauuuauuguguauuauauuguauggcauuggcucaacuuucuuuguucaucuuuauauguauguggcgugugcauguauauguauucauaugaauuaucaugugcguagaggccucaguaucagucuccuucucauagcucugacuggagggcaaguccuccgagcagucuugcuuucaggauccccugagucugaguucuaaggcugaaauuacuagccagcugccaugccuacacagcauuuacauugguucuagggauugcucuucuugcuugcaggggaaaugcuuuaauugcugagcagucuccccagccccugcuuuuguguuuuguuuugaggcaaggucuuacuauauagccuuggcuugucugaaacucacuauguagaccugacuggccuuaaacucacagagauccaccugccucugccuccuuacagcuaggauuaaaaaguguguuccaccacauugguaaaagauuuagaaucaaaacucuuuuaugaguauauguucauggagcacaugccugcaggugaggucggaagaaagcaucugagucuuuagaguuagcggcaucugugagccgucugauaaggaaacccagccccagcccucugcaagagcaccaaguucuuagccucggaguuuucucuccagcccgucccacugcuccucaguguuuggcuuggcuuuuguuuuguuucuugagagagaggauagugagucauccuccagcucacuauguagccuauacuggcuuuaaacucaccauccucuugccuuaaccucuugaaugcuggaauuauaggugugugccaccaaaccagggucagaccuuuccaaaugauuaaucuuauauuccaauacccauauuauaauaauauguuuuuuguucugauuugaaauacuguucuuauguggccuaacuuugaucuguucuuauccuuuugcuuuacucauacuggggaguuuuguuuguuuguuuugcuguggguuuuuugugcuuuauguauuuguuauaaauuuuuguuaugcuaaaguaggaaauaaauggaucaauaaaugugaaaaugaaagaaugauauauguuacuauuugaaaugagauacuuggcaauuugauauuuguguuuacaauuauuggucauuagaaucaucauaaaauaacugugccuagguuggagaugacaaaacugugaagcaguggaaaauggauggaccaggcuauggagaggaggaggagccguuguacacaguauuaggaaagguacaaaacacauugaauaaugcuugguauauuaaaauucuuuaucuuuuuuuuuuuuauaauuccagcugagaggguuuauuugaauaauuggccgcuaaaacaagguuuaaaaguaacauuuuauauaauuaagguucuuugaagcuaaagaauaugaacaacucuuuguaguagaguguguucuuuguaauagagucugauuucucuguagcuaauaaauacuggcuguauuaggccuuacaagucauauagggguugcaaugaaauaguucuuaaaggaaggccacagaagaaacuguaagauaaauguuuggaaaauaauggcuuaguuucucucuuguuuacaucaucauagaucuuauacucagaauuucucaaagaaacauggaguggugugugcuucuucuauagucuuacacuucuaacaaauuguucuccaagucagaugggguucaguuacagccuaagagugauuuggaauauuuggcuuacaugucuuacauaaugaaagcucauagucuuaaaucaagcagacacaauucugaaguuagguuuaauuuuuagauaugugcauuugaaagccaccauuuauuucauuauuacacuaguguauauguaggugauguuucagguuucaacaaauucucaauauucuuaaagggagauggaaguaggauauguguacaagauggaaaaauguccaggugguaacagacuaggaauuucacagcaaacuugguuucauuuuuauaauaugccuuagcauuuuaugauacuuuugcccuuuaaggaagggcuucaaagaauuucuuuagacuuccccucaggggagauaccgugguuaguugccaacccggugacuaucaaauguaggcaacucaguuacacaauuuguagcaaaauguggugggagaagaggaaagaaguuucuuuguagcaagaauuucuuuuuuaaacaauuguuuucaauaugccgauuuaaaguaguaaugaaccucugugccacccucuuugcuuuuacagacaguauauacuggcauugaucaucacuggaaagacccagucuuugccacuuguggacagcaaguagacauuugggaugaacaaagaaccagcccugugugcucaaugaacuggggauuugacagcauaaguaguguuaaauuuaacccuguugagguaauguucuuuuuaauaauauguucuauuuauuguucgacaugaaauuuuaucucuguuuaggaaacauuuucuacauugacuuucuagcauuuaguaagguuuucaggcuaugucuguguuuugugaaauuucagcugcuccucagaguagacuccaaaugaguacuugucucucuuuuguuuuguuuuugagacagaccuuggauugcacagacuggucuugaacgugggaucucuuuccuaagccucacauucgcuuuucuuuucugugcuuuccaugcuccuauuccaucagguuguacucuugugcucugaggaagauguuccuuuuucuuaagccucuuggaggucaugagagggagcauugggcaugcugguccguguuuggaagucauauggguacccauguuuguaauaguaugcaugacuacuugugggcugcaugauaauuagaguuauuagguuuucuucuuuugcuuuacaaucugaguuucuucuuaguuucuuccuagucuaagugcagacuuggaagucugcuauugcaugcuacguuugcaugugaacuuaagaggggcugaucaggaggcuaauguguccuugggcuccagaucuuucucugaucuuuuucugaauauauaacaagaaaugacccucauuguccagaagacucaguuaagauguguuuucuuuugccucaguguuaauaggaaguuacuauguuaauuucuguaagagaaaauccugaaaugcaaauuucauacucagagacccaacaugguaagagagggaugagaauuaagccagaguaacagaguagcacugacuguucacgugauguuauugggacaugaugugcugcgguagagugugaacuuggucuuggaguguugccaagcccugccuuagcaugugccuguguucacguuucugcaugagguuucauacaggucuagagcagggacugccaauauauuccccugcauguuauaaagccuuucuagaacacaagcagacccucuuccuguacugucugcagcugcuuuauaccacaguggaaaaauugaauaauugcucugggaaucacauggcccauuaaaccuaaaauacuuucuuucuggcuuguuauggaaaaaguuuguugaucccuagucuaggacuucugucugagcuauguguuccucgaugcagccucccucucacuucccuguguucacuuuggcuguggaagugaggucuggccuugagagguaagccagcuuuacagagcauggccacagacgagagauaagaacaggcuauagauacaaauaauguuaaagccugccuuaccaccucccucauccaagucauaagucucuguauuuauuuauuuuaaaauaagugaugauaucucugauuguacuuuacagguuuauuaugagcauaaauugugaugacauauaugaacauuuaaaacaaggguuacuuaaguacaagauggcaguuugucauuaccaaaacagcaguaaaucagacagauagugagagugauuuuuaccuuuuggaaggacagauaaaugcuuacuuuucuauuuugaugaacguguuagaagagcugaugacuaauuuuuaaaucauaauuacugguuauggccuuucgacuguauuuuucagacuugccauuuaauagcucuauuugucuacuggcuuuuuuuuuuuaaucuuaugaauugacuuagugauaaaagcacaugucucuuacccuguauuaaagcuaauggaaagggcagggcagauugcugugaacaaauagaguauaguuauuuccucuauccaucaauaauuaauuuucuguuaaaauauuaaggccuaacauucugguaaagccagaaguuaguacugaggguugccauauuuugcagugugaaaguuuacauucagucuauguggaacuuuuugcuauguucagaucaaagucuuuguuuuagaaauugacccuggucuuuacuaaagguaacauuauaaaaagccaguaaggguuaagagguuaaggggcaacuaaaggugguuuucaaagcuuuuuuuuuuuucuuuuuuucuuuuugagacaagauuuugagaagaagggagcccagauuauaaacauuaguuuaugauauuuuauuuaaacuguggcacacagaaggaguuagcuggcccuauggcuauuuaguaaauaacucuugcugcuuuguuugcaauaggaaguaacauuaggcagaagccaagaauuaugguaccuggauccgugaauaaggaaaaauaguguuacagagugggaccccgaguuggagaagugguuaguggguaaaagugccugcuguauaagcauauggacugauuuugggucccggcaccuauguaaacgcuaagcauggugggaugccuguaaccuacauuagggguggcgacagggaucccagggauucgccaguuagcuuuuagccaaaauggugagcugcagggucagugagaggcugucucagaaaauaaggggauggauggguagggggacugaagaggugaugcagugguuaggaguacuugguguuaggagaccuggauuuggugcccagcccccgcaugcugacucacagccgucuguaauuucugucccaagggauccagcacccucuucugaguccagcagcacacaaucauacaugcugacaaaacaguuguucacauaagauaaaugaauccuaaaagggcuuuauaauuauaaaaugaggggcuuaggagauggagagacgacucaguagguaagcacacuugccuacaugccgucagccucaagucugaguuugauuccuggaacccauaugguagacacgucuguaagggaauugaguguuuaagaaauauugucauauagagcauuuaaacaacuaccugauuucauucaguuauaauaaaagcuacauucucacauuacagucauauuguuauacuuucaaaagauaaccagacuuaaaugucaaaagucauaaaguuguuuauacuuuugauucacuagugcuacuccugaaauuuuauguuaaggaaacaauucaaaagaagaguuuaaaugaagaauuaaaauuuuacugaaguguuacuuauaauagucaaaagcuguuacucagucuuaaauugaagagcagguaaguaaauuguguucugcuauaaauagaacacacgguuauuaguggagauugaaccaugaauauacuuuacuuagcugagauuaugggugauguauuauguccucauaaagugggauugaguguaacagcuugagggucuaacauagauauuaaagauaauuaaauaauuugugcuuugaauggauaucauuugcuuccaacguuggcuuuuaauugguaauuguuucaauuauuuuuagacauuucucuugggaaguugugcuucugauaggaauauaguacuguaugauaugcggcaagcuacuccuuugaaaaaggugaguuucggucgugucuuugcuuuauacaauuaaggcauucuguauaucaagugacuggaaaaaauggaaucaucucauaguucuguucuucuucacagagcugcucucuagccccacaaugaugguaguagcauucaacucuccaucgauuuuagacucuguuucuuugugacuuccauaaugcugguacauuuuaggcaucuaauuaauacacuaaauugaaacuuuuaaaguaaaagguauuugggggagggggcuugauuaucacaugccauauccguuuuauucaaaaguuuuagagcucauucacauaaugaacuaauuuaauuauaugcugauauuaguuugagucuuugcuuagacaaguacuaucuuguugaugagaggcuuuuuaguagucauuucauucacuguggucauuucaagacuuagauaucaaagcuaguacuuccuuaugcugacuuucgagagagagaacuauuguuugcauauugaauggacuaucauuuuaagcagaguauaaaguugauaucaaacauuuguaguauugcuagaacagaagaagggguagauaucauuuaugcaccaugaauccauuagcacaguuuacauauaaaagaaaaauuuuuuuuccagcuagauguagugguucaggucuauagucuuaacauuugcuaggugaaggcaggauaaucaggaagucaaggucauucuugaaacacacugaguuccaggccagccugggcuucauaagacucugucaagacuaagaaaacacaaaacauuuuuuaauguguugauaaauucagaaauaguaaaaguaggaagaaugaaauuaguguguucacuauuaauuaaaaguaaaaaucuggguuagugauggcucagugguuaagagcacugacgacuuuaucagagguccuaaguucaauucccagcaacacaugguggcucacaaccaucuguaaugggaucugauggccucuucuggugggucugaagacagcuacaguguacucauauaaauaaaacaaauuaauuuuuaaaauguauaaauuuaguugcucauuugugugauacgugaacgccacugucuauuucuuuuguaaaauggugguaccuugcaguucauuuauauauauauauauauauauauauauauauauauauauuauacaagugagguaggaugcguuuuaguaguuagcagagugcugacaagaaguucuaguuuacuauauaagagucuuugguaaauacacacgucuacaugcacuuugguuuuagggaguuacauuugcuguaaaguagagaagacgaccuagccuggcauucagugcacucauaagcugagcccaauuugcauugcauucauuuguuuguuuuaaacagugagacagugcuuaauugggguuugucacaugaacauaguaauaggcacugcuaccuuuucuuggguuuugauguuauuuauuuucaagacaggaucucauucugcagcucugacuguccuggaacucacuguguagaccaggcugcccucacacuggaacucacuguguagaccaggcugcccucacacugacagagaucugccugccucugcucccagggcugggauuagggacgugcaccaccacauccagcuuuauuauuguuauuguuguuauuauuaucgcuaucauuauaaucugguaggcauuacauuuguaguaauucuccuccuuaccaagaaaguuuugaaaucaugaaaggaguagucagugggcaagugccugagagagagugagcuuuguacaguaaauguggguuuuucuuuccuucuccccaguaccauugcauugagaaacacuacaaguuaccagucaucaaaggucuuuucagacccugccuugugaaaccuuucuucugaacuuuaacccuaagcucaccauugauuuuguaccuauuuauguugucauuuguugcuuuauuauuuauagcuuuaauuuuuuuuuuaauauaugcuucaguuuccaacuaaacuguuagccauuugagguuuaggggcuaggcguuaaauauuguuuuguucauacuacagugucuuucucagagaacagucacugacuucuuuauccacuguucugcauugugcacugugcauaugaaaguauuagcuaaaaucagaaaaaaaguagaaaguuuauucauuuuguguauauuaguucuguaguaaugggauaauguuaccuuccuuucuuagguuauccuggaaaugaggacaaauacaaucuguuggaacccuauggaagcuuucaauuuuacugcagcaaaugaagacuauaaguaaggucucuccuuuuagaaacauauuccuaacaaaaauggcuccuucacauugccuuguuaauauaauguauuucauuugguaaauaagcuuucauauauuuugcuaaaaauaauuucccaaauuggagaagagauuuuuagaaaguauuuucucagauuuuagcauaacuuagacaaagaauaguaaacugccaccugugaugagcccuuugcacaguucuugcuauggugcgcuuuugcuuacuuccugguuauggcugcuuauauucuguaaugcuuggaugguuagagaaaauaaaucauggcucacuugcccaaacagaagaaacugaaugcucucucauguaggccauuuaaauagugacaagaccagcagguauggaggugcauaucuguuucccuagugcucucgagguugaggcaggaggauugaguuugaggcuacccaggauuauguggcauguucacggccagcugggauucuaccggaaaacauuguuugagaacaaacaaauaaauuugagcaaguagugcuuggcccauucaugcuuucuuagaaacaaucucuucuucacaaguacuugugacuccuccagugaugaccauguagucagacugucugcugucaggaaaacagccagagugguaguagauuuuagcuucacauuugcagauacuuccugugccuguaaaguuggauuagcagacuuguuaugaacucugagauuuuaugauuccuuauguagugcuuugcucuuguugacauugaacauugcugucucauguuaucucuuuacuauugcaaucagauaaaauuuacaaaccagagagguuaaucuagugaaauuauguaucagccuuuuauguuuuuaauguguuuuauucuuuuaaguacauucuuaauauaccuuuugagaagguacaagcuuguuaguacauuugaccuuuagauauucucuuuuuaaaauuugaccaccacgggcuggagagauggcucagcaguuuagaggacgugauaucuugcagaggaauucuguucucagccuccacauuaggcaccucacaaucaaccaccuguaacuugugucucaggaaugugaugcccucuucuggcuucugccggcgccugcacuuguguagugcacauagagauaaggaagcacacacacacacacacacacacacacacacacacacacauaaguaaagaguaaguguccaguguaugugacagcucauacacggaccacaggcugcuuucacccaggaacugaagcucucaggauuucccagacugagacggagcagaggugauuccuuaaucagcaaugcccagccgcguugaagccuuugcuuacuguaauggaugcuuugaaauaaaaugguccuguuaccauugaaggcaguaaaagacaagagaacacugcagcauggugaccuaagcuaagauuuccaaaguacacugugagcuaguuguuuccccagaucaucucuuuucagagccgcuuuggaauuucucuuuucuucccuuggaaagauuauauacaguuccuaaaacaugucucuuaaaagaaauagcugcuaguuuucccuaauuguccuuauuuuugaaauauucuuguuggcugucaugacauaugucuguaaucacacacugggaaagcuggggcaagcaggaagaggaguugaggaaaaacuggguacagggcugacgggccacaugaagguuucuccaggcgacagggaucccucugugcugucuguuuucuaucuucauuuuuuuuuguugucuccggccagcggaucacauuucuggguucuagccuggaaaggcaucuuggaaaccuggaagagaagaguggcuuggcggugugagagaaagauggagcuaagacagucauccugaucaaagcucaauuuuacuauuccuauacucaguuaugaaggagggggaggggccgauucccgccaaauaauccagggguccaguaguagggugaccacauguauggcuccagaacagcaaagcggcagguuccagcagagggcguggcagaacgauugagcagcaagcuccaccccugagcaaacagguuucaggcugagggggugggggagguuacaucuccucccuguuguuaauaaaaaaaaaaaaaaaaagaaaaggcuggccugagguaaaaaauuuaucuauguucaauaguucugccugaauuuuuagggcuaaagaaaaaaaaccugucaccaugggaccauaucuggauaagacuguccuuucuguccuaguaaacaacuaacagaauagcccugggcuuuaggcucugacuuuauaauguuaacuaguacugaauagguaacuuccuaguugaauuuuaaauagggcguuggaacccuggcaaagguugacuguaagaauuugaaaugaacuuuauuaugaauaacacugaauggauauuccuccacauuuuuggaugacaggcggaguacagggaggaggggguuaugaccggcuccauaguacagggccaauuggcuuuuuuagggugggagucugugaagggcuugcccuuccaacaguacagucuccaaccucucccccccgcccccaauuaauuaaguuuaauaaggccacgcuuaacugaggugauuaaaugauuuucucaucuguagaugacugggcuuuuaaccuuggcuuggguggaaauugaccccauuccucccgugggugcugucacgacccacaccuguggcucuugguaucuuuuggggaggggaggcagagccuuagaaagauguuuuugguuguaacuggaaauagauaccaaccuccauccaaaccugguguaucucacaaggaacccagaaauggucaagcuggaccuuccccugcaguaaaucucugcaccaagugguaaccauacuguauuuguaugaucacaaaccaguaugcacaguucugaguacugugcagcuccuaaaggagaauugucaaccucagaauuagcaagaccuagacaagaauuaugucauuaguaacaccacgauuuggggcuaaaauaggagcuggaagucauccuccucaucucuguuauucccacagccugaggaacuaaggggaccuugcaguaacacuaaggguggaaaaccagaggccagcuaagggacuaagccugucuaucagaauaaaaaccaaucucuucuaguauagaaauaucugcuuuucuagcccucguaguaaauccaaaucucaaaucagaccuaaaagccacaaaacguguuggaauguccuucgaaugaaaauaacagucggcaccuguacgcucuugggggcggggaugcacgggcugcggucaggcuggaggauguugauuggccugcuugaaaaaacaagaucuagacaaugagaaaguagcaaugcaaaucuuuuuuuuuuuuugggggggggggggaguccagguacuuuauucaguugcaaauuagcaaggcagaagccaagucucugggcugguuuuagaauaguaaaaaggccagagacucucuggaagugggggaugugcucugaauuaacuuugcuagguaauuaagaauauaggaaucucuaauauuggacugaauauuagaccagucuaagauggaguuagaaugacuggucacacugaagaaaagagaaaaaucauuaugacucuauuaaaugacuaaucucacuaagucagaauauacagucucugauguacuauugccauaaaguuaaaagguuugaagcuagucuaaacuggaaaaauggcaagcaaggauggaucuaaaacaugaaucuaauuuaguuucuuagucauuuuaaucagggcacugaguuaacuuaccugccagcucaucacacgaauuaaccaucaugcuucugcagcguucuguggagagaaccuguuuuucccuuuccuaauaagguagcuauuuaggaucagucuauaagccaauaaguagauccuuuuacgaugcuauaaagcauuuauuaaauucuuugacauuuaaauuuuaaaaauugaaaauaaagguaagauuuaaauagugugcaugggaaugcacuaaauaguauguacggggguuuaauuuuucucuuuuuugucuuuuaagaaguuuuaaaguuucacaauaucuaaucuuuugaauuaauaacuuguugacaaaacauuuuaaauacuuggcuguaaagaggcagugacuaauugcacuuucaaucauuucucuuaaggagcgguuguaacuagaaagcuugaaaagcuuauuuauuuauuaacuagaaauaagagcauuuauuuguagcaaauuauuaaguaaagguccucaagaauuaacacuauuauguggaaacaaguaguaucugaggacacuaaaaggaaagaauuauacaugcacaauuuucaagaauacuaaaauauuaucuuaaaccauaacuguuaugaauauacaaagaaugagguuauauauccaaucuauuuuacacggaugacccauagacugagauauaaauuuaucuugacauuguuuuaaaauguccaggcaauuaggacaauuuaauaaaugucucaaaacugccuucuuaaaaggacagcauuuuuucuaugaguuguuuaugcauaagcaauugcaaauuugagaauuaauagcaucugagggacgaacaaucucaagcaauugugaacucagagauauagcauugacuauuaauauacaaauuaaaguuugauuguucagcauuuuaaaacaccaucuacagcacacaacuagauuauuugugcugaaacagggggaacugugugucagugcuccgccccgcagcagcuagcugggcccacaugggccaacgaucggcugggaggaugagaaaaaugacuuuacaauguuuuuucuggccaaggaauugucuugggcacagcuaauauuuaauuaccaaugaauauaauuaauaacaauuauaaaagcuuucuuuauuuuuuuguaaaaacuuuuguaguaaacuaaaacccuaaguaauaaaacauuuuaauaaagagacauuguuuuaaaucuuaucuuuaauuuuacuuuuuaggauaggaaccacauuaauuauuaucuaaacuagaaauaucuuuagagacccagccucuuggccugccuuaugccacgugucggaagacauuaaacuugaguuaucaauuuuaagacuaaccauauguagcaauguaacaauuauuaaucuuaaccaacaacuuaugagcugauugugcagagcacauuaccaauaaaaaagaaccaaaugaagcaguuacauuuagaccaaucagaaaauauuaauuuuucuagcuacaauaauagaauaaaaagcacuuuauuauuugucaaacauauuaaucacgaaccauuuaucagcuuuuuuaccucgaaacuaagaggcuguagacucgcccuuuuuuucuaaaacgaacaguuuuuccagcagggacccuccugccaugugucuguuuccugguugaagcaaguggcagcucucggcuuugcggauaaaguuuuuaugucaucuuuauuauccaacauaaaacauagaacauauucauucauacagacuggacacgaacauacaugaauugaacacgagaacaaauuggugcaccagacauuagacaagacacaaaaggggacagaguacuucugcuauaaggcccagagagaacaaagcaugccacuccugaaauuucucucugcuuuuugggacauuuuccucccacaugaugcaguuuuuuuuuuuuuuuuuaaacugcggccaucugccugauuauuaauuuccuuuuaauaagcccuuucuuuucucacgccuaaaauuguagcuucugagagcuucagcuaaccaccuguuacaguuccuagcuccugaugugccucacugcugauccuaagugaauuagcgcucagguuaaacacuguuucaacuuagcccaugccgaccuucucugguaugaauuuccuuuaauuauuuucuucuauggagcuccaaaccagcaguguuucuuccaaauguccucugccguuucucaguccugcguugguucgccaaauguuguguccggccagcagaucauaugucuggguucuagccuggaaaggcaucuuggaaaccuggaagagaagaguggcuuggcggugugagagaaagauggagcuaagacagucauccugaucaaagcucaauuuuacuauuccuauacucaguuaugaaggagggggaggggccgauucccgccaaauaauccagggguccaguaguagggugaccacauguauggcuccagagcagcaaagcggcagguuccagcagagggcguggcagaacgauugagcagcaagcuccaccccugagcaaacagguuucaggcugagggggugggggaaguuacaauuuuucuuuuaauauuauaauuuugaauuaaaacuauaauucagaucugcaaaagcugauuauucugauagaaaguaggcaaaucauuuaaacgagcucagugcuauggauugguuguaagaaagguuuagaauagagaauugcuugaagaagucccauaacucagaacauuaggcauuucuguccacaugaaauuauuugcuuggaauugaacagauuuguauuuuuuuuuccuccacagaaugacaaaacaguuuguuuaggaaagaaacaauuugcuaaaagaagaguauuguaaucuuaaggggaguuucugccucgcucuguccuguuuagcucccaaauaaaagucaaagaaaccugguuuuuuuauuuacaaccugcugaugcugugcugagcggcuucugagcuauucuaaccuacaucccagccauaagcccugugucacuuuaauuuugagucucaucugguuacuguuccauguguguccucagagccacaugaucaugguucaucuuaccucauggcaaccgucuucucuaccucuccucucuucuucuccucauggucacuaccugagaccccuacuugacccaccucaagucccaccuuccucuccugcccagucacaggcuccagccuuccaugacccaucagagauuacuggggagcauucuuuauagcacauuggucaauacaguguccagacugcaaccuggucuugggguauagaacucagcaucugaauacacagcacacaagaccaaccaauacaaaagagaauuguuuuucccuaguuugggaauugccaacauaaucagguucuccuaagggcucucuucuagaaugcaggcagccaacuucuguccucacagagcaaaccagcccucuggccucuuccacauuuguuuguuuaugggagggguguuuguaugugugcaugcaugcuugcaugugugugcacaugcacaaccuauaaugcuuguguauuguugguucucuccuacuauguggguucugaggauuguacucagguccaccggguacacacaaagcuuuacccacugagccaucucacugguuuuuuguuugucucuuuguuugcuuauuguuauuguuguuuuucuuaguuuuuguuuuuuugguuuuuuuuuuuuccuuuugguuuuguguaaucuuacaaaguaauaagaauucucuguaucuuaccuaccuuaccuguauucagaaucagagugcuuauuaagagguucauuauuuaguuaaaguucuuauuuuuacuacuaucuuuuaauacuauacuuggcuucuuucuagaaauugaagucuaauauuuaacaauguuucacagcuuguauacuuuugauaugcgcgcacuggacacuccuguuauggugcacauggaucacgugucugcaguacuugauguggacuacucucccacugggaaggaauuugugucugccagcuuugauaagucuauuagaaucuuuccuguggacaagagccgaagcagguaugugcccaccagccagccacgugcccgcuggccagccacuuaauuuugggugauacuuagucuugaugaucaugugucuuuucuuagaaggugguugguucuguguauaugguagggcuuauacccauguauugugacauggaguguagauuucugcuguaucaaguuaggucaaaucaggugguuuucuuuuauugucuaggagauuuauuucuauauaaugaauaaaauuaauacaaauuuaguuugaugguaaagagcuuggauaauuuuuucugaaaguaguuuuuaaagcaauaaauaauauucccaaguacuguuuuuuauacauucaaauccaacucauuuaaucagcaaaagauuagaagaaaaagcagcuuaaauugcuaaacucauguuuuccuccuuucuaguuuagucaguaauagguacugauccauaugauauaguuauucacaaccaugcugauuaagccaauuacaaguuuagagucauuuuauuaauggccagaccaacaguagacuugugccucugaaaagucuccuggugaccaagcucggguacagcauuuuuaaagacaaaaucccaauuacaucagcucucgugcaggggcuauacuacuuaguaacaucugcucucuugcaaagcucagcaguauguucugaaaacugcaugacaauuaucuuuuuauuuguuugaguuuuuuguuuaagcuuucacauaaccuggaccaugguuagggucaugggcaguccccaaagccuugaaaagcagauguagcugugcuguugagggagauggaaggcugagaaggagucuccacagacauaaauaaaguggggacaagaugccauugcuguaagugacuccacuguguacucugaauggagagcugggagauuuaguacugagccauccauuugcauaucucagucugugagcauauuuacuaccauuccugucuuuaagauuuacauuguuuucuacaguuuaacucuacugcuuauuauaacucaggauagcauguguuauaccaugacagauuuuguauugagguaauuuauagaaaauuagggcauucuaagagacuucagggaacuuuuguauguuauguuuuguuuuacugacugacuuugugauugaaugugagcccucuugggaaugcucuaccaaugaguucuucccuuagaccguuuccuccuccuuaaagucugauucgugugcuguggcuuacaaagcacuugcauacacuuucucccuguucuuuaguaaugcuuagacauguuccuaaacauacacguaagccaaaggaaagugaagcaucaaaguucugagcgcuaagcuaguagcauuuacucuugguacucaggagacagaagcaggacgauuguaggcuguuuuggcuugcucuuuugcugugaugaaacaccaugaccaaaggcaacuuggggaggaaagaguuuauuuggcuuagacuuccuaguuggucuauuaugaaggggagucaggacaggaacucaaggcgagaaccuggagguaggaacaaaagcagaggccauggaagaaugcugugcacuggcuuacuucccaguggcuugcucaaccaacuguuuuauuuaaucacuuaggaccaccuauccagggauggcaccacccacaaugggaugggcccucagacaucagucauuacacaagaaaaugcccccacagaccugccuguagcuuagucugauggaggcauuuuaucaguugagggucccucuuuccagaugacucuagcuugugucuaguuaacauaaacuaaccagcacauaggcugaccugggcaacccucuaaaacuacaguaaaacaaacaaaaacuuuugaaagauugauaauaugacucaaagauauaugacuacuuauaaugcauaucaaaauauaaaaaaauauaacugaauauauauacuuauauacguaccagugccgagugugcgcguguauguacccuuucuugguuaaguggccuagacuuacuugacaaaacuguaacuaggugaaagaaacuggagagucauuguaggugguggaaaagagaaggagaaagugcauauggaaaggaagaagacagccuguguggggaggugcaaggugguaagggugcuggugucagcacugguaaugccaaugcugcaccuacuaacuuaccagagauuggaauaauuuuaaaaucguucaccuccuuuuaaaacucuucagaaccucuucuggccccauuugucuaagaauaucauaauuucauuguuuuuaauagcugaguaguacuccauuguguaaauguaccacauuuucuguauccauuccuccguugagugaaaucuggguucuuuccagauucuggcuauuauaaauaaggcugcuauuaacauauuggagcauguguccuuauuacaaguuggagcaucuucuggguauauguucaggagagauauugcuggaucuucuggaaaaacuauguccaauuuucugaggcaucgccagacugaauuccagagugguuguaccagcuugcagucccaccagcaauggaggaguguuccucuuacuccacauccucaccagcaucuucugucaccugaauuuuuuaucuuagcuauucugacuggggugagguagagucucaggguuguuuugauuugcguuuccugaugauaaaggauguugaacauuuuuuuucaggugcuucucagccauucaguauuccucaguugaaaauucuuuguuuagcucuguaccccauaauuuuuuaaauaggguuauuugguuuucuggaguccaacuucuugaguucuuuauauauauugaauauuagcccccuauuguauuuaggauugguaaagauacuuuccuagucuuugguugcuguuuugucuuauugacaguguccuuugccuuacagaagcuuugcaauuuuaugacaucccaauuugucaauucuugaucuuauagcacaagccauugcuguucuguucaggaauuuuuccccugugcccauaucaaggcucuuccccacuuucuccucuauaaguuucacugucucugguuuuauguggaguucuugaucuacauagacuugagcuuuguacaaggaaauaagaauggaucaauuugcauucuucuacaugcuaacagccaguugagccagcaccauuuguugaaaauguucucuucuuuccacuggaugguuuuagcuccuuugucaaagaucaagugaccauagguguguggguucauuucugggucuucaauucuaguacauugaucuacuugucuauagcuuuaccaguaccaugcaguuuucaucacaauugcucuguaguacagcuuaagguugggguggugauuccaccagagguucuuuuauuguugagaagaguuuuugcuauccuaguuuuuuuguuauuccagaugaauuugcaaauugcccuaacucugugaagaauugaguuggaauuuugauggugauugcauugagucuguauauugcuuuuggcaagauagccauuuuuacuauauuaauccugccaguccaugagcaugggagaucuuuccaucuucugagaucuucgucaauuucuuucuuuaaagacuugaaguucuuaucauacagaucuuucauuuaguuaguuagagucauaccaaaguguuuuguauuauuugugacuauuuugaaggauguuucccuaauuucuuucucagccuguuuauccuuuguguagagaaaggcuacugauuuguuugaguuaauuuuguauccagcuccuucaaugaaguuaucagguuuagacguucucugguguauucaggacuuaauaaggugggagaguuuaguucugaugaugccaaguaaccuugguuuauguugcuucuguucuuaugcuugccucccaccaucugauuaucucaagugcucccugcccucaauauaucugauuggagccuguccuuccuguaaucccaguugauucagaucuccucagaguccaggguucuuugugauucuggauccugugaugcugagauucugggugugucagaguucuuggcagucaggcuuccucugagccucugagauccugggauccuaagauccugggcauguuagaacgccuggaagugguaccuccucuggggaccacggggcuguccuagaccagugcugaccugaaggaaccugagccacuaaucgggugggguuccugugccugugccccagcuguccccaguacccucgguucuauuggaacagauguugugcuccacucaccagugauccuaagauccugggcgugcuagggcuccuguggggugaagaguccucuggagacugugggacugaccuccaaguucagacccaaggugucccagugcuguugccgaccagaaggaacccuguccuguaguucuuaccuuacugugcaccugucauaccaucugcauuugaacucauuuuuuuuuuucugcguuuggaacuaagaagucucaucuuaauuucuaugaccuuuuacuuguuugaaaugcucuucuuaacacuucucauuauaguuucuuccgugaauucacuuagcauguuucacagcauuuccaaauagggaugucuuaacaucgccguuuauuaacugauucuuaccucagccuaucagacauuuuugcagcccucccugcauuuucucaccuauaaauaaacuugcacuucaguuaggcucagaacagugugcccaaacaaaaaugggagcuggacugagcaugauagggcgcuuuguguaggccauuguauucauuuuauuuuccgguaaaauaccguugaggagagaguggcuguugauccaaauuaaauuguggaugaaaaaauauuaagaauaagccguuucuagccagaaguggcauuacauuccaguaaucccuacacacucaggaggcagaggcaggcuggucuuugaguucaaggccacccuggucuacagaguaggauaagagaaauccuguuucaaaacaaaacaaaaaacacaaaaggggggaggaagggaggaggagaagccaacuuuuguggaguuuuguaugaaugguuuugcuuaguguguuuauauuucuauuauuaaauuguaaauucuguuaggccaucugucugucuguuuguuuauuuuaauucccaagcacuuagacuagaaccaaauuaauuaaguucaaucaaaauacaaugaauugaaauugaauuguccuuuuauacuuccuccagacacaaaagugguuuuucugaucaucaguaggcagugguuaaagaaaaucucuucuacaacuccugaagauauuaacuuaauuccuuuucuacagggaaguguaucauacgaaacgaaugcaacaugugaugugugugaaauggacuucugacagcaaguacauuaugugugggucugacgaaaugaacauccgacuguggaaagcuaaugcgucugaaaaacugggugugguaaggccugucuuucuuucauugcuacaaaaucagggugcgauuuuauugaauaucauuguuaagagcuuuuugaaguacuuaaucaggguaacaccauugugauggaaggcugaggggcuggcuuguuuguuagagugcuugggaagcaaggccccagcccucccuuuccuucccuucucucuuccuucuucucuuuccuuguuuuuuaaaaaaccagacaugacagcaggccagcagcacccugucauaaaggagacaggaguguuacuggggcucacuagcuagagugccuggccagcuuaguugaauugaacaccugucuccagaaauaagguggggagcaauggaggaagaucuggugucgaucuuagccuucacaagcacccacuguaccugcgcacgcacagaagugcacuugcagaagggcugaccaguuuacagugacacugcuccgacuccaucauucuuuguuuucuuugguuggacguagaugacguagagaguagaaauguaagauaugaaugaacaacucuacuguuaaagcaguagugauugcauaugucaaaggcugcaaguccuaagagaucaucugauggcaaagaccugaaaauccaccuuuaaaauagauucuaugaaacugcagcuauaucugggcuguaagauaauguuugacuugugguuuuuugucauuguugauauuuucuaaguguccacuuuccuguguggacuguguagucuguuuacgugaguacuaagaaagggauguuggguuugaaaugauuucugcuuagcucuggcaggaaagucaagcagcaguaaacaauaaccaaagguaauucuacuuuaaguucaguugucauuaguguucacugugucucagaccccuucauaacagaaugcucuaguguguuucucuuauuccucgaauuguuaaacaaaaccuacuuaugggguuacauacuuuuuaaaaaauuuuuauguaguuagauuuuuaccaaaaucuaaauugacugacugcuccugaugccuuuucuguacccugugccucgugugcucagccuccgagggcugcagagccuggcccugcagcucacacagcccugaccccagcucacacugcugcuuaccuucuggcaucuguuuacauguuggugugcugccuccagagcagcggcugcuugcagagcgguacugacaagcucacuggugauuuuguuuguguguaguaaaaguugaauuuuggggacaagggggaagaaguacuuccuaaauuuuuacacucaagaaaacuauaaaaaauuugagauaccaaaugcacuuuguuuuuagcuuacaucacgagaaaaagcagcaaaugauuauaaccagaaguuaaaggaaaaauuucaauaccauccacauguaaaacggauugcucgccaccgacaucucccgaaaucuaucuacagccagauucaggagcagcgcgugaugaaggaagcucggcgccgaaaguauguguugagaccguugacucuucgcuuaguacucucagcugucuucccucugucaucucugucaucaccaucaccaagcagacacuuuccuuccgucuuacuguuuggaaacaucucaccgauccuggaaaucaccuauugcuagacuaguugguuggugaacuuuggagauccuccugucuccaucucuccagugcuaaaguuaccgacacauaacgcuaaggaaugaguuauagcuaggcagugguggcgcacgccuuuaaucccagcacuuggcaggaagaggcaggcagauuucugaguuugaggccagccuggucagcagaucgagcuccaggacagccagagauacacagagaaacccugucucgaaaaacaaaaacaagggguuggggauuuagcucagugcuagcuggguucgguccucagcucuuggggggggaggggggaaagcaaaucaguuguaauauagcuauuauuaugacauacuguauuuucuaaaugaauucaaagaaacuaggcauaguagcaccuaccuauaaucccaguacucuggaccacgaguucaaagccagucuggacugcaacgaauuuuuaaaacucauauuuaacaaucauuucuuuuaaaaacuuuaauuuuauuugagaucuaaugucuuguuucuugagguaagggacucacugugauuccuaagcuaguuuugaauuccugggcuccagugguucuucuucuucauccucugagagcuacgaagcagaacuuccccagcccccacccuuucuccuguagaacgccuucucgggagcccaugauuaaugcaguguugaaguuuuuagagcuuuuggguuuuguuaugaguuacuguuguuaugcucuuuggguacauguugggauuuaaucauauuuaugucucuuaauaaacugugguauuuuuaaacuuaguaagggaugcuggguuuuagguguuuguuuguuuguuuguuuguuuaguugguugguuuuugguuuuucuugagacagucuccagggcgguaguauggaccagacuggccucugacucagagauuauccugucucugaguccugaguccugggauuaaaguccuguaucaccacaccuggcucaaaagcaugcagcacuaagguguauuccuauaagccagucuugaccugcuuagcuucuaaggucagacaagaucaggugcauucagggugguacagccuuagacauugaucauuaauaugaagcaauuaaauaacaaaaguugaauguaacuuuuuacuuuauucucauuggaaaauucuuuuuuaaguuuaguucuagugaaagaaaaugcuuuaugauuuaauuucuuuuggcugagguaauuucuuauguacuugcucauauuuuauauauuuuguuuauuucuagggaaaugaaucgucguaaacauagcaagccuggaucugugccgauugugucagagaggaagaaacacguaguggcgguugugaaauaauguuuugucuuccuaccaaguuugauauauaauuauuugcuacuuuugauuugggaacucuguaaauaaaaguccugagucugguuuaauaguaaac

SEQ ID NO: 7742 - RNA, 2226 nt, Mus musculus
gauuuuuucaggguaaaaaauaauggguuucauuacgaaaugcauguacaucacuaugcuuuucucaaauucauuucuuuuccuuuucaguauaaauauuuccuccuccccuuuccucuuggcuuucguuuuacagacugauggacguuucacuuucaaaggagagaagagauaacacuaguugucagcaauugaggugggguauccuggagauuaauagugagaacccacucacuaccagguuuugagaggccuuugggcugauuugcuggucggauugaugcagucucaucuuggcaaagggaccgacuuccuucaagaaagggccgagguccagucuaccuaguuguacuuuggccccuaccccuacuccucucucauaauuucccaggcagaguuggaaaggugggagcgguggaaguagaaggcagcaggcagggaaaguaaauuacaguucaggcaacaggaacagugccuccaaggucaggcugagugucaacuaauuauguaaaauccugcggaaauagaagucggggagaagcccagccuacucuuguauuuaaggagaucuuuccagagccccuuucaacccacagccccauaccuucacccuuuggccagaucuuuguauuuugcccgccuuccuugauuucucguuccaauuccaccagaauaacccugaaaacuuuuuucuuccucuugguaagucaguagcagaggagcuuucccauaauuucagaccaguaucuucucgaugucucugucuaaggcccugaggcuagggcugcugggcagcucuggggaccggggacgggaaggggugccauaccccgcagccuggaguugggacucugcucuggcuacccuggcaggugucuguucuuggggcacgguuucccagggcagggguccaggaggacgccagcucccggagcccgagaguucgcugcggggacgcgcggaaagggggugcgcuggcagccgguagcuuccuuccgcaggagcuauuuuuagcagggcuucgcccccccuuuucccggagccgccggcguggucgccuccagcucguggccgucgcucugcagcucggcgccgccucccccgccgcggauggcucuugguagcuuccacgcgggcagguccggaaacugagcaagucugcaagcgcuccgcggccccggcggcggcgacggcggugggggcagagcugggcugcgucaggcugagcgcaguccgcgcgcggccgcgggagcgcagugccagcgccgcccggccccaccgagaggggcgcacucgccgcuacggggcucgcaccgcucgccgcagcccccucccgccgacccgcaaguaaguuugugcggcugcugggcgccgccggggcgagggcuaggcgcugggggagcuggggauggcgagcgggaagagcgccuggacacccggagagcgggcagccuucugccuccggagucccgcgcuucucccaaccgcugggcagguagagagcuccugcuuacaaggaugcucuagcaaaagcuauaaugagcagaccccggaggguaggacuggcucaggguucaggugugggucacucuggaaggaagaaggaccgcggaugagggagcggacccggcaggccaggagccggcuagugcccgauggggaagggaagguuuggagagcagggaccugccugggaacagccaaaaagggaaaguggugucccuaggacugacagagggucagagagcaaaauagaagggcgguguguccugaaccaggaugacagaaggggagauagauggaaaguggggcgugugaaaagcggauuuguaggagaguaaaggacgccaguggaagggucagugggcgccugaugggcgggugaacuugguuaauucggggaaucagaacaagcuuagguagauaugauggaaagaggcagauuuaauucaagccuccggagggagugugugaggcaacacguugugagaaccagcggguuuagaaaguggccuggaagggagggcuggaaaggugaugagggauaugggggaaugugagcagggagugggguagauucaugccuaggauagggaggaaggggaguugcaaaccugugcauaggguuggaggcuuccgugagucaagucccaugguagagguuuagagguacuucucugagguuccucuuccaucuccuaucugguuuggaggcuccuaggaucc

SEQ ID NO: 7743 - RNA, 1522 nt, Mus musculus
gcuucugauauugaacucgaguuggaagaggcgaguccggucucaaaauggagggccauaauccaaaggaaccagagcagcugaggaagcuguuuauugguggucugagcuuugaaaccacagaugauagcuuaagagaacauuuugagaaauggggcacacuuacagacugugugguaaugagagauccccaaacaaaacguuccagaggcuuugguuuugugaccuacucuuguguugaagagguggaugcugcaaugugugcucggccacacaagauugaugggcgugugguggaaccaaagagagcuguuucuagagaggauucuguaaagccuggugcccauuuaacggugaagaaaauuuuuguuggugguauuaaagaggauacggaagaauauaaccugagagacuacuuugaaaaguauggcaagauugaaaccauagagguuauggaagacaggcaaaguggaaaaaagagaggauuugcuuuuguaacuuuugaugaucaugacacaguugauaaaauuguuguucagaaauacuacacuauuaaugggcauaauugugaagugaaaaaggcccuuucuaaacaagagaugcagucugcuggaucacagagaggucauggagguggaucuggcaaauuuaugggucguggaggaaacuuuggaggugguggaggaaacuuuggucguggaggacacuuugguggaagagguggcuauggugguggaggugguggcagcagagguaguuauggagguggugaugguggauauaauggauuuggaggugaugguggcaacuaugguggugguccugguuacaguaguagaggagguuauggaggugguggaccaggauauggaaaccagggugguagauauggugguggaggaggaggcuaugaugguuacaaugaaggaggaaauuuugguggagguaacuaugguggugguggaaacuauaaugacuuuggaaauuauaguggacagcaacaaucaaauuauggacccaugaaggggggcaguuuugguggaagaagcucaggcagucccuauggugguggcuauggaucuggagguggaagugguggauaugguagcagaagguuuuaaaauaaaacagaaacggcuacaguucuuagcaggagagagagcgaggaguugucaggaaagcuacagguuacuuugagacagucuuuccaaaugcauuagaggaacuguaaaaaucugccacagaaggaacgaugauccauagucagaaaaguuacugcagcuuaaacaggaaacccuucuuguucaggacugucauagccacaguuuggaaaaagugcagcuauugauuaaugcaauguagugucaauuagauguacauuccugaggucuuuuaucuguuguagcuuugucuuuuucuuuuucuuuucauuacaucagguauauugcccuguaaauugugguagugguaccaggaauaaaaaauuaaggaauuuuuaacuuaaaaaaaaaaaaaguugagc

SEQ ID NO: 7744 - RNA, 2326 nt, Mus musculus
agauuuuuaaaaaauaucccagaaauuuauuugauguuuacuugaauacauuuuauauagaaagauugggauuguuuguguuuggagccccuaggaaaucucugaaccauaaaggugccauuccagagacaugagaaauggaaacuguaggcccaauauuaggacugcuguuuaagauuugucucuggucaaaucaagccacucccuugaaaaaugcuugagguguuagagccacuauguaaaaacagcugacaugaaggagggcauuuagauucuggcuuguugaauacuuaaauacuuggaaauaaaaauauucagcuuugaaguuuucaauacuggaaaacucucaagucuaggguugacagccaggaagggcugcuucguacuccuucaauuggacugcuuuccaaaacguuaaucuucagcuuuggcuuccauuucuucugcaucaucaucuccauccacuucugcauuuucucucucaagccguuccagcugccuugcaaguucagucucaucuguaucugugaccacugugggcuccaucugaacauugaagacuccccucuucuccucgaucuucucuuugauaacugccauagccugauugaggacagaggccucuguccucucuaggguuguuguugucaucacauaccuggguggagcuauuagguuacucuugaugggcaugguuucuguagaaaaauucaaaucugcccucagggcuucuuuuacaucaucaaugccuucauaaccauagcaagcuacuucaauaucugcucggauuuugaccgcuuguggggucaaacgccuacugauauuauuaaugaguacuuuucuuucaucuucauucaaaucuaaacuauccaagauagaugggucugagacugcaugcuuaaaagcaucauaggcaccauaugcaggucucuuguauuugucaucaaagacccaggcaguccucuggaacaggcucuccagcugcucauccuugguauauucuaauaccucagcaacuuggcgaagaaugcuauaaacaguuuugaauuuugugauuuggccuuaacauuugauugcuuccucuggagaaacucuucuuuuugacaaaucuauauauccuuuuucuuuauccacucuaaugacaacaacacauucauuucugccaauuuggaucaguuuguuuauagaacggauacgucgucuggauaguucacuaagaagaaucaugccuucaauguuauuauauuccaacaaguugacauaggcccccauuucagcaauggaucuuuuuaaaaaaaauuuuuuauuagguauuuuccucauuuacauuuucaaugcuaucccaaaauuucccauacccacccacucccccuuuuuggcccugguguuccccuguacuggggcauauaaaguuugcaaguccaaugggccucucuuuccagugauggcagacuaggccaucuuuugauacauaugcagcuagagacaagagcuccaggguacugguuaguucauauuguuguuccaccuauaggguugcaguucccuuuagcuccuuggauacauucucuagcuccuccauugggggcccugugauccauccaauagcugacugugagcauccacuucuguguuugcuaggccccgcaagaagcuggaaagaacccagaugccccucaacagaggaauggauacaaaaaaugugguacauuuacacaauggaauacuacucagcuauuaaaaagaaugaauuuaugaaauuccuaggcaaauggauggaccuggagggcaucauccugagugagguaacccaaucacaaaggaacucacacaacauguacucacugauaaguggauauuagcccagaaacuuaggauacccaagauauaagauacaacuugcuaaacgcaugaaacucaagaagaacgaagaccaaaguguggacacuuugccccuuccuagaaaugggaacaaaacacccauggaaggaguuacagaaacaaaauuuggagcugugacgaaaggauggaccaucuagugauuuccauauccagggguccaucccauaaucagcuuccaaacgcugacaccauugcauacacuagcaagauuuugcugaaaggacucagcaauggaucuuacauucaccaucacuacaucuuccaccucaggaaauuuguguugauaaaauuuacaacuuagacccggcauucugaaguggaugugugaaucccgaaguagggucccacgcugugcugcuuaguggcaacgaggagacucagaacaccaaccccggacgccgaagcuccucagcgugcgcuucca

SEQ ID NO: 7745 - RNA, 53089 nt, Mus musculus
cagcacaucgaaaggagccugggcugggcccgggucccggcccugaggaccacgggcauagcucaccaccaucaccgcgggcgagggccgucccuucccagcgacgaaaugacccuugcgcugacgaccguuaccuaccacacucuucggcugcccggacuuagacccucaguagcucgggcaccuaagcacacagaaagcuagaccacgcauuuccggggcgggaucuggccacccugccuauaaugugagaauucaacuagcgcgggccgccuucuggucgcucggcccucuggguaaggaaguccagagucuguuagcugacguggguucagggaucaaaaaacuacauuucccagcauugcaacagaaccaaauuucucauggacacuacacuucccagaagagacguggcgccgcagagucgucugggaugggaaccacgccguuucccagccucaguuccaggagugaagcgcggaccuuucaacaagagcuuuauugauucucuugcugggaucgggggaacgcgauggaggcggccaauugcucucugcgggugaaaagaccucugcuggauccccgcuucgagggcuacaagcugucucucgaaccgcugcccugcuaccagcuggagcuugaugcaggugggaucggcggcacccucucgcacccgguuccuucuuguugaggcugccauuggcgcaacccucugucacuccggcuagccagccaccuccugccggucugcaccuagagcggccguccacgcggggacccgaggaugcccccuuuccuuccgcgccuuagccgcggcacugugggcuggccuaggcguccgcagcucaggcucggauguucuccgcccauacaucucuggcuccugcucugaagguucaaguuguccuuccuucccaaaccuuaccuuuaguaaacguguucgcugagaagccacaccuccuuggaaaguccccaacucccuuuuuccuucugacgcagaaucauuucuugggagagaaaaauuuccacauucaguuagcaguuucaaauacucggguccuggaucaugcuacaauuuauugagggcaagugauuuagugcgcuuacuguugcuugcugcuacuacuuauuuaucuguaacuuccuagaggcuauucuccuuuuuacaaccauaggaauuguaguuuuguuagggaaaguguccagggauuuguguuuuuaaauacaugucucugcagauucuuauuuugauacaaguuuuccauagguuguacuuugagaaauagugaucuagagguguuagucgacguuugaguaucaagcguuacuuauguauguaucuauguaucuuuucucuagauuguaucuagauuguagggagucuauucuugacuguccuggcacuugcuuuguagcccaggcuggcccagaacucacagauaaccagcugccucugugcugggauuaaagacauaaacaaguagaccaacaaaugcuuggguuuuuuguuuguuuguuuguuuguuuguuuuuaaaguuucuuaaguguaaaaguaauuguugugggccuguuuugugauucaucgagaugauuacgugauugguauaaucaugaguaccuaauaaaucauaauccauucacuaauaaacaucuaauuacaguaugggcaaguagugagaggaacgugagcaaauguaauggucuaacugaguauguuuucucaacuuguuuggagaccugggaaaacuuccgguaggaguugaugagggacuugaguugugaaggaaaacagguagcuguuggcugguauaagaggagaggugcuuccuucuuuuuguucuuucucuuggacguuuuuuguugcuuuucuuucugugucaauaaaugauccggccauguuuaguuagccaauugauuggaaacaaaauucgaaggaacaaaaccuaauggcucaagccagcagguucuccucacugcucauucaguuacgaguuggcagaggcaguucuagucagcuugauuugucuagaucacuugccagaugaucuugacuugagucuuccauauggcuggucaccuuucaacaggcuagcacaggcuguuugcggaaguuaagucacgguguacaugcuguuccaguggcugucgacacauuuccacuuguuccauugggcaaagcaaauuaaauaaucaagugaagaauugcuguuggaagacccuagcagaggguggagaucuagagcgcuaaaaguugggacagugaaagucuaggaaauuauauuacucucuguuaaugugaaaucaagguacuaaacagguauaaugcccaaguuuccuugugcccuuguguaacucucucugcuggcacccacagucaggaaaugagaaugcuuacucucaaccugauuucucuuuauucaguagugcugcccccauuaagaucuagguaaucucucauagguuugcccagaggcuuaucuauaagaugauuugggauggagcugguuagauggcucagcagguaagagcacccgacugcucuuaccuugcucuuaccugcucuugaguucaaaucccagcaaccacaugguggcuuacaacuaucccuaaugagaucugacucccucuucuggagugucggaagacagcuacagugacuuacauauaauaaauaaauaaaucuuaaaaaaaaaaagaugauuugggauccuaugaaguugacaaccaagauuagagcuguccauuuuucugcaaaucucauuuucuuuacagcugaauauaaugcauuucauauacgugcaucuguguagcuuuccuuuauucagucaucuauugauaaacaucuagauugauucuguuuccuagcuuuugggaagagagcaguaaugaaugugagugugcagggaucucagugguaggauagagaauucuuugaguauaugcccaaaaguauagcuguagggucauaagcuuuggagaaaccuccauauagaucuccauaauggcuauaaguaguuuaaauuuccacuagccauaaaacgggaucaucggugugcgcuauccucucauuucuuauggaugacacugaaucucaaaguagguuuaauuugcuuuuuuccugauugcuaaggaugugaaacacuuugauguguagugauguguguuuuaguuuuuuaguuuguugucguuguuauguauaguuagcuauuaacuuuuugucugaguauagagcuaaagacuuucauucuguagucugccuuucacucuguuaauaguuucuuugcuguugagaaaacauuuuaauuuuauaucaucucguuuauuauuuccugugguuauuuccugugcugauaaaguauuguucaaaaguuuuuuuuuuucuuucugugccuauaucuugaaauguauucccuuuaaucucuuguagccaucucaguauuucagauuuugauagaguuugaaauaauuuuuauguagagugaauauagucaauaauuuaggagggaaagccuuaucuguucccauucuagcucccaaauaauugacucaaaguccuauuaaguuuauuaacaagcuuuaaacacaaugacugggcagauguuugucuauucuaacuuucuaagccauagauaggucccauguuacuugcagucugaguuucccuggcuugcucuguuccaugugcacccucauggugaaucccuuggugaccugcucauccugacuccucuccgauccuuugcucaggaccaauucuuucucauucuccccagacacaccuccuucgggacugucucccuggaaucagaaguccugccuucucugcccagccauaggcuaaucagcuccuuauuaacuaaucagagauaauuggagaacauucuuuauaaaggauagauagaggagaugguucaauaaucaugacagugccagcaucuggacuguaucuagauuccuggacacagaaaucagcuucugaauacacaguacacaacacacacucccaaaacaaaacaaaacagguuuuauuucauucuucaaguagguaacaagugugccauuagcauuuauuaaauaagcuguguuuuuuccaguuaugucuuugacaccugugugaaaaauuaggcagucauagcuguauggaaugauuuuuuuuggucucucacguguucucagugucugccuucaugcugaugucaugcugucucuauucuuauauuucuagaauaaggucagguauuugauaccugcaguaauauugcugcuuagaauuguuuugauuauuuguagucuuaugcauauccaugugaauuuuuggguucuucuacuucuaugaagauugccauggaaaucuugaagaggauugcagugaaucaauagaauaauuuugguaauauauccauucuuacaauauuaauccauccagcccaugaucauggacgguguuuucaucaucuuauaucuuucuugauuuauuuuuuacuuuuuaaaggggugauguucuaauagggaaacgguuaagaaacuucugauuuguuuugcgcuaccuaggguucuuuauccaaagaugacaaaaaccaugcuuggcuuauuauugcuuaaaaucacuacugcuuugagccauuacagucugauaugcuuccugcauuaguacauuucauccacacaguggugcuagaaagccagcaauugguuacaguuucucucuuauuuagugaaguauauauuuuuaaccaucccuuauaaaauaaauacuuccuugaacugaaggagauguuuccauaguccccaaucagcguucuuauaaucuuaggauuuugcuugugacgucugaaauguuuccaggcuucagccaccucucauuuggcugaccucagcuccucucauuugagugaccucaauggcuucuuaaugguuuugccccuuuucugcugcaaucaguuuuccaaaucauuguuuuuuacauacucucucaggacucaagugugaaucuuacucuccuguuuagaaaccaaugaauucgugcuuacuuccuuuauaaaggaagaaaugaagauaaagugucuuauaaucaauuucugugcucauucuucagcugcauuuguuugcagcuguucuugguauguaguuuuuauacuuugcaaacuaguaaugguuaguucuaauucucauuugacacagccuggaaucaccugaggaggaagugacaggaguaaauugcuuaauuugcccugugggugugggugugagacuuuuuguuuauguauuuauuuauuguagcucaggucauuuugauaggaaagcauaccuugacugugguagcaucauuuaauggguugagcccugguuugagugacagggauagagcaccaaauguguauucauucucuguguuccugaccauggaugugaauaguggcuucauguuucugaauugacuucccuagcaaugaugggugguaaccuggaauugagacauaaauaaauacccuuucuucccuaaguggcuuuuaucagaguuuuaucacagcaauaggaaagaaaacuaggacuuuuaaucgaaugcguaucuuuuuauuuccacuuuuuuccuguuuuuuuuuuuuuuuuuuuuuuuuuuuuuuuuuuuuuuuuugcuuagaaaggguauuauguaaaguuguauuucuucaauuaauuuuuucuucuuggcucuguccuggaaagcuuuuguuaaucuccugaguaggucaguucucuucuauauauccuuguggaaauuguauuuuuuaauauaagauuuaauuauguaaaauuuauuuuacggugugauugcuggguuaguccccuucgcuuugcuugagaggugugguuaucuauuuauuaucuugagacagaacuugcuggccucuaauucacagagcuccaugugccucugccuccugggugcugagauuaaaggugugcaccaucacaccuggcccauuauccuuuuucuuacaagauccuaaguucugaaaagguagauagaguauguucccuuuguguaucacugguaugaguggugcugauuaaaagacuugcuaaauaaaugagugaauaaauauguaagccaggacucagggcaggcauugaaaauaggaaaaguggggcuggagaaacagcucagcagauaagaacauguguugcucuugcagaggguucagugccaggaaccugaaugguggccuaugagcaucuguacccauagucuaaaggaucagaugcuuuucucaccacaggcaccagacaugcuagugguacccauacauucauguacacaaacacaaguacacaauaaaaaugaaaaagaaaauagcaaugguaugauguccuuuguggguuuuauugucaacuugaccuaauugagaguuauccagaagagggcaugucaauugaaguguugcccauuucauauugaccugcaucucuguaugugaagaauugucuuuauuguugauugauaugggaagacccagcccaccaugaacagagccacugcugggcagauguuuaaugguauauguauacaaaagcugauggagcacaggucagaggaagcaagccauuccuccauaguuucuacgucaguuucugcuugaguuccuguccugacuaucaucggugaugaacugugaccuggaugcuggaguuacccucccucucugagguugcuucugguuaugguguuuagcacagcagcagaaagcaaacgaaagcaauggguaaaaaagaaaauuguugcagggagaauagaguuaaagugaguuuuauaguaagguaacauguaggcucagugacacuuaauauuucuuguuacaacauuaauuaauuguacaacaugagcagucccgagcugcaagaauuuggaacugcacugauaggcaggagugugagggagagaccauauuuuuuuaauucagaauuaggagaacagcuaguguuuuaguugagagagugcuacucuguacauagaaaaguuuauguauguccuaacuaugauauuguuuuauuccauauaauugggaaagauggaauaugaugcugaagucacuauuuguguuuacacacaauuuucuaacuuuauaaucauguaauaaagacauugucacuuucuuugugugugauaaagaugaauguuuuaaaaagcauaaaaaugcuuuaucaauggacacuuguuuguuugcccauaaaauguugacuauuguacuucaaaauuguagagguacauaaaagaaaaggauugugcuacgaaagaccugccuguuguagccucuguagcuggcauuaacuguuucuguacccuguaggcauucugcagaaaggaaugaucugagaugcaaguuuuaaugauuauguuuauauuuaugcauacagauauauguaaauauauauuuguauauauguguuuuucagcuguggcagaaguaaaacuucgagaugaccaguauacauuagaacacaugcaugcuuuugggauguauaauuaucugcacugugaugccugguaucaagacagugucuacuacauugauaaccuuggaagaauuaugaacuuaacagugaugcugguaagaaacacaugcagaggaaaaagacagaugucauccuguuuuccuuacuguuuaaucucugaaucugauguccagacagucaaggugcacauaccuuuggaauguggaaaucugucaucaaacuguaaggcuccuccccuucugcuuaccucaguuauagcuuuuccucuucuugauuuuuauaauccccugugcccauccauuuccaccugugugguauagccucaauauaauaauggauuacuucuuuuccauuucauuuaguguuuacauuagguaauuuaaauuagguuugguuguuuggguugaucccuguugcauuauaaaauacuccuuuuuuuccuguaggucuugggaaaaaauuugccuucaaaucuuauuugucuuauaauaauagaguccuuaaauuaauuauauuguaauauauguauauauauauagucuuauauuaauagagacuuaaaaacuaauauucuggcuagggagaaaucucaaucaguaauauuccuuuuauuucuauauuguguaauaauuugaggaguauugguauuacuucuuugaaaaucugugcuaaaaccucaugaggaucugaguucuguaucuagcaucuauauugcaagcccuggugugguagcacucccuuauaaucucaguccugacaaggcagagauaugcacuucccugcacuugcaguaguguacagugucagaaaaacaccaccagagguuuaccucuagccuccauguacauacaagcaaaugugcuuauacaugcaagugcacauacaaagugcugucuuuuucuuugaauguaucaaaauuuuuuaccuuaaaaggguuaaagugugucucauaaauagcuaguaguuaauuuggauaaugguuugucucuuacugauuuuucccaaaaaacaacucuuuguuuuauugacucuugguauuguuuuuguuguuuuguuuugcuuguugaauuuauuucucuuuuacugauuucaguaaucaauuauugauaaugaauucuguaauugauuauuuccugcuguuuacuccuuuugugugugauuucuuuuuguuguuauagagcuuuuagguguguuaguuucuaguaugagauuuuucuaauuuuuuuuuguaauguuggcacuuaguucuaagaauuuggcucuucgaacugccuuuguuggguuccauaauuuugaauauguuguauauuaauuuaucuaaauuaacaaaauuagaaaugaaaagagacccauccuucagucucagcucugaaggaccauccagagacugccccacccaggauccaucccauaaacaaccaccaagcccagacacuauugcuuaugccaacaagauuuugcugauaggacccugauauagcuaucuccugugaggcuaugccagugccuggcaaauacagaaguggauccucacagucagcuauuggauggagcacaggguccccaaugaaggagcuagagaaaguacccaaggagcuaaaggggucugcagcucuauaggaggaacaacaauaugaacuaaccaguaucuccagagcuccuugggacuaaaccagcaaucaaagaaaacacauaaagggacuugugucucuagcugcauauguaacagaggauggccuagucagccaucaaugggaggagaggcccuugguuuugggaauauucuaugccaguauaggggaaugccagggccaggaagcaggaguggguggguugaggaucagggggaagggggaggguauaggggauuuucaaagagaaaacuaggaacauuugaaauguaaacaaagaaaauaucuaguaaaacaaaaaagugaaaggaaaggaaaggaaaagaaaagaaaagaaaagaaaagaaaagaaaagaaaagaagagaaaagagaaucauaacaacaaauaccgagaaaauccaaagaaucauaagggcauacuuuaaaaaucucuacuucaccaaauuuggaaaucuagaagaaauagauaauuuucucaauauaugccacuuaccaaaaguuaaaucaagagcagguaaauaauuuaaauggaccuauaacuuccaguuaaauagaagcagugauuaaaaacuuccaaccuccacaucaaccuauaaccuccccacgcccccccaccccccaaaaaaagacuagcugguuuuagcacagacuuucaaagaagaauuaaugucaauacuucucaaauuauuacacaacauagaaacagaaggaaauuugcccaguucauuuuaugaggugucuuaauuaggguuuccauugcuuuaacgagacaccaugaccaagauaacuuguaugaagguaaacaucuauuugguagggcuagcuuacaguuuuagagguucaguucauuaucaucauggugggaagauggcaguguucaggcagacaucgugcuggaagaacagaguucuaccucuugauaagacagccaggagaagacugcucugucucuucuacacugggcagagcuugagacuaagaucucucaaagcccgccgacacaguaacacacuuccuccaacaaggacacaccugcuaauagugccacguccaaugggccaagcauauucaaaccaccacaugaggacacaguuauccuaauacccaaaccacauaaagacccaacaaaggaagagaauuacauggugaacauaaauaugaaaacauuuaauaaaauauuugcaagcugaauccaagaacauaugaaaaacaucauccaccaugaaguagaccucaucccagagaugcagagaugguugaacauacauaaauugaugaauguaaucuaccacauaaaaaaacugaaagacaaaaacuacauaucaucuucuuggauucagaaaaggucuuugccaaaaucuaacacaccuucauguaaaaguucugaacuugccgggcauggugacgcacgacuuuaaucccagcacuugggaggcagaggcaggcggauuucugaguucgaggccagccuggucuacagagugaguuccaggacagccagggcuacacagagaaacccugucuugacacccccccccaaaaaaaaaaaacccaaaguuuugaacuacuuaagaauaccagggagauauacuucaauauaagaaagguagucuacaguaaucccauaaccaacaugaaauugaauggagagaaacucaaaguaauuucacuaaaugcacgaauaagacaagucugcccacacguauucgguguagugcuugaaggcugagcugagcaaugauacaauugaaggagaucaaagggcugaagauaggaagggaaagaugcagaacaucuuuauuugcagaugauauaguacauauaacuaaccauaagaauuccaucagggaacuccuauaacucauaaacacuuucagcagaguacauacaaauucaaucacaaaaauuaguagcccuccuauguacaaaugaugagcagauuaagaaaaaaaucugauaaauacccuuuauaguagccucaaauaauauaaaauauacugggauaacuaacaaagcaaguaaaagacuuguaugauaaaagcuucaagucugaagaaaaauugaagauaucagaagauagaaauaucuccuauauucauguaucaggauuaauucaguaaaaaugggcuuccuaucaaaagcgaucuaaauaaucuaugcaaucuacaucaaaauuucaacacaguucuucacagaucuugaaaggacaagauuugcagcuucacaugguaacacacacacaaacacacacauacacacacacacacacacacacacacacacacacacacacacauacacauauacacacacacaaaucaggauaacuaaaagaguccugaaugauaaaagacaugcaggcgggaucauuaucccugauuuuaaguuguacuacaaggcuauaguaauaaaaacagcaugguauuggcacaaaacagacaccaauggaauagaauagaauacccaggcauaaauauacaugcauauagauacgugauuuuuuuuuuuuuuuuuaauauaaagaagccaaaaacacauccuggaaaaaagacagccucuucagcaaauggugucacccuguacaaaacaccaaagaccucaccguaaaaccaaauacauuagaucugauggaagaggaagggggugaggaauagcauugaacucuaugggacaggaaaagacuuuccaaacagaacacaguuaacauaagacacuaagaucaacauuaauauauggaaccucaugaacugaaagauuucugcacuauaaaggacauuguccuuuggaacaaaguggcaacauauacaauggaaaaagauuuuugccaacuacacauuugauagagggcugugcuggauaguuuuaugucaacuugacacaagcuaaugucaucagagaggaggggaccucaauuaaaaaaaaaaagagucuccauaaaaucaaacuguagcaagucuguaguauauuugauuggagaugggcaagcucguuguauggguugccaucccugggcuggaguccugaacuuuauaagaaaucaggauuagcaggccaguaggcagcauuccucuuuggccucuucaucaauuuggucuccugccuccaauuccugcucugcuugaguuccuguccugauuuccuuugaugauaaacuaugaugugaaagcauaagccaaaaaaggcaacaacaacaaaaaaacccuuucuuucccaaguugcuuugguuaugguguuucaucacagcaauaaucacccuaacuaggauaaaggauaauauuucaaaauauauaaagaacuaaagaaacaagauaucaagaaaacaaccaaauuaucagugggauaccgaucuaaacagaauucuuaaaacuggaaccucagaucgcugagaaacauuuaacuuagauaauggaauauuaugcaaccauuaaauaaugaagugauucauuucacggguaaauggaugcacuagggaaaaaagaaaacauucugagugagauaucccaguuugagaaagacaaauauguaugcuuauguguagauaguggcugugggauuaggagggacaaauagaucuccuuagagaugggaaagagaauagacuagauaguuacauauggaugguagaggcuggaaugggaggaucaaguugggaagagagaggggcaugagggaaggaauagcgggauagacagcuaaaauuaaggggcauuugaaggguaguauggaaaccuaauacaguagaaguuucuuaaaauauauacgugcauggagguguucuaacugaaaucuccaaauaaugggggaaacacagccccaacuggccaucucuuauuacuaaaugaugcuucuaguucuggaauuggguuauaucuaauggaguugugggucaaaagggucccaugggaaucuccaaauaacccaagauguugccaagaguauagauuguucucuacaaacagacagaaaguccccauugcuaaaaacaauaccuacagaacucauugaacauggagaaguugagcuggugcccaacuacaguuuuuacccuuaugugcuaauauugaugucuuuuguacaggaagguacuuugcacggugccaaaagagaaacauaauaugaaucuagccacaaacccuuugaucuacagugauggucuaccuguauaauaugcuaugcgguggugacacaaagcuugugggagugacuaaccaaugucugauuugucuuauggcccaguccacaagauggaaccuauauuugauauuguuuggauggcuaagaaugugagacuagauagccuuaacauuggauaaaaucgaauacugcuguccuaaaaaacaauguaaucaaaauauggaaauaugacuucuaaugacauucugcuauucucauagaugagugccuugcucagccaucaucagagaagcuuucucuuguagcaaaugggaacaaacacagagaccuacagcuauauauuacacagaaagacagaucuuggaacacauagcccugaaaagaauaucuccaucaaauccuuuccguucaguacuuaguggaaaaggaagcugaaagagcauaauagccagagggcacggaggacgcugagaacagaagggucucuaaaucaacaugagcgaaacuccaaugaugucacagacaacagcauaugcagggccugcacaggucugcaucagguccuuauggcuccgugacugcucucugcuccuuguguccuucuguacagugcuccuacaguguugucuguuuaauugacuguuucauuuaaauuuauuuagcaguuaauucaugcuagggcgugguguugguauggaacuuuagaauaggcaaaguguauauauguguaugugauuuacuaaaguauaugugauuuacuaaaaaaugcaaaggaacuuagcaauguccuguuaaccacauuuuugcucugucuucaccaauacucauuucuugugcaaauuuccucauuuauuuaaagccaggugagcaugaacacugcucuuaaaaaugcaccuuuaucuuucaccaccuugugcaugauacuccagcaauaugaaacugguacaguucugaaagccauccauucguuacuugcgggauuuuuuucuucuggucacauccacuuggcccaugcucuuaaucuucugucaggcugcuucugagucuucacauacauaagucugagugaaucaccgcuucaucuaagaagcugugcaucucuccucuguuguucagcaauauucacaccgucagugcucagauaggccuggacuccauacuccuuuaccagagccuggcagcuuugcauggagcgaaauauuuuaacuuaauagucguuugcuacagcuacuuacuuuuugcucuccuugggaaaauugcaguaauuggguaaaaauacaaguauggcuaucuuccgauaaaacuuuauguauaaagugagucagaaaugacugauucaguauugcuagcuaaccucuggaguagaccaugagucguuaauacauuucugugaaacaucaucuucauuauauuacuacaugugcuaguacuaacuuuuauauuaggaguuuauuuuuaguuuuaaauuaacuuagcaaaguaguggauuuccaucuauaucuuguuucgauugcuucuccuuccugcuuuacucuucuuguucucucugucccccuuucccugcugugcccuuuagccacugggauuuccccauccacuuugauggaucgucuuccccacucucuucucccuuaaaucuuucuuucucuagucacacgagucucuuucuaggucccuggcuuuacccauauuuacucccaucuggagacacauuuaacaguaguuuaucugugccuggauuaucuugugauacaguauuuuccaguucuauccauaauuucauaaauagcauuguauauguguuccacauuuucauuauccauucaucugguagacauguagccugacuccauuuccuugcuaaugugacaguguuaacaauagauuugcaaguaccucugguuuuuguguguauguccagaagugguguagcaggcucgcuuguuagcccuguggcuaguguuuugagaagccccauacugguuuccauggugaccacacugauaccaauaguagguaaagauccugucuucuacucuuucccaguguuugcuuuccucacaguggcuccaggugcagcucucuguuuucauguauuccauauaauuuuugucuuuguuauuuuguugguaaaaguuucucuccaaaucauacagguuauauauauacaggcauacaggauagcaaccaacuaugaugauauauaaaaccaauucuagaacuugauuuuauuuuauguaaagcuuaaugugccuucccacagaaugcauuguuugcauuccagguauaauagucauucccuuaauucuagccuuuguaucggcuggcgaggaaagcugccagauaaaaaccacaggccuguggggucuacagauaagauuguauuucugaaauaaucacuuacacuauauaugcauuuuuaacuuuguuaaauaauuucuuaaauuguaugucguggucuuuggacguuauggcuauugacuugacuuuggugaggaaggugagcagagcaagccuuuuuaccaaaucuaagggaagaagcguggcgguugagaggcguugagguggccuucccucucucuuacauccuuucuuucuauaaaaagauucaaacuacuuaaaucaaacugccucuuuuggucuuugucuucugaauagugucuuuaaguacuuguauuaugugcugaggaucaauuuggcuuacuuguaacauugugaaugugcuucaaaacuuucuaccauuacucaucaguaaaaaaaaaaucguauaucuuuguucacuuuucucucaaaaauuuucuuaguaaaguaggagcagauugcucugcagagaaauuuucaauaaaaucuaguaguucuccuuggggggggaggaguuucauuagcacuuucuaaaaggcucauugauagccccuuuuuacucuguuuuacuauuuuuuuaaccguucaguaugaaaaagaaaaccacacauauacauauuccuaggaaucuuuaguuuuugagaugaauuaauuuccugaguauagaaauaccuuucuucaaacauugacugaaugauucuacgugguuaguagucagaaacacacugcuagcguggcggggugaaagucagcaguaagacgcauugcagcgcagaggaggaaagacagauggauggguacaguguucagggcugcgacauggagaggucaccucaacggagaucugaaggaugaaugaggguuugcaggagcuggguguguuuauguacaccuguguucaugucaccgagaacaugggaacaggagaaucacaagcuggggcaaacugagccauaugcaaaacuaacucuaaacaaaggaagaaagggaagaaaaccuugccuuuuagacuggugaugggaguuguggcggcacauaugacaaaguuaaggcauaauugcucccuguggacacuguguccaacuuggggaggucuccacggacagggccacaccgugguugucaucaguugucaucgcugaugaccagcauuuagagaaccaugucuagcugggaucacagauacuucauucgaaaucuaaaguaaacacuuaauugcaccaggaaucuaugcacacauuguggacugguucuuguuccucuguuggaaagcuuucacagaaaaugaguuacugugauuauacacaaacaaauuauuugacauguaauuaauugggacaaauaccaagacuuuuaaaauucauuauucugaccuaguuuaucuucucuaugggcaaguuagagaaagugguucuggucuuuuaguuauuuauugccucuuuucugcaauuuuccucuguucaaucaaguuugaggaugacacuauuauuauaacaauauacauuguauuauaaagagucagguuugggguuuuucuuuucuuucuuucuuucuuccuuucuuucuuccuuucuuuuuuuuuuuuuuuuucaucacaauucugcuucuuucuuugauuuucagacuccauuucaccuccuagucacagaucaacaaaagaacuacuuuuaggauuccauuuccaaagacucugaaucagagauaugccugacgguggccuagaaacuuaaaauuuuauccagcacuguaggcaguuuuccugggggccuagugaugacuaaaucuugagaagcccauuucuggggagcagaauauaauacuuuuuucucaucagcaacaauauagaucagccauuucucugaacagugaugagagcaugugaagaaugcuaaccacuaauuagacaccagcuuuucuuccuauggcugcugaaaaaaccggugcccuguuaaaucuucaaaaucacagcauggcaaaguggaaggcuauggagcucugagguuugagggucacacauggcgccuuccucuaacuguuaggagccagcagauggcagcaguucaaugcuacucugcauagguauccacuacaagcagguuuaacugugggcuuacaauauuuaaacugggagaaaaugugcagacgguguagaaaaugcaguggggaaggguggguaggaaaaccguuuuauuugcugcuaccgcucaauuaaggaagcuuauuguuucucaguaugcagaauaucucuaucguaacaaacuccaguuuacuugaaaagcuaucuuguuuucuccaauaacaggagcaccauucucuguaguguccuuaaaauuugggcaguaguucuuauauuuuguuuuuaaacauguauugugugaucaugccuuaaagaaacaaguuauaacuacuuuguaauccagauccuugggugcuagcaggcugucucuuagccaguaggaaccuaguuauuuaagguaaaagaaaaagauaaaagaggaggagguaaaauuugaaaauaaaaaugucuaauacagcauuaaaagguucguuuacuuagacauugaucaagcuaaauugauuauaaccaucuguuauuaaagcuuuauacuaauagagaugaaaaaagauuaagaaaugaaguuauuguuuaacagucaagaugcuuuuuuugcuuucugcuuaaggaguaaaauuuuaauuccaccuagcaguacugauggguggcauccuucauagguucuccuugagugugauuuuauccuugagucuuccuauaaauguguauguauuaaagcaaaacaagaacaaguauuuuauucagucaaaucuucucuguuuucaacugcaacuauaagaacccccaaaucuaauuuagugcuuauugacuauuuauuuggagugucaucaauuugugauauauuaacauuaugacuuguauuacaucuuauugcuauagcagucuuaauugaaauuaugauauguuugucuaaugaaaagucgaauguaguaauuacaaucaaagagaauguuuuagagugugguauuugaaaauugcauugagauuugaaauacuacuuguuuagaaaaauggagaaaauuguuucuuuucuagaagauuugauaaagggaaaaaguguuaacaugcauagcauuaagugggucuggacucuuggccccgcccauagcaguggaguuucagucagauuuauucauuugaaccucucuucuuaaacugggauuaaugggguuuggugaugucuacaugagacagugaaaauuaaaaaugcuucauacuguacugcuucauugacuguuaaguuugccaacacaguuucaauccugcaaaucaacaugaauuauugacucacagggauuuucuaacaucccugaacaugguugccuuacuuucugugaggaaagggaaaguggguggaaccugguacuggaaaugucauugucguaacguguuacuaugcagacauuuuaaaagugaauaaaauucuaaaucagcaacguuuuuuguguucauuuuuaucauuuaauccaagugaggcagacacagugugguuuaaguuaauuuuggcuuuacauuuauguacuugaguguccuaauuauuccauuagauauugcacaaauuuaucugauaacuaucuuucuauuaacuugagucaugguuagcuauuuauuuaaaugaaaaugguccaaaucauucacuuguauaugauugaacagugacugucuuaguuuagcuccuuccuuaauggcgcuucacuagagcaagacuggagggguaugcuggaaaacggcagauagcuuugcuuugaaacauuuacuugguggaauuuuauuuuacugugccuuauuaauauuuuucauucauaaauguugcacaaauuauuuggugcagaacaaaaauagcaacauauuugaagcaaaauggcaaaauuugccuuuaccccgauucucccagccccaagugauacuccaacuuauuucccuuucucagauuaugcaccauaguuaugugucuguuuauaauuuacugugaacugaugccccaccuuuguuucagcauauaugaauucauguugaauguuaaugcauuauaccauuuugucuuuuuugauaauaucucauuaauuuuacuuauuuacuuacuauuuauuuacuaucgucugcaaaacucaguaaauugagcagguaucugggauucucuggaguggauguucuauuuccuugccagcacuuucuagaaaaaacugaucccacuguuugaacaaguuggacuuuaucucuugcagcaagagaacauaaaugaaggagugccgcaggguaucugagaggauuuagcauuggugauauccaggcaucugaccuguguuaggugauugggaggguuagguuuaaggaaguggguguggugagucucaucuagaaaugaagacuagaaugggacucgggcuaugacuagucaggacgauacaguggcucaugcuagugugcugugugaucauguguguaguguugacgugcucuccuguauaggaguucucacugagugauguucuuuugugccacauuguauuugucugauauuuauauucaauagaagaauccuguaaguauugaacuuuuguagccaaaccaagaccugcuugaggcuucuaggccagcucuguggugacaggggcuguuguuacauucuaucccaguuuuaguggcuuaaguuuucuuacucuuuauacuuacagcuucauauugaugaaaauauuauauaaacuuuuauagcugaauuauaucaaauuauauuauuuauaguuacaucauaaauuugaauuuuuacuauuuuuaaaaagccuguacuuauuucuucuaccaacaagggcaccucagccaaagauaggcauugcaagucuaauuuuuuuuuccuuuuugcuagugcuagaauauuauucucccuuuaaaacccauuuuuauacaauugaccuuuacuuuuaaaacuuuauuaaauaaccauaauuuuccuguucacauccuuucuccauuuaaauauuagugauauauauauguguauguguguguacauuauguguguguguguguauacuuaucaggguuuaaguacucuucagggguuuuaagggcaaguugauauuuauauggacauuaguccuguguuuuuagucuuuguuuccuauaucuuucauuuuugcauagaaaaucacugacuacccuaaagcuauuaaaacaguccuugaucagucauuuaacuuugccucuaaaucugggauaugggauauuuuuugugugugucucaaagacgaacuuuuucccagaagugcucugguguaccagugucauuuguugcugagucuguuuuuauuuaguggaaauaccaguccuuuuuaagugcagacacgggcaucugccuauggcaaaauuucucuuaacugaccuccuucuaagugcuuggauuaacugauguuguuuauuuccucugugaagcaucuggucugaagacaacaauaagccagaugauauuuguauaugucuguacuauagaugaugcaaucaguacugucaugauauacagugcucauacugagauaaugauauuucuaacaacaguuuuggguaguuguacuugcuauucuguauuucuuauuuacuucaacauuaucaaauuuaugugaguaaaaaugaaagaugaaauauauuaauuaaagauuaauuuccuucucuagggaaauuugacauguuuuaaaugugcaauugaauauaaucuggugccuaauaagcauuuguuugcuaaaugguaaauguuugaauguauuaucucauaaaacguuuuguugauucuucauauuguaguucuauguuauaaagacagauacaacugaaaauuuauuaacacauaucuaaguugauagcagucuaaaugcuacuuuugcgauacagcaacgguucucaacguguuugggggggugucuaguguaucuuucaugggguuacccgagaccacuggagagcauagauauuuacauuaugauucauaacagcaaaauuauaguuauggaguagcaacaaaaauaauuuuauaguuggagaucuaguuaguaaacuaaaaauacugaucauuaaaccuaaaguuaagagaacaaauuuacuguacuagcuguuucuugauauaacaacugcagaacuuagugacuuggaacaggaggcagugaccaucuaucucagucucaguggccaggaaucaugaaguggcguaaggggcaggcagucucccugaugguuucucaugggaaacgugaccucagguaaagaaugccauuucaacacugcucacucaggaugcucuuuuauuguugaaagccuucaguucuuugcugugcagguuucucuguaacaucccugucuaaucaucaccacagcauggcugcuagccuccuuauagcguguaaccuaagaaagcaaagauggugauguaaagaauuuuguguugcaugucaccugucacauuuaauguguuucauguguuagaagagaaucaauacaguuuauacucacaggaagggaaauggguacagcuuuugacuacagaagaauuggccgugcugguauuuauuuugcauuuuuauggaucaggacuaggaauggauuuguuuauaauccuugguuucuuucuaggacaccgccuuaggaaaaccccgagagguguuccgccuuccuacagaugugacagcauaugacaaucgucuuugugcaucuauccauuucacauccccuuccuggguuaccuugucagauggaacuggaagacuguaugucauuggaacaggugaccguggaaacaguccugaaaaaugggaggugaguugguuuucuuuguuguucuuuguaagcuuugugaggaguccagaagguauauaaacuagacucaggagccauuuaccagccuauguuguaugcuuuguuaagugcccccuuuuucccuugugauucuggggguuugcuuuuguucuuucucuccuguucauucuguuaaaauguccugcuauuucuuuguuuuguuuguucuauuaagggugcugaucuuauuuuuguuuuauaaacuguguaucuaaaauaugugugauuuauuuuccuauagauuauguuuaaugaagagcuugggaacccuuuuauuauaauucacaguaucucacugcugaaagcugaagaacauucaguggcuauccugcuucuucgaauagagaaggaggaauuggaccugaaaggaagugguuucuauguuucuuuggagugggucguugucacuaagaagaaagaagguaaagcaaacaggauucugaaccucuagccugccuucacugguggggcucggaaagcucuguuuacugcuugcuucuugagcaauguaauaaauuaugcuuuauaagggcuaucauaugcuucuacgaguauuuguacauuuuguuugaaagaagacauuacauaaauuuuggagaccauaagauacaucauuuaaauagccaagaguauauaccuaaaaauucacauauaugaacauggauauaaauaaguagguguuguguaauuuucuuucugugagacaugaauaagcuuuguucgcauuagacauucauggacagcagaccaaaguagcaaccauguguagcuuagggaggcauugacuuuauuggagcuguauacaagaacauaaacaauguguuacuugccggagccugggugguucagcacuaaaaagcccaugcugcacugguaacaaacucauaaaacuuucuuccuggagcuuugcccaaccccgagcauucccaggagagucuauucuguuauaccuucuauaaccaugggaggagccuuugaauuuuguaacuuucaggaguuuccugaaccuuguuugauucaccugagucaaaugagccucucuucuuucuaaauaaggaccuguuucaguacgcaggaaauagcuacuuaacagaaauaggacguuuuaauguaauuugaauauaaauaagaacuagaagauggagucgguuccuuccuuuuugucaacauugucuuuuguguuuaucuuccauaaaacuuuccuuauucauguguguaauaaagucuuaaaacuuguucauuugaacugucagacuuccagcaugacuuuaaagaguagcucuuguguaguucugagcuuccuuccccggggauuuugugcuccggaagacucugcuuaguuuaagagauguaucugacguuccuccuuucugucacuuuucuguuucucuaauuggaagcuaagggaguuugcuuuguguucuuguuuuguuuuguguuuuccaguuugacauugucccacugcuuuuccuuguucaguuggcaguaaauuaacugaaauucuucaucacuacaaaacagcaaaccuaaccaaaaacccuucuuuaccuuacugcuaauuuacaacucggauacaggcauuaauacuuguauucuagaaggaauaacugccuuaagaaacaucuauaugcacaugaaaauugcuuaugcuuaagcugaauauauuuguuguucccaguauauauuuccaucucuauaguaaugcagaaacuauauguugggggugggggguggggugggggacuguuuuacuguuaucagacagccugugucacagcuauucagcugugcaguuauggcauaaaaacagugacgaauggguaaacuagacucuaaaauacuuagggacauugaagcuuaaauacuaagaauuguuacaacuauauaaguauucuuuugcuccuuuuucuacuguuuaaaauacagucaugcuugacucaagcuguaugaauacagauagagaccggacuuuggauccuggguuuuaguuugaagacuacuacuuacggaaacaguggaaguauuucuuaaggaauaugauucuuaagaggagaagucaucgugcauuuuccuucucuaagaauauggcuguguaguugcaaaucaguccguguccaugggacuuaccagacggaugccuguagacacccacagcagcucuguccucacagcaacucuucgucaucccucuucucagcugaacaagcacucuuagauuuuacuuucuuuuugcuucuaggauucuuauuuguagaacucagcaauuuucugaagauucugucuuucuuugcucuuuuuaguaucuuguuuucuccaguuacuaauagaauugucuucucuuaaaauaauuuuaaauccaccuccccucuguguguguguguguguguguguuuucaggguuguacaggguguggaggccagaggucuacuugacgucuuguucauuagaagcagucuaccuuguguuuugagguguuuucacuagucugcagcucaccaaguaggcuaggcugguuggcaguguccauaagcacccggcucuucugcuuuccuagugcugggaauacaagaacaugccaccacgcuuggcuucugacguguguaucugggggccaaagucaaguucucauguuugcacagcaagcaccugacugacugagcuuugucaccuguucuuagugcuuggaucuaauacaguagagcaauacuucuucuaaagcauguugaggcaaacacaggauaaauuauauuuuguggucaguuaauuuugaaaaugaaaauauuuauuauccccaaaacacacuaaguugauuuuuaacuaguguuaagcuuacaaaacuaaaaucuauccaauaguguaguaguaugaagguauguccuugucugaagugauguuuuguuacuugcuugguuucuuucuuuaucauauuuuuauuauuuuuuaauuuuuauauaauauauuuugaauauauucuuccccuucuccuaaguccucccagaucaucccuccccaacuucacguuccuucacucucucucaaauaguccaaaaaacuccaaaacaaacagaaaaggaaacaaaaagacaaaaacacuaaacauagcaaacaaacaacaaaacaaaacaacccccuuccuauacacacaaaaaugugcguggccuuuuaaauguuuauucuggggacagaauguuggucaaacacuuccaagugggaggucugcccuggaguguguuugguauacguggugauucugcacuggagaaaagcagcuaguaucaauuguagauugucuugguuaggagugggacuacacuucacuuccacuuacuugugcuggaauuuuuuucuggcacaaacuuguauaggucguguaugugcugucagagacucugugaguucauagguguguuagcccuguuaggucuauagacaccgcuuccuuaaagccucccucugucucugcucuguacaguuuucccaccuccucuucuaccuggauccccgagccaagagaggaagaguuugauagaaacaucccauuuagggcugaguucuccaagaucucaacaucugcacacuguccaggugugggucucuguguuaauucccaucaaacacaagaaguuucccugaugaggguugagggauaaauuuacuaaaaccuuaaaauacuguuaaacugauauuuauaguaaagguuguaaguguuauuucauuauugaucauaauagucauguaguucuaauuugguauauaaaacccaacuacuauaaaaauauuucauuuuaagaaaccuuauuuaccaguugcuacagcaagaaaaaccuaguucauuccaugcuuuccccucaugcucggauagugucacauaccugcggagaaaguagucagucaccggcauuagccacuaggcauaugugguuacugaggguuugaaaugugucuaaguagcugagguugugaauuuaaagcuuaacuuuaauuaaauagccauuugaagcugguggcuacugcacugcacagaacacauuaaagcgaaguucaucaaaaccaguauuuuauaguaggaacuuguuugaggacaaugaaguucucagguguaugugugcuuaucagaagaaaacuauggguguugguucucuaccauguuggucuucggguuuguuggaacuugucaucaggcuugguggcaagggcucuuacccacugagcugccuggggggggggggcaaaguuguccauuuuuuuauucuaacucaaagacucauuaaaauguagcuuuuuauaauguuuauuuuccuacagauaguaaaaaguaugaaauuacaaagcaucauguucuccguggaaagucagugccacauuaugcugcaauugaaccuaauggaaauggucuaaugauuguaucuuacaaguccuucaagguuauuucgggagaucaggaucuugaagagaauauggaugaagacaggccagagaaaaucaaagguaauuuaaccuguugaggcagcucaugcaugccuauguccauauacacaucuaccugcuuuguccucucuccaacacguuauggguuccaccauaacauagucagaacauaugucccaggaggaacaaaagccgcuuucuuuuaguuuuguuucauauccucaaccugcacauguugaaugauguggccugguuuaccuucauaacuuuguaauuaucugguauuuuagaaauugcaguugggucaaacaugauucccuguuuaauauuuacuaaauaaguauuagacaaaucaaagugauaauauucucccaaauaaggccuaauagaccuagucuuaccuucaugcuaaacugacagugccuugaaggcagaaucacugcauuucuggauguugagugaaagagaaaauguuauaccuuagauaccgaaaguccaaaagaucuguggcagccuugugguggggcuugccuagcauacgcaaagccccagguuuaaccuucaccauaagaaagcagggaaaauguaaauguuaauauauguccuaugaugaggggauuaagaaaaucuggauuuucuuuaaucugucuucuaaaacagacaugaauuuuauacguuucucucuuccucauuguuaucagaaguuauccauuaugugaucauaaugaauaaacuguuauguucacauuucagggagacgugugugugugugugugugugugugugugugugugugugugauaaaagggagaugaaggggagggguagagagaggcagaaagugaaguaacaaaggaagagauugcugucaauauuuuggggugccagucucuuaaugcauuuuguggaccuggaaaagaggaaaauauguguauuuguuacaauuccuugugucgauuccuugaagucuuguguguuuauaauuuguguauaugugagagaaaugaucucuagacaauauugauuuggauagguguucucuuagaugucuagcuauacuauccuauguugugucuaauuuuuauugcuacauaaugccuuuuccuauucccaguagaaccucuguauuacuggcaacaaagugaggaugauuugacaguaacggucaggcuuccagaaagcaguacuaaggaagauauucaaauacaauuuuugccugauaauaucaacauuaagcugaaggauauccaaguuuuggaaggaaaacucuauucaucuauugaucacgaaggcagcacauggacaauuaaagagaaugauagguauuuuuguaguuuuacuuuagaaaauuuauuucuuaugacuucacauuuuccuucugaucucucuacaaguagguacauugaaggugaauauaauaguuucaucuauaucgauuuuucagacagauuaaagauggugaaacuacauuaaaauguaauuguaguuaagauugaugcugcuauacuuacuguuuuucaugaccagcucuauauacagagauaauaaaaggugaaacuauuuacuuauuuucauucguacucuuaaaacauugcaguagaaauaauuucaaguuuaauuugcuuaugauguaauacaaucccuuuaucuaaauguauuuaaggucuauaaaagguuauggcaugagaaggcucccucuaaccagucccaccagucccaggugugccucuccucgaugcuguuacuagguuccuucuagagacauuuccugauuacucugcuaaaguuucuguuuuguuuucagggaaaaaaaauucugcuauauguaugugaguguguguguguauauauaauauguguauauuauauauaguacauauauggcuauaaaucuuguuuuuuguauuuguaacuguaaauuuuaaauauauuuccacuaaggauacaugauuauuuucaguacuuuuuucugauuugauagucauuuaaagcaguuagacuucugucauugaaccuuuagaauauuuugcuaauaauaauuaaauaucuauaggcaaauaacugugucacuuugcauguuagaaagaaaauuacuguauguguagaauuaauauuucagaauuuugagagacaaacuuuacuucaauauaaacugaucauuuauagcucuuuuuuguagucuguauuugcaacacacaaaaaaauuaaaccauaaaagaaguacaugauaauugaacuucaucuaagauguuucugcuccucagaauugaaaaguuaagucaaaugugguagugcaugccuuguaucccaguacuuggcaaagcugagguaggagagucaggaauucaagcucagucugagcuuuuuugggucugaggucaguuuggauuacaugagacccuguuuccaaaagccaagaucaguuuucaaaaauugaaauuuuaugcucaucuaaaaacacauuuuaaaaaaagagagagagaaaacaccagaagaugaaaugaugcucaugggucaguaggauuaacauaguaucaauagccaucuuaccaauagcaaucuauugauucaacacaauccccauuaaaauuccaaaacaauucuuuacagaccuugauaaaacaauaccuaacuccauauagaaaaaacaaaaagcccaggauagcuaaaacaauccuguauaagaaaagaacuucugcagguaucaucauccaugauuucaagcuuuucuacuaagcuacaguaaaagaaaauagauagauuagauagauagauagguagguagguagguagguagauagauagauagauagauagauagauagauagauagauagauagauagauagaugauagauagauagauagaugauagauagauagaaguaggaaaguaagacaugaacaguuaagaaaauauuuacauaaaagacauuuucaaugcuugaaagcccaauacauuucuaagauaaccuagggccuuaggauauauucaguugcuacagggcuuguguagcauacacaaauuuaaugauuuuuuaugguuguuguaauauaugaaaaacaauuauuuuucaaguucuuuuaaaccgacuuuaucuuuccucauuuguuugucauguguguguguauguacaagucuugaggauagcauuuaaaauuggcuguuaaaaaguaauaaauaaaauugguagcuagaacauacuguugaaugaaacgcuuuccagcuugugacuuugucagguuacuuaacaucuuaagguaugaguuuuucacucauacuugggaacauaaagauaugacuugauuugguuguguuaagcaauaaaugagauaaaacaggaagugucugagguagccccuagcauaugguaaagcauuagggaaguaugagcuaauauucuuaucauuuuuaucagauuaguguauuccuuagagaauauaacuaagucugggcaucauugauuguggugauaauuuucauuguuaaugguagggacuuuuauuauauaacugauauuauuuaguauaguuucuuaaauaguugcagaaaauuucuaaauguuauaauuauguuaugguuguugauaauaacugucuuauaaaagaauaguugauauuuuugcauguucuauuugauaauugcaguaccgguuuuauuguacucuuggaauuguuugcuugaaguuuuuuuccagggugugaguuaguaugguguacauuuaucggaaauggcuugugcaaaggauuccuuccugugaaaaugauacagaaggccuaccaccugaguuuccucuucuguccuaagaacaugggccagcuucugcuucuucugucugugguccgcucugacucagugcucccuuuuuuuguaacauaaguucuugaucuucgggucucuggcaggcucugcuuaguacauuuggaguuuauguuuaacagcuugaauguauagaauuagauuuaaagcaaguuaugcagacuacacuaacauuuuuuucuguguuacaaaguauacuuugaaauuucuacauuuguuuuuaguucuuuuaaaaauccauguuuuaaaaauuaacauuggcauuagcuuaacuugucccaucuuugauuacaauuauauauuaagacuguuaauuuaugguaguuuaugguuguugagccucuauccugaaagcucuuuaguuguaggccucuuguauguguccacugcacagcccauagguccaggccacaugcccguauauuacuuagauguaguaacauacugaacaccuauguccaacaguauuuuccacaugcugucuuucuaaucauuccaccagucugucuucaaagcacuugaugcuccauauccaaugacuuucauguuuacucaugaaguuuaggugauuuaucauuggauuacagauuuuuccaucauguauaaagccaaaaaugaauaagauuuuugauaaaacacucuacauaccagauaggugaaugucuaccuucuucucccucccuccuuucuagucuuccccuccccuuuuuccugucucauuuugauaugugcucucacuacauagccucuagugguguugaacacuggguucuuucuugucugggcauaguacuggaauguaauaccacaucugauuaaauguucaauguuuaauguaacaucauguuucucacuuaauguuuuagcuuggagauuucuuugauuaagaagaaugaaggacugauguggccugagcuggugguuggugauaaacaaggugaacuuuuaagagacccugcccaaugugcugcaauagcagaacgcuugaugcaccugaccucugaugaacugguaagccauuaccaugguaaggcacuuccuaagaauccagaauaucuaguaugauuaugccaagucaagcauuaguuugccuuucuuaauauaaaugauacauuaacauaauuaauguuuuaauauagauugaaguucuauuauuuguauagcuuacucugaauauauacaaaaaugggaaagaauacuuuacaugcuguauacauguagauauguaucucaacauucuuuagaagaaucgaccaauguugacaaacaaguuacaguuaugccacuuaugugcuaauaaccuaggcugauucuauuacuuaauuauuauaaauagagcuauaauacauacauguacagguugaaaucacuauggaguuuacucaaaaaacuauaaguaaaacuaucauaugucugaacugucccaccucccaguccuggguaaguguucaaaugccccuuuccccauguccucaugaauagaacagucaaaaacuaaccaauguaaaccugaguauuauauaugugagaguaaguauuaaagacagaaaaugagauaugaguaaaaaugacagugucaguaaacacgucucucauuuccaguguccccgagagggucccuguguucuuuuugucaucuuguggguuuaaaaccuugcuccuuuauaugucuaacauuacauguucuuaucucugucaucucaggucugcgucuguugcugcucuuugccuuucccugccccgacuucuuucccaagcccagucuugaguuaauauuaguggggauguggaagauggcugugguuccuucuccaccaccuucgagugaagagauuauucauaaugaaugaaauauuuccuuauaaugauuacaaugaccugacaauacuuuuuggcuaugagagaacauacuaccauguuaaucacuugcaguagccuauugaaauuuugaaaacauucagcaguacauugauaaacauugguuacauaaucauuuacuaacugauauuauuagcacguguaaucaucugacuuacugcuauguugacuaagagugaaaaagaagauucugaaaaacuauuuacccugcaggaauaaggugcauccuaagcuagaaaagagagauuaaauuguugaaagugauuuuuuuuuuuuuuuuuuuugcaaagagaaguauggcccaaauagagagcacaaguuucaucuuugcuaacagucauuaacaauuucaggaauuauugcaacucauaugccaggcuugaaagugugauuucauagccguuuuuacaaaagccuuauuccccaggcucauucauuuggcagauuuuuauuauaaccagcuuuguugagaauauaauaauugugacacuagaagagauuguagauaauuaagcugaacuccuuuuaagcuugaugguuuugaaggaacauugauauuuauggaaaagcuacuuauuccccaaacaaugguuuuuguuucgaaaaaugcaaaaauacaacauugucuucuacaccugauggcagugaacuugggaaugggaaauaguuaaaugcucuacuucucaacuuuuggaaaacaucuauccacuuuugauaucuagauaaugccucacucauaaaaugacuaggcaaagcuuccugcagcauggaagagauuguauaguauuacuauucuguuuuuuuuuuuuaaaucagugucuuuuauuagauauuuucuucauuuacauuucaaauacuauccugaaaguccccuauacccugccccugcccugcucuccaacccacccacucccucuuccuggccuagcauuccccuguucuguggcauauaaucuucacaagaccaagggacucuccuccaauugauggccgacuaggccaucuucugauacauaugcagcuagagacacgaacucggaagguacugguuaguucauauuguuguuccuccuauagagcugcagaccccuucagcuacuuggguacuuucucuagcuccuucauuggggacccugugcuccauccaauagaugacugugaacauccauuucuguauuuuccaggcucuggcauaugcucacaggagacagcuguaucaaggucuuuaauucuauucaauguaucaaugugucugucacugugccacugccaugcaguuuuuaaucacaauugcucuguagugcagcuugugguaggggauggugauucuaccaggaguucuuuuauuguugggauuuauuauuugcuaucuuagguuuuuugucaauccagaugaauuugcaaauugcccuuucuaauucuguggagaauugaguuggaauuuugagggggauugcauugaaucuguagauugcuuucggcaagauagccauuuugacuauaguaauccugccaauccaugagcauggaagauauuuccaucuucugagaucuucuuuaauuucuuucuucagagacuugaaguucuuaucauacagaucuuucacuuccuuaguuagagucaugccaagguauuuuauauuauuugugacuauugagaaggguguuguuucccuaacuucuuucucagccuguuuauucuuuguguacagaaaggccauuaacuuguuugaguuaauuuuauauccagcuacuucacugaagcuguuuaucaggcuuaggaguucucugguggaauuuuuagggucacuuauauauacuaucauaucaucugcaaagagugauauuuugacuucuuccuuuccaauuuguauccccuugaucuccuuuuguugucuaauugcucuggcuaggacuucaaguacaauguugaauagguagggagagaguggacagccuugucuagucccugauuuuagugggauugcuuccagcuucucaccauuuacuuugauguuggcuacugguuugcuguagauugcuuuuauaauguuuagguaugggccuugaauuccugaccuuuccaagacuuuuaucaugaauggguguuggauuuugucaaaugcuuucucagcaucuaaugagaugaucacgugguuuuugucuuugaguucauuuauauacugaauuacguugauagauuuccauauauuaaacaauucuugcauccuugggaugaagcuuacuugaucaugauggaugauuguuuugauguguucuuggauucaguuagggagaauuuuauugaguauuuuuguauugauacucauaagggaaauuggucugaaguucucuuucuuuauugggucuuuaugugguuuagguaucagaguaauugugacuucauagaaugaauugguuagaguaccuucuguuucuauuguuucuauuuauuggaauaguuugagaauugaaauuagguuuucuuuaaaugucugaaagaacucugcacuaaacccaucuaguccuggacuuuuuuuuuuuuuuuuuuuuuugguugggagacuauuaaugacugcuucuauuucuuuaggggaaaugggacuguuuagaucuuuaaucuuauccugauuuuacuuugguaccugguaucugucuacaaaauuguccauuucacccagguguuccaguuuuauugaguauagccuuuuuguaguaggaucugaugaugcuuuggauuuccucagguucuguuguuaugucuccuguuucauuucugauuuuguuaauuaggaaauuguaccugugcccuguaguuagucuggcuaaugguuuaucuaucuuguugauuuucucaaagaaccagcuccugguuugguugguucuuuguauaguuuuuuuuguuuccacuugguugauuucagcucugaguuugauuauuuccggcauucaacuccucuugggugaauuugcuuucuuuuguucuagaguuuuuaggugugcugucaggcagcuaguguuugcuuucucuaguuucuuuuuggaggcacucagagcuaugaguuuuccucuuaggaacgcuuucauugugucccauaaguuuggguauguuguggcuucauuuucauuaaacucuaaaaagucuuuaaucucuuucuuuauuucuuucuugaccaaguuaucauugaguagaguguuguucaccuuccacaugaauguugguuuuguauuauuuauguuguuauugugaucugauaggauacaagggauaauuucaguguuuuuguaucuguugaggccuguuuuaugaacaauuauauggucaguuuuggagaagguucccugaggugcugagaagaagauauaucuuuuugauuuaggauaaaauguucuauagauaucuguuaaauccauuuguuucauaacuucuguuaguuucaaugugucucuguuuaguuucuguuucuagaaucuguccaaugaugagagugggguguuaaaagucucccacuauuauugugugaggugcagugugugcuuugagcuuuacuaaaguuuccuugaugaauguggaugcccuugcauuuggagcauacauuuucagaauugagaguucaucuugguagauuuuuccuuugaugaguaugaagugccccuucuugucuuuuuuugauaacucuggguuggaauucgauuuuauuugauauuaggauggcuacuccagcuuguuucuucagaccguuugcuuggaaaauuguuuucagcauuuuacucugagguagugucugucuuuauuccugagguagguuuucuauaugcagcaaaauguuggguccuguuuacguagccagucuuuuuauucuaugucuuuuuauuggggaauugaguccauugauauuaagagauauuaagggaaaguaauuauugcuuccuguuauuuuuguuguuagaguuaggguucuguucuuacaacugucuucuuuuagguuuauugaaggauuacuuucuugcuuuuucuagggcguaauuuccguccuuguguuggaguuuucccuuuauuaucuuuugaagggcuggauuuguggaaagauauugugugaauuugguuuugucauggaauaccuuguuuucuccgucuaugguaauugagaguuuugcugaguauaguaaccugggcugacauuuguguccucuuagggucuguauaacaucuguccaggaucuucuggcuuucauagucucuggugagaagucuuguauaauucuaauagaucucccuuuauauguuacuugaccuuuuucccuuacugcuuuugauauucugucuuuauuuagugcauuuguuguucugauuauuaugugucaggaggaauuucuuuucugguccagucuauuuggagaucuguagacuucuuguauuuucaugggcaucucuuucuuuagguuagugaaguuuucuucuauaauuuuguugagauauuuacuggcccuuuaaguugaaaaucuucauucucaucuacuccuauuauccuuagguuuggucuucucauuguguccuggauuuccuggauguuuugaguuaggauucuuuuggauuuuugcauuuuccuugauugauguguccaucuucuauauggaaucuucugcaccugagauucucucuuccauuucuuguauuuuguagcugaugcucgaaucuaugguuccagauuucuuuccuaggguuucuaucuccagcguugucucauuuuggguuuucuuuauuguuucuacuucccuuuuuaggucuuguaugguuuuguucaauuccaucaccuguuugguuguguuuuccuguuuuucuuuaaggacuucuaccuguuugguuguguuuuccuguuuuucuuuaaggacuuguaccucuuuagcaguguucuccuguauuucuuuaagugaguuauuaaugucuuucuuaaaaucuucuaccaguaucaugagauaugauuuuaaaucugagucuugcuuuuugggugugucgggguauccaggacuuucugugguggguguacuagguucugaugauggugagucgucuugguuucuguuaguaagauucuuacguuugccuuucgcuaucugguaaccucugguguuagauguucuagcugucucugacuggagcuuguuccuccugugauucuguuagccucugucagcauuccuggaaguccaacacuuuccugagucccaguggucagagcaguuucugcagucaagcucuccucuugcagggaaggugcccagaagucuggagcucagauccaccuccugagucccggggucagagcccucccuggaggcugacucuccucuggcggggaagguggaugaagacccagagggacccuguucaagaagcucuguugcuucugcugcccacgugcuguccuguguagccuggucucagugaucccaagauccuuggugugcuagggccugccaaguuggcuggcacugaccugaaggaaucccagcaacuaguagggcgggguuccuuugucccuguuccugcuggcacaagacccuccaggguucuuuggaacagauguuggguucuacucaccagggaucucaagauccugggugugcuagggcgccuguggcguggggaguucucuggggaccuugggacccucuccugaguucguguggaagaucuacuauuauguuuuaacauccgagcauucagcucccuuuuuugaaaguuuuuaacuauucgauuuaauacguggaguuuuauuuucagcucuuuacuuuuuuaauuacgguauuuaucgcucccuuuuguuuacuuugaaaguuuguucuuuucucugccuuuagagguagcuuagacaacuaauuuuuaaaauaauuaucuuaauguuucccuuuuuuguuugcaugugcaaacacacacacauacacacacacacacacacacacccacacguauacacauuagguggcugucucuaauacuauuucuuaaaaaguaguauuucaguuacaacguaggaauugugcaauguaucgacuccuuucucuguauuaucggcauguguuuauuacagucuguuauacaucauuauuuuuuugccuuacucaguuugaagaagagcaaaaugagaaaacaggucuuuucacacaugugcauauucccaguucccucugguuuauauuuaucuugaauuaacaguuaauuucaucuuuucccuccuugaagaauuucccagagugucuccuacuguaguguagguaugcuggugauuauuucucccagcuauuuuuaguaaaaguguuuuuguuguuuucccucuuucaguuggucaggaguagaauucaguguuagcaguuuugguuucuguuucugaaacacuauuauuugaccugcauagcuuguaugagaugucaguuauuuguauccuuugucaggcaugcaaaauauuuuuuccugacugcuuuuaguauuuucucuuuacuacuauuuuuuagcaaucucauuacugugacuugcuauacucugauuuuuuuuuaaacauacaccaaucuccaauguucuguaguguucaguuuauaccugcauugguuaauuaccuaguuaacuaucucauggguuuuuuuguuuguuuguuuguuuuuuucuauucauacuuuguauauuuagguucuuuuuuccugucuuccauaucacaucuucaacuucuuuuucuucuuuggguauauauaauauauuuuuaacagcuaagagccuguugcuggcuagcugaccaguucguuggauuuagugucuuggaauaggacucuaguccagacuggacacagucuuuguacccuaggcuggcuuugaagucaugaugguccuucugccucagacauuuaaguucuggguucccaggcugaagcaguauguccaacuguuguaauguccuuucugacuaaaucugucauuuugaaaauauuuuuuaaggaugaauaaauuauugucuuuuguuugaaacauacuuuuuuuuuuuuuuuuuuggcuuaagaauccaaauccagauaaggaaaagccugcauguaaugcucaagaauuagaagaaugugauauuuucuuugaagagagcuccaguuuaugcagauuugauggcaauacauuacaaacaacucaugugguaaguucuugguaauagcacgucuaaacuguuguggauaauaagacauuugguagauggaaauugaaggaaauacauguuuuguaaaaauaguuugauuaaaaguuacugaguauaguaaaucuuaucacuccaugaaguagccucauuuccauauuaaaggcauauuguuugaguuuuguuuuauauugacauauuucaggcuuuguccucugccuaccuuuuguauacaguugugaaccuauuauauauagcaacuuccuuuauaccugacacgagcauuaagaaauaagaauugucucuuguuauuaauaacuuuaaaaaugaugugugugugucuguguguguguguguguguguguacacuuguguauguguguaugcaugagugcccacaugugugcaugaauguucagauggggccaguagagggaaucagguuccugaaaguagaaaguaugacauuugcaggaugccuaguugguuauauggcacuaaaauccaaacucuggucaucuugauuguacagcaagggcuucuaaauacugagccauucuucuacuacccuuagccaaacuacuauucguuaugcaucuguguuacaugaagccuuuuuauauucagaaauccuuaaugaagaauuacaaagucaaauuagucguagacucggcucuugaagcuggcuugugcuaugcagucucagcgauguugucuguccuugccugccucauugugcuuccccugcaucuucugguuggugucaggcauccaguucuuguaaacugcaguuugucagcugcuucaaaggaaaggacauuccaugaaaaaauagcauuuagugauuguggcucaaaugagacaaccaugguugucauuuauucauccuauccagaccuuucuuuuuaauauauugaagaaaguuuuugugaauagccccuuugaugcuuacagaaucuguagcaaaagucucucuuuuacaugugauauuucuugauuauucuggcuagaaauugaucauauuaacuaacuuaguaaaauuaucuaguuucauuuuuuuaucuugccaauuuucauguuccuucucauuuuuuuuuuuguauuuaauuuguauuuuuaaucuuaggagaagauuagaaaacugauuuuuuuuuuuuaauucuuguagucauugagugcucacucuagauucuucugacuccaagguccuugugcuguccauugagagaauucauacaagauacagaauacaguguaggugauaggaaacgcacugcagaggagagcaguguuuuucaaggcaaagaguagcugguaguuuauuuuccuuuacuuuagaacagccaacuauaaaacauuuuugacaaugaauucauuuugugccauucauucaguauauuuuuauauuucuguuggaauaguuugaucaaauuugaugacaguuaugauuuauaucacuaaacaucaaaugugaucaguuuugaaacuggaaaaacuguugucuuuuccuuuauauuucuaaguagaaauuauuaucuuagggauuuguauaaauuuuuaaaucuuuauuucaucauuccauuuuauaucacuuagauaacuauaucauccuaacuuacaguaauggaaaaaaucaauuauauaaggaauuuaauaagugagugcucaaacaaaacgaaagaguauuuuauaaaacuuccauuuucaguuuaagauguaaaagcaugaacacauuacugucuaaccuaccucacagaagucauagaauguggauugccauaucugauauagcagcauauagggaaacuaggguacuugccccauaguuacuauaaaguggguuauugaagagaauaguguuuggcaaugaggaauacaagucuggaaacacaucuguauuuaaauuauagccacuauuuauuaccuccuuaauuucuauaucucugcuccuuaaauuugaauuuuuucauuuaugaacuggauaguauuuuuuuuaauucuuagauaaugaagaucaaauaaaguagggaauagagaucuucugaguauuuuauagauuucaucuguguaccgaguaugaauuuaaaaauccaaguuuugaucugguuucccaaugaagacuuuguucuugaauagauaaauaaaauccuuuucucaguaguaguuuuccauuuaauuggcuaguaacaguaauugacgauucuuugaauuucuucauucugacacaaaaaucuuuagaagucuaauuacugggugucuaagaagacuaucaucugacuacuucacauuuucucaaaaauauauuacucuaauuauagucuucauugguacuucagcauuaaauacaauuagugaauaugaaaaugcagauaaugugaaauuuuuaucuuauuggacaaaagauuuauuuaauuuaggcaauaaaauacaucuuugguacuaacaaggaaugaguuucuaagaaagaaguuguguagauuaaauuuucauauuuaauacaaagccuauauuuaaagcccuaucaguaaucuuacucaaaucucuuauucacccaauguuguauauugagcauccugaagaaaguaacuuucuauugauccuugaauggcgacaauaugaauaucaguuaccauacugucuauuucuauagaugcccauagaggcauuugagguaauuggcauuuauugccucuacaauaggcugccucagccuacucuucaaauccuuucuucucauugcaguugguucacuguuuucauuguacuaauaauaaacuauugaucguuuccucuugcugacaauuuaucuuuuuuuuuuuuuuuuuuuuuugguuauacucccaguuuacuuuugucuacaguuaaaauguucgugagauuuuauuuagaaacaggauauagaguuuucuguuaaacugugauuuaugcuuccuguuccugacuaaggauaaagaaacaucugggcauugaaaccagagcuuuuuacacaaaugcuguaucaguaaacuauacucaauagcccuuguaauuaugucugggacucuggaacccuuuaaacauuuuguucuuguuuuucuuggacagucguucaugguaaauaaugguuaacaucuaacuucuguguuuugccuucuuuaacuugauggcuuuauccuuaaaaguaacauaacccccacccccaccccaugauggcuguuucagucucuucaggaucuuacaaaaguaaaaauuauguuuuuuaguuaccccacuucauuucauucacuuaucaggguaguuauuuuacucagcuuaguuuguuagacacguaaucuuggcugucauuuugaauggauugaaaggcaugugacgaguugagugcauuucaagaguuauuauguguaggcuuuuucagaggggcgugacuaaggugggaaggcaugccuugaaugugaaaggugccaucugauaggcuaaugucccagauuguaugaagauagcaaaagagaaaaccaguuggcccaggaauauuccucacucagacccugcccccuaccacaaccaugauauuagcuaagcuacucuguucuaguucccccacuguggugacugaaauuaaggagccaacgucuucuucuuguaaaguguuuaugccaggcauuuucuaacagcagcaacuagacacaaauaguaaaaauauuucauugucaagaaacaaggaauuuucagaaauaauuuaaucuaacuguuguuauggcaaaaauauaguagaaaagauugugcuacacauuacagauaaaaauugcaaaagaauaaaauuaauuaaaaaacagacagcaacacagagagucucacuguauacauaguguaucaacaaaacaaccaaaugagugaccuugggguugguauuuaaaauuaccaucugucaugguuuguauauucuuggaccagggaguggcaccauuuggagguguggccuuguuggaacaggugcgaccugguuggaauaggugugucacuaugggugugggcauaagauccucacccugguugccuggaagucaaucuuccacuagcagccucuggaugaaggaguagaacucucagcucugccugcgccaugccugccuggauacugccaugcuuccaccuugaugauaauggacugaaccucugaaccuguaagccagccccaauuaaauguucuuuuuuuauaagacuugccuuggucauggugucuguucacagcaguaaaacccuaagacauuaucacuaaaacuaucucuucaaucauaggugcucuucgaguugagugcauuucaagagaaacacucugucuagcaggagggaguguuuaggguuugcuguuuguuuuucuagaacauaugcaaaggcuauauacauauaacuaaguagagucugaaaagaaccauggaauacuuaucagaauagaauauauucaagaccaaacaaaaacaagucuucgagaauagauaguagucauagaggaauuucauauggaguauauguggggcaaugggcuaugcgcagacagccuguucuccuauugagcugaggucuugaaccccggugguaccagaugggugguaauuucuaccuacaugggacaguaggcguuugaccaugucuccuggaccccuggcuccugucgaaguuaccguccccacagcccccacaagagaaacauguggcuuuaaguuacauagacaaugucccaagcuucuguccuucuggcuagacuccuccccaguuaccuagcaacaacaagauaacaaacccacuaagcucucucucuaagccuuuaccuuucuuaaccucuaauucucuuucucucuuucccuuccccauucucuccucuuggccauggcgccucucucucucucucucucucucucucucucucucucucuucucuuucccucugccuuucuacaauaaaacucuaaaaccauagacugucucuguacaucaaggcccggacuaaggacacucgccugcgugggaaccauccagugcccucucucccucuacuuucuccccuuaucucuggggccgaguguugcccuguggccccuauucuguuuucagcuccucugccauauccagugugggaugccagagacugagaaccaaguacugggggcugucccuuguccacccccccacccccaccguguggggucaauggcuuuacacagccagaugcccaccugaggccacguggaaagcgucuggcacagaaacucugaccaguugcgggcuaucuccuacuccccucuuccuauuccucucuucccacacacccacggccccacaaauauagaugacacucagcacagguagggauaccccuucagaaagggagauuuacaucaucacauguuacauuacuuaagcuuccauaugaagaaaaaaacaaacuauagucaaagcagaaaguaaaugauagagaugauuuucuucauuaguuaagauaagccauggaauguuuguuguaauacugaaaguacagagaaaaaaaaguacagagauggaaccggguugcuggaggucagcccucuauaaagagcuucguguaggugugugagaaaggaguguguggacauugcccuuauauggacauugaaagccagggugaugugggaaggcgguggguggcagaauguggggaucauuacagacaguacagggaccugugacccugggacccucuaguugcuaaaucuuucauguaaaaucuucuaguuuuucuaacuguaaaauggacuguaguaaucucaucuaaguauagagccuuggugaaauaguuuuaaaacaaacauucauuaaacacauagaauauagauacaaaagacaaacuuguacuaacauggugacuaucuuggguuacuguuacugugaaaacaugaucugaauuaauggggaaaaaaucauuccgugucacugaguguuagaaguccuaaaauguguugugagaucugucuugcuucguggaguucuuggggagaauuccucccaugccuuucucacuccuaaaggaugcuuacauuggcucucagucccauccuguagccauaugagcagcaguguuguauccuguagucacccuccuuuuccuugcuucuguucuucuauuguccuuuauguugugaccuucuuccucccucuuacaaggaaacuuaagaauacauuggguuaacucagauaagccaggguaaucaugccauuugaaaaucccaacuauaccuuuuuauuaucuaaagaaauguucagaaguuccagagaccuacagugugggugcucugggugacaguauuuagugguagucugugcacccagcaaucuaaucuaguccaauauuuuauuggaaauaauagacaugaaauaaagaaguuuuagaguucugcauugccuaggaucgugagaguaaauauuccaggaacaggugaugauuggucugucuuggggaauaagcagaguguggaagagggcaggagucaguaaaggcagagugugguguuucuggcuugugaucaguggcauggugauaagcacauauauggaucagcaaguggcagaagggaaagccuguaaucggaaccggggcuuaugcugagagaccuccacccacacacucugacccgcauggcugagcucucucuuaguuaacccuucagcggauggguuaugcugacuuguuccuuucucacugcugucccuucaugcauaggaggcuaauggaugaguaagcuccaacauuugcaauguuaauucucacuucacucgugaaaguagaaugggcacauuuuaugaaaauccacuugcaguccgccugugccuuacuguaguuggguuuguccuucugggaaagcccucggaaacccaaaggaaaacagcagcaacgagcaagaacuaaagcagggcuggauccaccggagcuuucuuaacgggcccauucgcuacuuggaaaguaagucuuacuuggccacugacaggccagagcaagggaaaaaaagaaaugagcagaggugagaacaugucagcccauccuugcugcggggagugugcucugggccuaaaagcccugcuucccuggguuauucuccugaggugggagacuuugccauuggaguccgagagcccagguugccugggagaaccaguaaauccucacaugacagccuuuuaggacuuugcuuacagagugcaagucucagcuucucagccaagauuuuguucucuuuuguacugugaaauuuauagaaccaagccagcauuuaucacacugccccccccccccaaaucuaacucuaaaccuggcaccuacauuugauguuauuucuguuggaguugaaagcucuaauaaucagauggcugaugaggaauauggcugaaaccuauguguacucaugcagcuuccuugugaguaggauccaacuaugagucucagauggucacuuuuguagugaaaugaguuccucaagucagucaguauugccauaacaacugcuagcaauauuguugauauuaauacuguaauucaggagcacagcggagucauugguaaguagaucugagauuuuauccaauauugugggguuuccuuauaggcuagaaccaauuacuaaaacucucgaggcuguacuuucagcuauuccaugaagauaacagcucaccaugagcuguagagauuaguacuuaauacaugccugauauauagaauaugcccauaagcuguaguagcuguuacuuauucuugguaauauuuacaaguuaacauuauuaaguuuaauguuuguauucuuugaacuaaaacuauucuuuugguacuuucacgucauauguuaaacuaacuacuaaccuugagguguagauggcauauugguuaagaacagagauuucaugucugcgacuuaaaaccacccucacuuuagacaagcuaaguccuagugcaccuuugcuucucugagcuuuaaaaugaauguaaacagaaacacaucccuuucaggagugcuaugaagagacaacccaguuaaguccuaaaaguguagagcaaguaagacgugguggcugguacaugugcgaaauucuaggcugagacaggagaauugccaaguacacggcuggcugaacuacaugcuaggaagaauggaaggaagaaaaguuaguuuaaaauaauuggagaugaugugguauguuagguuuuuucauuuauuauuaacuuuuugacuaaauuuacuuugucacuuuaggugaaucuuggcagcaaccaguaccuguucucagucauuguggauccuaaagaaaugccgugcuucugucuacgccaugaugucgaugcucuccucuggcaaccacacugcagcaagcaggacgacaugugggagcacauugccaccuucaaugcccuagguagacagcauucucuacaguagcauuugcagucugcccaaguagucaucaucuuaaaacuuuuuaauuggagcccuccauugauuacauuacguugaucguuccauggauugggucuugcugugguuugcucuucuguguccuguuaaacuguuagacuagaaagaugaacauguucuuccaguugcacagaagauaacgcaggaugaacauggaagugacaauauaaccauuggaauauuucuuuucuuuuuuuuugguuuuuuugagacaggguuucucuguguagcccuggcugcccuggaacucacucuguagaccaggcuggccuugaacucagaaaugugccugccucugccucccaaguacugggauuaaaggugugcgccaccacgccuggcaugggauauuucuaaucaguuguuucuuuuaagucaguauuaguaggagcguugacuuugcuguacucacaacuuguauguaagucucuucaaaaacucaugcaguugcuguacaguaaugcccccccccccuuuggaagacauaggucauugaacuuaagugucaaggaagccaagccuggcggugcacaccugcauucccaccacccgagugaugaggcaggaugcacagacacaucuggggcuagccagaguuaauguagcaagagucuaagccacagaguaaacaagaggccaugauaaucaaacagucaugaaaaggucaagcacaaauugaauuuauuugcuaaagaggaaaauacuuguuuugaaacuaccccuugaaaaaacuuuaaaguauauauaacuauagacuaugccaucauugauuuuauguaauauuguguaggaguuguacuagaugaauuagcuacaguuauugcuuuauuuaaagcuuuuuuuaaacuggcagcaaaauguagaauuguggguuuuaaaggcuguguguguacaauucuuaauuauugaggaaauuugucacuuagcgcuuauaacuaaauggccucacucaggcucuuaaguggauuucuauaaaaugaaauaguaagagguuugauagauuaauuaaccacacaauuucuguccucuacuguaauugcuauuuuguaauuaucuucuuuccuuaaggaagaggaaaguucuuccagguugcuuuuacaugcuaagacucuucaauuccaugucaaaauggucuuggaaaugaacugccaugcuucauccuaaguuaaaucaauuuuauauuagcuaguacuugaguuacauacauuauuguuggaguuucuuguacaguuaauguucaucuacucaaauagaucucuauaucuucaccuaauauuuuacaagcaguguuggccugcuugugccucaugacuuugcucacuuuauagaguauauauaaacauauaugcaaaauauauaaauauucauguaugcauuuaaaucuagcuugcaugagaaaaaugauuuuuugucuucuuccuuauucuuccgcucucuacaaugucaucuauuuuuuaaacaccuuuuuguaucuuucuguacuuacacauauguguaugucugugggugugugugggguguguguguguguuaauauguagagucuguaugugaaugaaaacaugaaguauuugucugagccuggcugauaucauuuaacaugguaauguccauucccauccauuuccuugugguguauaauuuuguucuuuccacgugaauaugugagugugugucacauuuccucuauguauucaucuguuaaugggcaucuaagcuaauucuaugucuuuacuucuguaaauaguguuaugcugggugcaggcaucuuugguuacuuccauuuuaugaccagguaaaacugcaucagauggugguuguacguuuccaguuguccuaauuuccuucuugucuguaccagugcacacucccaucaguacugagugagugcucuucuuuccccacacuauucucaacauucauuguccuuuguuuccucaguaacagccauccugaguaacucaggcagaaucucauuauagaucuaauuugaauuuucacauuaaacaugcugaacauuuuuuucuauauguaugagauauuugugcuucaucuugauagcuaccucuucaugucaucauccauuuauacacuggauuguuugguuuguuguaauucagugaguucuuuauucuggauacaaugauuucucagaaacagauagcacagauagucucacauucuguaggcugugucuucucagcauuccuugcuuucuugcugcacauuaccuuuuauuuucgcacaauucaguaugugaguuugguuuauuccuugaacugcuguagucuuccccacuaaguccuucuuuugcuugucacuuguuaccacucguuuucucuacugguuucagaauugcaggucuuaaaaguuuuugaucgacuuugaauugauucuucuccauguggauaucccguuucccagcaggacuccuuacaaaggcuguaggauuucuaauguuuguuagcgacaguguuucuguuugcucaugcucuuagcugaacccugugaaagggucacuccucucccaaaagugucucacucacaccagagguggagaaaucccacuucacaccauuccauuugucuguauguccguuucugugccuguacuaugcugccuucgaucuuguggcucuguaguauggcuugagaucaaucacuaccauaauaaccuccacccauuacuuucugcuuaggauuuccuuggcuguugagggucuuuuguguuuccauaugaauuucaggauuguauuauccauuucuccaaagaauaucauuagaauuuauaugaggauuuuuuuuuuaaacuguaaaccacuuucacucauauagcuuauuuucacaauaaauccaugggcaugggagaaaagccuuuguauaaucuagugccuucuucauuuguuuuuguuuuguuguuugucuuuuuuuuaauucuuuuaaguugucauuguauuccuaggguuauuuuuuuuaacuaggcauuaaagcucuuauguauuugguauuuaagacuuaagauuguuauuaucuuauuucguagagauuaaacagaaguauggugugcuuuuguugaagagcaggaggcuugcuugugccuuaggaauuaaaguucuauuuuuaugccucugagaagaaauugugacucacuguuaauggugcugaauucaaccauuguugacuguuaauaguauauguauuacauaaguauuuaaaugugugauagauaccaugggauacuaaguguuaaaucuugauuuuucucacuuuaguuugacagguuuuuuuuuuuuuuuucucuuguauuuuggcagguuacguccaagccucaaagagagacaagaaauuuuuugcaugugcuccaaacuacucguaugcagcccuuugugagugccuucgccgaguauucaucuaucggcagcccacccccauguccacugugcuguacaacaggaaggaaggcaggcauguggggcaaguugcuaagcagcagguagcaagccuagaaaccaaugauccuauuuuaggcuuucaggcaacaaaugagagauuauuuguucucacuaccaaaaaccucuuuuuaauaagaguaaauacggagaauuaauccuccaacauuugucuaaaaaguauccagugguaccuggagggcugaacaguuguacuauaacuugauaaguuuuagcaugauaaaugagaauaccuuuuaugaaguuuuauuuuuaaaggauacuggaaauguauucaguagauuaugaaucuguaaaagcuguggauagacgaagcuacaggauuagagaacaccggcuucuguaaaaauauggagauauuagcaaauauaguuauuuuuuaaaaccugagaucgaaucucaucuuuuauaugaaacauacaauucaguguuuacaaauaaaaauauuuaucauguacuuagcucauuguuuagauugguacagucauuauguagaauguuuggguaguaguaaaauacugaguauuauaaaaguauuuuaaugggcugaagucuauauacagaauugcuuuaagucuguauagauuuguaagaauacagcaguuuugacaauauuugcuuucaacccuuguuuuacagcaagcagaaauuuauuuaugucuuuccuguaccacauuggaaaagguuauacauuuuccauuauugcauaacaaaguucaacaaaacucaggucuaagaguuuauuccaguacaugggaaacuaaagcuggagaguuagcaguucaaggcuagccagggccacauagcaagaccuuaucucaaaacaaaagcaauuuaagguuuaugguuuuucacgcuucucugagaugucucuuguccucuaguagucuaagcucugcuuccugacaucauacagaaacacauucuagagcaaacuaggguacaagagguuggagagccugguuucucauuuuuugcuaagaauauggacaaaaugagucgcauggcuacgucuaaacagacaguaggucugugacacauuagagcccuuguugggacagucacacagaauagauuuuaacgcauuugucuaaguuccccuuacuuuucugacaguuuauccuauuuacacaugaguuuuuuucccacaaauauuugugguucagacuuccucuccaaacuuccuucaauuuguauccaguauggauuguuguguuuuuauuuucauacuaccagaagcucauguuuuagaauguucucaagagcuuaagaggcagcaaauaaagauuaugucguggacaauaccuguag

SEQ ID NO: 7746 - RNA, 1768 nt, Mus musculus
auuaaaucaaacaaacagcaacaacacaaaauaaaacaacaaaaaaggagaguucuccacaaucaccacccagagauggaaaggguggcgggaggaagcccucgggcuuaggggccuuacacugguugcauucuguucuccaagcgaaguucugguuccacagcccggauugggacacugccagucuccagcucggugcuggacauuuccuccuccagaggguuuuucucuggagccuuggggcccucuuggagggaagccuccucugucuccuccauggccucccaugugacccauggguccuccagggccuccugggccaccaggaccuccacgaaguggugguggcuucccucugcccucacgagguggcaugccaccccgcacgcuguucauuggaggcuucuuucgggcaagagaaacuuuaaguuugcuuccuugaaaaucuuauccaucaaaacauuccauaagccuuggcaguugguagaucuucauaggacacuguggcaucaccuuuaggcuuuccugucuccuuauccagguagauauggaucauggguuguccaguucucuuguucauuuugacuaccccacacugcuuaaagaagucugccagaucauccagagucacauugucauuuaauccuuguacauaaauugcacuguugucagagucuucaucgggaucuauaggaaggccuagauuaagaucugguccuucauccauggguccaccaggcuuauugaagccaccucgcucuccagcgcugcccauuccacuguauccuccucccugcccaccucugcucaugccuccacgaucaaaucccccucuuccccugccccaguuaucagggccacucaagcuccgguucucuccugauccagaaaauccuucagacuccugcccauaaacacccaugcuacuguagugguccugucggaaugaacucugcugccuguagcuguugcucuguugacuauauugacauggagccuggcuguaggauccagucugaggguguaacuaguaggaggcugcuguccauagcugcucggcugcccauggguguucugcugagaguaacugcucugaucguaacuagucggcugugaagaggaguagcugguaggaggauaagauggagguccaguaacuggcugcauuggguagcucccaggcaccuggggauaacuguaguuacucuguccauauucaaggcuggguugguuauaacccccugugcuagauugagguugacuagucucagcagacuuguuaccauccuguggucugguaggugcgguggcuguuggcugcuggccauaggugggguaugcaggucgggugccauaugcagucugagcugcguaagaggccugcguuguggugacuguagcaguggugaugucauaagccccaaugccauauccuugcacaggcuggcugugugccuggggggugccauauccuugcacaggcuggcugugugccuggggggcaguuggagugguauaaccagugggaggcuguccguaagaaguugcauaugcagucugcccauuaguggucugagccuggguauagcugacaucaguaggcuguccauagguuccauagcuuuauugccaauaugccugaguggucuaugcauaucuuugaguugguugggcaguguaagcacuguaacacugcugggcugcagcuugacuauagguacuguggauaccauuuucucgccuuccucgagguggcccuggaagcauu

SEQ ID NO: 7747 - RNA, 235714 nt, Mus musculus
ugagagcuagagggaaagguaaaaagcacuuugagaguucuuggcauucuccaggacagcaucuccaguaucugggcagcaucgccucggcugccacgcauugccccccgcgccccccaagguaggucccggccuccaggcccucggccagggcaacacagccucccuccucccccagcccguccggugggggaggggcggggcgggacgagccgcgcgcgguccccaguugucgcgggcuggugcggccggccggucccgcgggcggcggcggcgggugcucggggccgggcggggcggcggcggcggcggcgcggggacgcgccugucucuuuaagggagcucggucugggguggcgcuuuccuccgcgaaggcuccuuugauauuaauaguguuggugucuugaaacugacguaaugcgcggagagugagguccugacaagcgauaacauuucugauaaagacccgaucucauugcaaucuccagcguccucuuuuucgcugcugcucgguggcuccggaccucgcguccuccugaucgcucucucgccuuugccuauuuuuuuuuuuuaaacaacaacaacaacaacaaaaaaccccaacaacacccccuccccucuucccacccggcaccgggcacauccuagcucuauuuccuuucucuuucucucgcgcucucuuuuuuuccuggggggggggggagggaagggaaagggggggaggcaggaaagaccuuuuucuccccccccccccaauaauccaagaucaacucugcaaacaacagaagacgguucauggcucuggccgccgcgccaccaucuuucgggcugcggaggguguuccugacgauuaaucaacagguaagggggagccgggcaggccggggggcgcgggcucagccggccggggcgccguuccgccagcgcugcgcccgcgcgagugugcgcaaaaugugggcgaucgcgagcggggagcccugggaauuaaaagugacuuucuuugaaaaaaaaaaaaaaaaaaaaaaaaaagcacagccgagggagagagugugcagcaagccaagcgcaggcuucucggguuucacacgcauuuucuuucuuccucccccccaccccccuuugcgcgugugauuucuuucuuucuucucuucuguucccuuuacacccccacucccccaauuccucuuuucucuuugcugggucuaaggcaucugagccuuggaaaccagagcgacuucaaacugcaguagcccccagagucaggagggucaaguucagccgccggggaggaggaaaaacaaaucccgauuugccaaaaaaagaaguuucaggccggugcccccucccccucccagccccacucccccucgcugucucuugcuggcugauuuuaauucucuccuaccgggagcagcagaggaucuggagguggcuggacccgaggggccgccgccgccgcugcugcaaguuuucugggggcuccuggcaaacggggagcagacuaggcaccggcaugcagaguaguaaguugggugaacuugggaggguagggaggguuucugcgaggggucuuggaguggcccacaaagugguaaaacagcauagacugccuuuggguuugaagaguuuaguuuguaaagccaggcuucaaacuuuuuucccuuaaaggcccagcagggcuggagggagagaguguggcauccucuccugguauacccgucucugggcagcucagggcagccugggcccaggggucugugcccugucgguaccaugaggcagggccuuguagccagggcgcuuccguaggggcugagcaaggggcagacuuccucugcggugcgguugaugcgccaugugucgagcgggucaggggacacgggcuggugauuaaacgccugacagcggugggacaugcaggcagacaggcucuuugcuuucugucuaguuccuguuugggcuguagagucugaaacgcaucuuugaaaggccaaggcaaacaccucuaucccuccaaauaacuccaggauuauaggaccccaugaauaauuugagggugaagcagaagugggagcuguuugaagugcaaacuguuuuugaggcugggaaagcuuuuucugugaguaccugucugagaugaugguguuuccccuuucaccagggaagucacuaacuguuuuauggcucuaggauccuaaagccauugaagugagaggacccgaggacuuacuuaugggggcuucagagagaaccuugauuggacucacuacauuuuaagaccuggcugacuuccccauaucuuuuuaggccucagauuugaucuuuugaaaguuuuugagucagagcuauggauuuaaugaugaauccaaauuaggauagaauauccauccuuuauccgguuuggggaaaucaccgcuagcauuuuaaacaagguaagugaagagagacuggccgcgagaagaagcaaaaucagacacaaguuaggccgauucauugaacuuguguaugcucuccaggugaacaggcaagggccuggaagagauaguacaaaaacaaaaauacagauaagggccugagacaagauuacaaagaagugaucauucuaggccugguuagcuaaauuugauuacucaagccuaaagaaaaaacuaaaguagacuuccccgauaagccuuuggagugcuguaaacucuuuagcgcaaacccagcagccuccguagcaucucgauccuucgcuacagguuuuaggaagacuugauauuuugaaaaggcugcuagaguuaaacauguuagggacugucaggaaaguacugcagcuagcagguccuugacgugggcaaaaugagaaugaaagucucuaaucucagugcugggcagcuucuuaguuacuguucacuugcuucuaaggcucucucaguuaaugcaguauugguguagaaaagcagagguucuaaaauaaucaccaugcggcuuuucccccuuuuccuuuccccaaguaugacaggguugugaauaaauacaggguuuguaugggaagaugaagcguuuccuguaaguuucgaugcugacaagacagucuggaaaugauaccaacauucugaggauuuuuuuuuuuuaaaccuuugagcgaaaguuuauuaauggcaugcucaaacuucacaaguuaaacuuguauguucaucauguuuauccuucuguaagauuucagaacuuccuuuuaaagcuauacucuugaggucaaaacgucuccagucaguuaaguagacagggcuccgaauaugcuaguuuggugauuaugucuagauauuaguacggugaaaauaaaacugcaaaggaggaaaucaugucuuaaugccucuauucugccgugauuucucuaacugcaagauauugggaaccuucaucagugcucggcaaaauuuuauuuaccuuuggugagcugauuuucauggcuucccaauaugccuguugcaugguaagcuauguuuguguagaauacuuuuacauacauaauaacuaagucugacacucuccaaauaacucguagaaaguagcuaggaaaaaaguuugucacuucugaauuuuagauucuguuaguguuugugcugcuggguggcucuuguccuuuguuauagcuagcauuaaaggugcggaagagacugccggaguggcugugaauccugaguugaauucagagcuccacacuuuugacuacuaauauugugaacaauuuuacauaaauuucuacauacuuucauacuaaccaguuuagcauccaaaucgguguguauuuaaucaugagugacuuacaugugcccuuauguuguuuuuggcauuauuuuuacuuuucuuuuaagucauauaacacuccugaauuuauucuaguuuucacuauaggucucuguaaaacacauagggaaaucuucauucauaagaaaaccuucucaacagggaugugaaugcaccugugggaaaguugcucuuaagauaaaguauuuaauggugcuuuuacuaauguugguauuuauuauuauuauuauuauuauuauuaugaguccaugcacagagagaagccacuauuugcuucuaaagauauaugcauuuucuauuaagaacuaaggccacggcgugagguuuuguaaacacuuaacgcuauuuuuugaaguaaauugacauugcugaaaaauuuuaaacuugcaaaagacuuuguuuuugaguuagaacuuuauuuugaauuugaaauuggugucagcauggauaacuggcuuucugauaauauauacauauauauuaucaaaaaauaacaaauuauauauauauaauuuuguuaaucuaauacauccuuugagagcaaacaauaauaucaaaacacuguguuauuguucauagaacaaaauagacuuucagagaguugcggacaggugucuauaauugauuucaagggaaauuauuauuuuugaaacaagcgaugaacuuuaaauaaaacaacuggcucccauuaaaacauauccucaugaagauauucucugguguguaaaaugaagccauucauucaacacacugacaacuuuccacuugguauuugccucugcuuaauuuaguuuccucgggacagcuagugugguagccugcaucuguuuuuggcaggcauagaaaacuauaaacucagacaguucugacucaaauauuguauuuagcucaugaguuacaaucaauuugauaaagaacaggcaaguuguaugagcuugcuuccuguuguucauccuuggcccagcuuucagguaacagacuucucguucuucuuuuucuaguuaugauuacuaauacugcugauagcuaauuauucuuguuaugcuuccuuauuuauuauuuuuuuugagcuaugggggaaugaauaauaacauauacagacauacauauacagcauaucuauggaauagcuacauuuuauuuggggcuauguggaagugaauuguguugucauaacaggauuuaugggaucuaauggagccauuguagauauaauauaaagacaauuuacuaucgagcugaaauuuaacaucauuuuccaaguauacuuauuaugcucauguauagaaaagauuuaacauacuuuacauuauuacuugcauuuuagaaacugagcaguugguuuuaacaugaccaaaaucacuuuucuccucaacuuuuugaucagucuacugaaauacccuaaaaugccaagguuuucuuuuugacuaccgcuuaguugcaaauagagaucagcuuguuuuaucuuucaauguaacuugguccaaaguauuugcauuaaauauucuauuauugauaaccuucauaagugacacuucaaaugguacaguuaugcccauguuggggugucuuuauaucacucuaugacccuuguuucccugggaagugaauuugcaaaccuuugguuuguuucucuguaggauauaauaauggagaaauugauuuggguuggaaagagaucuuggggcauaaggaaacgcuuuuacugaauucauaagaugcugaacauuauuuggauuguuaaaagcuaguccagagaagccugcuagagauaauagcuaccggaaccauuguaacuuugccgcacgguacuuuuuauuaucccaucucuuuuugaccccucagagcgcaguuccaaguaccaaaaacaaagaugaaauuaucaguguacuucagaucugaagcaucauugaaauaaguuuuugacucaagguauaauugaaauacaagcaucaaggcuggccguacagcauguugcauucaaaagaauaagauaaaaauuacuuuuaauuuuuaagauguugcuagcucuuuaaaaaccugcaguacauacuuuacaaguggcucgacaccuucccugcugcucaguuuauacaaguaggaaacuuucucuccugcucucucucucucucucucucucucucucucucucucucucucuuguuuucucuaaaccaacugacgucaugacaaacuuugcuuuaaaagaacagacagaaguaauugguagcuuuuaacuuuuaauaauguucugcaaugguuucgguggccaaaaugcuauuuuuuucuuaaaagggggaaaaaaaaaguucaaguaaaaacgggcuuguggcccgaggaagaaaagcuccguugauacaguuauuuuuauucuuguuuuucaaucuguuauuaaaacucauucaugcuuagcucugcuauaacuccugagcuguucucagugauggcuggugcauuugagguugccaccauuuaaacaguuugggaguuugccgggaaaauggguguuuguguuacuuuauuucuuuacuauuugaaagaagaaaaaaaaaaaaaacccaacaaguuuuguuucgauugagauuaauuaaugaagguuaucaauggugacaggucagugaauauguuuauauagagaaugccacaccuguuaccaggagccuaaaauauggagguuuaauugugacauuaaucauuuuuaugugcagaggaaggaaaauagaugaaauguucccaaaaaugcaguuuuauauugaaaacaugaguuucgagggucagcuuguuccuacuggaaguguugcauuuuucaccuugaaaaauuuaaauggcacccguaaaccuuauuuaucacagaguauuuuaacucuauuuuaauaauuguuuucuucccuguagaauuugcacaggcaaauagaacuucaucugcuuaagagacaccuugaucacauucauugucaggggccaacuucagaaguuggcaaggagcaaagucuuucuggggugaaaaaaaaaauugugucaguauuuccuucccugggaaaagcugcuccacccaaaaguagggccuucuuucccguuuguggggcagaacuuggugucgauguuccucaugcaagcugcugcugaaguuuaagucuuuguuguaauaauaccagauuucaugugagagcuaguuauuuuuaccccuuccauaucuagagacccucucaggaauaagacaccaugaaaggaggugucucacagaggaagacuggucauuaauacauuuauaauuaucaaaauauuucugcauacuccagacccuucaguguuuccuucuuagcuaguuuugauuuacuuuauucggucucagcuuuuacuacgagagcuauagacuucaguucauauccgacagauuucuccuuugauaacaacuucuuugcuuaaacauuuuuucccccaggaaaaaguagcagaauuaagcuauguguugcuuguaucaacauagugcagauuuauugaauugagauuuuauuuaauucauaaugcuauagagagcuugcaagcauaaauuucaagucauagguaugccugaaaugaauuuuuuauuuaauaaauauuggucugcuguuucaaaauuggggauaguuaaaaaguuuugaaagaagcaaaaaaggcagagugaaguauuugcagcuagagucuuuuaauaucagcagcuuguuuacuguggaguaguggggagggguaggagagacuuuguggaagaugauacaaaaaaaaaaaauccaucaauugcgcauaugauccccuccccuuaagguuuacuuaaacaauauguuucgguuuugccucaaaccauucggcgccaccuccacuccgagcaucuaucacuagccugguuccugagugauuaaggauggucuuuucuguuauauagcgagcagcaguauuguuugaacaaagguaacauauuuugauuugugaaauucuuugguaguuauuaggaagcugucuauaguguaagaggaauucuauacucuaaacccuguggauguuugaugcagccacaguaacucuacugugcuugaauuauugcagcaaugugugcaugcucuuggagccauauuuuauguauguaauucuuagauccaccuugaugguggaguuuaaugugcuaaaucaugaccugcugugcuuuuaacagaacuggaaucguuuaaagagauacaugacuuguuuuuaaaaaguuagaaguuugaagugaguguggcgauuaaacauaaugaaucagucauucccauaguauuuagauguacuuagauuuuacuaagagauuucaaaagaaggaaaaaaaaaacacucuauaaaucaaacugcccccccucguuguguaucuuaaauaguguucugagaacauuuuugaaaaagucucauuucuguagggagugacaguguuuuguuuuguuuucuuuuuugucugaagauaucauuuuauaagcuagcacuuuacaguuuacaauucuauugguuuaaaacguuaugcagaaauaucauggaacauguaaagacucuguacucugagcccaugcauuuuucccuagggugauggauucugugcgucacccaaaugugaugcuauuugcugggcuuguaauacugguuugggguugcuggauguccuaguucaucaagcaacagaauacaacaacguugguaacuagguaauugacacagucaaaauaggcucuggaaaauguuccaaauauuuuaaagucaguucagaacuuagcauauauuccauuuauucagcacuuaaauaaacagaugauucauugccugcccuuuaagucugcuaucguugauagcaguggaacgaaauuuuaaugcuuacaguucuuguuuuuauuucucuuucuuuaguuugaaaggagcaugguugccuuacuuaucccaaugauuccuuuauccauuacuuacuuauaauugugaucaugaguaguauaauagaagacauuuauguucccugacguguaugccucaaucuuuagaaguaaugauauuauucuuuugaaaauuugaauaauuauaacaacauaggacaacagauaacuuauuuaagcauagaagcgucauagguguagaaaacagggaugaaaauauuuucgcucagagcugguuuugcuuacagaguuuggacagacuaugaaguuuuacacaucagugaaagugcauaauaggacgugaucuuuguaauuagguccuacuguauggcuuucugagcacuugugcgaacugcaacaccuuuucuuccaugcauucaucuaugaacuagagauaugucuauaaacaguguaaauaugugucacacaguugguuuggggaaucagauuucucuauuacaugauaugguuuaugugccuagggauacccuuaauauccuaggauuacuacagcacacucaucuccgacuugaugauucuaaguacacacauguauguguauaugcuugugugcucuugugcuggaagucacuguauuugauucuaucaaacuaaauguuuuuuuuuuuaaaucacauuaaucuuucucaggucuuuuucaguuauuuaaugcaucccagagccuauuuaagaguuaaauuaguuauaacacugguucucaaugcaagcgagguugacuuuaaacagugaacaacauauucgacuuuaugugaugucaugauccacaugucaucuuagcucuggaagauuacugcauugguuucucaauaguuaguaguucugaacagauaagugguccuaggaaaacggcggccacuugucuuugccuuacuugugauguuuuuaaugcuggcugaaagagaaucuaggucacuguacuucuaaaugauguuauucaguugacagaaguuaagacugaucguagauaguuuaaguuuaaucacuguccauacuacuaaauuuuuacaauguguauugucuuuuucccaauuauuuuuauguaauucugagacccuuauaccucaucuguuuucuuuauuuugaugauguuuuuuuuguaauauaguuuuaaguuuuuaaacaaacaguuaaaaugauuauguucaccacuagaugcaaauauucuguaaagauuauugcaaacacugcucccuaguucuguggagauaggaaaguucuagaaaauaaccuggguaaagccaccuuguaagcaugaaguauucuacacuguugaguaaguauuuaagaacaguuuuuuuuuuuccuuuuuacuaaaauugaguucuuugcauguaagaugugagggaauuagaguaggaaaucugcugccaccaugauccaguuccaguaaacuguuuucccccacccuuuacccucucagucuucagucuguuuuaaaaugcucuauuucuuacagaaauuuacuguguugaaagaaugccauaauuauuuguaacacauauugcuuuaaaaaaaaaacacuuugauacacuauaaagcgggaagcugucacucagaacacuaguccaaaacgcaaaaaaaaaaaaaaaaagaaaagaaagaaagaaaaucauauguauacauuuuauaaauagaccuaugcacauggucuugaaugcugccuuugccaaagucuuaaucuuuuauuugucguguuuguuuacaauuaauucuauguauacauucugcacuuuuuaucccaagaaucauucacuaucucauagcugacauuuauuuaaauauacugugcucuuacuacucccuguaagguucauguaucacugagaauaacauuccacaaugugacugacauggaacuugauuagaaauagacaaggauagguagauaguaguguaagcaggcgcuccucauuugccuguuacagauuuuugguucccuuuaaagaagaaaucugccugaacagaaaggggaguggggucuauccaguccaugaugauguaaggcauuauugaagcauguguuuuuauucauuuauauauauauauauauauauauauauauauauauauauguauuugacacagaaaacuuugaccucagccugagguccuugagaauuuuacauaaaccccaguggggucacacuuagaguucuggcuuugcguggcauagagcacucuguguguagcuucugcugugcuacuaugccguuuucugucaggacuggaagauccuuuaaguugauuuggccuuugaaaccauaaccagaauccuuccuuucugaaaauccucuugauggguuucagaagggcaagcagggccacacgauaucgcugacuuuagggugcugaagaaaauuauccugagaccaaacaugcugucucuguuacuaccccaugcuuuaccagcaguuggucccguuccccccccccccuucuccuuuuuucuaucaguuuugaaaggauauagaauuugccccuuuaguggacagauguacuugcugggggacuuuuuaaaucuucauuucuuuauuauauuuauauguuaagagcaguggcauaggaaacagaagcuuacauacugcuaaaugaaaauuugauuuuauuguuugcucuugagcaggucauuuccacuuaguucaugugacgaaauacaccgaaugaaauuaaauaaaaccgugauauaauuuggaaauaauuaggaauaccacuuucuuuuuucuggcaaaaacacuaaggcaauuuuacuuagcgcuuuuaaccaccucagcaucccaaguuugugagugugaacuggaccacucgaucucaggugauguaugcgauggauguuauuuugauguagggacgagagaguugcucugaaaaugcucaccaguguguuucagauucccaaggggugaaugccaacuaucaccuuaccagcgcuuggaggucuucugagaguuuuaauuguuuauuguagugauagucaaugacacagggcacaagcugcuagcauauuuguucagagaguugguagagcacugugaacgacugacuacauugucaucaagguuugggguauagcauaaaacugaauacuauuugucuucuaagguggguccgaaguuuggggcuuugcuguugacuuuccgucucucugguccgaguguuaaaauagguagaacuagccagagagaucacuaaagcuaguucugucuuucaugucuaggaaauauagcacugaauguuugcucuuuguguguuuugucuccaagcagaggaaacugacaguuuuauguuuuaagugcagaaaguugcucuuggcuaagcaacccuagaguuaaucacagggauguuagcuugaauuuuggucuuucuacaguuucugauuuuucaaacgaaauguguuguuauuaccaaauugacaucuuaacuucuggguugaguuuuagguaaauguuugcuuaaaugcuauuucuugaaguccauugcuuucaaaauacauagguuucccccacaaaccccuuuaaggcuucaggagaggaaauaguuaaccuuuauaggguuuuugcuuuguuuugguugugucuguguguuuucuuucuuuccuuuuuuuuuuuagauagcugauccuuugcucuuucuuguaaaauauaaacucauuuuaaguggauuuggcuucuuuuuuuuuuuuuuuccccugucauuccaucuuuuucaaaucucugauacaggagagauccagacacgagcaacauauuucucaaaguacucucuggcagauacuuuggucauuuguaaggagucacuacagggagaagucauuucccgugugucaguucacacuuuuacuuuaacuccagcaaagagugauuuggaaaagucacguacuuaaucacugaagcuaacugaaauccgugagcgguguaaaagaacaugacauuuguuugaguaucaguuauauuuuauacuuguguauuaaacuuuucaucgaagggaaaaauacuuuauccaacuuugaauucuauuuaagaacaauuucuggaacucuccaggauuaaaaggaaaauaggaaacaucgucagugaaccagguuggaauucccacuuuaaagaagagagacuucccugugacauauuuuagggguguguguggaggguguuuaauuguaaagaaaagucucucugcaccuguauguuuuuccugacuacuggugaugaugacaggcauucucacaguguaguuauguacagaaagaaggcccuggccauagggaaaucacaguccuguuuauauguaagagaaaaaaaaauguuuccauuugaaauagauguacuucucccuaaagagggacgcacggaguuuuaaacucccuuucacuggaagaaggaguagggccagagacaacaggguuggaauuuccaacgaaguguauuuagaaguaguuuugugucucuacugguggagaugagacugcuccaagcaguuaccuccucuuuugucugcagugaugucaggcaagaauuuagccagaacucuccaguggggcuuucucagcauugaggaauuaggauacuguaagguucuccaaaucauguuuuggguguuauuuugaaaugacaaauuuaaauuugaauuauaauaaugaaaucagaaugguacuuuuagauuuaauuugaagccaguacuuacagauagugaaaaguuuaacaggcuuuuuuuuuuuuucuucacauuuuccuauguaggaaaaaaaaaggggagguggggggggauucacucauucgacuagcaccagagaaauaguagguugacuuuauuuccacaauguaugauaugcuauaugauauguuauauggcugaauuucaggggcaaaaugaauguaccuuuucaauggauuuacaauaaggaaaucacuuaauaaagggaacugaugguccaaugaauuaaaucaccugcggugacaugcagugcgcacucuggccucugacagagcucuccuuguucugugacucugcucuguaacaucuucuucuccgucucauuucccgauggcuucagugauuaugccugaauguauggccuucucauuuccuuaaaagaccggccuauaugugugaucuuuuacuaaucauccuacagagaaguaggauccugagcaaaggaaggaagguccuuugcucaauggcuggcuuuccuucaguugucagucacccaggacucuguuguggucugucuucaucuuuguucuguaauacauguguguucagaaagacaaugggguccuauauuauucuggauguuagaaacuccuuaaauuacuauuccacuguugugugcccaucuugcucuauaaaggaaaaaacaaaacccuagagauucaguaacagguuuuccuuauguuacuaaaagaaugaucaccaaaauaaaucuaaguaaaucaguagacaguuuccaggcuuauucagaaacuuugcuuaauauuuaagauucuuuaauuuuuguguuucuuucugcagauggguauggaaacagaaucaaaaugccauuuaguuugucauuaguacacagaacuuggugcuuauauaacgagugcauugauauauuucuuuauugcaacuauauauauauauauauauauauauauaguuaucgcaugucagaguuucuacagaaaauuuagguuugguguuuguuuuagacacuuuaaugauaggaaccucuuuaaauuugcugauauaaaauccuguuggacugaaaaacuaauuaugacaugcccacuaaaucuguuaccuuuuacuuuaguuuuaaaaacuuuuggcauuuaacaauauuaaagcccagcaaaacaaugguucauuugaguuaguacuuugaauuuuuauauacuaaucuaguguaucuuugacauugagccugaaaaauaagcuuaguuuauuugaaugugguuaagaaaggguucauagcauuuuauacaaacuucucagcacuuacaaaaacaauuuaucaaaagaacaaagggggaaaaaccuuuuuuuauuaacucuuucccucuuaguccuguaauucaaaugauagauacauuucagcuucaaaugcgguaaaaugaaauauuuaauguauagauaugauuauuuuauuuauuuauuuauuuuacaaucucuucacuuuacauauuuagccaugguuuggauggauuuugacauggauauaauuaauguuuauuuuuuucuugauucuaaucaagucaauuuucauuugguguguuugaaguacagaauucccuaacaaacuuaugagguauaauaauaccuuaaauuccuuguuuuugcucaggguuuauaucuaauaguaacaacugcauuuuuaaagggcaaauacaaccuugucccucauaagagcuggacacagacugguuauagcugcagugugccugcccugaguuuaagaacaaggcugaaugccaugaaggaaggauuugaacucugcauuccuggcucuaucucagacaguuccagaagugacucugcagaaagcaggaggaccugacaggcucuggacgugggcugagcugcaggcugguccagacuguguaccugaaccucauucuucuugcuugcaagguuaagaagaaggaugcugucauuuguaaggcccuucauugccuugugucucagccagaugucaggugguuauuauuuauuauuguuuucuucccccuugcuuugguuguuuuuuucuccuugauguuuccuucaggugaaagcucuuaugcauaauuuaucuauagguauuccuuuaaagaaacagucuccuaguagaaaauaaucaucuuuuucuuguuagaaauuaucaacugaaucaugauacaagggagugguuuaagaggaguucgccauuuugacgaugguucaggucaccucaauaguaucucccuccuuugugcagccgugagugcgcaaucguacuaucugauggcuaaaucccuuccucugcccuuacuuaacuuacaucaaguuuuucuaugcuuuucauuuauuaugucaguauaguggaaucugccauuuuacucugauuuuaagucauaauuuaauaucaauauguaccugaugcaauuauagcaaaaaauagguaaaucucucucuuccucaaguucuucucaaugauuuucuuaaucuugucuuaaguauguuuuuccaauucauuucccccuccauauauuaaacaccuauuuucuucuuuuacuugaggauauauaauggcgagugguugcauuuucuuaagcagucugcucucccaauaagucauuguaugcaugcuuuuuuuuuuuaaaguuucucucaaaucacaguuaugcuaauguuuucaccuacugaagcaaauuccuuuucaggcagucuuuaaaccauuuuauacuuguucucaugacacauauuugugaacaaagacugucuuagauguuuuauagaagguaguuaaauggguuauaauccaguuguaguugguuauagagcauucucagaauguaagaaaagucuuaaguacagcuuuguagguaaucuauggcuacagaaggugggaaauagguuggaauucaagcagaauggaaucuaaggaacacuuaccaaauacugaauacaacuccuuaaacaguuuugauaaaucccauuccaacugaaaggcuacuuuuaauuuacuuguccuuauaaguaaaaacuguuguuuucugagauuuaucgauuccaauguuuccaagucagauguggaauccagacucuccuuuuuuuuucuuccccccccccccccagauaaaagauaaacugaaccaccuacaaaaauaagcggagaguggggaaaauauuggaugcccgaauuugguucucuuuucuuguaaaucagcagagaaacugugccaggccucccuguuucuugacagugaugcgcugaagucaccagcaguggcuucacagaagccaagccccaauggaguuuccaugugauugcaaugcucaaaugagccugucuggccagccauccucuccugugucucucuggccuuagugaguagggcauugcgguucagccccccuucuagucgucugcccuugauuuuuuuuuccccucuaaacgucuguuucuuucuuugaggaguuuaugcuuccagcuuuucagcugaauaaaauaaucccagucuccccuuuuauucccguccugccucuggaugccaacgccaucagccugcaccuuccuucaggacuugcucaucuucuuguuucuccugugaugcuggcacucagcuccucccagaggcuugugauuuacaaguucuaucugaaggucgccauguauucuguccucagccgagugcgccuggguccccggacauucucaaacacauuugcuaaugcucuucugucuuuaugacauaccuuucauccagccuuaccuaaagcaauccucuccauuucuccugaggacuuccacuuguacggaagcauccuggaauugggcuacauuucuggcucuagcauagcccaaauaagaaucuucuugacauuguaaacccaagaaaagggagaccagaccaaaucaucucaguaguuucuuaaaaauguacuacuaaguguguacuugagaaagaauauuucgucucuuucuuucuucuucuucuuuuuuaauccagaaaaguauagggcuuucugagguugagacacuugugaaauuggauugucauguuucagagaguaauaggauuauauggugcuccauaauuaguagacucugcuugaaauuugcccugguguuuuguuccuaaaguauaauaguacugguuacagcuuagcguguugcauuuuauaguguccuuucaaaucuugcauuuuaaugauuaaugauaccuaaccaagcagaacuguuccagaaaacugagguagagggaagcucuaauacuuucgaaaaugagagaaaagcagaauccaugacuaccuuccaucgugugccuuauugguuccgccuuugacacacugguguacucaaugcugcaugauuagaaaagacaacaaggguggugauguuaaucuccaccauaaagggucagauaugugaaauugaacuucuguacauuuaguucuucuuuucagcacaaauauuguguccuguacuuaaaggcgacuuuugcguugguuucucagugaaagugcccaguaaacaggucucacgccucagugcuaagggagcaaugauaacuugcacccucagaagacccagcgugguuagugaugaguaagguucuuuaugcccgaggagaaccauagcuaauauugcuuuaaaaaaaauguccaguucuggcaguaaaaggacuucucuuugcuuuuaaaaaauacagaaguuuucccaacaaaugaccaauaaaguguuaagugauuauagcuaauggagcgauuucaugcuggaagaagacugucaaaggcuucuggauauuugauucucaccaaucacuuuuccuugcaucuuaaagccaacuaaacacacugaacucucucucuuccucccucccucucucucucucucucucucucucucucuuuccuuguaagcccugggucuuggaucuuuucuaagugauuuuauuuauuucuaacuaaaacauuucuuuuaucugaaaauugggaagucccuucaauuaaacaaacgacucuacuuagcauuuagauguuaagcagcuuugggaaaacuuauuacgugauauuuuaauuauauauuuccaaggcccuauggagagggcacuguggcagagaauuccaggagaggaugugccagggugcuccuuuugcuucuauggcugacucacuuguaagauucccauuccaauguaucugccucuuccuuagagaccaaacauuccaaagcuucccaggaaccuuagcuaauugcauuuuucaagcauacuguucuaaugucaccuuuuaucuauuagcaacuuuacaaauccuuugaaggagauucuuggauuugugaaguggugugucugucugccuguauuuuuugcacaucuuauaagcaacaguagaaagaguucucucuuuaaaagugcauucugguuaauaaguagggguuuuuaaaauccucuguacuuuuccacaacugaaggagugcauacuuuugguuaaaggcaaguaggcaaaauuuagcccugcuguucugguagccuugguggcuuuaaaacacaaucucuucauugccauuucauaaucucugagaugacugccuggcucucauguccgcuaaaagcagaaauagaggaaggaaauguauguuuuggcuucaucgaaguguuccuuaucagaguguauguaggaguggauacugaugaagaugccucuauuugccagcuggacagcaugugugcugggcuagguuccugucagcuaaagcuguguggugcccuuuaaugauaugaaggaggacauucuuaaguggguuggacuucguuuucacuugugaaaauuagggagcagagggcgcgcaaacugcgcucaguggcuggacucaguuugcauagaaaugagcuacaagccugaaaaacuucuucgguugaugagcagccagcacuaaugaauguaagagaagccacuggucucaggugaggcagguuugcagggagaaagggcgcugaguaggagcgcugucucucauuagaggauaccuuaaccuguuacuccuggagcacauuuguaaagcucaggcuacugccuugucagcuaagcgucuugucuccaccugcaaccgaaucgaggcgggacuacuuagggaaguuacauauuguccagaccacaaaggguagccaauggcgucaggauuuggauucagucuggcucuguaaaucuguaaacuguucuguccucugcugguuggaugagcaagauuccaggugcaggaucauauaguaauagcuauuuacuuauuggagguaaggccucaccauauauccaaagcccuggguuucccauuccuucugccucagccuuaggaauucugaaauugcaguugugcacgacaaugccugacuuuacucaguggauuuuugaguauucaacuuugucauauuugcacuguugcacugugauuccuuaagccauaauuccuuguuaggagauaaacugucaccuuuauauauguuuaaaaauguugacaguaguaaucuagacauaccacaaauacuauuuuuuugguaacgauagcugcaguucuaguaaacacacacacacacacacacacacacacacacacacagagagagagagagagagagagagagagagagagagagacugacucugacucagaagcauaaguaacugccucuccuggcuccauuacaguaaaaaggcugugcucagcaaacccugguaagaggaaguuguugaaugacauggggagguggcaccggcaccauccuguuaaucuugcuuuguguuuccuaauguauuuguacucuuggggaacuacugcucagaauggggucugcacaaccuuguagcuugaggauacuacaaagacaucaaaaugcaagcuugguuugguuuagaccuaagcauuuccucaaaucaguuauuaauuagcuuuaugucucuauucauccauccauccauccauucauucauucauguaucauuauuauuauuuuuaauugugcuuuuuuguuuguuuauuguuuuuuucggaagaguuauaaagacgcgguguagcuccggagauaguacgaucagaacuagacacaagagugaaauauuguaccuuuccccguuuuuaaaggcgaaguggaaaaaugggaguuucggauccauaagccucaggguccauuuucauugcugcaccaggagaagccgccgccggggcggaccgggaggggcuggggcugcagcggcucagggcuguagaaccgggucaggccugggagcccaggcgcucgcgcgugcagggcggugggcguggagcacggcgcuggggagcuggugcgcagccugccaggccuccccguucggcacuggccuccccggccgagccuucucccagucucccuugccgcuuccucuccugccgccgcccuccgggaugacggggcgcucggauuuccucccaccggcccccaagauggguuuaucaacagugacucaucuuaaaaccguguucuucaccugcgaucgcugugcaaaccgcaagaguugccacgguggagaagcgaaguccuaguuuuucaucaguuaaagcaaucuaugauuagccuuuaaugagcggccuugcuuucccaggcuuucucauguggaacuuuauuuggggacacgaacauacagagugguagugagcauugugucucagguucucacucagaaagcuaugaauaaaauuggccuacagucauaggcaccgaaucgccaugugccuuauaauuaaguagcuuuauaagcacaugaaacuguuuaguaguggcugagccuucuauacuuuuugguguucuguggcuuuauagucuuuuaaagucugaauuugaagacaguugccgaauuccaguucaagcuuacuugucuuuacauuaucaaccuuauuuuaaaguuauuucuuguuaaggaagugcuucuuacacccuuccuuuuaaucuccuuuucuagaacuccauauuauuaaaaguguaucgugcaacagcaguuauuuuuaguguaacugcccugaaguucuucagacagguauuuagcagagauugaagguuauugauucauauaauuuguauccaacuccuuccuuuggccuugaagaucugugagugccuaacauuagccaaaggaaauaauggauaugugcgccagcgugugagguggccaguuuagcuuguaaugaccaggguuguacaccaaggccuucauuaauuuuaaaauuaaaaauaauaaagaaagccaggauaguuaggucuuucuuuccagcaugcaacagguucccuuucaggaucgagcucacucugaagaguuuuugcgcugacagacaugaguugacagauuucucugaagguuugacuguguaauccagagcagcuucggaguccguguauagaacaaguggcucccagcuccucaucuuggcucagucuccagguacucagaucauaaaggcauaccaaagaagcagggcaggcaagaucaguucccaagggauuauguuauacaaagcacacaguggucccuuaagcaugcaugcugacuuaguauggcaaaucuuuuuaaggaauucauuuaagggaauguaauaaccuuaugauaaaaugucaccuguauugguuacuaaucagcaguacccugaccuuaaacacccuaacuaagccaucugccauuaaacagugggcacgaagucagccccaggagcaccccgucuaguauacagguaagaaaggacuugagcuugccaucccagggaggggaucuguuaagggagccaggcuuaguguuaggcaucuauucaucauucucauuauuucuguggucaucugugcucaccacaauauucuuaaucuuuugucuuguuuuccauuuucuauaauuugagcacuuggccuguuucaaggcuuacuugauaucuagguacgcagagugcaaauuaaaacuauggaagacugagccacgcuggugccuuugggaggcuccaugucuagaauaagcuaaugcccagccuugcuuagaauuccggcaauuguggguuaggguuuacuucugugguguggcuguguuggaauaaaagucagacuuagaguaaaucuuuaacuccucaaguuuguaauuuucccaccuguggacuugacuaauaauacauagguuuuaggggaagaacaauuuagauaacuuaucuaaacaggccugcugaaugcuaaagggcugugugaauauuuauuaugauaauaauaauuauaaugaucuguuucuaaucuuuuuaauuucuguaugucauuaacuauggaaaugcucauuagacuauucaaaauggugcuucugagccagugguucucaaacuucccaaugcuaugacccuuuaacaaacuuccucaggucauacuggcccuuaaccauaaaacuauuuuguugcuauuucauaacuauaauguuccuacgguuaucaauccuaauauaaauauaugauauccagaauaucuguuauacaacccccaaagagguuacacccuacagguugagaaccgcuguucuaaagcccuauuuuaauuuagaauuuagaacauuuauugcauaugcagagugaaacaaauucagccuuguaggaaagcaugcccucaaaauauuuccagagagucccauggcaucauuuucgccaaguaucacucaugccuuaaguuuauucauuuauguuucagucucauuucaagacuauccugaacuguacagaaguuugaaauaauaauuuggggguguuuuauauuuugggaugaucucugaaaucauccugguuuucguuaggguggggguaguuaguucuuccgcuauuacacaaguucuuuaaaagaucacaugacuuucugauagccaagcuuuuccuaccauggcuuacuuucuguggugauugcaugacacuccuuccucuucuccacagccuuacacaguuccucuucagcauuaaucauuggcuuacuuggcaauaggugugguaguccugucagaauacaaccagugugcuucugaaggcugguggcuuagcuguaaugucuugugguucgcccaggauauuuuagaauugacuuucuuuuccuaggugaaguaaaugcgauguggucauagcauuuuguuaauaaaaggacuuguuaagacugacgccuccaacguuucuuaaggaaaacaauaaagagaaguuauuugauuugguagucauaguagcauguacacaguuggggugacuaugaaguauugucuacuuaaaaaccaguguaagugugaaagcuaucuaggccuuaaaaacaaaaaaaacccaaaacaacaacaacaacaacaacaacaacaaaaaaccagacuagauguacagauacgucuuaguggugauacaagaaauaccacugaaauuuccugacacuuucuggaggaagcuccagcaaccccguggaacuguuuuaauuugguagcagauaugugccuagccaaaagugcuaauucugaguguuugcuggcgggugcugcucuuaagacuguguuugggggcgggcgugguggcgcaugccuuuaaucccagcacucuggaggcagaggcaggcggauuucugacuuugaggccagccuggucuacaaagugagguccaggacagccagggauacacagagaaacgcugucucgaaaaaccaaaaagaaaaaaaaaaaaaaaaaaaaagacuguguuuggaccauaaaguggacaggucccuuauguaggggcuuggaaaaggugcugaucuaauggcuagccuucucuuuuuacuauauaaguuuuaagaauaaauuucuugaaaccauuugagaacuugcaaaacaccacuuuccaagggucugaaaacugacugcuguuuggacucgauuccuuauuuacuuuuuuuucucagaaaugaaugagccugaaaauuccuccaucuauuuuauuuuuauuuacuguacagugcuuguguauauggaugguguauauggguuugauaauauuaauaucugcgcaucggacacaagaccuacucacacagacuuuuuauuagagacaguaccaggagcuuuucaucucugcguugcaguuguuuuccaauacuuaucuuccguaacuggaauucauuucuauaugcugguaauuugauaaacuguuuugaaaugcauuuguugagcucaguguaauuccaugugccucuaaugaaaggcaugugacccucuagauuagaagaaaggucugugguuggcucacacagaggccuugcugcuccuuuugggcaauccuuaaccuggcacccucuaauguguuugcuaagauagaguuuuccaaaauugaaauaaugucacauuugaaaagaugccaagaaacaauguggcacuuucuaaauuuuugugaagcuaaaauuccuaguuaugaaaaagaguacaugucacagaugaguaguuagugaugacuucaguguagcaggaaaagagcaauucccauaugcugauucuagucucauaauaaagaauguuauagaaagauggcagaguauuuaacaagcugugaguuaaugcgacagcgucgguggauccaguuccagaaggauaaucacuuuaccauauuucuucaaaaauauuugaaguuaucuuacaaaacagaaaacuugcugggagugaaugcaggcugcacugcauuguaucuuccaacccagacagccagacagucgaauggaguuucuuuaaacagugccauuguucaagaugcuugugcgaucccacaugcuuggauaaauuugugguucucuuugucagacucagugggcaaaguuauaaauguauaaaugccaggacccgaauuugaguugccaaagucccugggaagcuggaugugguaguguacacaucugcaccccuugcacuucugcaaaauaugggagauggagacaauagaauccucagaagcucaugagcuagcgaacuugcuaugcacagccuuagacaagagauccuguuccaauaacguagacgcuagggaccuacaccagacauuguccucugaccgccacaugacccauggcuuauguguguacaccauauaagcuugugcaugcacaaagguaaauauaaaaaaagacgagacauuuuugaccaaagccacauugcuuuuguuuauuauguguacauuucauuguguccaugagcacccuguauguguguuuccuuaagaagaacccauuaucccaaaguuaguauuuuuugagagacccguuacuucaagcuugaaagcagugucguguguguaugugugugugugugugugugugugugagagagagagagagagagagagagagagagagagagagagagagagagagagagagagagaaaagcauuguugucuugcaugugaaggugucccuucaugauauuuauaauaccacagguauucacacgcuaacacauuccuccuaauugcccaugucuuugggcucucccugaaggggcuuagaagaauuaacuugugauggccacagagggcuaaccucugcuaaaaguaacaugauuugggaaugaucucauuugaaaauaaacuuccccuguugguuagcaaugggagauguaugcauugguguaaaguauaaaaguuuagauggaccucugguuccuugguaugaagucugcuaugguuccaccuguauagaucuugacuggaagaggccuccaguccacacgguaagugcugaguuucauggaccacaacaucuuaggagaaucgucaccgagauuuuguccacguucuaagugagcucccaagggaacuggucagaugugagcucauuuuggaagguccacauuuaccuuucaguuuacucuagggcacuacaaaaugucaccaguguaagaacauaagucugaauggacucugcuuaguccgagcgacaaugucccauuagaguucuacagaagacuccagcagguagaaguuaagcacuugauucaugcuguggcugugguuucaacaaguuuuuauuaauuccaguaauuuugauaaguuccaccaacaaauguuuauuucauggcuuuucauuggcccauaggucgugagaaugcaaucugaauggcaauagaaugacaucauucagguaggaauucauaauaaugauacaaaaaauagugacagucauauuucugauuuaacuaaauauuugaauacaugcaaaaucucaaugauuuaguaucauuaauugcucaaacaccuguaucagaaauuugaagcuuuguugagagcccagaacaucucauguaaguuuuucuccucuuauuucacuugugauuagaauugaauuccuuuuggaaucuacauauucccuucacauuuuaccuuucccucuucaguauguaugccaugacauuguaguuuauuauuguuacuauuauuuacuauuaucauguuuuuagaaacucucagguggguuuguguuuccagggugucaacccuacugaaaugcaaacuucuaccuuaguugccuuuagaaccacagccauuuuugaugguugccaaggcaaccauuuguuuuaaaugcugacccuucuuugagauauguuuauagugggcaguuacccuguuuuucacaucuguaucucuggacacccucacuguccucucccaguacccuguauaauuccacaugaagauaauguucccuccaagugucucuaauacuacccuccacauuaaguuguuuucuugcgguugaagaaauagaucugauaauaauaauagcaaacaguuacuguccaguguuuacauuccgagagaguuauuguuuguguugcuccuuuuucuccugucaugucuugugcugaacuguugcuuagguguuuagcucugauaaagccagccagcucucuuagaaagucaaaccuuugucuuagaauuucaguguauuauggaugguuuaaauguauaguuucugugugaauuugagguguaaaguguuuuucccaugaguacaguguagauaagauacuuuugaugcugcucuauccgucaucucccuccuccuuucuauuaccugcucucuccuucccucuaugucauuuuuuucuuuucuuuuugaaccgugauaccucuuagcucauggaacaacaacaacaacaaaagauucccugaaaauuaaauguguuauguuguucuucaggacaagaauauuaaacuuuagaaagagaucaauucaaaauagucacauacaaacauauauuuauaaauuguuaucuuucacuucaacuguuucccaugauaauuauguaggcauuguauuaguaaccaagaaaauaaauacucuguaugucaugcucacauaacaauuugugaauacuaaugacaaugggaguauaugugauagauuaauugucaauaauaccuuucugggaaauaggauuuuucuacagauauuguuuucauucuuuguuucauggagguguuuguuuguuuguuuuuguuuuucaagacaggguuucucuguauaguccuggcuauccuggaacucacuuuguagaccaggcuggccucaaagucagaaauccgccugccucugccucucaagugcuggauuaaaggcaugcgccaccacagcccggcuuuugauuuguuuuguuuuguuuguuucauggaguuuuaucccaacucaccacaaguucucaguucuuuaaaaagcauauugaucuauuuuggauguuggcuuuuucaccuucucucucugaauccccaagucccaucuuugccuuggacagcuacugcugucuuucacugauaggcaguuuuaucuuaggagguccuucuugguagaccaaacauggaucugguacccuaguuccugcuuuucuucucuuucuagccuuauaagcucagugagagauuuuugaugucuucuuuguacaucuugcucaacacacaugacacaugauuggcccuuaaaaagccguauuaucugaauacaugugauguuaauuuggcagugcucucgauccucaguuaucaaagcaucugauagguuuuggaauauuuacacauaggagugaaaacuaaguagagaccauaccaagggauacuuuugaccuuggguucuuaaaaaaaaaauccagauauuacaguugaaucauuuacauuuauuagcaaauguucacaaucuuggacauuuuugacauguugaacuauuuuaguauuuaguuacuuaggcaaagauuaaaacaguauucccucaaguagcgccucuagucgcagaagacauucccagguagcacuuguuucaacuugucagcaccuucuaacauauuuguuguuuccuuccauuugugcgaggcuauggggguuugccugucugguccagcuauucuuucagcucacgugguccauaggaaugggaugagauuauuuagccgacucuaucuuugacuauuucuuuuuuccuuaaggaaucuugugagugcaaaauuauguuggaaaaguugaaguaacuucuccaugaaaaaucugauugcauuguauauuauacaguacucacaaaacgaaguaguuuuaagaauacuuucaaguaugcuuuuuuuuuggucagauacuacuguacuucagaaaccauuuaauugaaaauagaagccaaagucuauagaaaauauuaacuaagugggagcuugaaacuaauagaauuuuaccuauuaacuuuuuuuuuccaugcaaaaugaacagccacucugcaacauuuaguagagggaagaaauaccuugauuuuccuguuuugcacaaaugcguggaaaguccauuagguaagguuccucucaacaacagucuuucuucagucucaucaggaaucacguaauuuagguggugaauucgcagaggaaaacccacaagacuuggauuggcuguuugucacagaucaggccaggcuucuaagagagacagguggcagcaaccucuuuucaguugaguuuucucaucuguaaagugagcuuaauggauaacuuguacagcuuuguucagggguaagugggaaaacccugugagcaaaugaauaaauaauuaggaacuaguacguguuuaauaaaugguucucauccacguuaacuuaacuugccucugcgauauaauuguacauauaauugcgcauuuguauaauugcaaguuagaccaucaugauuuacauuuaauaacuacagaugugucuucccuugacuccuucuagcauccuuguuaacagucauggaugaaaaguuuucucacuucucccuguuucaggcucucugauuaucuuuccuucugauguucuucuguuguucucuggucuuauuuugaguuacccauuuuccucaauaccccccccccuuuuuuuuuaauugaaauuucucaguuuguuccuucccucagcuccuugccugcguugguagacagacgcuccuugucugagccugggcacgaggcacuaaugguaacucuauucagggaggucuuguagguggagccuccgacuauagccacugaaagauuucaucucagcauaucugcccaugcuuucugcagagcaauuuauguuuuucuggcaggaaaauaacaugagcacuaaucacaucaccaaaaagcacaaguaugcuaagaacugugacacagugcauccaccuguguaacugccuuuccugucaagaaacaaagucucugcagcauaagcucccaugccccaucgugaucccaauuucuuccccuaaaaaucaaugccucucuugaccacuaacagugucaagagaggcuuuguuugauuuugaacccuaccacuaguaaugcacagcauuuaugaguacugcaugcuuuuacugguucugagcagcuuguguuuguaauucauuguaugcaguuucuucauacauuuuuuuucaauauaacaucauauaauagaaucacguacuucacuguguuuucuucuauuauucauuguauggcugugugugccugcguaugguauguguuugugugucuuugaaacuaaacaugguuuugugucuuuccagauguucuaaguuucuaggagucugaucuaaacauuugauguuuuccugcauuauuuuaugccccacgaauuguacuuuucaaguucucuuuugacauacauuuacuuaguguguguguguucuuguuuggauaucugagggcauauguguguuuaaauauauguacaggucugugcacuugcagaugggagucaaagcuaggcaucagaugucuuccucaauuccuacacacucgauugaugagcaagugucuccagcugagucgggaacucacugauuuggcuacugaacaucaggauauuguuucccagacaucucuugagugcuggagugcaggcggguugccuugacugccaguuuucaugucugugcuggggauucaaacucgguuccucaaacuugcaugcuagacacuucaucaacacugagcaggcuucccagcuugugacucacaauuuugaaagggaaggucuauguauuucucacuacuugugcauuuauugccuugugcauguggaucuugggucaugguaguugguucuuuauccaauacaaauaaagacaaaaugcuuugaaucuguaugucuugauuagaauguauuauauugaugagacagcuuuauaccuauauuuacuuuauucuucaggguucauuuaagacuuagggcuuccuuuaaaaguuagaucauaugcagaaauauuuaaguguuuuaauggcuacccaucuaguaacaauauauuugaguauguaccuaaccuaaaguuugucucugugagagacauauacuagaaguaacaggaagauuuaaaaacaccucaaguguuuuuuuuuuuuuuuccuaucucuccagucaucacugucauaauuacuggacauugacaguuguggaaauaugucccaguuucagagguguccaaccugcaggaggguggaagacaaugugugacauguaaauacuuauaacuauaaaagaguauauaucaauaaucugaguaauauauugcacauaugaauggagauaugcugauauuuuuaauuagugguaauguuauuauugauauuuucugcucuaggaaaaaucuagcagagagccauaauugcaucaccauuuaaaguauggaaagugcuguugaaggccaucaguaugaaaugucaugugaacaagugcagagaaacaguuucuuuugugacuacacuagaagacuugguagaaguccacucaucuccugaacuuuacuagucugcaucccuuagugcugguagcuuugaggcaauuccagaggcuagaauaacuuaguggccucugugcauucauugcccugagauauggagccaagaaaauaugcuugauagcugccuuucuagaaugccucucauguaaauaccagaaagggacaaugcuuuuauaucuacaaauaucuugacauguacauugcauguacaaauaugucuacaaguaaguguugcucaagaaaaaaauaucaagguuuaugaaaaauuaguuuuaaacuaguacuuuaauagaggcuuaguguacuaauagccagguaugcccaguccucagccuaugccuaaggaagggcuuaaaacuguauugcuucaucuguaaaaugcaacgacaauuauuauuuuacccaagacaagcaaucaaaauuaaaaucaggugagaugacguacuuuugcuccaguuccuggcucaguguagcgauagcaugacacacuuagucacuaaucacacaguuuucucucaguuucuaugggcacucagggucaggggccugaagggagucuaguucugaauuuuguucucuuuccucaguuagauuuuggagaaagaaagugugaaacaccugaaucuagaauuauguaaguguuuuucccuuuccucuguuaugacagcuguccacauguagauggauggagaaaagaaaugauuaauuaggguauagguggagaaagucuuugcuaacuguucaugugugugugugggggcggggaagggagguauguagauagaaguguaaguuuacaucgaacuugaaauagaagauugauuacauuaguuauaagaaauauuucaugagugagcucauuucugcccuagcuaauucuguccuuucacccacaugcaacacauuuuuuuuuuaaugugaauauguaaaaugggaacuguuggggccccaaagaaucuauaugcauagccauucuuucaaauuuagaucucagugggacuuuaauuccaauucaauuuuuguauuuaagauuacuuuaaagauucuguuccuuguuucaauuaauucaguaucuuuguaaucuuugucucugucucucugucucucugucucucuuucuuugucucugucucucuuucucuuucucuuucuccucuuucuccucuuucuccucuuucuccucuuucucuuucucuuucucuuucucuuucucuuucucuuucucuuucucuuucucuuucucuuucucuuucucuuucucuuucucuuucucuuucucuuucucuuucucuuucucuuucucuuucucucuccaccccucuuggacccuuucuucucucuccuuuauucuuuauccucuccuaucuauucuauucuaccucucuuaccucuccccauaucucaucuguuugaauucuuacacgauauucuauuaagucagaauaacaaaguucaugauuccauaagaauucuuuaguccauacaagcuuaggauagggaguguacuugaagacacuugcuuuauguuagugucuaucacucagaaucaucagucagauuaauauuaauucaugcucuaaaugcauacuuucauuagaggcugguuuuccuaccaugggccaaggcauuguuauuuuguucuuuauuauuaguccaguuaagauggcacaggguagaguuuucagaagcaggaggauucuggagacuaccauauuuuuucaagugugugauuacuacagauuguaaauacacuuuguugcaaccuuaagucuuccccuaauaccuuauccauuccagaguuucuuaauaugacauauuaagaaguuuuuaauuucuuaaauauuuucuuauuuuuaauaaaaugaaauuucaauuauuuguacaggaaugagacaguagcucaucagaaaguucagcugguagaagcccuugccauacaagccugagagucucaggaacccacacuagagacaaggauugacuccuaauuguuaccuuuugacaucuacacauguaguguggugugugaauguguuuaugaaaaugcuuauacaugcauacuccauauauauauauauguauauauauauauauauauauacacacacacacauauauacaugaugcuaguaaaguugguauaaagaaugagacaaauuuaggaugaguguuuuaaacugaucauugucaugguuuagcuuuaaaaacuguaaccgaaaauuuuagaguugcuacaugugaguauuagcauugagcucaggguuaccacugagcuuauacauccuacauaauuaagaguauaugauuucaaaagcugugaucugugaucuaauuguacauugauauuuuaucuucugcuuuucuccacuccaugucuguaauccuuuccuauuacugauucuucugcacguugauucuauccuaucauauuauauugcguuuugaaauuccuuuacuacugaaaacuguacuaaaacccaacaacaaaccucuucaaaaaucauaaacaaauugaaaauaucaaaguuccccugccaaguuaaagaaauuacauuauguauguuuaaaugucuugguuaugauuuuccuugagccuugcugucuggaagcagcaccuuuucuguguucaacaagacuuuagugggguaagugggauucugugacagaaagccaaaugagacugggaaagucaguccaaauggaauggaugccaucuucuguucuaucuaagaccuuuuagagccguaauugcuaauauacauuauggauaucugggaggggugcagaguauucaguuucaacucagcuuaauuugaucaagggcuugucuuucauuucucuuuuagaagucauuaucaugagaagaacauaagaggaguuuuuggguuuugugucaucucuguuuaaacaggcacucucucaaaaucccagacagagcuuagcugaguaccgguugaacagaggcagaauagucucauaauauuuucaaaacugauuuuuuuuuucaaaaaugauucauguaguggaaacuuucuaggcauaguacuucaauucugcacugacuuuauaugcaguguuagaaaucaugcagagaacuuuuucuagaugacagagaacuguguuuuguuacacaguuugcuauacuagguuauguugcuuucguaaacagacuuauuuuugaaugacugaucaguuccauuuucuauguauacauguuagguuguauguuugaggacuagaggucccaaaaaggacaucaaauaaccagggacuggaauuacugauaguugugagcuggcagguugguuuugggaaccaaacauagauucucugccacagcagggugugcuccucacugcucuaauccugcugaggauccaccuagagguguuugaaaaugguaauuuucauucaaaguaucauugcaauuaaauagagaaaaaucccccccccccauccuccuguuauuucaucagaaggaaaauggggcuggguaauauuugaacuucccacucuaguggcaaaauacuccgagaagacuaaaauagaggaaguacuuuuuucacacauaaugucagagguuuuagugugugaucacuuggccucauagaacauggagaagcaaagcugcccacuuugugccagacaaaacauagaaacaaauaggacagggaacuuggaaagacacaucgcuuaauaggcaagaccucacugacuuucuucuuaucgugaggcuacaacucuuguuauugcuaccauucaguuauaguucaauuauagauccucaugaaucgauuacacggacaccagauagguugguauggaaaacaaaacaaauauuguguaguugccauguguuuauugcacuacaugaaagucugcugcaagugcuauaacuuggcugagauaaaucuggcaaaguauacacugauagguuuuagaaagcauggaaugggaaaaaaaaauuccauucuguuguguggauguauuaucaaauguucaugaugguugugccuuuaacuguuggacaccucugugguucuguccuuaggcuauuuguccuuagaugggugcaggccuuuuaaacuacuuccuauuguauggcaaggauaaucucagugguuucuaaguuacuucucaguuucaugaggaagaacuauugcacacgauggcacacacuuacuucccuucaucuuggagggagaaaaguuuucugucucuccuuuauguauacaguacccagccacacaguauacugguagcaucgauugucgguguauuuaaaccuuauggagugggggggaggguaugggggacuuuugggauagcauuggaaauguaaaugagaaaaauaccuaauaaaaaauuuaaaaaaaaaaugaaaaaaguaagggaauaccacgaugaccacauuuuuaccuugggcuucauagugcauugaaaacagagcauuuucagugaagugugcugucuccaggguaugaaucuaacagggucaccauacugcacaaucguauucugcgugugugugcaucacuucacuuuuaucaaguggauuagcacuccuuggcacugauuucuuaaaggagacagcuguuuauagccaguuauauuaguggguugaauuaaugauugaaauguccuuugcuuaaugacagaguggaaauauagcaacugcaauaaauaaaaauuaaaccucuuuuaauaaacgaggaucauuuuucagcaagugcuagaaagcaaggcaaauguucacacaaagacagacucuggcuauuuuuuguuaucaguggaaauccagguuucguacaguguuaauucacucuagagcugucuuguuaaauagguucauuaauauguugccauaagcuauucuuuuugaacuugacacuaugauuggugcuuugcccaaggaccaguugauauaaguuuagucaagaagaaaaggacaaagcaaaacuugcucacaugcaaauuagugggccaggguaauuuguggcucagucagauuaguugguuuaaaucaacaguuuucacuguagacauuuuuguuuucuuugaaaaaauaauggaaaccacaugaguguguaucuguguguauguuugugucucugugucuguguguauugcugaauuucacucuuauuuguuaugaaacaagggaauuauuccucucugauuuugauacuccaagauacauauuuguucuuuaguuauuccaauuagugaaaauaaaugcauguuuuaauguuuucagauauguuuuaaagucagauuucuaccauaaagccuuuagagacaaaauauaacuguuucaaaauuuucuucuaaaaacaaaauugucaauguaaaguuuuaguaugcauccaugaagucucauuuuuacacagauugcauuuuuacuaacuuaccucaugaucccuuuuaacauagacuaauggcuuugcaaugauauauuuaaauuacagggaacacaguaugaugaaaugauugccuaauagguauguuugaucaagccucaaaaguuauugaaugagguuagcauuuuaugucagaguggcuuacgugaguucuaaugucuggaugauuauuaauagacuuuguguuuggaaauauguuacuagaaguaaucauuuuguauuacuuuggucugaaguaauaagagauuucuuuuaugggagaugugugaaggugauggcauuuaaaucucaaaaggauugaaaacauccaaaaauaucuuuucaagauuuagaaaugauaaagauucuauguccaaauuaaguaaaaaugaauaguaaaggacugaauuugacagagagcuuauggaguuggaacgcccccccuuaacaaaaaagugaucuaccauucaagucuugcccuagaaucagaaggaauagaaaacauuuaaacuccuucagugaugguuugugaaucggauaaacaguguuucuugcauuuuuauaguucacuuaagcagucugauuuugaucuguauauguggaguagacaggauacaaguggucccccauccccccaaaccaaugagcagacacauauguuccuuaaagaagaaacuucccguguucauauggaagcuaucuagcuugcuauagguccaagacuugaccucccuuuuauuuggcuaucauuugcuuaauucuucagauucuuugugguagacuuuugaucaaaagaaacuuuuuuauucuuuaucuucuuuuauuuuuuuucauaaaagcuacaagaaauguguaauuaauaacuuuguucuuuauguuagugauaugagcaaguaugguauaaaacaucuuauuaaagauuagagcaugaugacuucuuuuuuugugacuacuuugauuucaagcacuugaaaguuuuauuaucuggaaaaaaaaaagaacaagucaucuggcguuauauauuaugaacaucagaacagcuacuuguacaguucauacucaaugggaugaggucagaucacacaaucuggacccggaauauuugcaauguaguugggaauguaguuugcauacauacacauacauguggagguucaugcauaaaaugacauuuggaaagcuacugaaagagaaguuuuuuuuuguuuuuuuuaaauuaucauuucacuugauuuucacauuguuauucucuuggaaauuaaagcuaaagagaaugagcaaaucaugauuguuguguuugguucacagcugaugcugaauggugacggaugucagugcccguguguuugcuccccccgcccccuuguguguguguguguguguguguguguguguguguguguguguguguguuuaccuuaaacuaggaggguguuaucuuaaacuaggaggggguuaaacuuaucggugcuguaaaucacauccaaaacuuguucccauucuuccucguuuugauucuuuuguuugaggccaagguaguauacagagagaacauacacuuuacauucuguacuuucaaaguuucauauucuauggaaacuaauccucauuuucaccacagugaaugugaaauuucaauucuuucaaguuucuguaaaaauugauugcucuggccaggcaguuugauuauggauugcauggauaguugggcuaagaauauuucauaaguguaugagugccuauauuuguguacauguaugugagcauguagguagauuuguguguguguguuuaaauguguauacagauauguggccuagagcuaagucacuaugggugaauuucauuguccagauaacggaagacuuaggucuccuguuucugugaagaagccaccaggagaaaaugauucaugucuuaacauggacgauucuuuuauauacuuaaaauuuuuaauuagugaaauaaagagcauuaugucuaauguuaaucacucccacuguacaaacuuaagugauacuauaauacaacgccuuauuuggauauguuuuaaauaauugugaacucuaagaauguuuuuaaguuuauuguccugauauacaauucaaugaaauuaguugagaguaagacuuagcguuuuugggacagguauauuuuauaucuuagaacauacugggcauacuguuuagcugucuuggcagucagguuagauggucuaauuaagacggauuuguuuguguguguugaacgugguguagguaugcacaaugaucagcauucucucagaagguaauaguucugcuucucucaaucauguugaagucuuuuuuuuuucgagacaagguuucucuguguagcccuggcuguccuggaacucacuuuguagaccaggcuggccucgaacucagaaauccaccugccuuugccucccaagugcugggauuagaagcgugcaccaccacugccuagcuuuauguugaagucuuaaacgaucaguuuagguucccucuguccauuuucucuuuuaaccucauuaucuaaaaaucugcuuuauaguggauuuacuuuaacaagcauuuugaauuuauuuguucuuuuaguuuaaaaaggaauauugcuaugaaguagaaugacaugauuuaccuucagucaugugauuguccauaaaguuugucuagaaaauccauugcuggugugaacacauuuagauccccucuuuacccggcacugguaacuaugacaguuuuuaagguugaaggaguuuuuugaguugaauaaucucaucaaguuugcaaucuuucggaaaaaaaaaucauuccuguuccauaauguuuuauaucacauucuuucccuagcuguauuauuaaaaccaagaaaggacaggauuuugucacaugucugccugagcuguuaucagaauuuuuuuuuuuuuuuuuuuuuuuuuuuuugagcagcccagagugcuuucuuuauuuaggaauagaaacuguucuuugcauuguuuguuuuacagauguacagaucaacuccaaaaacaucuucaguguucucuaagcaucuucuaagacaauagcuuccugauaguugacaaauagaaucaauacuuguagaaggcauucugaagccacccacaugcuuugugaagucagugcuggguacgauuuuccaaggaugugauuuuuuuuuucaagagaaaauguucacuggaaaaguucuuggcacacagugaaacaucgugcaaucuguuauuugucuuagagauaauaacuggcggguggcuauagucuugugcuaucuaacuuaugacuugagaggggaguuucuuccacucagaaguauugcaaaugugcuuauauuuacauaauaugucacucugaaaaauuaugaugauauaauuccaguaaaaaaaaugcuuuuuucuauagcuacuucaaaguauacucaaauaaauuaaccaauuuuuuaauaaaaacagcgacuaaaaagaacaugcccccuaccccccacagcacaauauaaaacccaaaugaccucucugauuccucuuugaaguuuuagcaguuuaacauucuuugcgauguauauuaguaagggacucuguugaacauaagacaucagugagucauaugcuuucugaaggucuguucuuggguggaacgaaauuuugaguagauaauuuaauuaaguucucucugucucucuuuuuuucuuuuucucaauaccuaaugauguugguggaguaauuuuuaacucuugacccacucuauuuuucaugauagugauaaaucagcagagaucuaaaauguuucuuucuucuuaaaaaauguccuuuuuucccaauaugaauguauuuagaucaauucacuuuuaaguauuuuaucuuaguucccuuuucauuuucccaaucacguugacauuaauauaugggcauaaaccauuuguucuucauuuugauagacagguaaccuucauaaaucagauuauaauuucuacagacauuuugucuuuucauacagaauuuuuauagcuuugggcaaccucacucacauuguuucaguuacucauuguuagaauguagguauucuaaggagaaaaguugccacacaaauguuaggguuguugaccacuugaccaaagaaggacuaaaguguauuagauaaggaugagauaaugggaaauauacaaaauauuucagaauucucuaaggagaggcaaaaguugugucccaaaccagugucauuuuauguguaggaacucuugauguuaugaacgagagcauccugucuucuaggucaauuuugaauauaaguguauaaauauauacacacucauauaaagguauaaguacuuaccccugagcuuguaaauuuguaaauauacguaagugcaugcacacgcucaugugcacacaaacaugucauugaguucuaucgguuacuccagaacuccugggcucagcugaucuuucagcaucccgaagcaugccacuauacuugguuugcaauaacauggguuuuguuuacauuuauaguuuaaauaauaacuaauguuuuaguuuuuuuuuucuuaaaguuuuccccuucgaugguuagcacuaaaauugccuuguaaucuuucacaugcacucccaaggcuaccagagucucaucugacagaccaauacaggcauccuuagaugcugucagcgaaagcaacauuucaaugucaaacauuaaaaaaaacauaguuaacccaugucccaaauuacaaagaagggcccuaguuucuuucauuugagacucucaugggcugaccaggaaagguacauauuccucuuccuuugccauguugcccucccuggcuaacccuuugucuugaauccucacuccuuucaccuaguuuuguuacugcaugcggggacuuauguggaucugugauggauggugauuaucagugcguaaggagaacauuguaguuuuuaaagugcugucgaacuguguucaacaauaguuacugaaguaucaccucgucaaggauuguuuacauguuaguacauuaucguguucagugauucauaucacagcaacuuugaguggcuagagcuguucagaagcaaacguccucucaugccuuucaaacuaguggaguugugcagccuauggaggaguuacagagaaaaacaccuaagccaugauauuaauuugaauuuuuccagcacauugaguuuuugguauaacuuacuuuacuaaacugguccucccagcaaagccuguuaauaacaaagaaagcuugcauuauuagaaauuagcacguagaaauuucagagagacauuuugagugaugacuuaggcaacacuugaguuuuucagccuagagcuuaaagaacaaagaccacagagccccauucugaacugcucuuuguuaauaugcucuuucauuuguaggagacuauuuauuucucaauauuauucuacuccgggucacuaauaucacuuggaucuaagcuugauuguuacuaaggucuaaggcagggucaguagcacuggaaugggaagaaaaccaccagaaauugcuaagaucuugucauuuuagccucagaaugacagugaccuguaucaacuuccauauuguucucuaggcgagaccacaagggcuuaguggauuuccacagaguccuggugaaaccucaccuguuacuguaacacaugucaggcccuacucucaacuuccaggaugguacccuuagguuuuaaagaacuucuugguagggcauaucagaaauguucauuauccucuuuccugguagugaguggguaguuaucauucaguucaugacauagcugucugucccccccccuuuuuuuuuuacaagaaucuauuucuuugaaacuauauucucaguguaacacuauaaaaaugcaacuuaguaauaauauguacauacuauuucaugggaguaaacauucaauauguucuauaaaauuaaacauguacaucucuguucuguaagcagcaaaccugcauauauauauauaauauaaauucgauaacauguguagauauauauguacuuaucauugaccguaauugaaaguaaggaaaauuagucaaaaauaacauggguggcaaugauuaagauuauggcuaugagauuuuuaauauucauagccuaccuuaaaaaaauauaccagccagcuuuuacauuaaacuguuucaaauaucaaagauuugcuuuugucugauugccuccuuuuguuuucguauuugaagcaaucucccucccugcccccagaggaacuauuuuauugugcaccuuggaagaccuugaauagacuguaauauauccuagauuggguuaccugugcauaaucuuccaauaaccaugugccuuuauuuucccuauguguucacagauaugguccggaaaaagaaccccccucugagaaacguugcuagugaaggcgagggucaaacccuggagccaacagcuacagagagcaagguaucugggaagaacaaagaauugucugcagaucagaugucagaaaauacagaucagagugauguugcagaguugaacucgaaggaggaacacagcacgcauggccaagagccaucuuccagcgguaagaaggacuugcaaaucucaggccugagugagaaggcuggcuucaauuaugaaagccccaguaagggagggagccuugucuccuucccacaugaugagguaacagacagaaauauguuggcuuucucaucuccagcugcugggggagucugcgagcccuugaagucuccucaaagagcagaggcagaugacccucaagauauggccugcaccccaucaggggauucauuggagacaaaggaagagcauaaaaugucaccaaaggccacugaggaaacagggccagugcagaguggucaagccaauugucaagguuugaguccaguuuccguggccucaaaaaacccacaagugccuucagaugggggugucagacugaguaaacccaaaggugacuuacuggugaaugacaacccagacccggcaccucugucuccagagcuucaggacuuuaaaugcaauaucuguggauacgguuacuauggcaaugaccccacagaucugauuaagcacuuccgaaaguaucacuuaggacugcauaaucgcaccaggcaggaugcugagcuggacagcaaaaucuuggcccuucauaacauggugcaguucagccauuccaaagacuuccagaaggucaaccguucugugcuuucuggcgugcugcaggauaucagcucuucacggccugcuuuacuaaacggaaccuaugauguacagguuuguguuuucucuugugauuuccaggaggagaaaaaaagugauucgugaugaaaugugaauucauauuuucauguucagugucagcucccaaggccagacacauagcuuuuaggcccuauagaaaagauggauguaucucauugcuacuccacucuaaugugcauucagaguuuaauuucccauuggcagggagcaguacaaaauuuccacuagauuuggaaaagucuguucguggaauaagcuaagauuccuauuucuugaucuacuucaugauagauauuuucagcccuccagcgauggcagcgaucucugacugcacaugauaauucauugccuuguucuaguuucugacuauuaggcuucuccuauauucuuucuccugggucaaucaguuuucuaucuuaaauuaguauuugauuuuauacuuagucuaauuagaguugaguaauaucaacagcgacagagacauacauaguccugaaacaucaaaaucauuauaaaugaaaauugaaaauaacauuuuacacugauuaaaaauuucaaugagacuauaaguaguaaggaacccugaaugacuuuuaugcaagccaauaaagcauuucuuugucaauuuaagaaaaaugauaauaauuuaugaaauguuuacacuuuuauugaaaacuauaugcuguuuucaucuauuuuucugcccaguugaaaucagaaaugacaugaaaaaguacuaacguguaacaauuuaauuugaaugaaacaucggaauacauauaaaaaauucaauauuuaauuuuaauuuucaugauuuuagcauaguugaagcucaugaccagucuguaaagaguauuaaguuuuguuacauaauauaaauuguuauuguauuauaaggagagggagaucacaaaguaugugauagcuaauauuauuuaugaauuauuagaaauaccauagaacuagugaguucccauagcacuuauuuaguccagaaaguccuuuggcagucacuuuuuugucaucuuccuagccaugguaccucauucuuacaauuuucuacugaacagcaucaguuaagaaaugcacagagaguuagguuacaaaggauaggaguaaaguauuuugcaauauuuguaaaaaaggaacaggauagaaaauucugaguccaguaagcaucagaaugggcaucagcauuugaaaggggcuauggacaaaacuuaauaagccaguuucaucuuuaaaauuuccaucuucucagugaauuucuacaaauagaguuacuucuguggagcaacgaauuaaggcgacguaguuauuaugcauagaagcugcaugcuuuugaacuccugucuuauuaaggaucauuucgcugucuuaugucagauacacucugcugucaagcucugauuuggaaagcaaauacguguuuuagauaaaaggguuggaagugcauaaagucaguaugcgaaacgguguuuuauaauuagcaaguaauaugauguuaauaccuggauuuccggcaguuucaguuuguucacucuggggacgacuucugagggaagcugaucccggcugucaggaaggcucuaaaaagauuacuaaggccuaggguuuggaagaauucagauuuuuaaacacacuuccauuuuccccaaauaguuauuuguuagguucuuaguuauuuauaguaaaguuuauguuuggguggaacacuuuuccugggcagugauuuuagaaaugaaacagaugugugagcuaucugaauuuggaaauaaaacagcugaucaucaacuguacuguguacuaaaucccugcuaugcaugcagcaaagagaagugauagguaaccgcaggcaggaaggugaucuuguuagaauugguuuauuuucuccuucaguugaagaaaacuacugcagcguguagcauaaaaccagcccauggggaaagugggugauucucucaaggaaguggauagguuuagggccaaguuuacagaaaguuaacuucauuuuuuggugaagagaacaccaagaacacuauugaccaaugaugauuuugaacuuaugcugcguacauaccuaauacugauacacaaaagugucugaguaacuuacuaguguccauguugaacuacaaauaaauagcuacucuuccuacauaugcucagcaccaaaggcaugguuaaaauugcuuuuugccuucccagauuuaugcugcagaaauguucuuuggcuaguucuuucuuugagcacuuugucuguuuugacuaaagcuaugagauaaaauacugacuacagaauuucuuuaaugcagaguucuauaaaaaguauguauauccaucuaucuauuuauccauccauccuucauccauacaucuauccauuuuuccaagcauacauguauauacuguuuuuuuuuuugugaauuaauggcuuguauauauagugauaaaaugugauuuuagaugccaguauuaugaacaauuucaggaaucauuuacugaacuacauuaguuaagucaauugcagaaauggaugaaccauucauuaaucuuuuucaauuaaacuguuuuuagggagcauucagagcagucagguaaugauaaauuuauugcauguuacacccacccccccccccaaaaaaaaggagcagaggaaagaccucagaggacucuguuccuuugaucuuuaguuugguuugacauggaugguucuuuaaauuaauugaaccaacuugacugcaaauauaagauagcuaguuuggaagauggaguaauuuaaacaguuucuuggauuuucauauauacauaagcaacaugugaaaguucaguagcacagauaauaccugacacagauagcauccauguaaaugauauccccaacaacuugcccuguagauaaagaaccaaggccagguggaaacaaaucacccuggaaagaccacugucuuguuuugcacugaggaauucacaacguucuccacuguucauuuugugcccugaaaacagaaaagagaucaucuguuuaaggaaaaacaaaaaacaaacaaaaaaaaauaaauaaaaaugaccuccccauccaaacuaaaaauaauggaauucaaaccacaccaaaacauaaacaacacaaaacacgagaaaagauaauggcuagcucugaacccacaugguaugauagggguucugguuucccaaugguucacccccucucuauguuuugucaggcuuuucucuuacauauuugagaauaauggauauggccugauuggcaagccucaugucaguuuuacuaucuguauucagucuuugaggcucgcaaguagaccaauaauaggacaagagauugaguucuuuaaaaaguaauuacagccucuuucuuuuuaaucugcuuuauuaugcuuauauuuaaaccuucucugaauggaggccugcauuaacaacgccgacucugcuguuucauuaggccuucaugugcugugcauuagggcguuugcaucaucuuuaugggggagcuuuuagcucucagaucagguuauaaaauuaggaguccugucaaguugcgcuucccacgggaaaguguuuacacuaucccaagcugauaaaagcuuaagaagcauacaaaccuuuccauauuagcagaucuuucugcugcucuacauuaugcaggacucuaugagagcagcuacuggauucccucugggagccucauuuuggccuugagugaaauccaaacuuuacuagaaggauccuuucuuaacuuaccagggacccucuucuguuugaaccaggaaugcuccauuucuguuucauaaacauuuuuuuuuuaucauggcuguacaauauguaauguucgaaacaggaagagcagauuuuaaugauaggaaacuauccauuguuuuuauauuuucgacacauucagcuauaggagcucuauauguccuuaacauauaguguauucaguuaaacauaggaauuagaguuuugauuuuaaaaguaaaggaaaaacacaacaaagcaaaacaaaaauaaaacacccgggagcauuauucucauugugguuuauuuugacuugucuugaauuuuacacgcaaauauuuccuuuuuugccuugcaguuuccuuugaucuggcguuuaagggaaguuguagaucuuagcagguucuguuucuuuguuuuucucaguugagaacuauugcaucuuagaaaaaaaaaccaaaacuggugaacgagacuuuaaucaauucagacugucuauggaguacagaauguuugguguaugaauccagacuuauuucagggcuguaucucuuuaacgaguaauaaagugugcaaaauaaaacauaugcucaccccaaggccauaaagcaaagcaaaguucugggauuuaccagguuauuuucaucaguggagauggcuaagcuggauaagguagccccccaaggagaaguuugaccauccuaacuaauccauuuaccugcauggcaguuaaaucuccauuuggcuguguuaauuugagaguggaaugauaaauguccaucgcucuuugguguuugguuuguuuguuaucauuuagagacuguguauccuuuucuagaauaucaguguuucucucaaggcagaauguuuaggauuuaaaaaaaaaaucccauaauuaucagugcauccaaucaaauuuggacucauucaacuguucauaaaaguuuuaucuuccaaauggccugcucugcuaacuguaucaagcaggcagauuauggggagcuuuucauucuuugggucauccguaauuauagcaaacuugcagcuguggaaggcacagaucuacagcgaaugccccaagugaauggaagugugcagagaaaaggcagugucuuuucacuuucugauuuucuuugugcugagacucauucaaccuaggaccuagcaugucuuacuuuuauucaucccaugacuucagaucuuaacaaacauauuaugcauuuucaggcccuugaccuugcuugguuuuuauugaauggccaacgcagccuuuaggcugucaguauuuuuaaguugaucuauuccucuuucaucaucuuucaguuuacauaauaaauauugcacauagcuuuccucccguggauuuagauuuacauuuaauaauagcuagcguuuauuaagggcuucuucugugcugaugugucccuggguucuuuauguacauuaaucaacucaucuucauaaaaucccuugaaguagacacuaccauuauacccauuagaaggaaagaggaagcggguauagagggauuaaaguaccaugcccaugagagagaguuacauaacuagggucgaucggauguaagccaugagcggcaggccccagaagccuggccucaugacuccugcaguauacaacuuccucaaagggaaauugcauuuacgccauagagacaagagugggugggugggugagaaguccaacagcccaugagcuagucgauccccaugcugagucacuuucaaugugcagagucugugaucuccuugagauuaucugugaucuaguccaugccgaaugaugcugccguaucggcauuuacuaggcuuauaauugaaaucacuggagagaaaguuaaauguguugauuugucuucuuuuuaaucacugcaauucauuuucacugauucguuggcuacagaagcuaguuuugauggaguggguacaggacagauuuugccuuacucaaugaagacuacaauguuauuugcagauuaagggaugcuucaugcaugcauuugguuucuuucacagucuuuucacucacaggucuuuguuuuaagaauucauaaucugguagaaggucugagaguuguuuucuucaguugguauguccaugaauacuaauguuaaggggagucuacacucacccuucuguauucuccaagguuggagaauacaaauuaugacauuaccuucugccuauuugaaagcagagauagacuuggaggcagaaaacaaauacauuuuauuucuuuauucuuuauuuuuguacuggcaacauuaauuauauuuagaauauucagaauauuuuauuuuguaaaauuuuaauuuacucugcguacucuguguauuucuggguagugugcguguauggugugguguggugugguauguuuguguaugguuguauauguuuauguguguguaguguauauauguuugugugugguauaugcuauaugugguaugugggguguguguggugcauaugugugguguauacauguuuguguauguaguggcugguauaugugguauggugugugugugugugugcuaugugugguguggaguguuuguguguguguguguguguuugugugugauuuguguguugguauguguggugugggguguuugugugugcuuguguguaugugugugguguaguucagaggacaacuuucagaaguuuuuuucuugcuuuccacguuauucaggcagaucucuuuuguuguuucugccuccauacugugacuagacuagcugugcagaggggccagucuccugucucagucucccaucucaacacagagugcugggauugcagcuggauuuccucccaucuagcugcugauaggcucagacucagagcaucuggcuugugcugccuggguuuccagcugcgccaucucuccuuccccacauugcuuucuuuuauucuuuuucuuuuguucaucuauccuuucuguccuccucuuauagcucuuccuugaucuuuucucucuucugcucccccuccuucccucaggcucugacuuucuuccuuucuuugcucuuuccuuucuuauguuugcguucccuuuggggaugcuuccagguucugaggaaggccuuccccucauuucugaguuuauugagguuccuucuagcuccuuagccuuuacauuagcucugcucugaggcaucucuucagauaucagcuugucucuucccaguucccacacugccucuggaacucuuuucugucuuuucauuuuagguagggucuacuuuuguuguccuguaacugugaucucagcagaagcagcacguacuauacuguuuucauuaucuauuuucaucugaguuuucuaaaagcauuuuguggugugugcguguguguguuguaguauauguggugugugugugauguaugugugugugugguauauguguguuuguggauggugauauaugugugugugauguauauguggugugagugugugugugauauaguauaugugguauauauguggggugugugggugugagauguguguaugugggguguguuugugugagugagauaguauauguggugugugugugugcuauuuguguauguguguuugugauugauguguguguaugugugugugugagagagagguguaugugggguguaugcaugugauagagagauguuguauacguagugugugugcacauguguaugaguguguguauuugugugucugguguguaugugugauagagagagauguaguauauguagugugugugcacauguguaugagugugcgucucugugugucugguguauguguguuuguguguggugugguguguguuuguggcgggacaugagcauguaagcacaguuaccugaggacagcggagggcacagaaucuuacuggagcugagauaccugggagcagugcugggaacugaacucagguccuuuauaagaugggaugcuuucuuaaaugcugagccaucucuccagcgcaugugcgagauuuuguguuaaaucacagacauuugugaguucugaacuaucauuucuugcuaauuccuagcgcucagcugguaaaagugccccacaagcaagcucuuuggaagauauucuguucacucagauauuaaacucugcuuccucaagcccacuacucuucccuuccauuugcauuuuuccauguuuuuauuuucauugucaguucugaguauccaaugcaggguucgugcauauuaggcaagaacuucacacggagcauugucccuagccaauauuucuucuugcaaaacacaugcacucuauuuuuuuuuuuuuuuuugaaucuccauguagggcagucgugagaggcagacuggaugucaauguguccuaugaggagcacccugccuacaacauacucacauuuuuuccuuuccaguaaaguguuaacuuccggauuauuuuuaauauuucucucucucucucucucucucucucucucucucucucucucucucucucucuuucucucucucucucucucugugugugugugugugugugugugagagagagagagagagagagagagagaguguguugcauagccauguguggguuaugggucugcacagacgcgugcuagaagucaaucucauucuaccuuacauccuugugagacggccccucauugauccuggaguuuggcuaguggccugcagaaauccuacucucuuugucccucaaagcuuuggcuuuauaggaacagaggguuguuacaugaguucaugcuuagaugacagacacugugaccagcugagcaccaucuccucagcuuggcacccaguuucuuauugggauuagggugaugacuuaccagucuucuggcauucuagugaccaggugcucagaggaaacccaguuacaccaagugaaauaaacgacaauagaaaauuuaaguaaaccauuugugaagaaucagcauuacuuuuuuuuuuuuaauugcccucccccccccccccggguuauuuuaaauuuugacaaucacucucauuuaguuggcuccuuuaaauccaaaugagaagaggauucacaggaguuaucguggugacacugauaagaacaggcugcaggaauaagccauguagagagagaaggcugccacauaauuagauuugccacugaaaauuuuaagcacuucuucgcugucagaagcgcacgcgccccugcagcacacucggcuggcuuucgggagugugacccugaagcucugcacaugcagaagcgauccuuauguauauuaacagguuaaauuugggcauaguuaucuuuagccuuggccaucccuuauagaugucuucaagaaaugggaaagaccauuauuucacagugaucuucauucaguaaccuagcuuuuuauuuggaagguuuuaccuuuuugacuaucagcccauaaccucaaguccucucaaauuagcacccuccuacuuugcucuguugucaucaauuauaguacuugaaaaggaaccacaucugagggagaguuugugugcgguucaaacaacuccuuuuucuaauguguugaaaauguguaauuguacuaaagugucacuuuaagaauucggaggcuuuaaaacauuuucccuugacauaguccuuuagauauuauuuuauucaguuuuaaugcauauuaccagggggaaacgaaugaauucauacaguccaugaggaaacaaucuuugaauguuuuucaauucucuugugaaauguuucuuuuaaacaacacacaauaaauuaugaagaaaacccauggaaaauacuguguggaaggaauaaauucauuuuaagcugcuaaauuugaaaauugggauuaaaaccuaacaaucccauuauuguuaacagagaacuuaaguuaaagaucugcuuuuguuuauuuguuuuguuuuguguuguguugccuuuuugaauuuuguuuguuuagguauugcuguuguuggcucucugugugugugugugucuguguguuacuuggccugguuuuucuguguagcuuuaacuagucuuuggaaggcuauaagcucauguucuuuuguaugaaaggcacaguuaagggcucuuuugaaggucaaagccaugcuagaauugcugaguucuuaugguuccuuauuccaggugacucagagaaaacuuacuguuuguccccagucacauucauucuuucagcccaaaugcagggagcccuuacauacuucaaauauuaguaacacguucuucuugccaucuagaaagagcauaaauagaucauuagccuaguaacagcaaguggaaccuuucaguuaugcuaagcguacuguuugaacaaaauguguugaauuugccacugaugucaccaguuuccaucaauuuggucuauucaucauguuggcaggagaaauuuacuggaugggucauuuuauuaaauaguauuuuauucuugugacauugcucugcagugugcugacuaauauacuuuaugagcacguguagcucuuuagacuuuauuuaauuauugaguugaugaaauuuaagaaaacauuuagguuaaaugaaaccuaggucgcuuucacuguucaaucucaguagcuacaugugacccaugccuuucaauggcagagagaauaaucaacaaaauuuuuauugcuuuggaaaaucccauuggaugugauagcuuuaaaguucucauuugaugcuuacaauaaucuaauuaaauggcaaaauuguacaacguuauuuauauucauagagggggggaaugauucucagguuucuauuuggucacagauuugcuauggagaauaucuaggagcagauaaaugcaugacaaugugacugcaguugaaaaaaagcguuuuucauacagaauuuuucaccuuaaacauccuuaagacaaagagguggucuaguucgugcuccuuauauuauaauuucccuuccagagcccagcacaagccacauagcagcacuaaagagcuagaggaauacauguuagguccaaaaugaacauacagcuguaugauuuuaauuugugaauaucuacauagaaaauuucuguguuaauucauuguaauuucaaguguugguuacuaaaggaagaaaaucaguauggucugcuucuucuauuuuuuuuuuuuuaguauaauuauaacuugaaauguuuuuccaauuauuguuggauucuaaacuuuaggaaguuuggaguaacuauguguaaaagcugccuccugacaauaggcuuuauaaauuguggcugauugugcuuaaacuuuuuuugcuguguauuuuuauuuaacuaagauaggaggagaucaaaacuaccacguguagguacuaaaaauaaaaccagugugggcaguagacagggauagugucuccuaauaaauuguguuuuauuuuuuuuagaggcggccaaaaaaugaauaucagauauguauuacugugacuuaagcaaaugugcuacuguaagaagaaucccguuaauagagucuaggucuucuuuuugagagaaaaauuaagcagaauauuaaaaacuuguauuucccuccauaguauuuuaauaauaugugauucccaagcccuuccauacugcauagcagcaugauuuacagacacuggucaauaaagcaauuuuguaaucuauagaaagaucaaaagcaaugcucuuuaccuugaacuaagauuugugaauuuuaguuguuguuugugcuguaugcgaaagagcuaaauaguggaacauuggggauguauucuuaccauaauuguggaauuuaguaguuguucaaagugugcugaauagaggaguugacagauccacuuccacaggugaagacauacaucucauacacacugucaacaccaaguccaacgaccuacugcagucugcagguuuacuacauuucaaucaaaacacuucccugauaauuacuccuaaacuuuucuccagucaugguuaggaacaacucaaaagcgauaggaugaugcccagaaauaguauuuuacuugaaaaucguauguguagggauuuccuaagaacacauguccuaauuguacaacuacuuugguguggcugggcuuaugggccuuaaagauugcaaaaucaaacauagugauggucugugguaguuucucaggaaucucacuuguuuaagcagaagucugcagccuuuuacguuaaagaggucagcauaugaagcaauguaguagcuaaaacaacaaaauuauucaucuauagacuuuuguacuuacuucguuuaucauuauuauaagacaguauuucuguauuuaccacauuggucugugcuuacguccccaaagugauugauaaugacaucccacuaaauguuuguuccuuugaaaauaagguuucuucucaauucuagugaauugggaaguccauguagaaguuuuguaauagaaucuguuuugugcaacuuucagcucuuuuugaucaguguaaggaugcucuaggugguuuuugucuaggauuugacuuuggcucuuucaaguuguugacucucagauuucuggcaggcacaguucuccguucuccaguauuagcucucaugguucagagauccugucuuuugauagauuaauaacuaugugcuugauauauauauauauguauauauauauauauauauguauauauauauauacacacacgcauauauauauauauauauauacauacacauaaguguguguguguguauauguguguguguguaugugcaugagugaguguaugugaucaucaucuuuuaaguaagaccgugaagacaaucaaauuauuaucuuaauauccauucaguaacacgcuguuuagguguuaguguugauuuccuagaacuauaauacuggacacaaauuuagaaccuaccaccauuaaggaagcuguuggccagagacuuuaaguaacuugacuaagauucugccuuuuuaggaagcaaauaaaagcuuccauuuucguuccauauaguagagaaacaaccauuccggaaugcacuacagaauagaauuugcauuuuaaguagaacauucaaaugauuuugaguagcugaaacuuuucucauggaaugauuuggaaaugagcagcgaucacacaugucauuuuugagcagcuguugaagaaggcagaacgcaauuuugccacuugcuucauacauuacaucugggugcuggaaaaauaagagaucacugauguuugaaggaagugcuuuccuuuauauuccuuccuuccucucuauauuuuauuuuuucaagauuuuuauauuuuucaagauucagucaguaauucaauuuucaaaccaugaguuuggcucaguaugauucuagacugagauauuuauucagaucuggacauuucuuauaaaggaccuuugaaggccuacauaucaccaauaaaauuucccuuucuuuauuuuucuuuauucaagauaaagucugccuauuuagccuaaggcagucuugagcucugucuuccucccucugucuuccgaguguuguauuauauucuauaacauguuuuacuaugcaacuaaauuuuaucaaagacaguagaauugcagaguuuuucauggaacuuugccuuauuuuaacauuugaacauucuggaggaaauaguggcuacgguuauuaaaguccugauggguuuaucucuauucuuugccagagaaauguuugaaauucccaguauucuugcccacuccauuuuaauuugguuucacucugcauaguuaagcuucuguuagaagcccuaugugcaaucauuuuaggaccuacguuuugucuaaaacagagaacugcucuuugcuuuccuccucaaugcuauaggacugaauguugcauuuucuuggagaaucucuucaaugagugagcucagagccauugccguugguuuuuauagaaacccuuagguuuucaaauggaaaccccuuguuauccggguguuucugcagucauguagaacagccccacucaguuggcaaaagauuucuuaaaauauaaauuauuuaguucuaugaauuguuuauaauaaguacuuuuauuacauauauuccuccuuuguccuaaaauaaaauauccaaguaaccuuuaguaaaaaguauggacugucccccaccccccguaguucaagugguuuccuaagaugcaggaaaaguacugucauuuuauaaaaguguucaauacuugaaaauaacccucucuuccagagaagugacuaaauucaugacacgucuaaaguaacuuccaucucuccuacacugcaggucacuucaggaggaacuuucauuggcauuggacggaaaacuccagauugccaaggcaacaccaaguauuuccgcugcaaauucugcaauuucacuuauaugggaaacuccucaacugaacuagagcaacauuuucuucagacgcacccgaauaaaaucaaagugucucucccguccuccgagggugugaaaccuucagagaaaaacucuaacaaauccaucccugcgcuucgagccagugacucuggggaugugggaaaguggcaggacaaaaugacagucaaagcuggagaugacaccccugucggcuacucagugcccaucaagccccucgauuccucacgacaaaaugguacagaggccaccaguuauuacugguguaaauuuuguaguuucagcugugagucauccagcucccuuaagcugcuagaacauuauggcaagcagcacggagcagugcagucgggcggccuuaauccagaguugaaugacaagcuucccaggggcucugucauuaaucagaaugaucuagccaaaaguguagaaggagagccauugaccaagccagaaaagggcuugaguggggcuaaaaagaaggacuuccccagcaagggagcagaggauaauaugguaacgagcuauaacugucaguucugugacuuuagauauuccaaaagccauggcccugaugugauuguaguggguccacuucuccgucauuaucagcaacuccauaacauccacaaguguaccauuaagcacuguccauucugucccagaggccuuugcagcccagaaaagcaccuuggagagauuacuuauccguuugcuuguagaaaaaguaauuguucccacugugcacuguugcuguugcacuugucuccugggguggccggaaguucgagagucaaacaccaaugccaccaguguuccuucucuacccccgauguagaugugcuccucuuucacuaugagaccgugcaugagucccaagcaucggaugucaaacaggaggccaaccaccugcuaggaucugacgggcagcaggcugucagggacagcaaggagcacucgugcaccaaaugcgauuuuauaacccagguggaagaagagaucucgagacacuacagguaaggguucuggggaccaaaauaccaggggagucagagaacccagagggaggagucaggaaugggugagguggcacauguguggcucgacauauuagggcagucccauagaaggucuucuguagaacugcaauaaguuguuugauggguugucuucagacuguaauuuccucauuuguuuucagguuuccuaagugucuucuuagcacucucagagagcguuguccaauucucagcgauaugaaugaugagguugcuaacucagcacagcuagugugacucugcaucccauaauuauugaagggucagcucccaaauuaaagguucuacuagaauauauguugcguuccgggaaauaacagucagucugagcauaugcugcccauuucucuguuugaaugagacugguucuuccuuucaguguucauacuugagcaucauucuugauugacauacaaacaaaauguugagcugagauuuuggaaugcacauggauuugauugugcugucacucugggggcagauaaaacggguuauuuaaaauuaauuaacacagacaaaaaacacacaccacauggaaacauacacacacacacacacacacacacacacacacauacacuuuuacuccuuacuucuccugauauauuauuuucccuagcuuacuguucauaccuucuuacuuucuagagaugaguuuacauuaaacacucauauauauauauauauauauauauauauauauauauauaugcuucuuaauuucacagcugcacacuuuagcaggaauugaauguacaggaguaaauaagauaggcacaguuaguauccauuuggaacugacaauuaaaggagaggaaaaggcacccacauaucaucaggaguagggagugcuacaaaaaucaaaggaaccaaagacuacacuugagauggaaauaguaagaccacaucuuaucacuggcaagucaggagaugccaucccaaggaaagugguuuaaacugagaccuguuuauaaucugggauuauuaugcacaagccuugaugauucaaguugugcagagauaagcacuuauuguuacucugccucucagcaccaaaguaaaaaguguauuuacuuucuucuauuauuuuuauuuuuugagauggucaaaauuuaaaauaaauuuuguagcuccagcuugaguauaaaucucuguauaacccagguugaccuuaaauuccuggcaauacuccugccucaggguuucccacacauugaggugagaggaugagcuguaguauggagcuuuaacuugcuauuugaaaugcuuuucaauauauagguucaauaaccuagauuuaaaaaaaucugcuuaguucaguuuuguguguauaucuucucaguuaacaguaaugaaggagucgugcccaacaauaggcuaagaauguuagauguuaauuugaagggcauccuaauguucacagugacucaaaauguucagaaaacacuuacuugagauuuacacuguuuaauuuauaaggucagcucuaggaaagacacagugcugcaaucaaauauguguucacacuugcaaugaguguuucugucuccucugauguuagcugcaugcuaauuucuuucuggacuagcaagcaccagcuuuucuucaacucuuaguaguauggaugcacaaauaugggugaguuugugcauauuguucauauauaguugugaaugcuccaaaauucuuauuucuuuagucaugaggaaaauggaauaaguacacaaauaugcacauauauauuaugugugugccugugugugugugugcaccuauauauguguggaugaguaugaucuucuuaaacacaaagacagugcugacugguaaccauaugauuuuucuccaggagucuaagccacuacuuaaagcuuugucugaaauaagcaggauauuuauguucuuuagauaaaggaaauaaucuuggggaaaugaauaauaugaauaaaggagaugucuucauaaugucuggauuuuauuuaauucuuaguauugaaaguagccucuaccaggacaauacuaaucuauccuugccacgcacuguagcugcaaaguuuaacacaugagcaugcauagaucuuggcaaaugucuuuaugcaaauggaauucuuaggagcauuugccugcaaaauaguuuuaaauacugacagcuccaaggugaguuacauuuuaaucuuucauuacauaguuuuagagccuuuugaggaacuaagguauacgccaaagacaauaguaguauguuggcuuucagucucagucaggcucccaacauuuuaguagcuaagaaauuaaauagaauguguccuuagggcauagaguacuuuaauaauacucacuuuuaaauacugacauacuuucguugaucuuuuagauuuuugguuauucaucuaaaaucugagacucuuuauagaauuauuugaaauugcgaaccuuaugaguucaagagucauaauucacgacuaggagguaucaggaaaccuuaauaaaucucaaucacauuggaagccuuaaggauguaaaaugaaauagucaagcaggugauuaaaauucagucugcuauacaaguauuuuuuuuucaaugcaauguuuuaaaaauagaauaagaggucagcuuaccuuaucucaaaucuaucuuugcugauuauucuuuauuuauaauagcccucuuagaguaugucuacuaucauuauauguuaauguuauagaacauucugggcuuuaagugcucuauguacaagagugagaguauagcaagaaucaggauaagucucuaaacguacaaaaaugugugaaaucauugccauccaaaacagaguugauguggaacucagagaaaucucaguguggaauccaugagaucugggcuguuuugaguggggcugaaagguuauccacucaguaccuggaaaugggucauuuagcauccuuucacaguguuaguacauccccuaauucaccuuguagcugccauuauuuuucaugcauggaucuauuucuuuugcuucaugucuucucuuaauuuauuacucaauagacagugcaucuauuuucuguugguuaccauuuuaucaaaaugaauaguguuauaauguugcagaccuaagaaggacaaaagucuucuuaaaauacaacuguaagcaagaguuuuaguuaaaacauacuuuaaaugcauugccagacuuccccaaauuaaggggacuuuccaaagcuuacccuucacuucacuaagaacgagauaaaccaucgugagggagaagugaaaaguaaguguggcaugugagguugcgcagaggacaaaugccaguaugucugcaggacgcggucaagacuaaggcguaggcucaucggaaaaagaagcugaauucaugaguucugcccuaaugcugcugcucauuauaugaguucuacgucagugcuucacugagugcuaucagaaauaaacaugaauuuguucauagaaaaguacucaauuuuuuacuugcaaagcaguccuggguuaagguaaguuuuauaugugugcacuguuacaaaguuugcuuuguagauggagagcccgauacaccguauuugaaaaagguagaaagcagaaaugauagauucugauaccuaggaacuuuagauacaggaauuuucagugauaaugucauaauugccaugggauugaagaaguaaaauuacuauuuaaaauuaaucaagcaaugcaaaacuuuacugagggaagccaacgaacagauaccauaaugaauuaaaaagcauaauuguugaaaauuggauaaaccaaauaggauaauugacagauuagguaauaauaaagagccuaugaggaaaucacaaugagacacuagaacaguauuuuuaaauaaauauucauuucuuuaaauauuuaauuaauuuaauuaucucauuugucuggguguuuugucugcauguuugucuaugcaccacuuguuugcuugaugacucagagaccagaaaaggguguugaauuuccugggucuggaguugccaacagcugggagacaccauguggaugcuagcaauaggaccauggucuucuaaaagagcagccagugcucuuaauugcuggacuaucucuccaggcccagagagaaagguuugaagagauagcaaggcaguugaaaauauaaaaccagauaauaaauacuauaugggaauagaaugaaaucuuuacauaagcacaacuaauuagaaccuuagaaggaaaaauagagaaugguaugguuuguauuugaggagacaguaacaaacacuauuuuccaggacucauugauauagaaugcauggauacaaagauggcauaaaccacacuaaggaaaauauauacaaauaaacguacccauaaguauauuauugcaaaauccaaagucaugaucuuuaagacgagcuucagacaaacaggaaaugagguacuuagaaaggagaaguuaucugacaugcucucauuagcaaagcugggaaccggaagcaggaggaauauuggcaaaagaaaccaaccuaguuuugcuugccaccuccccagacaaucucuaaggauauaagaauaaagagagguucagauaagaccuggaaaacagcucuaucauagguaccggucauugugauauuuaugaauaauuuuaagauggucauucuauauauuuuaguuugaaauaauuaacacuggaugcucagaguagugaggcuaaggcuuaauauuaucuuaaaaggugccaauggaaaauggauaauguguuugauuguacuaaaaaauagauauuuaugaucaguacuuaauuaucaggaaaucugaaaaugccaagucuccugaacaucaguucaguuucuaaauuaguaaaaccaugguaauuauagugagaugaguguugguuuuauauauuuuuaaauagucccuaauaaauuaaugccuggaauacuuagaugcagacaucacuuuaacuucaaaacugccacugugaaacagaaaaauacuaaggauauuacacaccauggagaaaauaauguguaacauuuuuuauuuuuauuuguaaacauuaauuaugaaaaauuccagaaaugcccugaauguaugcagcauaguuaucugggacagggcauguugcucagugugagaguacaagggaaguacaaggcuauagguuuagucuuuaguucagcaaaacagauaugcaaauagacauaagagaaaaagaaaauagcuagccuuuuuugagacaggguuucucuguauagcccuagcuauccuagaacucacucuguagaccaggcuggccuugaacucagacagauagacagacagacagaaagacagacagacacuggggaugucuuauaacacugacacaccuccuuugacaaggucacaccuccuaauccuucccaaacaguuccaccaacuguagaccaaauauucaaacaaaugagccuauggaggccauuuucacucaaaucacucuaccauuagaguuuugucaaauauauagugguuuuuuggcuugauuuuuuuuuucuggaaacauuccugauccuguuaugaauuaugaaaaucaaaagauccccaagcacugaaugaauuaaugguauuuugaggauaaaagcuaacugcauguugcaaucucagagggacacugaauaaauaauuuuauaucaugugaaaauucuaugaaaaacuauaaaacuuuuucuuuucacagcaauucaaaguugcuuaaauugaaguacaaauuacuuuucuauagauagauuauuccuguuuuguuuuguuuuuuuucuggaaagaaaugaugauuuagauguucauacuuuggaaugacaucacauuuguuauuguccucauucucuuuucuaucccaagauauuuuguagucccccccuuuauuguuucauuuugucaguaauuuuacuuauuuuaaaucauugcaaaauguuuaugcuucugcauagugaaaagcagaguuuuaaucugggaguuagaaauccugugacauuagcuguguguagacuaaauggguaaggcacuauuucucuaccuuauuguccaucaauaaacccuggacuugagagccuuguuuuuuaguguuucauuaucagacacaccucauaacaagauacauuuaucuauccagaaacuaugauguagccuccccuguauguuuaaacuguguuuaucauguuccucucucccugguggucuucuuaggcuugaaauguaccaucaccaccaccaccaaugcauuagguggcccuuuggauuggccaaacuguuuccucuuuguuauuucugucuacagugauuucuuccuuauccaaaacuugccaaaacaugcucuauuguccuuugauugcugguuuuaugucagcuugacauaaaguauagucaucugacaggaaggaaucucaacuugggaaaaugacuccuuaagaucaagcugagggcaaaccuguaggacaauuagugauuucguuugagaguccagccauugcggaugaggacccaccccuuauuugucguccaguguucuagaagaaagcaagcugagcuagacaugaggaauaauccaguaagcaucacccuuccauggccucugcaucagcuccugccuccaggguuccacuuuguuugaguuccuccccugacuucccugaugaugaguggugauaaugaaauauaagcuagauaacccuuuccucccuaaguugcuuuggucaugguguuucaucacagcaguaguaagccuacuuagggcacuucuucuggaaaggacagcuccuucuuggccuuucccucagaaagguccuucacuuuccuaagcaacccucauacuaucucuuucacgucauucuuuccacacaucauucuuguaccuacauauuuauguauagugaagcuugcccuccugacuagccuggaagugccaaggaagcaaggacugugaguuccuauuuuaccuggauguagccaggggcaggcaaagugauauauugaugauuaucuacaauuggacuaacuucaaaugauaucucauagaacuuacuguguauuuuuguuguuguugcuauuuuuguugacauaugaaguaaguaaaaagugcuuuguaagauauuugaagaguuaagucaggcuuuuuaaucaaaggaaaaaaaugcuuuauugaaaaaaguugugugcuuucucagaauuuuuuuuacacuuuaauacauuuuugaaucaaacauuugucuuaauauaguuguuuucucuuuaacaauggagguguuauaaaaucuagcaaugagaucucuuuguuuuaugacuguuaaaaagaaagcacacacaugaacacauaugcacauauguaggauccuuuaacagauauaccuguacagcaauuuacaugcuuuuugauacccagcagacauuuaguuugcucaguuuuuauaucuguugacagauccugcaauucuuuuagaaaauucuugugucaacacauuuuaccuuguagauuauauagaucagauagccuuauuucacugacuaaauggauucaaguauaugcuagaagguaauauuuaaucacagaauauuuuaacauauuggaaagguauaaaaaggaacucaguguuaaaaaugucaauguauuuauaaugagacagugccuuaguuuagguuagauaaacaaaaguggaaaggccauugguuaaaucaugaguagugacuuaaguaauuuagaacugaugauuaucaauaaagauaaaaugaacaucaggugauaaugagacuaaaugcccaguucuaaugguaauuaacugcaucaucugucucucuguguguguguguguguguguguguguguguguguguguguguguguguguguguuuguacuaaagaaaacuucacauucuuauacgggacugaaaaugccuguuaauuuaauuuuaauuuccgaguguugacaauauugcauuucuuucaacuucuaccucauugcaugagagaagucaggugcaugaggacuauuugagcacagagcauuccuuucaaaauucugacuucccauugacucuuuucuuccuuccaggagagcacacagcugcuauaaaugucgucagugcaguuucacagcugcugacacucagucacuauuggagcacuucaacacaguucacugccaggaacaggaaaucacuacugcuaauggcgaagaggguggccaugccauacccaccaucaaagaagagcccaaaauugaccucaaggucuacagucugcuaaacccagacucuaaaaugggagaaacaguucccgagagcauagucaagagagagaaacuugaugacaaggaagggcugaaagauaaaaucuggacugagaguucaacugaugaccuucgugguguggcuuggagaggggcagacauccuacgggguaguccauccuacacucaagcaagcuuaggggucuugacgccuguguccagcucccaagagcagacaaagacucugagggacagccccaauguugaagcugcccaccuggcacgaccuauguauggcuuggcaguagauaccaagggcuuccugcaaggggcuccugcuggcagcgagaagucugcaucucuuacccagcaguauccugccuccggagagagcaagaccaaggaugaaucccagucgcuguuacggguaggaagguuuccuuauuuaaaauaauuaauuccaaacauauauuuuguaaacuuagccuaauguauuguguggugaaauuaaauaaucuguauugaugcagugauauuuuguauguaugaaggccaaaggagcagaaaguagcucuuaggggcuugugcaguucacauaugcaguccaagguaggcaacuaccuauuugucuuugcucucagcugugaugaaggcuuguuaaucaaucuuggugaucaugcaaagcaacaaagcugccuuuggagcagggagcuuucugaucccauagggaugcucagcuguauucgaauaaugaucugacugcuaaacuuuaaggugcuaugacacaguacauaguugauaagggagguuagcagagauuaaaacaguaagaauggaaacuccugggcgagaugcuaauucggaaagcagcauuucuuaacacacacacacacacacacacacacacacaccagugccuguaguucaguugucagaaagaaugaaaaagaugaacaaaaucuaaaaaugaauggugcacuuacugcccagacaugagcuccuuauuuuuaauacucucagggucuuguagggauggaagaaacuggggugcggguagcaagggaaugagagugcaucuacaauuaaucuucacuaguguguuccugcgauguagacccagugcuccggaaacuuacuguaucuuuugaaacuucuugagcucccacaugcuguuuagguauuucccucaaggcagagagcauccuucagcauuuuaccucagugcugagaaaguuuaguaacugcugcaugguuuugaaacuaugucccugcacagaagguaggaucagaaacuagcucacuuuacaaaaacaccuguuuaggaaauggagcccacucugcuggggcuuugaccucuaggucagagaagaacccucuuggcugugaaucagcucgacugcucuguucucacuucagauucucugaagccuuccugagugucucaggugucuguggaguagagcuaaagaaugucccuuggaggugacacagauaguuaugaaagucauuacuuuuuucugccugauguuaaguccuagaauuaagccuugaauauagaagaggggaguaccuuguaccaucaagaaaugaagccguuuucuugucaucugacaggagcagaugcucuccaaguaacuuuggaaagaaagaaagcaguccuguauccucaaggaacaugcucaccucaggccacucccauuguagaaccguagguagaugagccuguaugauguacaguauagcuuuuuuuaauuacaucaugacuuuuggggggucucagaggccuucuauaguuucuauuuaagagggaggaugguguuaugugguauugguguccauugacacuuaacaauaaauaguguacacuuggguggucuccuucagaucaccugagccuccuccuggcuuccuuuuccacaucacugacauuuccgcuuggcuccgaguuguucuaauuuuuuuuuuuuuaacuauuuccagugugucacccuuccugccuccuuccaaggacuuggaaugauaaguaguugauuaagcagcagacugaaagcccuagcaguguugcgaucaggccaaggaggauaaaacuucgcaaaacaacuccuccuucucaguuccuuuacuucccguaaauucccugacugcaaguuucuauugcaccauuucaacugcccuuucacuuccucugcauuaucugccaacguaggagaaccucagcacaacuaagucuuuaaugaaugccucaaugccuuaucuucugauuuagaaguuuuaaagucggccauuuacuucauuucagagaauaggugcgcacacaccuuuuacaagacaggcucaugcuucugcgauguuaaucaaaugugaaucuuuaagaguuauacuuuguguuauaaugauucuuggggggggggaaucucuaauucuguuaaauauuuggaauggaaagagugggucagcuugguucauugugcaaucuuuggcuugauuucuuaacugaauuucaaauuuuugaucuguaauaucuucacgagcuuugaaagaaaccuggucacagugacaagcggagaaaauuuugguugagaaacugaggagauuuguauucuuggugguggaguaggggaugcuuuauugccauagcaaauacacuguccguccauucuggaaggaagugcccugcagagcaucauggccacguuuacuaaaggcagaaauaaugcaguucuuuguauaaaaccacaaacuaguaucaugcuuauaagugcacaguagaaguauagaacugaugggagugagaugccguguucuaccuauggcauagggaagaacauuaacuuuggaguuucugaagcagaguggauggaaccugggaagugagcuucucuccagccuguguguuuacuuagaguaaccauaguaacauacuuaggccauggaaguccuuuuucuuuuucuuuuuuucauuaguuugaucaguacagcagcaugcagcauaguaagcuaguaaaugcuuuuauagaaauugcuauugccgagagggaaaaaaaaaaaaaaaaaaaaaaaaaacaaagacaaacuuuaaaucauucuggcaagauguacagacugguagaaaaagucaagugcagaaagguuguccuagauuuuaggaucuagaauguguuggcuuaaaguacuucaggacuguuaggagaugaaaacauuuucgaugacuaggccagauguauuuaggcuucuuuaauaaagcaugcgacuguaaugcugcuuucaggauauucguucucugaggacacauuuuauuuuauuuuaauuaauuaauuuauuuuugacugggucugcugguaaaguuugcucucuuccuacaaguacagaaggaagcaguccagaggcgccuccuguucauauuucuuucaacagcaccagccacuauuuccuggucauguauuugcuuguuuuuauuuuuucccuuuuguugugucugcgucuagagcagugcucgcccuuuuuuggggggcucucaggccauuugcuuauguguguucucauuuagugaaugcccuucuguuucugcuuuguuaugaaugguaaagacauguaaagagcucuaaauuauuuaugccaccugugcggaucgcugagcucagauggugacaaaggauacauuggcuuaaguuuucccuuguaaaucacuuuugaaaaagucagacuuuuuauugcaaucaguaugacuuauaaugucuuugaguauuuugugaguuugaaggaauaguagagauuuuugguuaaguaaaacguuggcuauauuuuugauaaaagguguuacaauugucuacaguuauaugcaguuugauuuuuaaauggaguggucagcaaaguuuaguaaauacaaaaccaguguuuuuacuuucauuucaauuuggccucaugaagaacuuauaaauauucaacauuaccuaugccaaauugggauaaucaauuaguuacauguuuuaaaauccuuuuucccucuauauuuaagugguggauuaugaaguugauuggcccaugcacaacuuuacaccugcuuaucugagcacuguaucuauguauuuacuuuuaggaaaacaaauaacaaauauuguauugaucuuuuuuuaauuccuguuuuauccuucuggauuuuauucauacacuagaauuuuuuaaaguuauuuuugugacacagaaaucguucaacagaaaagcaaacaaauagggagagagaaaaaaauugcaccuuaaacaucacaacgauuuggucaguaacaaauggaguuuuaacugaauguagcaaaggcccaaccagaggaauuugaaugaaugagacuuuaagaggaagcagggcaugucaccagccagacuccagccaaucauuuguggagagacaguguccugguugcauuuguagacacaaauucuuccuuagguuugagcauucaagcuauuaggaacuuccuucagcccagaaggggaaacugagccacaguggcauugauuugggguuuguugcuucaacauccuuaucaaaguguugguuuuaacaucuacacccugcaccacuuuggcauuuuaguggagacuuuuagaugugggccucugggcguugaguuccguggcaggccacuaccuguucaaggcgagccugcaggaaauccaaacaucuaucucugacccaggaucugcuugcugccuucuuugcagcacugcuguguggcuuaguuaauuaauguuugucagcucauucgagguccucagauucagagugccugauaagcaaaaguagccugauuacucgcucaucuuguaaaugugauacugaggcaguacaaagcagaccuucuuucucuuuuucuuuagcaguguuaaauuuauagccuagaggcugcugauaccggaguccuuucagaugcaaaaauguucuuuuggaagcagccaugcaaacaagcccccaugaugaauaccuuaacaacaacugacacaagaccucaggaaccuuuuuaaaacuaaagaugaucucaagugaaaagagauauuuauuguugugcuucauauuuaaugaaaaccccaccaucauagaggaaauacugacuuacugucuauguaaauaaccauuucccucagcaucuuugaaucuuuuaaacauguauagucucacaggaacaggugagcuucugucagaagcacauuaauauauuacuuuccuauuggaaaaauaaaacauaauccuuacuauuuauucuauccagauauuguauaauuauuguauaauuaucugccuguauuuuguauugaugccuuuuauggggggagaaagggcugacaacucuuagaaaaauuuaugauauaaacucaaauuuaguuugauauuuucaaaaaucaagccuagaaauugaauuuagugcaaguaauagcaggccuggccacuuuaauuuuauuuacuaagguagcuuuuuuucuucuuacuagucauuaauaauuugcagcgaaauauaauuuuuugauggauauaaaggaauggaauuacacauaaacaagguuggauuuauuaguuuuacuauugaggauucuaguaaccugauuuuauuuuauuuagcuccauaggcugaaauacguuuuuuuuuuuuuuuuuuuuuuuuuuuuuuaaaguauuuucucacaccgaaaacaugcuugguuguaaacuagacuguaaagucuggcguggauuccuagaccaggggaagcagagauaucuucauucacuguagucgauaugaagcaguuucauuuacuucaguauuuguaauuuccuguaugacuacccuuugcuuggcucccucauucuccucaaauccugccgcugacugucugaggcaguagauaccaggaguuccaaagggaaccauuguugaguuuguuuaggugugagagggggaagaauauacaggugacccacauuuuaggcauacagagaggugcacagcgauucggaagugugucagccauagacauauccugaugugaaucgagcuuauccagccuuuucuucccccaguaacuaaucuaguggguagacuuuacauuaaauaccauacuggauuuugcuacuguuuucaccaaaaaaaaaaaaguaaaacauuuucuucuucaguauuuuuucuccucuguguuuaagagcuuaaagguuguuaagcgaagccgguucugugaucgggcuuucaguuacucagcgaagcuuggcaagccacgguuccuaccuugggaugugcuauuuaggaugagguauuuuccagggacucuuuagucaccuccuuccuuccuuugggagaaacaaugacauuauagaugccgauuucuaacgguaacuuugcagagaaauucuauaacauuuuguuuuauaguauauucugucuuuguuaccaaugcugagaagugagaaaaaggcaucuuaaaucuguuuuuauaauuauagaacaaauaaacuaaauugaguguuugauauucuuguccaaguugggguagaaaaugccucuuaaauauaauauaacaugucaacuuaccucuuuuuuuaguuuuuuuaaaauuuaacuuaggcauauuaauuggcaaggguaaauauggacauuuacuuaauuguacuuucaagguuaaccagagaauauuaaacaaacacguuuuugaaauaaaauauacuuaauuuuccuacauuuagaaaguuguagauacugauuauuucucaagacuugauggguguggggauaccagaaauguguuuuuacucuggguuuuugguagcgucaguaauuuauguggagaaaucauaaauuccaugacaauaugauauagugaauugcauucaucuguaauguuacauuucauuuaaguuuuugcauucaagaauuauucuugacuaugcuuuaaaaaaaaaaaaaggucuugguagauaaaugacccguaaaauaaucucuucucagagaauuaacuucaugaacuuagcuuauaauccaauauaucaugagagcagcucuguagcugucuaauuggaauucucacugaagaagacaaaaacugcaauacuacuucaggaaaaaaaaaaccacacucaggaaggcauuaaaaaugaaggaacuguuaaaacauaggcagcuauuuauaauuaaugacuaagcaauugaaacuuuaacauuucaauuucuauuaccuuuuggguaauuuauuagggcauuaaugccaucauauuaauuaauccaaaauccuugaaguucaaauuauuucuguuucuuuuauuuagaugaggaaaugaaggcagugguuuuacuuagguugccagaagucauacugcaugucaaggcagaggugacaugcugccuuggcugucagauuagagucccugcguagccucuccugccuaacuuugauugcuaauaagugcuugggggacuacacucacuuucagggugaguuugcucuucugcacacccagcaacuuauguguauaugaauaauauugaaaaucagaguucugaaguuuugaaagugacacaugucuguuacaaagagaacuguacagaaaaugaaaaccaugacgguacuccaauggacuccagugcacaauuuucuguucauauuuuggcgucagauauaucuuuuagauacacucacauauuuauuuuauugaaacauaggacuauguacccuaucaugcaauaguuugcuuuuaaauuuaacaaugugauguggaaguuuuuacuuguucauaaaggcaugucacaauauuuguuuuaaggccuuauuauuauagcuaccuacaucauaugcuuaaugaauuuacugaugaacguuuagacuauuuccaguuuuacuuauaaagaauacuuaaaagcuaggccucaacauucauaucaguaacaccagcacucaaaauguuggggcagauuaauuccuauggagcucaaggacagcuugaucuacacaguaaguuccaggcuagccuaggcuacaaaguggugagauucugucucaaaaacuaacuaacccaucacaaaaacaaaacaaucauauaaaaggaugcauaauuccccuguaucuaucacuuuucauuucuaugauauaguuuuuauauaauucauaaguuguaugagaaaauaugucuaauaccuaauauuauuuugcucacuguuuuuuaaaauggucccuuuucauacagaaauuccagucauaauaagcauggagaauaauaugcaguaaauccuuagggauaggcugcugacuuauaaauggcguauuaaggaagauaaaaagaauagagagaacaacauaauuucagauauaaacuucuuaaugucuuuaugaauauacacacaucuacuaccuagguuuaucuucaguauaguuuauagcuuaguuauuagacauguuuaguuuuaaucuuagucaaaauuuauaugugucauucagguagaaacagucccuguagauuagcuuaucuuuuugugugugugugugggggggguauagcuuuucucucucucucucucucuuucucucucucucucucucucucucucucucucucucucucucucucucuuucucucucucucucucuuauguaauuuuuuugagucauauuuugagucaaagguagucaauaagucuggcuaccuuuucccaauuuuggugaaucuuguuuuccuuagauacaguucgaguguaucuauggacaacugugugggcuggaaggcauaagaagacagaacucuaguuuuguucuuugaaagaugucuaucuuuauugucuuaucagguauauacuucuauuccauuacaaauuauuuccauuaugaaaguaucagaauacccaaucugaugucuacagugucuuaaugaaguacuggaaggagaaaagcaugaacauuucuaaacuaacaucgcauuugcacuuguuauuugcuugaaaagaauuacagaggcucagaccauucuuaauuacauguuuacaaagauaugcuuccuaccaauugcauauauuuaaguaagguaugcuaaaccagucuuauauuuuggaacauaaagauuuaaaggugcuuacaucauuugccuuucaaaggagaaaguucuuuauacagaaauauagccuuuuaauuuauuuguaaacuuuuaauaugucuugcaaaaaucaguacaguuaaaggaaguguugacaauauuuuagaauauucauguuauucuugccuaguucuuguuuuuuuuuuuucaaauuuacaacagcacauauucuuauuaaugagggaaauuccauauauuuuguuugaacaauauagcaagaauaaauaaaacauggauuguauggaugauuucuaugauaugccaauggcucuuuaguucucugucaccacaaccuuuacacuaugugaugugauuccuguugguuuauguaaaaguuugcuucagugucccauaaaaguuaaauauuucuaccaagcuuugaaauauuguccuuacauuaaacaguccucuaaacaccugcauuuguggcuucagaauaugcacaucacaucauuggguuuuauuuacaggugaauacuaacucaugauucuaauucucauuuccugcuuucuuucuuguucuucugggcauuacgguaggaaguagauuguacuguaggaggguaggcuuuguguuauaaauguaauuugugacuaaguaguuacgugacccugaacgauucagccaacccuuauguaccccauuuccagugcuuuagaaaauucuagauaguggauauguaguuuguuaaauugggcugugucaauuuccuguugaaccuuaaaacauucuuaaucaaugggcgacagaguuauaagacacaaaucuuauauucaagcuuaauaaaucugaaaagagauuaauuuaucugaaauacaaauugaaauauggcuuucaucuaguagcugaaaacuuguaaggcaucaauaacugucacacacaaucugaaacaugaaaaaaacacauuguuuaaguuuagcauaugcaacaaaaguauacuucuuuauaaauaaucauguugcaaaaaagucagacauuuagaggcugcucuaugauucaggggccagaggaggggggggggagaaauuuacacaauuauaaauaaagugaccugguggcaaaaugacaggaaaaaaaaauugugucuuuaguugcugguauugagcacugaugcccguuuuguucucugucagauguacugaucagaaguuuggaugagaaaacuaauuuuaguagguggggugcaaauuucuuaagaguccaugaauagacucuaaucccagcuguuucguugcaaauauaaaaauaaaauuggcugugaaucacucaaacucuguuuaaugggugugaauaauucaguuucaucccacugaaaucuugaaacuauaaaccuaucuuaguucuuuauguucuuucagaguucauaucucauuauucggagaugaccuauuugaaguauggguggucauaaugaaaggggccauauuucuaauuagccccugugguuuucagcauugcugauagccucuagcuugaggguaagaguagagaugaaaaggccuagggauaacuaagaacaaaacaaagacagauuaaauuaguaauucuuaacauuuuucucucaauaaaauauauguucauuauagaaagaaagaacacagauauucaacguauucaauauaucuuuguggguacgcacauguauacacucacaaagacauaugauuuaccacuuuggguuuuuauguuuauuauuaaaauaccauaugauuuuauuuuagaauaaaauauaaaccuuuuugaaagucagcauauauucugccucaucauauuuacaguuuuuuuuuuaguaauuuucuguauuuguucuggagaaaacgauccauuucuuguagucugacauuuccacuguuuauuacucuaagcauugcagcaugagauggcuuuguagaucaauaauugcaucuuuccugcgauuuuaaauaguuggauuuggugucccuauacuucagcuuguuugggagaugacacagcagaggcuuuuauuggcaaguauaggucacuuuaccagacuaugcacauaucuauuccucggaaauaggaaagcuuuaucauuucuggacuuucauuuuuuaggauugucacacagugguagaaacccuaacauuuucuuucuguguuaauagagggggaaguucauaacagugaaaauuugaaaaaugauacauuuauguagcaccagcaaagucucucucaggugcccaucucacauuuguaauugaaagcuagaauugaaaacuccaugucaccuugacauguaguuuauguaauagguaauuauacaaaaaugagaccuaauguuauaaacacacagggaucuaguuauuuccucaaaugcuucugaaagaaaguaaauuuacgguguaugugugcacauagaaaauuguuaggaaugcuugaugcaauguuuggcaagucaauuggaguuugaauauauaaaucaauuuugaaauucaccuggacaagucuauuuugucuucuuuggaaucuccuagaugaguuuauuauaagcauuaauguccaauauuaaaggagaggaaagaaauucauuuuauaucuuaccuguauuuauguuguuuauucuaauuauacugcuaugggcaaagcccucuuagaauucauaucuauuagugaaauuugaaugcauagcacacauacagauguauuacuauaaauaccuugguuaagaauuuauuuucagagauccaaaauacauuagaauaaacucaucuagacuuaaauaaaccuaccaaauuuaaugagaaccauaggacccuuucuucuuauagugguauuuuuuuguuuuccaacaaauauuaaugcaguuccuuaaaacauaaaaagguaaauaaauaagcauucccaccacaaguaauauuuaauaggaauaugugugcagaucaacugugaugcaaagauaaguuuucaugaaaggcagaaaaaguaggaagugacuuuaugaaaaguauaacagguuacauucagauaaaaaaaauaguguuuacaauuaauuuuuguccuuguugccaaccaaugaauaaaaagauccuaggaauggcccacuaauuagaagcccauaguacucuuauagaaaaccuaugcuugguucccagcacccuuguuguacaauucaaucauuuuuaauuccugggcaugguugucuaauacaugaacucauaggaacucuguggauaccagaagcacuguugcauacauacagacacacauaauaugaaauaagauauauuuuuaaaauauaccaucuaaaacagacuaggcuuuuuaguaggugaaucugaagaccuggaagacaagccauaaggaaaaagacugaaaacucagccuaacacuuugguuuucaagaucuggaaaaacuuaacagaaauuauguauaguauagcauuguauaggaaacuaauacaugcuauauagagaaauuuuuuaaaugcuuauuugguaaauuucaaaacaaaagaguacaggguuuuuguuuuauguuuguuuguuuguuuguuuguuuuugagccuaaaguuuacuggagugaacuuucaauuacaucagugcagucaguguuuuacguaugaugguuggucagaacucuagaugguaaguaugagaugaggauccuuaauaaguugucuaaucccuuacuuucuucugucaguuauaacaugaagccuuaauaagacccugauaauagaaauaacuucuauaugcauucuuacauauagaagcuucaaauuaggagagcuuauaucugugaguaaccaaagguaacuuccuguuuguauggauggaagagauaaugaauaagaauagccaacaauggagauccaugcacagguuguuagugguggugaaaaauuugauugucaauaucaauguaugguaacccuguuagcagaacuccagagucaagugagguaaaauugcugauauuguaccuauaaaaauuuaaguacaucuagauuaacuucuuucucuuucuuucuuucuuucuuucuuucuuucuuucuuucuuucuuucuuucuuucuuccuuccuuccuuccuuccuuccuuccuuccuuccuuccuuccuuucuuucuuucuuucuuucuuucuuucucuuucuuucuuccuuccuuccuuccuuccuuccuuccuuccuuccuuccuuccuuccuuccuuccucucucucucucucucucucucucucucucucucucucucucucucucuuucuccuucucucucucuccccccuccuucccucucucccucccuucuuucuuuuacuuuucagauuaaguuucuaauggagggugaauauggaucuggguguaaguaggugagauguuaggaaugaauaaaaucaaaauauaugaaguucgcaaugaaguaauacaaauaaauuaaaauauuuaaggauaaaacauuuuguuuuauuuuacuauuaucccuucaaagcuugauguuuucuaaugagagauugaaaugaggugaauccugauaggacaggagauggggaggaaguuggggagguagugaggggugacauuuuaauucggauacauuaugaaaaagaaaguuauguaaaaauuuauucucaguaaaagaaaaaagauaaaagaaaaaguaaauauuaaaauauccuuuaauucuauagagcauaauaauugcaauaauugugugagugcaucaaaaaagaaaagaagugaaaaggaaaauaucuaagggauaauugaaaaugccaccucucuuagagaacagauggagugaagggaauucaaaugaguugauuuucauuuaauuguugagaacuugcaagccuaguuuguacaaaauauccuagaaacacuagcaacauagacagacaaguuguagacucaagcguuuugacuugcuuauagacuaagaggagagauaauauucaguagacagguucaguagcucagcacaaagggcggauauugaggucuccuggaguaaaucuaagugugguuuagaggaccuuuaaauuuuuucuuaauuuaaauauuauuagagaauuucuccacuuuucuuucccccuucaaucuuuccuaugucccccaguccauuuugccucaugaaaucacugccucuuuuucuuuauuuguuaguauuacaugugcuugugccugugugugugugugggggggggcauguguguacacuaaaauauauaaauagaauuugcccaauuuaggguuacuuguauguauaugauauuauuucaggacuacuuuuaauaacgucgacuuaaugcacucauuaaaugaagagucuguggaaccgggugcuuauccuuuggguauugaaaaguagucuuugggaaacaugaagaacaaucaaagaaaagaaaucuaaacaaauuaaauacaggcagaguuuugugacuccagcuaaaaguaaugugugaaccccaccuuuagggaaggaugcuguuuugacauuuccuuguuuaaucuccucugugucugucuaaguaaguuucuuccuaauuaauagaguucagaaacaccacaugaacguguacacucauguguccugcuauaugcuaacccaaagaaaagcuaaauaaggaucuuuagagaagaaggaggauauuaaaguauaacauaaacaaacauaacauuuuuaauugugugaauaaauguaaaagaauauacacaaucuuugguauagucauuuaagaugucuaccauauguacuuugccuacuugauugauacacuguauacaagaacugucauaauuauuuuccuagauuauuguucuuauuuacugauuauuucuuuuagauuugacccauugcaugucuuauuugauguauugucacugagaagaaagacaaaugcuuggcucugacaugucaccuguuguuuaauggcuaaaacuguuacauaucauaauacugaauuacauuaagucauuuuaaaagcauucuacuuccuucuuuguuuaaauuccagcaaucccuaggauauucacagggugguuaauggaagucuugauuaaaaucuuccaagcuuuaaggcuuucaguucuuguaaacaggagggaucugagacauugggcucauuaugucuuuuuauuagccuauuuacccauuuaauguuaacaaaaaaagucaaguuuuuucuuuaguuuuguuguaauaaauacaaauuaaugccuuuaaaaaagucaagcacacuccauugugugaugaucacagaauuuaugguauuucuuuaaaaaaaauucucugaagacauauucuaauuauuuuaaaacuaaaugagcugccuuggguguaccaauuuuccaugauuuacaguaggucuuuuaaguuuuauaucuagacugcuuuuaaguggcucuuucaaaauauucaggacuaugaaccccacacacugauugauguauucaaccuguacuugcuucauaauaucuagccaagcuauaaguagacaaagucuuuguacauauguaauagcugucguggacucaaguuuuauauuugggcucagcagcauagauuccaugaccaguucaaacacauucuaccuuuuuagggcuggauacuaccacaugacauuuugagaugcacucaaaauuucuggccuuucuaguuuuaacuaacaacauggagguuuuaauuaugcaguggagugaaaagagcuccuugaacugugugguccuuaccaauuuuauguuucacuuaauguugggguuugucuggguuuuuggacaugaaaugaaagccuauuuagguaaauauauauguguguguauguauguguguguguguguaagagucuccucugaaagcuuauuuuauuuugauauauuugagauacaguggagcacaguuaugaagagugcaaguagucgcuuuuacauuguagauauuuuugaaauuuccuccuuucacaacuuugaguacuuugagugcucacauggugugccauguuuauauuugugcuucaugccagcucuguuauccuuguucccccccccccuuaaguuuagaaucaaccaauuguuaauugaauaaaauugagagguccauaugcauauuucaaaauguagaaagccaguuuuaaauuuuauuuguguguguguguguguguguguccauguccaugugugcauguguguaagucuguaaugcuaguaaggaagguagaagaaacuucuguacacuauauagauccaggaacaaacucaggugaacagcauugaauguaaguucccuuguccauuaagcgacugcacuagaccacauuuuacuuacugugcaaggcugaucguaaugccuguauaauuuucuauucguuuauaauuguaaguuguauuauauuuuaauuuuccuaagacugaaugguuaacaaauaacuuauguggauucuuuuuaauaauauacuauuuuaauauguuacuaagggauaagaaauaaaaagguuauuguagugacucugagaucacauaaaaacacauauuauuugaguuuuaacagaagacuuuuaaguuggaauuuuuuucuuuuucuggugaagccgaacucuuagugcucacagaguuuugauacuggaaugcagagaaguuuucaaaagauacaaugaguccuaaaagauuuguucuuucgaaaaaugauucaaaauucauucucuucacacuguauaacuuauauuauagaaagggaguucaggagauagggaugacuuuccugguaaacuggcuguagcccaggugugagagccugagucugaguccuugucacccaugugaaaagccuaugcaccuugcauuuccaacuagagaugagacaauccucuguggcucacucaccagccagccacuguugccaaauugaaaggugaacccagacacagugagagucuuucucaagaaaugagguggagaaugauugaggaagguaccagaugucaacucaggucucuacauacacucauagauauacacauauguaaccagacacauacauauaaauuacauccacaugggaacaugcauacacgcauguacacucucaugcauguacacucucauacucucucucugucucugucucucucuuucucucucucucucugucucugucucugucucucucucucucucucucucucacauucauauauacacaaucuagauuucacguuugaugaauuuaaucaaccugcaucauagcuauauuauuaguuuauccaagauauguuuaugucuguugaaccuaaaauguguagggagggucaugauucuucugacccuucccuucuaaggaaggaaaccaugguacaaugguaaguacagaucugcauggggcuguuuaucuuaaucauuuagagauaaauuagaaucuaaggcuuauaguaaagaaaguaagacaaaccuagaaagauuucaagagauucccagaacucuagaaugcauccauacugaaaagccagccucauuauccuaaugccuuugccuagaugagaugaauaaagguagcagcuugcugaacugggaacccuauaagcugcauccuuccacccugaucaaauucugaaaacauugcggagaaaggaguuagauacauggauauaaaguuggcaaauuauuauauuaugcuuuuuaccccucaugcugugcuguggcuguauuuauagccuuucucugguauuauguucacuuccuaucauuauuggaaucugugucgagagucuagauuuaugaaaaauuaaccaguucaagaaagccuuuugcuaagaccucucuuauggaguuauuuucuuuugggugguuuauagggaugauaauuccuuccaucauuuagacaucauguaguaaaaaucauuuacaggaaauggaacuccacuugguuacuuucuucacuuaaaggcuaaucugauuagcuuucaaacauuuguucuucuucuccuucugcacuugaaguaugccuauggaaggcauauggauuuaaacgguguauugccaucugcugauaagggaaaagugagccgcuaaaucagacuggcaggcaagucuauuucaguagaugcuauuucaaucuggaaugcuguaggaagucuuggaguauuuuaaucaggauuauauugauguguacucccacaacaaguauaguuguugauguaguugaaguuguaggauccuuagguucuuaugucuauagaaagcuguggaaccauacaaaaauuuaauuccauuaacuaugguguuuuuuuuuucccccuaaaaucuuucugagguuuuuuuuuuuuuuuuuuuuuaaagcaaugacacauuuucuuuuuccagaaaguaaaacaugcaagauaaaccuuuucagauaaaugaacuaaaacuaaagaaaaaaauuguucuuuucccaugaugcucauuuguugaauauuuuaauggcccacuguauuuuacaaaugcaacagcuuuguggaguuuagaaaagaguaaaggagauucaucaggagguuuacuaaaugcugaucuguaacaaugagaaagaaggggagcaggugagccuuugagcaacaacaugaagcuaggcacuuguaacuuaguuguaauauggagcuaaguuuaaggucucaaaagaaagcacaccugguugaaaagucucuaucaaacacucaaaacuccacaccacuuugaucuaguuuuuaugucuacucugaguacuugcugcaguaagaaagagggcuagcaugcuucuguuguugcugguccaagggaacaacaggaagugcacgcacucacaccagcuuuucagaucgugcauaacuguggcuccuccacccagcucaggaagugccacuucuuggucauugguagcaagugguguguuacuggacagugcuacuuguuucaggccuguggaagauuuuuuaugucacuuggaaguuuuaagucccuuucucauauuuauucuaaauuucaguucccgcauuugcuuucaguauguuuuagaugcauaggaaguuuugggacagaggguuauaauucauucuuacacuuguaacuuggcaaucuuucauuauacauaguguugucaaaauguuuucuucccagacuuuucuuggccuauuuccuagaagaggaauuucugugguaaaaaucuauguaccugcauguguggguacauaaugucagauugcucuccugugccuaaugucagccauugauuagaaaagccaagguguccacucagaauuuuguuagguugccaaagcuaagcagggacaauagagacaggaagucaacauguggaaaaaauaugucuguaacuagaaacucuuaugcugaguaucacuguccaauugauguauuauucccuugauagcaguuauuagaaccacuaauuuucaacauguggugaaucuuuuuuguccauccauuucugaacuuggagcaagcacaucuuggcugucagugauacaugcaauuugguagugacaaccagacuucuuucaguggagcgaacuacuaaaaccauuaaaaauacuacgaaaaaauauacauucuuucagaugaguuagggcauccucggugauguaggauaacuggcacaaaaauguggcagagauaugagauguaaaggagcaauugacuuagaggugaagcagggcuggcuuagcaucuugagucaauuuuuuaguauucaucuuuucauucacaaaacuauuuugauaaagguauaggaagcgauucaauuuugauuacuuaaaguuuggaaaaaaaaguauuuauaacagaacauuuuuuagaaagcagagcuauaugauguuuccagauaauuaacccuuucaugggugccauguagcuuuacagagugugugaagacacaugugcugcggcucacugcagggacaaugucaguaucuugaacaaugaguacugaaguaacggcauucugguuccuucuuccuauuucccugauuucuggaacgugcuaucuucuacauuuuuuucuggaacguguuaucuucuacauuuuuuccggacuuaaaaaaugucaucuuccccuucaagaaaagaggaaacacacacacacacacacacacacacacacacacacacacacacacacaccagaaaccucaaucacuuaagugccacacagcuugggcuuauuuuggggucuaugguuagucagacuggugacuucaugauguaaccaaaccaucugucuaaacugguugucaaggauccucuguuugauggaaguuugcccauuaucuccuaagcccuuaagucagugggcaccauuagccagaaucucauguucugcacaacagcacuccuugccccaaguaaguacacauauacauauacuaaccauaaaugauacuuuggguaaacacuuauggccagaguucaguucuagcuugcuucaaacguuugaaaaauaaaagugcaugacuauguagguagcauaacucagaucagagcauagaaauuguuucccuugcauuuuuaagcaaaugguuaguauuucuuauaguucagugaaauaagacauguuaacuuuaaggaaaaucagaauuauggugcaugacguuacuucuuucuuuauacuguuauuuuaaaugcgccacauaucucaguugcuagaacaauuacuaaaguucugucagagguauauggcuccuuuucauaggauuacugucucaaacagggcagggggcacuuuggaaagacaaacuucuacauuuucaucaaauugcagacacugaguucaucuggcagauuaaagaguuacuacuuagugcuuuggggagcaugcuacuauacauguggaaauauaggcuuuucaaauggaaaaaaaagcaaaacaggaaaacuccccauguauuuaguaauuaaauuagaaaaauaugaucuuuuuuucccccaaagcaaccaauaagaaacccauacuacuauauuuaugacuagugucucuauaggaggaggcacuuuugugcuaaucucuucauuuuuagaggcuauguaugcugucagccuuuaccaacagaauauggaguuggaauuuugcaaauaguuuugaauuuccuugacagcuaacuugccaagugcugguguuggaaaacaaggacuugugagagcuguuugaacuuauacagcaaaaccaccugccacccgaggcaaucgguucucgcccagaaaacaguucacauugaucuguguggguuagccacuuugucagcagaagucccuguuucacgccagugggucaauaaucugcauaaggauucagcaucauagcuucacauucaacugcacucagagaagcucuucuuaaauuauauagagaaauuaggggcuccugugugccccgugauccccuguccccagggaaauuggcuuauuaaaguuacuagucuucauauacuuaagcccuuuuuuauaagcucagauguuuacuguagacuucuguuaacauagaauauuaagauauauuugauauucucuggucuucucuccaacauuaagaguauuuuccauuacuuaaaagcugauaaaaacaagccauuggaauuauuauuuuuaaccauugggucccauggugaucacagacguaucuucucucaaaagaaggacaaaugcaggugaccugugaauuuuuauaaggugcugucccacacucaagucugcugcaggaauggaucgcaaaccugggguucuaauacuguuagaggauugguuauauucagcauuuuggcacuaagagcuggaaugaauuaauugauuguccauacaguauguguaaugggcgcuaucaacuguuucaauguauaucaauuacuuucaggcuuuccaaagucaucugucacuguauuguccacuugucucuacauaaagcaacacagcugucauugacuguuguccuugcuauuguuucuccuuccaguaauuuaguaauuuacauauauauguguauauauacauacauguauauauauguauauauauuaauuugcaaaaucaauuauaccaaacaaauagaaaauguccacaucggaaaagaguaaauaaggagauagauagauagauagauagauugcuugauaguuagaaguacuuaauauaggauuaaaaauaauuugugaaagcaacagcaagucuguacgcguauacauacauguguccauaugcauacggaauccagggauggaacccaggcauuguuucuaagucacuuuucaucuuguuuugcuuguuuuaauuuuguuuguuguuugcuuuauuauuauuauuauuauuauuauuauuauuauuuuuauuuugucucuuuaaccuagaggaaacagaacagaagauucuagcugucuggguauuuacaggaucccugucucugcuucccuagugcuggaaguauacauggguuuccacgcuuacuuguugaguggguucugggaauugaacuuacauucugcuuguguggcaaacccuuucccuaaggucccauccuccaugucccuuuuuccuuucuaguuucuagcaugcauagcugaggugucuucuucaaucauuuuguuuggucucuaggcuucucugcguagaguguaacucagcacaaguuacugaacacggaaacuuuccuuggcauuuucuggcuaaguucauaaaugguggugaccaccaccuuuucccaggaaugagcaaugccuggguuacaucugcuucuuuggaagauuuggaggguagaagcaggaauguaacuaaaaaggaaacugccuuguauauucuaugcugugaugaacaagucccgagacuccgcguguuuuaccucuggcaauguuaacuaaauucaagauagcauccauuucucaggggcggugaacacuccagcaauacccauuaucauugcaugacuuaucauaucuccuauuaccucagcuggaguuuaaguguuaugacagcuaggaaacuuaagggagucggggagaagcuuaggaggacccaugacuauaaguuaaaagucaggggguuugcucucauagaaguuuauguuguuaaauuuauacaaguuugauaaauuaagacauuccauugcaaauuaacaaacgaaagguauacuacucuccuuacguuuccgugagauagucccccaucauuuaacuuuuacauauuccaaagaggaggugaaacguuauaaaguuuucaucuccccaucccuccuccuccuagcuaaagcagugauuuagugaccagggaaagagauauucauauaaugguuugagcucaguucucuggcugcaauccauucaaucuugacaaauaucugagcuaaguacuuuguaagggggauagccuuuuguucagggugugugagaaauccugcugaaccagguuggcuacagaaacuaguaucaaauugcuuugcucagaguggugaauaagaaggugcagccaacagaaaagugagggcauuuuuuuuuuucucuuucugagcacacccucaccuggcacuuguaaaagacuugaagagacucuuuuccuauuucuuuuauugacgaauguuuggaggguacauugcuuuuguuuuuuugucuguuucuuagaaauuauccaguugccacuggauaaaucaaugcaguuaacaaguuuuauuuuuguauuuuuuuuugacucaauguuuguuuuguacuuguugagguugguugcuuugcauuuaauccacuuagucauagcguuugccuuaggggaucagcaaccuuucaugcaaauucuaggccauauaauaaaacuaauggagaaaaagcaucuaucuacccgcuucacucauauacauagacaggcucacauauucauauauguaugugugggugcauauacacacucuuacaacccauauucuuuccuucacugcuuaugucuaaauuagacuagaaagugagaaacuuuuauguccccauacuuggauauagcaagugcccuugcuuaaauugagcuaguauauuaauguuuggacauagaacaaguauuuuuauauuaguacaguaccuucuucuugaaaaugggagaacauuccagaugccauacaucuuaaacauuugucaaaacauuguuuuaaccaagugauaguccuaagaugacaaaaaaagguucuccuuuccuuuuaaauacaauacagugcaacauugguuaagcuuauuuuuucuuuuuuucauucuuucuaccccuccccccucccaagcacacugaccacuguauagacuugaauugcuauucagcuugaagaaagagaauuaaucaugauaacuauaauuagagauuuguaucaagugucaaacaaguuuuaucuuuaauaugaaaaaaaucaacagucuuuuaaaacacccaggaaauauaugauagucaauagauauuuucuuaauucauacagauucaucagauuuuuuaaaaaguaaaaacauuugagaauagaacauguagcacucuaucuuucugcuucucccaguacuuuaaauugcuacaacuaaaguagcauuacuguaccccacugguucuauuuaaaagaucaugguggaacuucucaggccugccaucuuagagacuugaaaguacuacagccuuuugcuggauguguuugcacuauuucaaucucaccauauuaucauagcuucuuacucuuggggcauuuauccagcaacauagguauuugagucguuguaccuaaguuuuuaaaucuguaggguuaccuugggcaagaccugucaguaaaugauggcuuggauuuccuucacuguugugguuuaaguggguacuccuugguuugcuuguacaagcaauugaaaauguucucuuuuuaaaaagauaauuuuuucccucugacuccuacaauccuccccuucccccagguuuccuaaacuccaagcggggagggauccaauggagacucuuaauuuaggcucucucauuuccuaauguuuaguuguggaucucugcauguauucccaucugcucucagaggaagccucucugaugauaccuggacaggauaccaaucuaugagcauagcagaauaaugggaaacugugguuauugugcacuguauacaaaagaaaucuauuuucaauaaaaaaaagaaaauauuuuuuaacauuguaguuuuagcgauguauuaauauagaugaccacaugguuaauacauuuaauuauauuuuguuuauucuguuuauucuaggagcauauacaugacccuuuagacuuuauucaauuuauccaccuaaucuguggccaccaaagggaacauuuucuuugcauuauuucaguguuggguacuuuucuuaacuguugauuuugacauaucccaauguugcaccuuuuguugauaguagagucugaaaacacuuaacagggaaaaaauacuauuaaggaaaaggagaucaacauaccagccuucuucugauaucacugauuuuaaagaauguggcuuuauaaaucugagaaguauaaugggacaucccuauaggugugccugguguuugcuaccugaauguggaaagcgcagacugccugcaccaauggccaagguucaauccuggucuucuaguguuuggagucuguuauuggaagacaagccauguauuuaggugaccagaaaauaaguuaauaguugcuuauaugaaaagcaagacauagcguuuccgaaacaggcaugcucguuacacauaccucauauaaaccacagggcuuucauuuacaaacugucuugaaacauugagcuagaaagagugguguuaguacaaacuagcauagcucuaauccaugauuaaugccaauguuaccuucaucucugcuccuugauaacaaagcuggggcuuuuggacucggaauugcaguaauuagguuaaagguaaugagguggggaaugugagugcuaaaauggucagauguguccuuagcacaucacucaccuccugauacugcuuagugaauuuaagcugagguuuuacauggugucacugacuggagguggacauuugaugcuaaguuguugggcaccauuauuucgucaaucaacauaggaauuggauauucacguuuccuuucuacgaagccugauuaguagcauguuauauauuuauuuacauaucuauucauuuauuuuuggaugaaaggguguguuucaucuugaacgucuaggaaacugucuaucaguaaaaguugucagagcaggaacucaagguaggaacccaaagacagaaacugaaagagaagccauggaggaaugcuucuuccuggcugguuccucauaacuugcucaaccugcucucuuauaacauccaggaccaccucauuguuggcacugccuuuagucaucaggagccaccuacaucaaucacuauuaaagaaagugcaccaaugacuuaccagggcaaucuuaguuucaauuaagagggccucuucccagguauguucagguuuuguuagcaugccauuuaaacacauaaauggacauguauguauaaucacuucagaccuuugugccuugugguuucgagagcucucuaagugugcucagaguugauauuagguagucuucucaaccugacaggugguauguaauuagcacaccaaugcuuuuaaccacgagugcuuaucaagguuuccauggaauguuucacaguacauaugccuuuauauuugggacaucucuaaaguggauucaacaacaguucccuggaauguucaaaauaauucaaggcacaaaguaaccuauauauuuaaacaguuccuuuacaccuuagccacgugcuuguuaagaucuuauggaaacagacuuuguuuuuuuuuuuuuuuguuguuuuguuuuuguuuuuguuuuguuuguuuuguuuuguuuuuucucucccaaugucaggcuuucaucagcaaaguuuucugugccuauuuaaugucucaaagacuugaaauagaaauuuucuucccagaucccuuuuugggagagucugcuauugauggcugauuauagucuauggguuuguuuuguuuuuuugucuuuccaugaacuauuauaucaauuguggaaguugaguuucuagauuguugaaggcuuaaggcuuacccuuacccuuuuuuuuuuuuuuuuuccuuucacaaaugaguugagaguuaauguuggcuguuuuguucuaguuaaaaauaaaacauucagagaugucuggcauuaagguggauggagaugauguggguuauuguucaauguucuugaaguauaggucacuggaugcuuuuggucugugcaccucuguuuccacugaugcuuuccaaagcaguccacacaaaaggcuuaacauuucuccaauugacacacaggguacacauauaaaaguauacaaucuacccaaagcaacuauauaaaagauuaaaagacaguuuacccauucauggccugcuuuuacaagcaacaauauaagaauucuguuucuuacuaagaauauagagauagggaguuuaaaauguuauaaaaauauuuuauaugaguuuuaaaauguuuggaaauuucguucaauguuuauuucauguauaaacucuauaauggaguaauuauaaugcccucaaauacauugagccuagaguuacucgcuuacuuauuaaacgcauaacaaagucuaauuagagaaaagacuuauccuaaauauugguuauggcuauuuaaaagugauccaaacagaaauauuuuuguucuuaaguagguaaaacauuuuuuuuucuaccuaagcuuucaaggcuaauaaacaugaaauauuuguuauacaacacaggaagaaauuagaaugaacucacuucuacuuaguuccuuuuacauauccuuuagacugacagacugacacuuuaugaauucaauauuacuuaaauuauuaugaauuacuaaaaauauauauacuuugcaaauacugaaagguuaacucagaagaccagugauuagcauaguauuaauuuuguaucaguauuucaaaugacucugggaaacauacucuaugcugauaccaaccauagcugauaauaaauauaacaucuuuauuuacauuaaaauccuggaucaaauaaguggcaaaaugucuuuguagcauuuuauaaugcauuuugcugugcauaaauauuaguauaccucauaaugcugguauguuaaaggguacaguacuggagguuggaucuugaaauuuuaugaguuauuggguuuuugaaacauagaguacauuugaaauacaucuuacacaaucuuagugguuuauugaaaucuauacuagccuggaaacaaagucuuagaaaugaaauauuuuaguuacaugcaauuguaagaacugaauuuagacuucacuguucucucuuguuuucucuuaccccauuguagauuucaaaagauucuuuccaugucuccuuauagcccgugcucuaacauuaccauguuaguguucucuacugagcagguuugauaucagaucacucaaugacccuaagaauuuuuguaccccaucaugaaaaucugcuacagaagaguaauuguaauuacaucuaugaagauuacagauucugacuauacaaaauacuauggcacagacaaauaaaggaaaacaaaaacauaaacagaauagaauuaaaugcaggccaauaaugggagacuauaaaaaucugcaaugugaccccuaugguauuauaaauaacugaucuuuuugaacuuaucuacaaaauacuaugaucaagggaggaaugagcaacauauuucuuuugucaaauucaagccuuggagucuauggaagacaaguggcagggugucugaguaugugugaucccaagucacuaguaguugucugucuauauacaggggauuggaauagccuggcuuacagaccaccuucucuuuguucccuuauguguucuguauuuuagcuauaaucacggaauugucaaaaacuuggugaggaucagugagaacucuucauaucuuuuauaaagagaaucuuauaguuacgaauacugcauuuagccaagccacucuaauacucuguacaggugaaauugauuuauggccauguacuauauucagaguagcuugggaagcaacucaaugugauaggaaguaacuggguguagguauuggcuucuuaaguaggaaucuaucauucugauuuauaaaguuucaaaguuuuaauuaaauauaaaguuaaguuguauagucauucuuguuagaaguagcaguguuugcugcuaccuuaacaucagagacaucuuaacagaacauauuucuuuucccgaagucuaagauggaagacucacaauaguccuugugcucugacucucugauucaggaugguggugggauuugaccuuuccagaucaucuugcucaucuuggaucuaggucaggcuuuuacauuuuacaggaagaagagaaagcuugagacagucaugauuuauccucuugaaugugagacacaagaggagugaagcaguccuucaaguaaucucuucaugggccaacauacagauuucucaagaacaaauauagagucagauuuaauaggcaaguuggaguuauggcauguagacauacuugguuucucaaaaaguagaagacaucacucacuagaaaggaagaauuucugaaucauaaauaauuuccuagcuuaauuuguucaaugccaguuggugugaaagagacuccucuugcaaauauuaugggcguguuacacgaggauguauuucuaaucuuacaaaacuugcacccuguucagugaggcaggcacacaaagugccuaaggacuacagcuuauucacccugcccaauagauaugaacacucaaugugguguauuaagaggacacaaauugaaguauauuagaacuacauucuacuggacugaauauggaggcacuguccaaguaacaguaguaacuuaaauauguguccucguaaaaaauuuaguaacuuaucugcuuaugugagauguuucccaagcaagcaucucaaauaaguagauuccaucaguuuucucuguuaugaauagguauuuuuauuauucccuaaucuugaaaaugccucaacuauuaaaaaaccgaaacuuaagacgggaugaauuaauugcuuugaaacccagacuuuccuuucauuuccccauaguuugacauuaauugguuaaucuuuuaucauaguugauuggggucguuauggcuguuagguuauauugaaaucugaacuuuucuauaaaauucuguggcuucccuccacaucaugagcuguuuugugcagaguggaaauauacugguccaugcuccgcccauccagccauaugccgauguccuugucaugcccuuaucuccuucugcuucccaugcuccugucuggagggaauugaucagcuugcagggggggaaagaaggccuugccaaacaacugugauuguucaaaucccugggaaaggucacuggugcuugauaacauauugggaaucuucuggguggcuguuuaguuuccugucugucugucuaucugucugucugucucucucucuuucucucucuuuuaaaucuaaaggaacucauguugaagagggaaauacaaauguugaaauaaucuguuuuauuugcccagucugcuccaggauuuggcaaacacgaaguauagugaagaaccugauugaaauccuaccugguguuuuacugaaaguuagcaauugcaaacuuagaggagaguaagacaaaagugucuuuuuaaacucuaccguaguccagggugagcugugccaacaagccuuaccuuugaaagcugaguguuaugagccccguacaucuucuuaguggcuuccuggguuuggaugcuuggggaaugagacucccacagguaccagaggaagagauaggaacauaucuguaacuaugaggaggaaggacagucccuggggguuugaggcgggucacuguuuauaccccuuugcucugcuucauucauggucauuaucaagcuggucuagucucuuuguuccucucuuuguccuucuccucaccuaccccugggcauccugucucucucuuuccucuggcaugcuucucaaaggcccuucucuuugaacccgugccaucuggagcagucgccccuuaucucagugccucauugacuugccuccgacccuaaucucuuuguaaaaguuaugucuucuuucuucaccuccacaaugaaauauauuuuggucuauuauucauuccauugaugaaucucucauuuaucaaaacuuugagagcugcauauuuauuuacuuacuuauuuauuuauuuauugaguaagaacaguaaagcugguauucaagaccacgcugcaguuuucucuggccauaaugugugaauuauguuggacuuuuuuuuuuuuuuuauacuaaggggaaauuucaguugaaaauuugaaagcagaaacacagcucaguuuugugaugcagaaccaauuguuuuauucugugcauuguuuucuggguguuugaaagugagaauggaucuaggauagggauggauccuugaguggguuguggagggggacuguagaaauaucuuuguauucuucaggcucucgcgucuaugugggacucugguagggcuggaaggucagacagucguggaguaaagaagcugcuuuguuugauugugaguuuguucaccccuuugggcaucucuggagcucuaaaaccaagaacaauccccucucacacuguagguuaaugacaaggaaugugauucaguuuuacagauguucgucacugcuuuugcagugacucugacacgauuuuagaaucuguuguaugaucauagguaauauauuuacauaaauauauuuuacacauauauuuauaugaaguuacaaguagugcaucuccauuaaauaacuuguuuugguuuugcuaguaggugaugacacccauuuuugaugaucuagccuagucuccagggugacuuauuuuccuacuagguaaugaugcauuucuauacucuaguauuauggguguaaguguucuguggccauuguaccaggucaaauuuaaucaaucguuucuugaaugaaucuguacucuggauuuccaggauuaaaguuugaagguaagaauucuuuugagaaaauguacugguaaaugauuuauguucauuuaauuguauaaaugagaggcuuaaauuguaugcaugcaaaagaauaauuuauuaaaacaaccauauuauuguaagaagugaaaaagaauguuaaugacauagcugcaguaugguacaguugaugguuauaucaaguaaagucaucgagaaaauuucugugcuauacuacuauauucaaaaugcugauuuauuacaguuuauucauaauuauuacaaacaugcauuauuuuauuguuuauaauuaucuauuacauuuguuauaauuugucauaaaacaacuucaaaauaacuguugaaauuaugcuuuaaugucuuuucuuuaggggcagagauaggacacagcauuugaaaauuagcaagccuuaggccuggguuccauuccaaguucugcaaaauuaauaaaugagaggauaaaaauucuucccuucaugugaauuuaauauuacauucaugauaacuguuuauauauguaaguggugggauggcugucucccuuugacaugcgauaauaaaauguuauggccauauagcagauuaagauagagacucucccaacacaucucaucauuuguagagucaggcagaaacuuuaauuuuccuuggaacaggcuuacacuauauuuauuucgcugauucuauucaaggggagaaaaaaagcauauaaaaagauaucuugcuagauuuggugacauaaaggucaaaagauaaacuguaaaugaucuccguguuuauuuuuuugacaguguuaaauuagcagccgcucagccuucucucagagaaucacaaccugaguaauugaacaugccgcuggggaguacgcuugguuaagcugauuccuauuauguugacuugucaggggccaauaauuaaagcugaagagcgaugcucauuagugucuguaagaugauucaaagaauaagggagagaaguccuugagacgcaccugcaaaaggcaggcaugccuggaggugagagcagaucgaguggcugcccuuucugcuguguuagcagucuaguugugaaaagggcaccccgaguguugcaaauguccuugcccugaacagaucacaaaucacccuuuacuuuugcuuuuauaugccccaugugauaauauucugcgcaacuauauuuuuaagagaauuccuuucagagaauagaaguuugaaaaagaauuauacugguaaucauuucauucauuuugcuggaaacuuuguauacagugccacauuuacuuugcuaauauaggauuuuuaaaaauguauauuuaagugagcuaaacugagucacaagcauaggauauggagacacguagaagagcaagaauucauaacucaagcaaacucugggugaagaacaacuguugucggcacugaauacuguuaaaaaaugaucauaauguccugaaaugcuuucuuuuuaauuuguaauuugccucuaagguaggcucugauuuuaugaacccaucuucaaauuaauaaaacauccaauuauccauauauuuuguacaauucagucaguuuguuggauuuuacuguuaucugucauucucagagguauuuuguagugaugaagugcccauuuuguuuccagcacuacauuuuaauuuuguccuggaccgugcaucuggacaauguaugccuuuuccaaggccccauaguucugcuggagucauuaguguauuguauaauuuccaacaagaacauuucguuccuuuguugauucuacugauaugauucuguuugagauuauguccguaugaaaacccucucauaugugaggcuucuacaacuuauguuacagauaugccauguugauuuggacuugugaaaguuucugugucccccauuugugcggagucccuuaaggacauggauugauucuuguuaauguuugcaugucuugugguuggagcucaguaacuguugguuaaacuuaaucaaggaacagaagaggucuucugggauaguuacauauuuccaaagauaauagcagcuuuagaagucaaauagaacaacccucuucuccaugccaagaauuccuuacuggauguucuuuaacagauagcuccuuuccuggcuugguagaacauuuccagaacuugagaggucaacacuuugcaagcaacuauuucuagauuggacaaccucaguuuauaacaacagaaaguuuauaguuaacagagugguacuuuacauaaauuaucuucagcauucauacuguucuuaagcauaagggaccaacuauuauuaucuccauucugcagauaaggauguugcauucuagagaggcuugaugccuuaacaaaagccuugugccuccuugggaaucuaccuguuucugaguuaagcuuuacaauaucuauguuuccaagccugaagcuaucuccuuacugauuuuccccauuauuacaaauguacuuaugguuagauuucuucaguaaucucuccauguguaaccauggagacaaggguguuuaccacauugcccugcugcaacauagccaugcuaugaaaaccauuaucccaagcagguggguuccuuauauuacaucaacacuccagucuaucuuaaucuuucuuauagguuaaguggguucucugagagguguuuuuaaaagguacuauggcagaaagucuacuugaguaggacuuucuauaccucuauuacuagggagaacuauaaaaguccagaaggggaaacccuuaccugccaaauguggguguggaagaaucaauguuuuauuaauacuguuagauugauaagcaaaguauuauguauggaaaccuuccacucucauuagaucagcuugugguauugauuuuauuuuguaauauucuguuucucugagaacaguuacauccaaaccauaaucaauauuggcucuucugacaguuauaaaugcugaauccauauucauuugcaugauuauugacagcacuugaauuuaauaguguuuuuuuuuauaagcugugaacauuauuuucuuaaagguuucucuuaauauagcgaagguagauacuucauuugacauuuucauuuugaaauaagcuuauugauuuaagcuagaaaagcucacacucauucauacauuucuaauguuuuucuuugugauagaucgugauaacccaauuauauauucuacucagagugucucucaucgguuccucuaaaaaauguuaaagcgccauugaaccaauuuuuacaguacuauuaaucaguguaaucaguauuaauauacuacuugaccagcugagugcuacuugucccugaugugacaggguaaaauuuacaauuuuuuucuuucuuucuuuuuuuuuuuuuuuccacaaaggcuuucauuucacaggacgagaaagaaaaagaacaggauuuuaauuguuagcaaucagaagcuugugugauuaagacuaacauuuugaaucaaacaugucagacucuacugggaauuuauuucaucucuuacuauucuuucauagauuuaaauguagucuuauuuaccaauacaugaaacuuuaauuauagguagacccacuggugaguaauaugucugcaaaaaguaauuucuuauuggaguuaaggauuuccaugugauuuaaauagacagcuuccuucuuuuauauucuugcuuguuuuggaaauaccuaaaaucuuaacuauccuuaggccuccaagucaaucuuugauguauaaaauggacacucuugagaacuaacauauuuuggugaggauugcuauguuaaguuucuauuaaauaugaaugauucuuaacauuaaugcaaguuauuuaaccaccaauguucauauuagucaauguuuaguucaacgauaaagcauuagguauuagagcagaacucagagaacggcauguagaaagucugguuggugggcagcuaccuuauugcagugaagccuuccuggagggagaaaaggagagacugaguaaggcuguggggagguagagaaacucuuuagggaggguguguuggagaaagcagacugagacauuagaaagaaguucuaauguuccccaaguccuaaucacccaagaagaauugcuucauuuuggaacauuuaacuauaugugauacuugccuugacuagaguaccaaacaaccugguguagaucuagaauuggcaacagaaacucacaccacacugaucacuuuacagaaaaacccaugagauauuuauuccuuguugccuagguaaaacucagagaacacaaagacagagucaauagaaacaccagaggaugagaggagaggagaggaggaggaggaggaggaggaggaggaggaggaggaggagagagagagagagagagagagagagagagagagagagagagagagaauaucagaauauuuggucuuuccuucugauuaaaaauaaaaagugauuaaucccagcacuugggaggcagagacagguggauuucugaguuugaggccagccuggucuacaaagugaguuccaggacagccagggcuauacagagaaacccugucucgaaaaaccaaaaaaaaaaaaaaaaaaaaaaaaaaagugaugcauagaaaguugauuuaguaaauuauggguaauaaaaacaucuuuuaagugcuugcuguuugaugggacuuuuuaaugauuuaauauaauuaaaaaguaaaauuaaguaaacuuccuguagauuaagaacaaauuucuaggaaauuacugucagugauaaacuuuaaauauaguugaccagugagucuaaugucaguuuuauuguuuaagcauuugaaguuagcuuugugaagaaaugaauacaagaguuggaugccugcucagaaugauuugaaagcuucuuggcugugcuuaugggcguaugucugguuuuaaccaaccugcauguagaaggaacaucuacucuguauauuaauguaagggaauuuaaagcaaggaauguauugcuuauugcaaucagcacaacaaauugcucugcgaacugcuuuccccaaacugaaaagugccucuuuauaucagaagcuuguagccaugaauaauuugagcauaauuuuuuuaaaaagcaacauucuggaaauguucacuuagacacugaaaacuccucucucucucucucucucucucucucucucugucugucugucuuuuguaucuaugaugcaccuuuacugaauacauauuacuuuucaguuugaaauaccaaauaggaauuuguaaaaccaauuugcucuucaauacaaagaaucauaauugaacaugauuuggaacauauaccuuguauacugucuguauguaaauauuuauauuaauguacuuauuuaaaugaagggaagcauuguauauacuacaguagcuauuaugguucugucugauuauuuuuauuuuagucucaaauguuuacaugcaucuaauauggcaaucggugaacauuuggaauuauuuugaugauuauuaugauaagauaaauaaauaaaagggaaaauaauguccaauguuccagucuacugauggguaguaucuaaacaaucaaaguauauaaaagcauacuaauuauuaaaguuuuugagcaaccaaccuaauaugcuaaccacagagagaagagcagccuaauuuaugaugcauaaucacucagguuaccacauuagcagcaacagaagaaaacacuauggagccauagaucuuagcaugcuacacuuauuuauuuaauauuuucgguuauuaccauguuuaucuugugauaacaucuaucucaagaaaagaaagcaaaacagcaagaaggguccuuucuaauaaugagggugaguccauuuuaaauacuaaugcaagugauacaaaugauaaacaugccgauauguaggauaguuugaaagacacuagaaaucaagguguuuaaauaagaaauguacccaaaccuaucuaucagccaccugcauagucaaaugguccaacaugauucuucuuguuugcucuguccuuccugucucuguuccucuuuuccuuuuaggucuaguuacuuaugaaaucugaagaccauggacaguaacauuucauaaagagugaguuucaacccuaggguuuguuacacacucauaauccuagaacuggugaaguagaaagaggagaaauaggaguucaagaucaccaucaacuaaauagagaauugcaggacagccuggguauaaaugaccucugucuccaaaaaacugaaaagguuaaaaauaauaaugauaauaaauaauaauaauaauuaauaaaauuuaaaaaaacuuaaaagcauaugucagaauccuauaccaguugcgcuggagaauuaaauuaauuaaaugauggauggguuuagcuaccacugaugcagaaaacauuggugaacauuagguucuuuuaaagccuugugcuuugguucauuuugcugauaagagcuuugugguagucugauuaaccacuaaauggauuuucauagcuuucuguaugccugguaauuuuuguagagcaaaucaauacaauauaacuuuuugagguguaauuagaagauaucuugcuacccugaaguguugacuaucauuucaggugguauuugcacagaugccagcaaggcaggccuaaccagugacuccaacccuggcuuauaggccauguuguucuuccuggccaagaaggaacagaguuuuauauguuaaguuacgaaaucuucaaaaugaucuuguagaggccaaaauuccuauuuuuucugaagaaagauuugaggccuaaguaaguaaauggcugccucaggucaaauaggcauuugugaggagugagaccagaauucaagcucugguacagauauuugcugugaaagauccuaccacugucuucuuuacacacagccaccuacauucaucuuuguugauuuuaaaacguucuccuagugaccacuuccguuuauuuccuaguauuucaaagagaauuaaauuccaugcuucgauuuuauugucuucauuuuguguugaugaauuaucucucaguaacaaugugaaaacucuguccuauucagaacauuuacauuucauacuuaauuauaauacauaugggcauuaccguguuaagcaaacaugagauguaggacauagugauuucagaguaacucuacuuaaaagccccuaacuuagguuauacuaaggacuuuguaagauauauaaauuauuuauaguuugauaagccuguuauugaaguccacacuaaauugagguagauucuuacucauuuggagcuaucauuuugguuuucauuuaucuuaauuggccuucaccuuguggacaaaaggguagauuuuguuuugagcaaguuccuaaaguaaauauuagagaaagaagauaauaggaacaguuuccuuuucgguugccaucgaguuaguaucaaguuuuuaaacauucauucuuggaaaaaucuuucucuuuugugcacauguaaauggaaucaaagaguuaaaggcuggcaggaauuaaccgguugguucuuucagaagaaaaaucacacagggcugcgagggaauguucaggguuucucugaaaucucagucaguugacauuucucaacugaaagaaagaagauggauuaaaacuugagauuggguuuggagggcaacaagucuucaaagccaccacaaugcaaaggcauggaggacaguggaaacagcauccugacuugcuuauuuuccccauguguguguguguguagacuugagaaugucuggagucuuuucuuccuccguccuuugggcuucuguaucccuguggacacuaagcuacuuuaaaccuguccuaaugccuucaugccauuguguguguugcggguuaaggggaauaugcauucaccacuuacugcacugggaaaucccagggugcuggguuccuaccagcuuuuguuaguccacagagagaagaaagcuaaggcuugugugcuuuuccuccuggaacccugauuauuucugaguaggacauauuguaggacuuaagauuguuuaauuauagcacuugacaguucucucauaauaauaauaguuagcacuuacacagccuguuucaucuucaaagcguuucacaagcacuaauuaauucucaccacaugccugggaggggguaucauucccauuuuacagauauggaaauugaugcaagugaguuaagagucuucccauuggccacagugggcaggcagaaucuaaaugcagguugcaaacuuaggaguggcuggcgccuaaauccuuuuccuuaggccuaaaccuugccuccgcccucucugcucaucucuucagauuuauuguuucuuucuuucuuuuuuuuuuuuccaccgucuuggaaaggacuucauauuuucucuucuuccuucccuuuagagaguauuuguuuaacacugcuccaagaaauaaauaaaucaucucaguauuauagcuuuaaagacauaauaugucuaaucaggacaugaauauuucgaaaugucaggaaaugaauuagguuugggugaaaggaaggauuccaaauuacauuuugccugauaaauguugccaccacaaacaguaaaaauaaugauaguaauuagguaacauuaccaaauaaagcuugcauuuaaaaugaaacugaccagacauuuuugugucauacugacuguggguagaacaguccauucuuugacaaaggaagacucauuugaauuguaaauugccgacaugguaaacuguagauugcaauaguaaggcugugcuaggcugugauaaauuauaagugcaauauuggcucggcuucugaacuuuguacuucugaagaauuuacugguguuaucaccgcuaauaucuucugcagagacuacauggcacauuguucuauacauggaaaaggaauucuauuguauaguggcuauggcaaagugcuauguggcuccuguguccuuugguaucaguuacuuauauaauucaguucagcguuuuccauuuuggguucaugcuugaaacacacuaaguaugcuguuauaauuaacaauuuugguaauacaugccaaauauaucuuaaaaaugaaaugugcuuuugaagaaaaauucucaucagaaucaaaauuaugccaugauaaaugcacucuuaguccuucgucucauuuggcgaaagagaaugcggaguuugaaugaggguacuaaagacugguuuccacacaggagacaaccauguacugugagcccuaaagagcucuaguguucucaagugucacacuugacuucugcaccuacuuuguuuuccuaaugguccaguuuucaucuuagagcacaaauaaauuacucaguuguggggaguggauugacauguagaagcuacuuuuuccaagugucugcuccguuagcauucuguugccauggcauagccggcagaauugguugaauuaggauaaugauuccuuauagcuuucuguuccuaaguaggccauggugaaaauaauuaauguauauugaaugcauggaugguacaauuuucagaauuuguguuaugcuaagaaagacugauggauagaaacaccauacaggaaagaaaaccaaaaccaaaccaagacaaacaaaacaaaacaaaccucucaaccuucuccaucuaucugguaguaucuagacccuaguuucaguguccauggcccagugagcccuucagagaguaggguucauuuucuauucugagcuauguauacauaugcagaaacacuaaauuacauucauauccauagacuuucauucaacugaccuguuuguuuaccaagagaguaaguuuguggagaauguuccaaauuugucaucuuuuaaaauuuaugaucauacucagcauuaaugaauuaaauauuauaaaaauuugauaauggaaauaaaauucuuuggugacuaaaacaucaagguuucagaaagauuuagugaaaauguauuacguuaauuaucaaacuaagaaauguguacaauauuuagguuaaagaucacauuuauuuuuuagaaaguuuaaagaauuuuuuuuuagaaaaacaacuuagauuagacccauuaauuuggaggggccaaaaauauauuuuauagcauaauuaguuacuaugucauugcauaaaucaauacaggaaugaauuuaaauggaugguagugcauaugacauauuuuguaguucugaauuuaagcuuacuuucuaguuaacagacuugaucugacaacuguugguaugaauuguaaauaggagaucaagacugugauacaaacuccuuuucaguccuucaagguuaucacuuguggcugggaaauccaaacugauuuuuuuuucuguuguaauucauucuauuaugguucaguguaggauggcucuuauaacagaauuaugagucgucaauaguuuuuuuuccuucguuuucuguuacaguuaugagauccuuaacacagcccaaaguguugagcaaugccucgcugcauuuucucucuagccacauccccuucugauugcaacauuugugcgguguaauaguguuggugagauuuagguuuuccuuuugcaguuuuguauagagacauauuagcauacucuuuacauaacagauuuuauaauccaagaauaauaaaacuggguucugaauucuaaauucugagugcugguugaucaucugcagaauagaaagggucuugccaucaagaaguggcauguggaacaugaaggguucucuugcccagugauaccuaagcaucuuuuaguaguagcaugcuuucugcaaaggcuuugaaggaaacaccuacugauguuggauguuagcucauugagucccccuaagcauauagcacaaucaaucaaaaauggccaaagggaggcacuggaagaguuuggaaguaagaacagugaagucaaugaagcucaaauauuggcuuaggguacaggguuggguugagauacaaauuagaauugauccaagugauugugaacgagcuacucaucuuuauuuguagccaugucauagcugugucauaauugucuauuggcugacagaccuauacauuuauuuguauuuccaguaccuuugacagugcaaguccucaagaaagauuacccaaugaaacuucaaaucaggaacuagaaaacucuuuuuaggcccuaacguuuugucaaguguaacaggauaugauauuuuuaguaaucuuuaacaacugcauguaugucuaugcuuucuuuuccuugugacuuauuuugaugcaaacuggcacaguaagugaauaauuuauaguuuugauguuguguugacagcuguugaaagauguaaaaauuuagauguauaagaguggaguuuagacucuagaucuacuacuacauacuugcuuaguagccaugaacagccauuauauuuuuucugucccucagaugaauccccugugauauaggauuauuauuccugccucuacuauaacuaaaaaaaaauauuagcugggacuuuagaauucauuuggcaucuaauacauaauauaaucuauauaaaauuucugauucuaaauauuaaucacagacuaaugacugcagcucagaagauauauuugaauacucacaucuaaauuuucucaaauugauacugucuacucucaaaaauugcuuacugacagucauuuaaauaaucucaguuuuuuaaagacaguaauaguauauauuucauaaaguauucuuggaaaaucccuauaacauucauauauugcuugcaagaaaacuuaaaccaauuacuuccugauguugagcaacauuagugucagaugaaagaugucccccaagagucaaauaucuuucagaaugccucuaauagugcugcuauuagagacaaaguugguaguaguuggaauuuuggcgauacuuucaaaucauagaugucaugacaaauuuuucuacucagaugauguuugguguauaaaaugucuucacugucaucagauguagguuaugaaguaaguaugucugaaagcaauguaauuguauucuuuuguugcuagcuucaucaacacuuagauauucuguucccaugucacuacaaagacaagaauuuagucacuccacugagcacauauuauuuucccucauaguuuauugaucugcuggaugauauugcgacucuaugcuuauauuauaaguacugaagaugguuccaaaacaaaccaaccaaccaaccaaaacccaaaaaacuaauaaaacccaauuaaacaacaacaacaaaaaauuaugacuuagauaggaugcaugcugcaucuuuaccauguacauuuuccuuucccuuucuuuuuauuuacaucuucauuuuauuuuauuuuauugaaaauggauauuuuucccucauauaauauauccugguuauguuuuccccucucuguacucugccaaguuccuccuuuccucccguuacaucuggaucuaccucuuuucugucucgcauuagaaaacaggcuucugaggacaauaaugaaauauaaugagauaaaucaaaaguuaaccauggaaauagucagaaaugcaaagaaauacaacaguccaagagagggcacucgaauuugaguccaacuuguucacucaggaaaucccauagaaucacuaaacucaaagacacaagcaagggacuuguagaguaaaaagacagaggaaauacguguacacaauaaaaugaaaaauaauaugauggaauuuuaagaaaagaaaaauccuguuacaacaaugugagacuaggaacuuccaaagaugccacugaauucacucucuguuggccaucuacuuuugggcaugaagccuauacacuuaagaguaauuugguuccccagugagacucuguugauggaaacuaaacuuuccauuugcaagugguuuaucaauuggagauugcuucuggguuagggauuggcacgugcucgcuucuccuuucuacaucagggccccguguggcgcagaccugugcagaaguucccugugcugccucaguuucugcauuccuguaugcguugcucuugugaauuuccggggcaugguuuuccuggcguucuccaugcccucuagcucuuaagaucccuuuaguuccccuuccacaugguuuccuaaucccugaaaggagggauuugcuaaagacauccuuuugauggcuguguaccaaggucucaccuuuguacagugucugccugcaguaucuguaucuguucccgucugcugcagaagggagcuucccugauuggagcugacaaaggcacucuucauuuucguguuuuuuaaaugggcuucauaaacuauauccccacuaaaaauaauucgacuguccuaaaauacagcccugaggaaucgagccaguaaugcaguuaaugacaaauuuccaaauuugcuggcaagacugucaguuaaaugugucauuugcacaucuuguucgucaagcaaacaaaauaauacuuaaguauguaauaauauacaguauuaaaucccccugggaaaagaguugguuuuaaauacuuugaaaagaaacuuucaaguuagugauuuacacaguuaauuauaaacaacaaggcuuguaauuaaguguugccauuuuggguggaauugguuucacccaucacuaauccgucuauccuugucuuuggccuuugagagauuaugggaaaaugcacacgaugaaaaguuuaacuugucaaguuuaaauuuagaugcaaaguccggaauaucaaacaccauaagugauaauuaucaccaccuggaaauaauuuguaccacugaguuaaguaagaauucuccuuuccugcugauggggaguuuuuaaccuccugaucaccagaguccugcagcuuacggugguguguuuugugguucacccccaguagucugcauagauucaaguguuuagccaaauacuggagguauaccuauuagcauuguacaaugucaggaagacuaauaagccagcaacaaaguggaaguaaggaagguccugauuuuaaguuacucagaggaagcuauguuaccuaauuguuuagguuacaaauuaccuggauguucuucuaaaaaaucaaaacaaaagaaaaagaaaaaaccaauuaugaggagauagguguuuaccuauucaagugguuacaucuauuguucuauguuacaauguccuacacuugcauuuuuccuguguuaauuuuuucuuuuuaaugugagggcauugaauaguaaaaugguagucccaaauagguuaagaagguauuuuuuuucuauaaguuacaaucauggguuuaaaugauacuugcauaauucuuuuccacagacucauuuaagcauuuucugccucauauuuauucuccagugaauuuuuauauacuauuaagacuuuuuuuuaauggugauuagugaaacuucuacacauucccuagagacaagagcuccuuuuaaaauuuugagugucuuuaauaauauuuaauuuuuauuaaccuucgaauguaucuucccaaaacauauuuuauauaauaaauagaaugaaccacaugaucccugauuuuuuuugagggauguucgauggauaggcuuucuaaaaaugaaaaagaaccuaaccauguaaagcuuuugaaguuucaaaauauuugaaguuaacuuccauauuagcuuaaaagaugagaagucaacaaacccaaaauucaauacaguccgcauuuacccacaaagcgggagacccaucaauugcaaaggaaaacuauuuugauuaggaucaugacauggguucuauguuaaggcaaagaagcaucuccaaaauugauuugcagcuccgcuuaaauggaauaaagguagagcccccuagcauaacauauuuaccuuuaaauuuauauuuacauuuucuaaguggcuaacauugucaaaucacagcuuuuuuguuaccaacaagaauggcugaaacuucaccugaaguuagaagaucauauauacagacaguaugauagagacaaacaggcacaguaguauugccuggcugaugauagagagccaugaaacccagccagacuuaugcuuuuuauuaauuauaauaagggaaugaacuauaaacacaaagaucugauguaaauggguuuguuguaaauuggggaaguggcacuucacaauaaggagaaacuacguuuuugauagccuaguggaguuuuaaauuaaguguugaaaaucuaaguuuuugaaucacauuaugcaaguauguauauuuucuacuauacauauauauauguauauauaugcuuuauauauucauacguaugauauauaucauguguguguauauauauauauaugugcuuucaauugauuggcucauuugauucauucuuugaauacaagccaauuuuauaauuuagaguucaacuucagcaaacgauggaaacaauaucaccauugaauuuauguguaguggcaagcggucuauucaucacucacaaaauuaaguaugaaacauuugagccugaaauauuguuaauaugccaauagucucuaaguucuguuaguauguccuuguuuuuguuuuggugugugggugguaccauguauguuugaauguuagugggcaacuuuguaaguagcuuuucucuucucacucuggguccuagagaucuaacaaagucacacuuguucagcgagugguuuucuucccuccuaguccuguuacuggucauuuucugaaagcuuuaaaagaacagccuugaagaagaucuggaaaucuaacaggaaguaguaugcaaagcaggugaggcagaagucuggacuaaugacuaucuugugaauuucuuuacaaauuuucaauugaguuucuaaaacuuaauacaaucauuuaagaaaggcagcaagaaaucuuccaaaacauuuuaaauuucaaaagaacuaaauaauuuuauaaaacugacuauuucuuuuauucaaagccccccagacacuauuaucugugacacuguaagcaaauaaggaaacacaucagauggaauuucaaauuacaacuuuguuuaacugaugacagaaaaucaacuuuugauauuguagggaaaauauguccauagguuuuaggaaacacuuagccuuuaauauacugguuguaggacaggaagagaaacucagcaguuaguaucuauuguugcuccuucagacaccuugcauuuuguugccagaacugauagggaaccucagaaccugcuauaaccccaccucuaagugaccugauaauuucucuuaucuccaaaggcacccauacucacuuguaauucacucauagagauauagaaauaauaacaauaauaauaaacuuuggauuucaaauuguuugaagaccaauuguuucaaguuuccauguuuaagcuuuucaacuuaguuuauauauaguuuucuggaaguauguguuuauagaaaaaaaaaaaaaaaacagguuagccguucagcauuugacaggccuuuuaggugcucuuuaugugcuacaaugaauacuuuaccaaaagauugugaagaguggguccucugcucacucacaggcuagaaagcaugugaaagcaucauucaacacaguucucaacagcauauucuuguguggauggggcugcucuuauuccauuuaaaaucuauuaacaagcagccaccucauuccuuaaaauuuuaagcuagaaguuacuuuuuaauguaaauguaucaugaaguuguuuuuuaaaguguauuuuucuaugcuuuaaaaagagcugcuuauaacaagcuuacacaugcguguguugugccauuuguucacaaaggcuaaaugucuuuguauucucaaauauuugcaugucucugugucagaaaucuuccuucauaacauccccucaucuccaaguuacucuucucaucuucucuucagcauagguauauucucgacauguugauauugguuucuuuuagauuccacaugugaacguggucauguaauacuuuccauggcuugauuauugaguagucucacuaugaacacagcccagcauaccaucugcaauugaaacauucucuagauguuacugcgaaauaucuuaacaauacuucugucauuacaccaugggcuucaguuguuuaaaaaucuaucccuuuuccauauucuaagagggacuaaguuuuacuaagauauuuuggauccuauaauauuguagaauuaaacuuuauugaaacauaacugaaaagaugcucuaaaguuguguaucaccaccuggucucugacuuauaauuuuucuuuucuaaauauuucauucauuuuuccauguaugguaaaacuuucaaaguaacuugauuacaacuucugucuagacuaggugagauugcuuuaugcaugcugggcuaguuguaguuaguuuuaaaaauaaagauaagacacugaaaauguggacuaccucggcugcacuuaagcaaucuguggguagaugugcacacucaucuuacucuuucagaaucuuuccccgaauuucucaauggugucugugacaucaggagucguauacuucuccagcuccucacaggcauggaaugccucagauuucuucauccuucaccacacuuccuuaacaacaagaagucagaaguguccuuucccacuguccauuuacccuuguuuuuaaucacacucaucucuucaagaccuugagaaacguuuuuacagcagaucuguuguuagcucuuuaugaccuuaauuucugucuagaucuccauucauaccuuacauuuuuucuuggucuuuauuuuauuagucauuuuuauaguucuugucucucucucucucaaccccucucucucccuccucuuucccucucucccucucucuuaauuucucucucuuacccuaucucccucuuuaccucccuuccuuccccaucccuguucugugucucugucucugucucucuccucucaacucuuugggcguguuucuacuuuucuagguucucuaauucuaaacaucauuuucuuuguacucaaucucuucugcuuuguugaaaagcuucuucaacucaguucuauuccagggggacacaggaaaggaaauuacuaugcuuucucagugaccagugggacccugauuucugcaggagucuuucagcccuuuuuuccuaccaauccaaugaauucugcucuuugcaucauucuuuacauuuuguccucgaugcccgucuuaucucccuccuuuaucuaccaacccuccugcucugucuucccuuuuuucuucccuuuccuauuugcuuucuuuucuuuucuuuuuuuuuuuauugucaaugaugaucuugaauuuguuuugguaaaaaguuuuagaccagaaaaaauaaguguauacucacauacaauguaaagcacauuuaaaacacaacaauaaggcaagcaaccuaaugucucaaaugaauaaaauauuggaaaaacacuucaccaggugagauacaaaaauggaacaucauuugauaaauguacaucauuaguccuuugagaaaugaaaauuaaaaucacaauauauugauauaauaucaucuuaaaaccuggccauaucagaucuugaauucauacuucccuggccuccaccuccuacauucugggauuccaggcauacaccaccgcgcccaucuuuaacuuccauucucucucuuuucuccuggaagcauuucucccuuaaacugucagucucucuuauuucaagaguccuggcaucaggcaccuuguccaagcugcugcuauuacaguugaugcaacaugaaauuucugaguuaggaagaugauaucaccaaagauaauauuuuuauccucaguuguuuucauggacucgucauguaacucgucauucuccauccugaugucauuuaagacucuuaugauucuauuuuaauuuucuccaacuaucucaaugaaugauaaauaacucaccauguaaucuuuuuauguuuaauaguuuaccauuuucauaguuaaacaauauuaaucuauaacaacccguugucaacugggcuuuuuugaaauuagguauuugucuuuuuuuucuuauuucuuuuccuacaaucauaagagaacuuuucugcgggugugaguuagacugaugaugaccaguaaagaugaaaaugauuguguuauaucacagcaauauugaaguaggggucaguaauauuuugaacacuuuauucauauuccucuggagucaaacuauuguguucauaacucugacacggugagagguuucacagguguaguucucauuauaauauuuugucugguuguauuuuauacuauuuaucauaaaauuauuuuccuguuauaaagagauacaagccaguuauggaaguaaagaguaugcauuuauacuuuucaggcaaagagcuuggaguuuuacuuugccagauaaaguccucuucucucugugccucugugucucugucucucucugucuguguguguguuuacacacacauacaugccugcccgcauaaauuagucauuuacuuuuuucugcaauaguuacuccauaaugcuaagagcagagagaauacacaagaaagacaucaggugaauacuaaacccuuuuuugggaacaaagcuguaacuauugauuauguuuuaucuuuucacguuuuaccuaucuauccauugaaaucuaagaagguuggaaacaaaacugccuguuuccuguuaaacaaacagagaaguuuugauuggugaugccuuacucagauucugacacuuugagaauagauaacaguagccauuugaauuuuaaagagcaggagcauuugucagaaucuaucagaucaaaagaacuaaugucaacugaaagaaaauaucccaaugccucauuuugauugagguaaauaauccugaguguugggcagguaaacguacccucaccuguucucauuaguuuucauucauccucggguccauuuccaagugaagguacgagugguugaugaaagggagcuuugccuaccucugccucaaauugacugacuauugaccguugcugcauuugaaacucaguaaagaaugagaggguuuaaaacguagucuguucucuuaguucuaagcuugccauggagugugugugugugcuaagcauggaagauguuagguaaaauuaaauacauuauugcugauuuuuugucagaaauauuaauguccuuauauauuuauguuuccaauuuugacagggacaaaaccucaugugcauuugugaauaaaauauggaaccuuaaacauuaaagacaaugcaucuuucugaaaaauugaagaugugauaucuguuuaugucaugcacucauguaaucgucaauuucucuucaucaaacuguuguuaauuaugaaauuugaguuuauuaugacaccacacacacacacacacacacacacacacacacacacacauugcccaauaauuauuuguuccaaggaguccuggaccccugaaaguguucgguauugcaugcuaaacauacuucugagguaagaaggcagcuggaaaagaaaaugacaaaagucagacucacauugugaaccacuucaaugaauuacauuauuuggauuuucuuuucuaaaauuuauugguaggaaaccaagucugaguuaguguucaaaacugggcuacugggcaguguuucaagggucagcuggcaauuaauccucaugugacuaucuaauuuauugcuagugcaaacaaauaguuugguucuuugcuacauaauuuaaugcuggacaauuugggaguugcuuuuauuaacguacuagaauagaauaaauguuuacucuuuagcagguuauugauugccuucuuuuacauaagggauggagcugugacuaguuuugaugcauauuuuuaauaaugaguauuaguuacuacuccguucuuaacauucucuucccguuuccuucuuuuccuuuuuguucuuucucuccauuucucuccuccuucccccuacuuucuucugcccucccuuuaucucccaguugaucuagacaaaauaaccuccuucaucucauuuuuugucuucucuaauuuuaaagguagcacauuauuggaaauaaggaauuuggcacacauagguucauagugcuggugauuuuuguguggauggguugccaaguauuucagagaucuucaauuauggaaaaugaaacucgguccauuauagcacuaccacuauaaacaaaacgauccagaauguacuuuagucauuuguauguuuccauuuuaaccugauuuaucuugcuaucaaguucuccccugaguguacaguacaaauauuuccgucccaacuuuaucucccuguguguacugugcuaauacuaucauuaccauuuuaggugaagagugugcuaagcugcuuuaacaugcuccaaauuguaagacaccucuauuuuacucuguguuagaaauuucugugauaugggaaauuuugcuauacaaauauuguuaagucuuguguuaaguuucccauugagacacaaauuuuggugaaauauaucuaauucccuuaagcauaauuuuaauagucuuagcugguuagugacuacuagguuguggaaagagguucuagguaauuaucuuuguugccauauuucuguuguaucaauauuauuguuuuaaguacacucuucacauauaugaugaugaaguuagguuuacucgugucagguaaaugcauaugugaauucuuuaauugacuuuaagaaguuaugcacuuacaccaucuauugauuuauuuccuggaauuuguuuuagacuguaguuacaaacauuaaaaauuguucuuuuaauuuugucauuuuucccuuucuuuugucuucaaaguucugguuucaucaaggauuucucuccuuuaucucuuuucacaccugaaauuucucuucaaaagaagucauacaacuucuuuuuuaguuagaucuuaacagaacaauuauucaaacaugauuucgaagucucaccaaggcagcaacucugcagguaucuaccaaauggaggucauaguguguuuaauggaucccaaagccauaggucuguuuuauuaagaacaacagcaacaacaaaacaaaugaguaccaucccauauguucaguaaaaaguauguuuuucuaaagcuuuuaaaaaauauauagaaauuaaugucucuuuauaaaguugaacuaagauaauaugugaacucaauaaaagcuacccaguaacaaaaucagugggcuaaacaccaauauguagaacauauagcaaauacugauuuuaaaauacuugaaagguauuacagcggcuacucuauuuauaaaaugugacgggguucaugacaaaaaugaucaagcccuaaaaccucucauuuauauaguuauaggaauuaauggcaauucauggucauugucaguuaaaacaagaaauucaaaaugauacaauauaaaaaucaauaugugcgauugucuaaaucucugaaaugaguguuuuaucaugaagauaauggaaaggagcaauuguugcucuuacaucuuuuuuuuuuuuuucacacagaaauguauuugggcugaggcaagggugcuucugacaagauagaucacccgccuuugguuucucagugccacaugguuaaggagagaacucaccaaguucccauuguuauccucugcccaucccaguauacuaagucaaguguaacaccagaccucaauaaaaaauguuccauaaaucuuuaacuaaaauuucaauucuaaucucucucccucauuucuaaggugugccaaauaauagcaauauuucuagcuggagagauggcucagggugaugagucguugcugcuuuugcaggggauccaagugugauuccaggcauccauacaggcuaacucauaauugcacuuaagcgaaacccagggaaugcagugaucucuucuagccuccaaagacaccucugcaaaugugcaaaugugcacgugcucauguguauacacacauauccauuaaaaaaauaacuuuuuugaaaauaaaaagcugaaaagcugucgcuuuuguuuuguuuuggguuuuguuuguuuuaaguaccaccuuuuaacgagaucaagaugugugcaccauuaggacgacuaagccacaauggaugcauucauuguucuucuuugcuccuccuccacuaucaccaccacuuuuuaacacagaaugucauuuaccaguggcugauaauagucagugcuuaugaauguaacugugugauagaauauaccuucuuuucguccuggcauuauaaugaugugcacaguuccuuccugaguaucuguugggaaguuccuuaaaguuauuuucaaaugaaaaguguggggcacugagucaauaauaugucuucucauagaacuucuuuauaagaagguuuacaacauagucgugagaauuauuauccauuuuaacaaaaaaauccagggcaugcuaaaacacccaucaugcucaauuuuuagugucuguaaaugauuuguugcuuagauaaauauguaccagguauuucaauagaaguauuaauccuuuuaaucuuuauauacugauuauaauaaucuaugaucaguagaacugauagaacuuaugacuccuuauuuaaccagcuacaguaaccuuucuaaaaagagaaaagaacguaaauucugaaaugaauauauagccacucaaagaguuuaaugagcaacuuugaucacuuaucuuagucauguagcauuuugcagaccuagacuaagacaccaucugugugauaauuucaaugcauuugugcacuauuguauuuuauggagcauaauuucagcauuuugcauuacuuuauaaguuucuguuguuuauaaguuuuauugaauaggugucuugaaaguaacacaaauggcaugacaucuuuaugccucuaauguuagaaugguaaagaaaaggcaaucaaaauaaauauuugauuuaaaagaaauuuuuguaaauauugacaugguaaaacuauuuuuuaaaacugauaguaagaugacccauugaacaagucugcucucugauugcacauccuuaacaucuaugugagcaguuaggauauauucuuaucuguuuuuuauuguuuuauuauuuuuaacaaaugaaucauagaaaugauuaggaaauuuugaaauuuauucaaguguagauagcuucuugaaaagcuuaaccaauaauuggcuuuguuuucuggugcguuuguuucuuuaaaaugugguuuaucaacugucuuaauagaugcauuguucaguuuuuauauuccauuuuaaaaauuauuuuagaaauggaauggaagauguacauacacacagauacauacacauauauauuggauuuggcaauagccuacaccuuccacugaaccaacaauucauuacaauuuuaacugaaagaacuagguuaauaauuguuggacccgaaaugaaacuaccuucuauaccaccaaaacuuaacuggagacaugucuaucuucucaaauauugguaugaccauguccauuuuucuugauuuaucacacauuaugguugugaacuucagagagucauuuaaucacccauaauggaucuuaagagguccuucagugguuuuccuagcucauuuguauagagguagagacaucucgccaaggaguuugcauuaucaguguuaagagaauagauuuuacagaaaauaacuuucacaagugugcuuucauaauaagcacacuagugaagaaaagcauagcugucacaugucccaaaucuuaccauggugcaucuuucuaggcugugacaaucuccggaacaccaaacaggaggguaagucaaacauuggcauccuugaugccuccuucgugauucuuuuaucaaagcaccuuacacucuuuaaacguucugccuuucacuguuccuugugcuucucaucuguuucugugaaaaggaaagcuagaggauagcaguguauuaagggcuagauguuuggauguucucaguacaaucuuggcuuugcccuuaacagagcauguagucuucgaacaggaaaaugaaaagggcuaucauaggagauuugaaugauugcaauggaaucaacaugacuggacaucaguuaacuuggcgacuucauaaucaaaagaacagcuucaaguuuuaaaucaacacagaaguauaaggagcuagagagcuuccaagauggaagacauagaaaaggaauucaaagcacagacacuuguucuaauaagucaaauuccuuuuuuaucugauuuauugcauagaaauaaaaacaaauaaaaauagacauugaucgaguuuugcuauaggagcaguuuuagauaucaacaaugaucuuuaaaaaguguauauaauuuugucuuaaugauguacaaagugugcagauuuauccccucuccucccuucucuccucucacucuuccuuacuccuuuucuaugccuccucuuuuguuccugucucccucucuucuccccuuucccucucaguacuggggaucaaaagcuccaaagugggaucuugucucuguuagggaagaacacuguucugaagcccagcagcuagccccauuuucccaauccuacuguuuuguaauggagucuacccacuugacaacaucuacuacagaacaauuuuuagcuugauauuuacuccuaauaaaaacaaguugaauaauagguaauauucucagccuuuacauagcucauacacacuuagcuuugaacuuuuuccuuuuuuuuucacacuaugaagcauuuuaaaagcuuuucuuugcuaaaaauuccccuuguucaacagcacacauuguauaauguguuuaaacagugaacauuccugcaacuuuuucacauacaaaauuuuaaucauauuugaaaaggucaaagcuagcuauuuagccuaagucuauuauacauaauucauguaucacauaugcaaaaacagcacucaguacccgauauccacucacuaucuuauguauaugugauaugcuugauuuaauauuuacaucauggugacuucaaaaacaggcauaucauacauuugauagcuugguggccauuuguuaaugcccuauuuaacucagaauuucagcagcuauguagugacuauuaacauuuaaauguuguguaacuugacaaacuauacaugaauuuugcuguagaaucaauaggaugagcaucucauuuauuguuucuuaaauccuacauacuaaccaaauuauuuuuaauauauacuauuauuuuagggggccacaaaguaaaaucuuuuaaaacaaaagaaaauacuucuuaggauuguacauaacaguaauaaauuuagguauauaauuguaguguuuucaaaccaauauuaucaaagcagcuauaauaguacaaagauauaccuuaguuauauaagcucaaauguacacucuuaucuagauaauuuuauauuuuuuauuguaaaagaauugcuguacauauaaauuuuuaauguaaauuuacucucuuggaaaucugggauccuuagaacugauaugauugauuauucauauaacaaaucauaucaaggugaauuucaaauguuaccauacaauuuuguaaugcacuauacacacaaaaucacuaugaacucauaguaaaacaugaaguucuuucuaaauuuuagaaaaccauauuuugagaagucucuuccacuuuucagauuugggcauguuucaagaacaaacacagacacucacagguucagauuugaacauuuucuuuucuuuccuuauuuuuuucaugcauguugaauuuguucuugcacaagcaaaucaauacaagaggucaacagaauucaguuucuguugugucucccccaagaaacaauagagaaauagaagagagccucagagccagucacgcccuucaccucaucugucuccuggggagacagcugauuugcucucuguacaccagagcagaagcaagcagguaggucaccacguggcaccaacagucagaugaggaagagagacacaggagcucagaagguaaauguguuuccuuaggcucuguugcuuaggauuuccuccagugaucaaagaaaagcaacuuucauuuauuuuucucaccaaugauuggacugauggucuuggggauuuauagugagauauucaaaacaacaacaacaaaaagaguaauugcaaaggauggauuucuuuuuuuuuuuuaaauuauaauugcauauauuuuugcuuugcuuuuaguuucaggaaagggaauacaagcaaacauguguauuagguugaaauguuuaagagaguggagccaugcuagcacagcuuuauccuaggagguugcaaaccugccacacgcagaaguuuuggagccuacaggacacacagcagugacuuguuuguggccucuccaggaugaacaucacccaacucacgucagucacugaaucacaacuuaagacguacuuccugcuuucuaaugugcuaacuguucaguuugcagugagcaaaaaauaaaugaaccaguauuuucauauuuaugcaaacuaggcaaaggauggauuucaagcuuggacaaauauaaaggcauauuuuaaaauuacuuagcucauuaauaaggagucaaguagagagcaagacugucuuacgcaaagugauagaaauaggacugaggcuugcagguuugagucaaagagaccuguuuauuauugcaauggaaauuuaagauuuaaauugaauuccuuuuaaaaauauauauuuuauguauaucuguguguauaauguguauuuguuuggauguaaauauauacacauagaugccuaaagauaguauuggacucuucagagcuggagcgacaggcaauuauaaccaaccugacaucgaugcugggaauugaacuugggacgucuagaauuuuagggaguguuuuuaacuguugauccaucucucuacacuggaaguguauuucuuuuagauccaaaaaaaaaaaaagauauuuuuuuuaccauaacaaagucaguaacuuuaauuuuaaagcauauacaaacauacuuucugagaucauuaaauaauucuuuuguuacacaguuaaauaagccccacucuaucuaaaacaaaauaaaauggaacaaaacaaaauaccaucuuuauucugcaucauaaccaaguuuggcaacuuuuccauaacagcauuaauaauuaaaaaaaagccagugacaauuuaaaaaacuuuaauagcaguuaguuuuacaauauuguuugcuguuuauaauuuuauguuacaaauuuuaauauuuuuauuccauauuuguccagguaugaaauuuaacuuguggaauuacgauuuuuuuuuuguaguuuuggagauccuaguguaaaucuaaagagcauguguccaaaaacaugcccgaaauaaagaaggagguauaaguugcauaucuuugaccaaaugagugaauaaaaucacuauuaauaucugcacauuuucaugugguuuauucuugugcauggucauugucuuaccaagaaucuaaaguuaguuucaggaagaaggcugaaaggucuaugaccuuggauagcacccaggcuauaugcuccuuuucaguauuuuuguugcucuuagcucuuaguugaucuuaucuggugugugugugugugugugugugugugugugugugugugugauuucugaauuuuagaccaaugaauaacuuucuugaaaaaggugacaggguaacacccgcccacccauauaauuaauacugucagccgaagucaguacauacaugaaugcagcucuuucaaaauauuuccaccaguccuguugaugauguaacacaacgguaauaauuacacugacacuauggauguauggauaugaaucaaugucuacaaguagggauggguuuccuacuuuguuuaauuagcuguccuaaacaaaauggauaaggaacuuaaaauucaaugaauuacugucaaaauauaguuaugaauuuuauaacauaauauuuugaaaacuauaguccuuacuuuuuguuuauaaauguuuaaaaauuugaaaaauacaauaauugauucuuuuaaaguauaaucaauuuaccuugaacucaacauuuuuggaaaauauauuaauauugcuuugauuauuaauaaagaguaagcaauauagcaaagacauuuuaggguaaaaugagaggagccuguuuuccuaaggcuuugagauuugagaaaaaaauuaguccuguauacaguaacauugaaaacguacacucuagguuaucacuauuuguaaggcaaauaaaauuuaacuaauaucccauuuauuuaauuuagguuuuaauuauauguauuuuuaugaaugcugucuacaugacaguggagaaacauuucagauuuaaaguuauaagaaaacaugcuuucuaaauuuuauggucaaauaacucuauuuuuauugacuucacaguuauucuguacuuaaugccuugcuaugagcaaaauacucucauauuaaauugcaauucagacuaguuguuuauuuauuuaccuauuuauuguucuugacuaaugaccauguauugaaauggccaucaugucacugaagaaauuauguugaaagggauucucauguuuuucuuauuauauuuuggguuauuucaguccccuuaacuagaauaugauuucuaaaugcaacauauuucaaauuuccauuguggauuucaaaguuaauuaaaaauuuaaguucauaggauaacuauaaugagcacuuacaaaaugaauccucccuagaacauuguuaagagguuauauucauuugaagaauguguuuuuacuuagcuuugcacaauaugugccuuuaugacugaauauucauuuauuuuucugccacauuugguuuuauugucuuuucuacugucaaguuuacugccucugaaaaaaucuauuauaguuaaaaacaagaacaagaaaaaugaacaacaaaguaguaaggaaagaaguauuuuuuaaaauuaacauuaaauuauacauuaaagaaauuuuaaucaaauuuugaucuuaggauuuuuuuucgacaugugcuaaaugcauguguaaaauauuuucugauguuuaggagcauacacugguacacuaugcauaauaacaaguaagauagauaucucuaacaguuuauauaagaucaguuauagccaugauuaauaacucuacauauuuuucuauguauaaggaauuuuaaaaauauguaccuguuaaggcuagguaaaaaugaguuuaaguaauguugaguuuguagcuugcuaauacauacagugaacauaucaccauguguuuccaaucucauaacuauuugcauuucagaucaucaccacuaugccauauugucuuucuccaguuauaacauauauacccauugccgcccaauauuuuucuccauuuaaauuggcauuucagggauggauuaauguuuugugaacccaauagauuuaaauuugggggagucuaccuuugagaaaaauacaucauaauuuuuuuuuuucgagacaggguuucucuguauagcucuggcuguccuggaacucacuuuguagaccaggcuggccucgaacucagaaaucugccugccucugccucccgagugcuggggauuaaagguguguaccaccacgccuggcacaaaguauuauuuuugagggaaaaaaaaaccaacacaaauuacagaauuacacaacugggucaacacaauuucuaguauagaaaugaaggaaauaauucacuauuuuuauuuguuuauguucauuucauaauccuuuucucucaucuugcuauauuuauucuucuugauuaccuuaucauaggagagcaaguuuauacuuguuucuauguuaugcuuuaucaauuguaugggcugacuuccucuggcuucaaaauggcucuuggcaugugaaaaagguugucacuguuuuuaguaaugcuucuaucauguuucuuucauauaugaccuaccagaucuggguacauccuccacaagaucacuuuuguaucugugcauuucaaaucuucuacuaucucuguucuuaagagauuucuauaagggggagcuaugggaaucuucuacaacaauguuuaucagaauaguuuuccucuuucccaauucuauuucuacccuugguuuacuauguuaaugcaagguacacaggagcccuugggcauuauuuccuguacaagaauaucucuuuaaacuaaccuucugagucuuguuuuauaaguuauauuuacuuaacaaggguaacuuauuauaauaaauaggaagugaucaaacuugcuggaagcagagcuaugggaaugaucucacuagacaggaguggaaaguuccagaucuucaaucaggaggccaaacagccucuguaaucaaagggacacacauuugaagcguacaaaagaacaucacuucuuuaacaacuuauuuauccaguguaauuuauuauaauaauacuuauuuaacaaguauaauuuauuauaauaaauagguagcaaccaaaguuggagcaaguagagcuauagaacaauuuacacuaggcaggaaguuccaggaucuucaacuaagaggccaaacagucuagagucaaggugacaaacauuugaagcuaauaaaauaucaucacuucuuugaauccuuguuuugucccaacgagucuggaaaucacaauuaagugcuauaacccuuaauugacucagggauacuacugaguuuuaacauuguuuucuuucuugcagaaagauguaaucuuuaucguauuaccacauuccuuuaugucauuugucuggccuuuucuccucugcauauggaagccagaagcaucuuuucacaccuauuuguauuguuuuagcacugucucccuaauuagcucuucggaacccugaugacaccccuuugccucuucacgcucucuugcucuuuuuuaauaaagcuuuguaaaacaaucauacaagacagaauuuucugacggguuaucucgagcuucuuuucuauaaaugggaguaaaaggagcccuuucuuuaagacuuccaggaaagugugaaugugugcaaaacuguugcagaacauguaaaacugaagcuuuuucaugacuuguauaaaagaguagugcauauuaucuacauaaauggagauacuucaaugaguacagacgggagugucugagagcuggcucaguccuuaugaacacugguuacccuugcagagaaccuuaguuggauugucacaaaguccuugggguuccaguccucuccugacuccugggcccuuagcaugcacacaguacacacacauaccuuuaugcaaaguaccgauaacaauaaaaaucaauaaauaauaaaaacgucuuuaaaugagcacuucaguaaacaggaagauagagauucuguguuuaaaaacuauuuauuggaaauaucaaggcaggaauuuacuacaguaauacaauuuuaaggugaucauuccaaauuuggguaaaaucauauauauauauauauauuuuuuuuuuuaguucagauuuccuucuuccauaucaaugcaugcaucaagaaguguauaaaugauuggcuuaggccauuuuccccuuuuggaaaagaaagugacaugugauuuucuuuaggcuuugaucguucuauauugauuucuuuuaauuuuucagauauucuauaugauucuucuacucuaacugugaaggacaauguaguaaaaggggauuaagacuguguuucauucuuugccucaaauaaccuaguucacauauaaaucuuguuaccccuccaucuaaaauaggauggcauuggggcgaugacucacggguaacgcacuuauauagcaacugugaggacuugauuucacauccucauaacacagauaaaaguaggugcacucaugugagucuguaauccagucuacucuuguaagcuguaaagcucaaacaggagaaucccaggcagcuugggaggccagcucaccuuaagaacuacccuggcacacuaaguuccugucucaaauacauacacauguacauaaauauucauuuaucaaacauacaaaauaaaaugggacaaauaacuacgugcuuugccacuucuguacuuauggaaucaaaaaauaaaaaggaucauauuagguaagcaauuuuaccaucuccacaguuaauauugauuguuagaaugacguucagcaaugaaugguugaacaucugcgaccuguauccuguucaaacuuuuuuuuuaauaaggaugaguucuuuaaauuauaccaagcucugaguaccagcagaacugccaguuugguucacauuaaccuuuuguuguggugaauccgguguuguguuggaugcuuagaaauacucuugugcucuucccacuggaggccagaagcauuucaugcuucuguuaagauaaauuaaugucuccagauagugccacaauaucuuuuugugaagcaaaauagcccuuuauucagaaagauccauguuugguuuuuaguuuauuugauuuuuuuauuugccaggggaacauauagauuuacaagagcauuccucucuggaaaacccugccauugagacgagaguccugaucagaaguuuaucuuuucuuacuuuguuuucuugagacauuuuguucauauauuuuuuucgguguuuugaucucagauuuuaacgguucagugaaaccaaaguuauggauuuuacguaaucucacagucuuuacaauuucuauucgauaacauuuccuaguauuuucucacagcagauuugccaaacuauuacuaauuauguggcaacuaggcuauuugaaguauuucuccaauguuucaacuuguuuucuuuuuucauuaaaauaucuuuuuccugucucgauuuguauaacauaaacucaaaguuuagugaauuaauuuuuccagaaaacagaaaagacuaguagaauauauuaaauagagagaacaaucuaaaacugcauaucaaucaacaaguaauauuuuagauuucuuuguacaucugauaaagugagccucaaguaaguuuaauaacugugcaaaauuuuauucauuauauaaucauuauuuacuuauagaaagcuuuuauguagcccuggcuauccuuaaacucuugauguagcuuagacaagcuuugaacauaucuuucucuuguuuccauuuuuccaguacuauuauuauagguacaccucaucauuguuagcuuaauaagauauuuuaaaauucauacuaugcuaauuuucuucaaauguggcuugaaaguacauugcuggaaagcacauuauuagugcuaauaaaaagauguuauuuuucuuuucaccaugcuccacauauaaucuugucaauaccuuaugaaaugucacuaugcauuuaaaaaacuauagcauaugcugggaauuaauuaugcacucuuauuuuaauuagguuuaaugauuuauguguuugaaggaugguugucaacuuuugguccuguagaauauaauuuggugaaaugagaaguuguuagaaaauuagagaaaccagaaugaauuuguccagugauugcaaaccuaaauugaguuuucuuuugacauagauuucacucacgaguuauaaauggaaaccuauagcaaaccuuuaguguccauccagucgaagcuagcgcucagugcuuucuuuaaaucauggcagugggggcaguaaccugugcauuuccuguuaguacuuuauuaagucauuauguaucaaucacagucaccaaugaggcaguuacucugaauuuuagcuguuuuguccauaguaauuacagaaccgaaauguccuuauauguucuguggacugagcaauccuuucucaccaaacauggccuuugagaguuuucuuuuuuucuuuucucaucaaaacuauaaaacaaaauaauagagcauucaguauguaauuucugauaaucacaauauuuuuaaaaauauauuaucaguaugaaacauugaccuacuuaagaaauuccaucauauugguaaauuuauucuagccaaauuuaugcugauuaccuuaaaauauguugaucuacuuuuauaaauauuauauuucauuaauuacauuuaaauccacacaaagggcauuacauuuacuauauacuugcauauggcagaaauaugcaaguuugaguaaucacacauucuuacaacguccccacauuaaauagcaagggaaauuuaauucuuugacugugcuuguuaaugcauuuauauuaaguuucugauauuuggauacugacucccaaagaggacuuuaguucuggagaaguaucagaucuccuuugccucaguggggcccuggcaacauuuaaugaggugaguuuggaaagugaguaugugucuuugucuuccaacuuugaauuuccccuucuuaccacggcccugggaaacucgcuguacucucuugcguuccuaacauauauuccauguagacuguguuaauuuucucaaaucuguacaugaucaucucuagaggcacccuucuagucuuaguugguaauaauuuuugucauauaggaagugcauagaaaaacaaccaucaugcauauuccauuuuuccuacauugauacugacaaguaaugcuauaaagaucaugagacaguagaagacguacacuugagcaugcaauuggagccucagcccuuucuuguucauuccaggaaggauuuguagucauuaaacuaguuacuuguugcugaugcuuuguuugggguuugacuuucauuuuuuuauuaaaguguaaaaguuugcaauccuguccuauaguaauuuacggcaacaguaaauuaacuucuacuaaguaaugaauggcaaauguaugguaaaaaugaaucauuucugagaaucuuuucauguaaggaaggauuagauggucuuuaaggaauuuaagaaaauuagaaaauaguuauaauaacagcaaauuauguuaaaaugcaauauauuauuuaauaagaaaaauuaguguucucauucuaauuucuguauuuuuaacagauuuucaaagcaguaaggucaggcuuuuaaccacucauguuuuaauaguuaauuuuaagacaauauuuuuuuuccaauauuugucuuugugugugucugugauugugcagauguguuuuugcauguccgcaugcauauaugugagagugagugcauauguguacaugaguaaguucauauacuagcuaaggcuagaagauguccuaguuacuguaaacuggaguagcaaauuauaggcaagucugacacacccaugcauguccuuggagccaaacucaggucaaacucuggaagagaguaguucaugucgacagucacuggguguuucagccacccagguaacauuuuuacucuugauuuuuauugauaaaauucaccucuuuuuauuuaccccuacguuuguauauguuuugugugcacaugcauguauaugcacacacauguauaaaugucuucuaucacugcccaacuuauuauuuaagaaaggcccucucgcugaaccugaaucugauugaguuugucaaggugacuaaccagaaaucagauacauccugucuccaccucuccagugcugaggugacagauccuuccuaucuuccagauguuuuuaugugugugaugauggaauaaaugcagagccuucgcuuaugcagcacuucgcuacuugagccaucucccaggcaaccuuaugucuuuucuuuugaaguucuuuagguugauaugccuacucagcccaagucuucacagcucuccauuccugcccgggucuagacuaaguaggagauuagugggaguugacagcuaauuaagauuuaaauucaaaugugaaaucucuaaggauuuacuuggguauuuuugugauacccuuugucuuggagaacuauagcaagacuuagccauccaggucagcggggaguuacugaggacaagcugaccauggugugguguaggcacagauuugugacuuuacaauagcauaugcucuugagccauuauaaaagccuuacuggaaaauauagauacagaacuguggacagcauacguugugauuucaaacucagauuauaaacugucugagacuuaaguacauucuaguaaggaaagguaggcagauuuugagaagagaagaggguuucuuguaucaguccuagagucacacaugggagaaugcuggacuaaaaaggcucuaaaccagaacuagucacugccaaaugcaagaaacacuaugcuuacacuggacagacuuaugugccccauguaugcaaagaggaggagagggcauaaacuuuauggaaaauaauaagaugcugaaaagguauaaauauguacagaauguacaauuaccauauaauggugcuuuuauuuugcauauauuaacagauuugcuuuucaaaugaugcuauaguuuuggcaacuucacauuuccagauaaaaauauagcaauauagauuuguuuuaaaaaaggaaacuucgccuaaaauaaagaugugucccaaauuagaaguccuugugaauaugagaucugugaagaucuuuagggaaauggcuacaauuugggacuugguugauaauaguaauucauguuuaacaaauaaguguaaaacaagggggcccaucuaaguuauagauguuuuguaaaaguugaauucagauucuauucagauacuugcugagcaccaguuuguauuucaaauauuuccaaauuuaugggagauagaauaggccaagugaauauaugcuuuuacaaacuaguuuuguaaugaguacaagacaauaugagccaguguuuauauuugauguguuuauauauucaucacgagauuguagggaucuuacaacaaaagggugccuaauuuuuuucuugugugugagugaguguguguguguguguguguuucccaugucauuuaacaaacauuugcaaaaaauaguuucauaucucuggggggggugaguggguaaauuuccuauggagaugggggugcuaauugcaauaaaaacaaucuuauuagacauuaagacauaucuaaguaagcuaaauuuugagugaaaucaaugcuaugauagguauuaccaaacaaaugaaauauaugggaaauuuuguuggaagaagauaauguaauacucucugaccaaaauaaaacaaaauacuagagugcuucauugaacuuuucuguuuauaaacuuagcuuuuuaucucagaaagaaguaauacauaauuuuucaaaguguucaugucuauuccagagggcagccugaauuauuucucgacaugggcuucugugaacuguuacuguuuuccccuucauaauaggauucauuuuauauuauguuaauuuagaucauucguaaagaaacaaggccauaaauagacauugcugaucuucagauuuucauaccuuuugagaaguacagguuuuuuuucuccuuuuauacaaaaaaaggcuacuaaaaccucaaaauuuuuuucuccuuuuugguucucuuauuacuucaaaaauucaugagcauaguguuuuuaaauuuagguuuuaaaaauguccucaugcugaguucuuguuugccaaguuuuaguuuggagggaauuuuuauaacugaaaagaaaaaucugaaaauagaauauuuuaaauggaaauucucacacacucugacugugagccacaaauguugccaguauuucagaaugaaggugacuuuucauuauuuugguagucagccaugacuucaugugauuaugggacagaauuguguuuagcauuauuguguuaaauugcuugaacauacuaagauuugugaccauguuuuguaagagagauauuugggcucuaucaaauauaguuuauguuucagcagucuguuaaguucaucucuuuugaauuaacuuucacauuuagcugaaagucuaguuucaaauuuacucuggaaagcagauuucuugucauugaauugaucauagugagacaucuuuggaagccuaaaagauuuccuuuagaaguucuuacucuaucacuuucaucaugugaacucaaaggucagcuauccuuuggggaaacccaguuuauaucacaugucugucaggucccaauagacuuuugucacuucucaucucuguacggggauuuugggucacaggaaucaaaaguaacacuuuaaaaauugauaaacuuuuugugacacuugcuccaagccagagccaguguguuauucaagacgagagcaugagagguagucaaucuuuaaaguuuggaaacagugaaugugaaaugcagggacagagagacugagguagacauccaggguggacaggugccacauccacgugagucaaaaccaacaggcacaaaagagagaaaaaagaaaaggugaaaagagggacaauaauguuuauacauuccauuuucuuagguugucuccugagaaauaaauuucccagaagcagcauauauuaauuuuaacccaaaucucacagaacauuugaguaauguagaaaauuuguagacaucugcugaauuuuauuuuaaacauaauucacaugaaaggagacaaaguccuuguuuuuccuggaaucugucucuucucuuucuucccacagagagacaguaaguccagauuuggcugaagauagcccuuuuaaacuauugacauguauuuucucugauaaaagugccaccaaagugagggaaaauaacuugaugaagaaaaacaacaaaaggaauaauacauaaaacaaacaaguuuaaaaaauuagugacuauucugugagacaggugcauaaauuagugaugggauauugcuuaacuacuuccugaaaaaggcuacuuccucaauuuaaggaggcuuucuaacaucugugucuggaacuaauucugauaaccuugacauucaaaauggagauaaaggauagauaacuauuuuuaaaaugcuucagcauggcaaggggaauuaucuaauauugauaaauaaagcaacgugacaucuguguugaauuucaaauugacugguugagcugaaaggcgagggucuuauugucaagauguaaaaugcauugggaagagacaaggucaaugcugauuuaugacucaaugcaaagcccuuucauucuuaaugaaaaucucucucaguaagaaauuggcaguugcagaacaguguuuugcgagaaguuuuacaguuuggggugggggcggucuuaagagagacaaugacucagaaaaagaaauugcauuaguggguaguuuguaauguauaacuuaaagaagagcaaaaauaguaguuuuuaaauaaugccugaaucauaguggggugaccugagcucuggcaugugcagucaaucaaaucagugccugcaacugcaguuuucagaucucugaaccaaaauucuucgcugaccacugaaaaugcauuauaaaggguaagaccauggcaggccaauucaugcauacaugucucagauucuucacagacaacugggaacuugaaaauggcuucuuuacuauuuucugaaacauauuugucauggaccaacuucauuuagacucuccuugugaagauucaacuucaguucuuuccuucgcuuccccaaccccuauaaaaugauggcuccuuuuuccaagaaggcaagugaaauggugguucgguugguucacuauugauuuagauacgaggagacaggcucgaacugagauuuaugagaucaugacaagaagaaaggcagaggaaguugaaugaauguugguggugucuucccagucuacuuugaagcuaggugauaugguuauggguuauuuuuguuuuuuuguuuuguuuuguuuuguuuguuuguuuguuuugagugaaacgaagaccaaaaggggaaaacaucucauggaacaggcuaagaaacugcaguuuuuacuuguuuggcuuauaagagagcaaccagccaugcuuucagaagggaaaaguguuucacacagagaaucccuaagccucccugaaagacuaaacuaaaucagcgaugauaugaggaauuuccuguuugagcccaucuuguuaagacauagccaggcuccuuccucaacauuuaugacucaacuuuguuauggaucgacuucuuucaaacuuuucuaguggggauucuauuuggguugauuuaucagucucucuuuaaaacguuuaagaaauuucguuaguuuuggagaaacuguucaccaaguuguaugaugcagaaaauuagcaauauuaacaaaaccugaacugauuuguuuaagcuuagcauuuggcuugcgcgucuauguuugccucccccaugucacauacauugcuggguccugcaguggccaccauguucucuccaccaugugcaagaaagucccugacaauguguguuaaaaucucuguguucucugcccccagugucaugccuuacaccuagcagcuaguccagaaaugggaauaaaucaauaaaugaaaucaucacuugcuaaacauaagccuucuccugggaacacacuggaucuauuaagaaagucugugucuguauaaagagaugggaaaagaagauguuuggguuuagggaaaacauccuguaaguuuauucaccauuaauuuuuaagacauuuuaauauaugagugaaaggacucuguaauauuuauugcuaguuacuugcacacuaacauguucaaagaaucacuaagaaggauuuuaaggcaugagagagaauauuugauuagcuaauacaugucuugaguacaaacaaaagggacaccuaaaucuucauagguaaaaauuuacauuucagaacuuuuaguguucuaaaauggccagugucuagccuuuccagaauacacugaaagauauauaacagucacacauacucuccagagauguauaucaagguauguagaguguuggaacucauugucaugagaaggaguucuagaaaacuccgaauucagaaaguacagcaaagcuccgaggaaaaccuuccagcuucuguuuuuucugcuguucaacacgauguagaaggaaaugcucccggauuuaauggccauuaccugauggaaaacagacguccucuggguuguccugaagcauacugaacgggucuaaaugaaauuagaacaauucacugaggcagagaugguugaggaaaacaaaugggcaaaaaccaggagcuuagcacauuaggagcacacguguuuucaaaguugcccuauaggaaguguguaguacaaagggucagacuaaacauuuaucugaugcauagagaguauucaugucaguuagcucuaaacugaauggcaaaauucucuaagcuuggccauuuuaagaauucugccauguuuaaucucaaaggguuuuauuuucuuuuucacauaaaagcggguccgugcuaucuguguaggauccaucuuauuuaugauauguggugcuuccuguuucaccaucaaauuaaaaacauuugcauauugccuucagaaaaucagauuuacuucuuauuuugaacuggguaguaguucuggugacguggccuuacagcuguauuuucuuucaacuaaauaaguaugcucagguggacauaacugaagagacaaugacaugucuuuuuuuuuacauuucaagaaagcaaguuguucgugcuucuuucagggaauaaaggugacaaauauugucauaagccccccacuuguguaauguuagauauauaacuucucucccacacagccuaguggaaugacaguguaguuuuaaagauggaagcaggguauuaggauucacagcccauguggaagcuucacccucaggccagaccuauagcaguuguaagaaaaugauuuauuucuuguaauaaauguuacuucucaaucuauuugcuuguucaaugguugcaguccccaaagaaaaggucuaucuccaauuaggacuggcauguauuaucugucaacuuuauauaguacuguaaaagucauagagcugacaguaauauuagcaggauguuuuauagaucuugggcuguguaaggcuuuguaugggugaggaugcuauggguccguggggcucugggguccaggauaagguugcgugucgaugagucguugcugugcuucuugguaaaugaacaucuggcucacauauugacuccaugugugaaaaugaggucagcucauauaaugaccagaaucaaucaggcugcagccgaggaguaacauacacuggucuugauuuguuagacaaccagaauuggcagcaccuugcauaauuuggcaccaauugacaaagauuaggcuguuugggggcccuggaugguuauuaauuugaauccccccuuaaauauuuugcagaguaaaaucagcuguaacuuauuuguccugggcuccuucuuuucauacuggcucuaauuguuuuagacaaacaagugagcuugcagccuguucacuuugcacaggaagacaugaauucuuugauccauacaauauucuuuagcucaaccuuggagcuauuuacuaaggagauuucuucgcagacagacaguagagcaguucuuugugaggcgaaaugaauccagcuucuauggguuucagcucauauuucuacuauguaguuacuguacgggagauaaagugaaccaucuuuguuuuuaagaaaacuuagggcuuuuuuuuuucuuuugcauauauuuuugaaaacugaaaaugauuuagacuuuugaccugauuauuuucuuuccaugcuuuucacucaugagaacagagcuagacgucagaaaauggccaaauuuauuuugcuucagcaagcugcacaauccagaagcaaaaaauagugugauuuuuaaaguacuauccauauuuauaguaaacauuuuggaacuaagacacauuaaggaacuuccagguauaaaagccugccugggcuuuaugaacaaacaggaggcacagaagcacagucaugauuauaaaguguaauuuaaaaauuaccuauuuauuacugccaguagucuuagagguauagacucauuuacccugaauuuggaaaauuguauuugcauuaguaucucaacugauaccuaguuuauccuuccaaccaaaugacaugcauuuacauaguuucuuuaaacaacuuauacauaauucacacauauuauaauaguagaaauaaaaggagagcuucauaaguagguuuuuauacaguguaagacgugaaucccuuuaggacgcuuugauuucuaguuaaaacagaugagaaaaauauugaaaaaauaauucucaaaaucucagagaggaauuguaaucugcaucuaugauaaugaauaauuccuacuauaaucagcaucuaauuuugggggccucuugaaaagucauacucauuuuuaccauauuuguuuuauuucauguauuucccccacauaaauuuauguaauagcuaaaauacacuuccuuaaacaacgacaauaacaaaaagcguagacuuuucugauuuuuuuauccucgaucaccaagcucauuaacaucacuuauuguguguuuucuguguuuuuguaugauuuuaugaguaacuuugagaaaccuuuggaccaugucagguaaguguuuauaguucauuaacaagacaaagugcugucauugaaagaugaagcaagccuaacuccuaaauaaaccaugauuaauaaaacauuuuauacccugggauauccuuuuaaguuguagauugaugcugaugggaauuuucugaggcugucacacuuugggaguuuuuugcccuucccuuagacaacuuccugaguugagaaacagaacuuuucaagggaaguaguuuuucaaagaguaaacacacauuucagauuuuuaaucgggaagcuuuuaagucuaaacaagcauuccuucuguaagucuucuuuuucucaauccuagauuguccccagaaggcuuaaacccuaacucugguaaacaaaaggucaugagucccugccagaugccucacaugaucaauuuacaagaauuuugacuaaagacauuggaaccaaaugcauaccucucagaggugugcggauuauuuauuugaaaaacauaaaggcuugaagaaaauauaaggggaaugcaauaauauugauaaaaaaggaguuuuaaauccagaccguaaagugacacaaucucacacaacagauauaauaaguaggacacuguuaagguguuacuugggugacgugcuagaaaaacggcugugagugcuugccucgcacauuaaaaccauuucagcacacauggguuuccugucuuuuaugacuagccccagguaagaauucuugcauauuaaaaauauuaccaccaugauuuuaaauugaggccaaguuuuguuucuggaaugugugauaauucaccauccugucuacacuguaaaugaaaccauguuagcagcaaugguacuuaaacaugguuuugguuauauucucaaagguuuuuaaagugguguggacagcuuuauauuucauaagaugcuucuuugucuucuuguauacuggcuaauuuggaauaauucugucauuuaaaccauccauacaugcuaauugacaaugacaguaacauucagggcaggcugcagaugucugucuucuguuucccucguauuuacacaagaguguuugcuugguauggugaaacauaguuuugccaaaaugacagauguugggauucucugccugggaguaaagacguauauccuguaccuuauaaaaauggcagccuaaacuguacaugcacugugguguauugguauaaaacauuauccucuggugggcuuccuggggcagguuuucauagaccucaauaaaguucacauuuuuuuuacuucauuucaucuuuauuuuauuucagauguaauuuuuguacauuuuaacuagcuaguuacagaauaaaucccuccuauaggagaucacuuauuuucaguagcaauagccucagagguuuagaauacugaaccuaauauuuucacggaaaaugacuguuaccagcuuaccucacagucacguguccuguacugggccacaaaauguauuuucugccugcauccaacacuuugucuuuugauggaaucuguuuaaaauuaaaggagaggaccacguuagagaugugugguuucaguugcaggcacuaugauuuuuauaaaaccaaucugaauaaaauuacuuaaguuuucauugcagaaggggcucaaacacugaaauaauugucacaguauauauuaggaaauaagggucacugauuuggcuugauucauuuugucuaucauuucuuuuaugauacaacugaaaagugggaaauaguuuuauggugagcccccucaaacagaccagugcuuuggccuucuuaugucugguuuguauccuuaaugcccuuggcuaccugaccuuuuaaaaucccucccuuuuccuuuuaaaagucuguuuguguguguguauguguacucuagguaagauacaauaugguucuaaaauugaauccauagcagaguugaauuuauaauaguccaugacaaaauggaagucaccagaaagugagaaagauugacaaauggaacagagggcaaggaaagugcccuauaugagguacggagcuagacuaaguaagauggauagguaacguguccuuugcagaucaacaaucuaaagauucacauucagggacucugaacagccaucgggaaaacgugcugucuaaagguguacacaguuaucuccacaugaacaauaauaccaaauaauggaaaacaugcuuuuugguacuguauugucauuggggcaaauuacagaauuuccauaugaagaaggaagaaaaauaucuaucuaucuaucuaucuaucuaucuaucuaucuaucuaucuaucuaucuaucuauuuuucaaacccagaaauaauguccagaauugaagaacuggucaagucaaugacaaaauucaugguguguaucaaaucacauucuugugucuuucaaauuugcuuuucaccuuuauauuuugucuauauuacuuuuaauuuuuucuagaccugacaaagacugaaaauauccgacaaagccauuuaauuucuaaauaaaauacuuuuguuuuauauuuuaauuugaaacucaaugauugaagauacacuauacacgauuugcucugcuucaaaauacugaaauuauauuucuuauagauauauugaauuauauguguuauauauacugaauuauuauguuaauugccaaaugcagacagugaaucaagaaagcauuacugagaaaucaguuugacuauuuuuauuuaccuuagcagauuuugcuuucuuugguggcaauuuuugaccauaaugcuguuguugaauugccuggcaauucaucaucauuucucuuauaucuuuagauguuacuuuuaguaauuuuaacagagaagagagaggaauugggaagguucauuacuguauugugcagaaaugaagucagauuguuuuuggacauuaacuuugaagguuuaguaucgaaucauuugucaaaacgucuucauuaugauuaguaauaagcaucucuccgacuaacacauugugauacaucuucuuaaguacauauauacaaguauguguacauauccucaacaugaugcauugagccaucaugucugagagacugaugccucuugaguguuucuaguuccucuuucagcuucaugaaauucacacaggguaggcuucaugagcaccucgugugcuucagguacugugaauugaacgcaaaguuguauucaauccauggguuugggggcuugcguagauaccauguaagcucgggccuucagguguuuuagccuuuaagucucauacauguccacauuuucauacuuuccacuucuauuucaggucccuugccugugcacggguccgacaucaaagagauaagaggagggggcugguaauuggagauaauuagccuuucauuucucuaguuuuugaaguucaagcuuauuaguguccuggcuuccacgguuuuaucaucuguuuugagcuguuagauucuauucuuugugagcuuacuucauuuuuuuuuuuuuuugauccucacgcauaagcaaacaaaagcuaacucagagaauaucaugacuuaacagaucuggcacuagucccauggcuguauuuuguucugucaaggaaaacacuggguaaaaucugcugccuaucagaaggaagcaguguuugucuucuagccgauucuauuccuaaucuacguuugagcaccauagaaggaccugucuacugcauaguucagcauguaacaacagacacagcuacgaaguagacuuagucaccuuagguuuuauugaauuuggggaaauuucuagcaaacagacaugagaucauguacauuuugggagaccauucuucugucagugagaaugauggacugaaauuggcagcaacuggguuuagagaugaagacugggaugaggaccuaagucaaagcaaaagaauuagaggugauuggauacacccuguaagaagcaacagugaaucuauuuugcugccagcuaccacaguguagaaaaacuggagcguuuucaaagagcgagaaauaaggaauugauuuaauuuuuucuauaaguguuuaugggacucagcuuagcuaugauggauuuuuaaaugaaacuucaaauguuacuuuuugagauccacgcuuuagaacugaaaucaggugaaguuauuauuccaggaagacauuuuauguugcugaaagauuuggauuuaguaguuuucagucauugguugaaaaucaaccaugaaugagauuuccuaccgcucacagcucccaagacagcaugagauuuguagguuucaguguuacacuacauaacauuuuauuagcauauuuuccuacaaauguucugccuuuugacuaccaagucaccuuucaauuccucaccaucuagcuacaccuagagcaguguccacacaucugcguguuuggggacugaauaaacaguugggauuaaaugaaagaaacguggagugaaacaaauaaaauccugggacugaugugauuuaaaauccucauuucuagugaguauucaaaggacuuugaugagaaccagaagagacagguggguacugacuaggccgaggaaaggaggagacaguuauaaauuggagguugcuaacucugagagucaguuggcucccaaauccaaauaugugacugugggacaaugcacaguaggagaaaucacuccuuaccaauauaugugcucacacucgggugaugugugguuuggacacuuggcuugacauuugaaguuucuuauacugucaagaauauguaccaggcuuuaucugucuucuaaaauguacacaucuguuuucaacucaggaaaaugacugagaggcaaccucuuguucuucuucacaucgaguuauacacggggaaugauuuuaaaaaguaccauuucaaugggauuuuauuauguaguauaucauauagacuuuauauuauaauagagacuaaauguacaguuuuacagucauuagaaaucacucaaaggugcaguucugcaugaauaaguucuucuuauggaauucaggaagguguacgauagcaggguggacaaggaguugguuacguuuuaagugaugaaggugggcaacuaggacaaacugaaugagauaaauauuaccaugacugucuuaauaugcuaaacauauggugcauauuuuaagauaauaaauccagaacuuuucuagacaguuuccauuuauuaacccaguauaucaagagcuuuauauucuauccuagcucaguacacacacacacacacacacacacacacacacacacacacacacacagagagagagagagagagagagagagagagagagagagagagagagagagagaauaguuaaauuguuuacaugaagaaaaaaauucaauaauuucucuuuauuuguuuuauuccucuucguuuguuuuucuuuucuuuuccuuuuuuugucccuacuagcaugccaaaacaguauuucuuuugcccuugagaaaugggauagaaauacacagaacaauaccauuacuguagaaaucuguguguuucaguaaauacucacaaccucugguucuucccagggcuuuuccuuauuauuauuuuuuauauaguuuauuuuuuuucucguuucaauacaagacuucgucuuugaaacauaaucauuuaaaaaugcuaguuccuuuuuuauauuacaaaaccuagauuuuuccaucuaaaacuaguauucuucuuguauacuuggauuuucauaggaaagugaaaauugaagaauaguuaaguuucaauacacaugaaagauacuauaaaguuuuguuuuugcaugacuuaaaccaauuacucugucauaagugugcagauuccaacaggagacaugauaccaaguuccuuuauuggaugcagacaagcuugauuuucuuugcuuuagauaacagaacuauuuucuuucaaacauaucaaacucuuuaucuaacaaguuaaugccuucuacuaaaguuuaucauguuuuacuggcuuguuuacuuucuggguuccaaauaaguaaauuuuccagagugagaaaugauucuucaguauucaagccuaaaacaccuuuucuaagguauguuguugauaauucccuaaagaguugaaguuagugugucaucuuuuauugcucucauaaauucauugaauguuguauauuucuuaaguugucuuuauaagauuuaacauauuucuuugauuuccucaaucucuaaguaauauguaauucugucuaguguuuuccuaaguagaauuuccuucccauuucuauuuuguguuuccaauuugcugauaauuagauguagggcccccuuguagauaaagcuuucguacuguauuuccgaagggauuguguauugugauagagagcaucuagccuguagcuccuugacagccacccauuccagugauaaaucagugcauucaaagauuaauuucucaagaagauacccauaaucaaaacuaaccccuccaauaggugcuguuuacaaaggcucauugcgugacaccauuuaaguugauaccuuuguguuuuauauuuugcugucaauugauuugaucuccucuuauuuccaccugaacaauauaaaacagaaaaccugcuugcauuuucuguuuuaaguuuccccuaacaacugauugaauugucccuuuguguucagauaauuucuauguuuaacuuguguugauauuacuccuguuuuucagaaaauauacucaagucaccuugguccauuuuaaaauuugauguaggccucaaauaugauaagaagaaauugauauuuucuauagcacaugugaggaucaaaugcuggaccaugugauccuagaauuaaguccucaggagaaaacuguagaugacauuucaugucaauaucuuuuagcuucauugucuaauaguauauaauuauuauuuaccuugcuuuggacaugucaaaaaugacuugaggcaaaaggguuuaagauuaaaaaacaaagguuaguuuuuucuaacucaaaacuugaguuagaaaguguuuauuacaguagcuuacucauuauaguuagcaaauuugguacaauauugaagcuuacauuuuggaaguuuucauuguuauuacuguuguaguaguaguuauucauugggauuuuaaguuguacuaagucacccugagaaagcugaaacacauuggcauuguugguaguugugaaauugguauuuuucuuuccacucaucauguucagauucacuucagcuuuaauauaaggcauuuuacaagauuuguuacuguaucaacagaaagaaugguuguuucuccuuucacuguuucuguacucaaugcuaggcuauguaucagaaugaaaacuuccugcaggauauaaccauauuuaaacuuuuaguccucuuuuuauccauuaagaauuuuuuauuugccuuuuguugcuguuuuuguuuugcuuuaagacaaugucuugugauuuuaaccaagacugggcuagaacucauaacccuucagccucagcuuucuuagggaugggguucuagguauguaugcccuuguccagauuauuuauuuuuguaauuucauauagcaaggccuuuauuuacuugcaaagaaaaauaauuauaucucauuuuggcucuauuuuuuacauguaguaauugguuguugaacuuaaggcaauucucaccauguuguugcauuaaaaagucuucuaaauuauuuuauuucaaaauauaaccauugauuagaaagacuaucagccuuggagccaaaagagauagauucuaauuguauuuuuugacaauuuguaucugaauccuaauggcauuucagguuuucuaaauuguaucuuaauuugaauuuauuacaagacauugccuuuuaguacaauuauuguaagaaauagaaaauggauuucuuaaaucauuugugaagcaguaguuaauugucaaacagaugcagcuauuaauucauugcaugagguuuaagaagcagugacgguggaguagagggaauucauaaguuccuuuaccuauguacuuuauuaaaaaaauagcuaugguacucgauuaucuggaggaagauuggaagacuugaaaugcccucuucuugaagauaacuaauuacgaaauccuguguucaauucaacuaaaauuuucagcccaauuggaauccauugugaguuuaaccucuccucugguccacucuuguuucccacaaaccuuuagcuuucuaagaagucugauauugcagaaacuuguuuuccaguuauacagaugagggcaaaagaguguuaguggauaugaagguaaacugauacuguuucaaagaggucacacucaacuguaagaaguuguuuucauucuucacauggaaaaugaggcagaaagaagauccccauucaguaaaugucuaaugugggcauuucccuuccguuucucuuucugacauaauuuggcuuuucuuuuucucucauaagaucuauuagacuguacuacagguuuuaucacugaacuaaauaguaguguguuuccuugggagcgauugaacaacagaguaaaacaaugcuuaguguuuccuaaaaguugugugagauugucaugguaauacagcguugcaucauguugucauagcaaccggaauuauaaaaaacgaauuuaaagagguggaagagauacccuuugauguuauaaauccuuuagcuuuaaagauuuggcuccuuuucagcuucuguaucuuuauuuuauuuugauaaaauguggaagagagguaauguccagggaauaaugggaacucagauuucuacccuggugaaaagcuacgcuaucuuugagccagguagaauucaggguacaagguagaggaucaaauccauugcugucaaccaucccaacucccaccaggaauucuacuccaagaggauugaaaauguauuuuuucuuucuuuaugauuaugcaugguguuucuuuucaagcaaaaacaucccagugccuccacugaacaaaaacauuauugagagcucuaugaacugauucuucaaacuuuaucaggcuuuggggaagauugcuuuucucuguaauuagaaugauuuaagucauuaugguugcucaagagguuaaaccuugacccucgaggugaaacacuaauuucaaugcuaaaccguuacuauuauuccauaaugggagagaaaaaugcaguacaggcacuugagacuuuuguuacuggaguacauccgaugagcuccuaaagacugaaccagaaucaauuuaacuuggaagguuugcuagaaaucaauuguauuuccugugccuucccuaggcuuccaccccuaguggcaugagcaacuugcuuuuguucuuuuuguugcuacaucucuucucccuuugcuuuuuaacaaacucuuuaagagccuggcaaguuggagcaaguuucagcauuaauagcgggcagguaguauaauacuauuuuuaaugaaugucuguuuucuauucuuuacugugcuuucuuuggaaugaggcccacgaaacacaguauuaagaaaacacauugcugcccuggaauguguguauuagcugcagauuauuuccuauuagcagauuagcugcaaggcuauuggcucggaaaggucuuugagagcauuuuguuuuguaacugauucaagccaugggagagaauugccaccaugauuggaaagaagaauuagcuacuguugccauggacaccggaguucacagcccauuguuaaaucuagugcuucagcuagagaugccccagcaggagcuccagcuugguuaaugaaaugaucgcauauacuuuuucagagcucuaacagaaucuugugaaagacaugugaaauaaaaauuuuuggcacggauuuuugagauuuccaacuaaauacaaagaucuuuuccaguaguuguccgugaaaauuaguauaaaaaaaucuauuuuaaaaauauauuuaaauguuugucccuuuagcacauucuuauuguuuaucuuuaaaauauuuuguuuaaauaaaaaaguuagauauucuaauuuuauucuacuagucucuccauaccuaugcuuucuacagcauaaauuccuuaugguauccuauauuggauguagcuuucugaaauuuacagauguaaguagauuaaaucagaugacacauuuuaagaguagucuacaugucauaugacauaauagaguccuuuaaaacuagaaggaauuuauggaauuugaagaauagcauguuggcagaggugaaaacaggugaaguuaacuuguaaauaggcaaaugcugucaccauugacuuugucucguuguccaaucuauaaacacaugaaacagaggcuagaaaccaaacacaauacucuguauuucccugagaacuuagacucuugaccaggcuuucuucuucugccucuuaaacauccuacuuacucaaaacauuuuguucuuacuauucuguugcuucaccuauuagauagaccugaccauaucauguuuuuaucucucagaaauuaaggugaugagucuugaaaauggcaucaaagguuaacuucuugccuucauacacaugcacacauacacauucauacauguauuacccaugcacauacauacaccucccauacauguauuacaccuugcacauacauacacaaagaacgaacucaaauuaguauauacugguaguucagugccguuuagugugauauugaaggacuuuaaacuugccacgauugucaugguuuccuauguguguacuuccuuuauaaaaguguuaaauaauuauaaaccaagacuuuguaucuugccuacauuuucuuuagacaaacuuggauaaaauacaguugcaugaacuaauaguugcuaaacgugaaauaaguuuggucaucuucguaucuugguauuuauuccuaaauaaguguuccagaaccuuguagugaggguucucaccaacuugaaaggaggagaaugaggacaugaucaggguucucuguguuaauauuauguugggaagacuguccuacucauuccaagauggcagaacaagcaagccaauugcacuucaaguugaccugaguauaaaugugcuuuucugauaaccaguaccuguggcagcuuccuuuggaguccugacauucacauuucauauuaauaagggaaugagccaaugacucaguccaaaagguguuuugcacgcacgcauaaagaccugaguucaauccccagcacucauagauaggcaggcuuagugggcagcaccuguaaucccaauacccauagucaagaaaacagagaauccauggacucucugacugaaaugacuugcuagauuaaugacuugcagauuuaaugagaagcucuuuuuaaaaauuaacguaaacuaaccuuggcucauaggggcuuaaagagacugaaccaacaaccaggaagcauguauguaucuauucaggcccuucugcauauguguugcaguuguguaacuuguucuauuuguggaacuccuaacaaggggaacaggggcugucuuugacucuuuugccugcucagggacccuuuuccuccuacuuggagaacuugcccauucuuaggaagaagaaaggugucuacccucacugaaacuugauaugccauguuugguuaguauccacuggaggccuuugaauuuuuaaagaugaaccgaggacuagauggggugggaggagaauagaaguguauggaguggggaauuggagaugaggagugagggggaccuaugauggggauguaauguaugggaggauuacaauuaaaaaaguuaaaaauuaagauaaagagccacgauuauagacauccaacauccaccucuggcuuccacacauaauguguacagaugauuagacucugucuucucuuucuuucuguuucucuuugucucucucuaugacucucucugugucucuguuucucucuuucucucucuugcacacacauccacacacuaaucucauagaaauaaaugugaauggcucucuuauuucauaaugaaauaugcuaucaccuacauccuagaagagauaaauucaaagaacucaugacaacaacaaaugcauggaugcucaggagcagaauggaacuuccuuugggaagucuaacgacucacuggcuguuuggcuccuguuugauaucuagcaacugguggagacuauuguuuccauaaacaauccugagcaauagauuaaagaguuucuggaaaaaagaaacaauucaggauguauuuaaaauauuuuuguuuuuauguuauccuauguguuuauuugaugacaaugauagauuauuaaaauacagaucacaacugcacuuaaggaacuauagucauccugcauuuauuggaaagagcagcgcagacugaacauccaaucuccccucacuauggaaaaaccauucccugguugauaugcaguuaaaggaaagguucucaagaauauaaccauaacuuucaguuccaugagauuaugugguucgagacauuggaaucacuugagcagaucagcuuuuguguguugacaguuggaauagcagacaaaugaaauuagaagcacaaaaagacgccauuugauacagaauagauuaagauguauugauuauuguccugacuuuauaauuacuucucauagcuacaugaauuuauuuuauauaauccuaaaugguuaacauacuuuccaauaagacuaugaggacacuucacguugcaucuaugcauacauguauauaugugguagcuuuguauugauuauaacuuaaauacaauguuucgugcauacuaagguauaauuaacaauuuuuauuuccuuuaauaaugaugcuauuuuguauucuuauuauguagguuucaugaugaaugaaacauuuuguauuccccaucaaacuaaucaugccucgaugaaauacucaucgugguaagauuaaaaguuugcuuggcagaaucauugugaucuuccaugaauuaccuguaaacauacaauuauaaaauccaaugaaguaaaguagaccaugaguuacucuaaaaacuuauuuuauguuagugauuucuaguuuccuuccucccucccucccucccucccucccucccuuccucccucccucccuucuuuccuuccuucuucuguuuguuuuuguuucaguuuguauugagacagggucucucuguguaucucuggcuauccuggaacucucuauguauaccaggcuggccucuaauucagagaucugccugccucuggucucaaauucugacaguaaagccaugugcuaucacuccgagcucucuauuguuauucuuuguuuugucucuagcaagacaugaggcaaauguccccaaacaauaugguauagugcaagaauugccacacuauagcuuuaauugaaccaagaaauuugucuucacauauggucauagaugcaugacugaguaguaauacuauauucuuuuuuguaaaaguuucuuuuuguuuguuuguuuuuuguuuuuuuuuuuguuuuuguuuuuuuuuuuuuuuuuuuugagacaggguuucucugcauggcucuggcuguccuggaacucacuuuguagaccaggcuguccucgaacucagaaauccuccugccucugccucccgagugcugggauuaaaggcgugcgccaccacgcccggcuuguaaaaguuuuauaaaaaacauauaaauaugcuuuacaaacucaaaauugcaaaaagaagucuuuauaauuuuaugguaucauaguuccaucauuuucccuuuccuuuuccuuccuccaagccaaucccuauaccucuuugguccucugaaauuuauggccucuuuuucuuugcuauguauguguuucuaugaaggugcaugccuuugaguguguguuuugaguguugauguuguaaauacaaaauucauauuaauaggggcucuguuuaaucaugucuauuucugauauauuuacuacccugucuacuccaaaugucagagauacuuuuuuuuuucauccagucucaaguugcucuuugcuuugaaaugggaauauguguccucugaguaucauaauuccacaucucucgguucaaauaaauggaaacaaaauguacauucuuuaauuaauguuuaaaaccucaaguguuuauuagaaaaccaagaaauaugugauugcccaacagaauucugucagacaaugggauguuauaaaaugguuuaauuggaaaggacugacugcuuuaggaagaauuaugcuccuuuuccaucaaacaagguuuaaggggggggaaaaaaaaaacuuugguuuuuuuuuuuuucuugaaagcuucuugcuuuuuaugucuucaauuuaaacagaguuuuaguuuggguuuuguauaaugugaguaauugggcaauguggcuacagaaaaauuaaauaggaaaauauguuuccacauguggugaugaaagaugcugacauuuucccaguauccuacuuaucacaucuguuuccaacugaaaauguauauaccguguaauucccuuaagaccagguguguguccaggcuuagagaaggacagggguggauaugaaggagagcaaggccucacugacucaugaaggaugcuuucuaggagaccaaauuucagugugacgaggugggaguacaaaccaaacagaacagcacaugcagagggcagguuuuugucaccgugaaaauguacaaguaguugugaggugcaacgaacaauccucacccuuuuauugggauacauuugaacaucaaaauauucauggucuacugacacuuauaauaauguucaaucauuuaauucuaaauuaugaguccuuuugcugcacccuuauaauuccgugggaaaaaauguauuucauuaaaacaaacaaaaaaccuuacugaacuuaauuacuuuauuuuugucucaaaauggcggguuuacuacaguugccuaauaauaaacugucauugauuagggugcaggguuagcuuagcuuugcacucaguacuggagguggagacaagcugcugcucaaguguuaauauuuaguuaucacuguaaggucuucacaguaaaucucuucuggaaauacuuggauagaguucucucaacuguacauagcaccuuaucuguaaaugcaaaaccacgacaccuacuguggcucauugaaauaguuaaaaaccucugauaaaauuauuagaaaaauccauucauugacaacuauucuaucaacuacuagaacaggucgugcugauuuagauuucggcugaacugauucugggauuguaauaaacuauagugaaggugaagcccgaaucuaucugugaauaguaaagaugccuaaaaauugacacuagaguacaugcuuauuacgacugcggccaaauauuuaauuugcugauuuucugauaaguuguuuauggagaagggcuaagguacuggaauugcaucacuuuuaugcguggauaauauuaaagcagugcaugcgagugagccuuuggaguuaaaaccaguuuccuuccauugguauaacauguuuuauucagaguaugucuuaucaauaauugagaacgaaggagagaaaggagucauaaugaaucaagaggaauuaguaauagcaacaauuuauaauugucuagugauuguuaguugcuguguauguucuaaucaccguauuacacauuguuaacaggccucugaaacagucacuauuucuaaucauuguguaccugugugaacaauaugcacauuauuugcugcuaaccucccuaguuacuacuuuuaaugacuuucucucuguguauggacagaugugcaucguguauugcuaacagcauugugaagcaccuacuauuucuaauugcucucuguguguguguguguguguguuguucucucuacaggucuuuccuuauggcaugacuuuuguccuauauauucauacucucugucuuugguauuucuaaugccugauacauacagaaacucuuguuccaugaaugaauugcaaauacuccacgcccuugaaaaauagaaaugcacauauaugugugaugaaaagauaauuuuauaagauuucccugcaaauguaucaugccuaagucuuuuuccacaccccauaaucuguugaagucucuugccuucucuacugauccucuugcaaccaggcuagugccuguucuucuuuccugugcaucccaaagccaugauaagcuugccuaugaaaaugauguccuaguucaagucaucuaauuauucaagauggaguuuucauugagcugauucacauucgugugcguagccacaccuuuaucauaaaacauaguggaauuuggcaaaguguuuuucuguuucucauggacagaugauauguacuuuugacagauuuuaaugaugguauauaauaaauauacugagaagucauuaagcuauuaaaaacuugaacagauucagacuuuaaaagacacaguuucuagugcuguguaaaaagccacuguaaacuuagcccuauaaaaauacuauauuuacuuacgugcauauauauauguguguguguguguguguguguguauauauauauauauauacauauauacauacauacauauacgcauguguauauguauguauguauguauauguauauauauacguguguguauauaugugugugugcgcguguguauauguauguauguauguauguauaugcauauauauacguguguguguauauaugugugugugcgcguguguguauguauguauguauguauguauguauguauguauguauauguauauauauacguguguguauauaugugugugugcguguguguguauguauauguauacauacauauacauacacacacacacacaccuagacacacauacacacauacauauauucaugauuuuuccuugaucucuguaggccaagaggcaggauacaguguggcugguauucugcucaggcacucccuaaccuaaaauggaggugucagccagggcugugguucuuauccaaggucagagacauuuuccagugaaguauaguguuaaagaucuauuuucauuccagcaggcaucuugugaaguucuuugauacauguuaccaaagaugccuuuucuucaagaagagagguagcauacugcuaaaguucuuaacaaguuagagagcgauucagcacuccugucuuuuagaucaagacugauuuuacaauccccauuguaaauccccauuguaaagucaucugauuaaggaucuagugugaucugcacaguguuuucuagauuaauacuguucaauaacucaggaaaguuguacauuaguacuauucaauaacucagggaagauguaaaaauuacagaggccuaaauuucagagugcuaccuaacaauucaugaggcauugagaauugagauuucauauguaccaaagcaaaugcaagucuaguaaccauguuccgggucacauuaccuuagcugacugacagcagaagaauacuguuuuauuuuuuuuccauugaacuuguauuuccaugaagagaucuuggaaugcaucagcucuuuuuuugagacuuaaaaaaaaaagagagagagagcaugucuaccagugagauaaauuuggaagauuaauuuagcaucuuucuucaaguaucagcuuuugaagaucacauagcaagagcucacaaguguuagugucauuaccaaaacgaaguuauucauaacguguuuuuaguugagaguuucuguuaaucugaguauguuugaaugcaagcccgagcagacuaugaaacacaaagaaacaguauggcaggguacaccacagugcucagcuuucuucuccuugcuuauccuucuauggggaacaggaaucaaggagucucuagcagcacaaucuuguagacauuuuuuccuaucauaggaacauuauaauuggacuuguccccucucagauuuguuuuagaaauacacaaaucuguggaacacuggguaagccuucaaauaaugaauauuagauauuuuaaagacacauagacaaucauauuaugauugugucuuuaccacuauuuucucugauguaguuuuagcucagaauuaaucuaauuaaguaacuguuuccauuuaaggugagauuugauuucagaguguguagggaacuuggucaagaucauacagcuaguauauagcagucaacauucaaacucuugucuaugcuacaccauuguagaaacccacugaagauacaggugagaaggccaugcauauacuauaguaaagaaaucacauuacacauaguuuucagcagcuucuaaauagaugugcaaauguuuucaaggcauauaaaugauucaaacagaauuuucaccaucuagacuauuaccgaacuccugaagcaaauauaccugccuaaaaaaaaaucaaaccucacccuaaauagcaauaauuacuuuuuuauaguagaauaauacauggaguuaaauuaaaacuuauaaguaaaguccuagcuauuuugucuagagaauucuaaggccaguauuaguagccagcuuuuuacugccucucuugcuaauccacucagcagcuacugaguuuauucugugcuaagaucugggucaggcauuaugaauauaauguugaauaaagcacagagugcuccuauugagggcaagaccuacuuacacggaauaccaaugugcaugaguuugugcggauacucacaugcagaugcaaauugguacugcuuacugcagaagacaguagguuauauaacuaguuguaucgaucacaugguaauaauuacauuaaucuuucuggauuuucucauggcuuucugcacauuuugguuuuaguuaagguggagcucuuugaucggaaaugcccacaggauaugcauucuggcuauugaagcuguguucuuguuuccuuugcugauggagccauguugauggucaagugaagcaauuuucauauucucccuagauuugaucuuugaugaaaggaaccaaaaagaauucaaaggagcuaccuugccuuagggacuuccuucuucuauuaaauugauggauccugacuuuguugggguuuaaagaacacuaaaaggcccauguugauugaguuuugacuugaaaguggaggggcgggccuguacucuccuaguguugugauauuuguaaaaggagguggggucauugcuaaggauuuuaaugcagguauuuuaggucuuaaagauuuaaucaucuuagugaauugaagcacagacaauuucucuguaaagugcgauaaucaacagucacaguuugaagcauaagauuuugcaaaaucaaaauugauucuguaugcccaauuuugauuuacuuaauaacuuuucauuugucuuuuacauuucuucauaaggauguuucuaaaauaugacaucuacuuuaaacaucuaaguaucucucucaacacacacacacacacacacacacacacacacacacacacacacuauguuaccuauguauugagagagagagagagagaacacucaauauagauagcucugccuucauaugaaaucauuugcuuuucccccuccuugaauuguucuugaaaacuacuguucaauagcaaaacuaaugacccaauugauggcacaggcuaauauaauacaucaaucugguuucucauuaugguguaaccuuccucagguuuaccccuaggauugauuuccuuuucggugcuccuuuuacuuuuguuaaugauauguaagagcacucaccucucuuguauuccuuugucuuuauuuuccguuuuguuuuuucuuuugucuuaauuuguugguaaugggauuugaacuuucagccucacauaugcuaggcaggugcucuggcaccacacuguagcugugucccuauucccuuuuugcucuguuguugcuuuauaggcuuccuguuugucccaggauuuccaaagacugcucuucaucucuguauuagucauagugccaugugcaguacuuuauuguacauuggucucaguagcacuuuuuaaaaucaaaaucuucgaccagacauuggauauuugaacuauccugaaacauuuuagaaauauccaggcgaaaaagaaaaaaaaagaaaaaaagaaaaaagaaaaaaaaucacuuucucagcagauccaguugccuuggauuucaguguguuccugaaagcaguucuaaacuuaguggcucaguguuccacaaauaguuucccuugcuuaugaagagcuggccggagcuucuucaaagaguaaaaagauguguuuagguuugugaguggauagguucucuugacaguuuugaugcccuaguuuuuuucaugaucugguacaguucgaggaggcucucuaguguuuaaauccugaaacaguucguuuuacuuccagcauauucuagcuuuugugauuuuuuuuuccugaggacgaguauuaaaauuguugcaaaaaaauggugagguugauuaagaucaaaggaccucagaacaucacaaaaaguuugaggcaaauugaaguuuaaauagcauauguucgagucacagcacuuggcgaggucacacuuugcuucucaguuuccuugauucuugauggcaaccagccuuugaagagcuauuuauaaaccuaauauuucuguccuaaaaguggguaagcaauucaaaucuauccacauguauuaguugccaaacaacuacauuuuuaaaauuuuuugucauuugauacuugaaaaaggugucagcuccuuuauaggagggagaaucaaauaacacauacaaaagagaguuuuaaccuaacacuuucuuuguaaugaaaauaaaggugaguagaauuugccauuuuaguauaauauguauuuaaacauuuguaguagauuuuuuuaccuaauuaauggcaauaauguauuucaguggugauugugcacauaaacuuaguucauuuuaaaucaauacauuagcaugaaauguauacaacagcaaguucuguuaacuaacuacucucaauugacaguucacaaguuuuaucucuugaaaguauauucacugauagaagucuccuauguuaauacucaguagugaauagauuuuaaaauacauauauucagauguaugaaaugucuuuuauauuaugggugcauucauuuuggcacaacucuuccauggagagguuauaugaaauacgugaagaggacagguuauuuuucaacuugacagaaucuuucacauaguuuuaugaucuaugauaacauuagguagauuaaaauaaauaaaucaaucaauaaauaagggaaauuauaccaaugucuaccagauuaagaaaauaagcauaacuaaagguaccaucaguuucuccacaucuuguaaaggugauuuuuccuuuucuuugcaaaauauuauauguauguauaaauauuauacauauuauaugucuuugucugaaugucuguguauacaccauauucaugcuuguugccuguggaagguaaaagaaaguauugugucccuuauagaaguagcaucacaaaacaucaugaguuagcauaugccuauguaaaaucaaacccggaugcuauaaacgagcagccacuuuccacucuuuaaccacugaaccaucucuccaucacuauuauuugcaugauccaucuucguggugucaucuauaaauaugcauuucccuuuauaaccugcgaauguugacaucaugguauucacuuuaacgcuagccccuuuacuagaauuuaagcuucccacuaaucaugccccuaguauuuccuuaguguuuaacaguaugcuacugcuguauacagaauuucauuuaaucugucuuuuaaaaucuguagauaaagcagagaauaaaaugaaauacuaaauggaauuagacuugguacucaauugucuguuugauuuuuacaaucaucuuuauucugggcagaagaaaacuccaggacaccucuguugcaucauacuuaaaacuaauauaaaauccaggaaaaaaaugcaagcaagaacauugcuucuucgugcuccucagcuauauccagucugcacuucuuuagagagugaaaaucuaucauacuaucaggaaaauguaaagacauuaaucuuuugggcauauaaugccauacccagaucuuucugaugcuuugagcaaauggagaagagccuugggcuggagagauggcucagccguuaaaugccagacucacaaccgaaaauguaagagaagggucucuuuagagagaaccuuacaagaaauauauguaggguugauagcauguugcucuugcacauuuucuggcuaaguacuagggaugaaagagcacaugcugaacauauaugaagacccaguuugauaacaggucugcaugccaugaaaaacaaacacagugcaaaacaaauucacaaguguacuucuugauguuccauuuauaugggcgugaucuuguuugcuuccuguuuagucauauaaacaaauagacacacacauaugugcauguaaagauauccuuucugacacugaccuguguugcuauuaaauguagacauuuguguauacuuuguuaaauuuuuauggagcuacgggcuaaaguggggguuaaguuaguuucugaguuuuguuuauuuaugaugaauagugcuaggauuaaaucacagaaaaauggcauuuuacuugcugggguucauuucugacauuugaguaaacguagcacaguauauagcuacaacuugaauaucauuuauuaucuagaaucuuucucaaaauaaccuuuaaaucaccugauauacauucacuuauauuuguuuuuccucauaaaugaacuacaaggcacauuagcucaggaucuacauuuaauuauaccacagccuuuguuugcuugagucaucuaauaauaugaguuggauugcuacaauaucauuaauuaaugauaaaugaauagcauauggaaagaguucuaauugacuuuuaagucuuuuuuagguagcuugagaacauaaaaagaagucugaaaauccuuccuuauuuguucacauauagauucaaugauuguggaaguuuaucuguaugacauuaauauuacugugcaauauccaaaaacauccuuuacuugcauauugaaagucuaugugcuuuuauauaagccuuugaaacccaaaccacguaaaaggguuaguaguaucuaccaccuuuaugauuuaauuuauaguugguugaaaaaaaucuguaaacuuguuauaugacacaaaaaaagauuagcuaauaauauucaagaauaaaauauugggaagaaaacucaauuggugagguaauuuuuaugcaagugugaagaccugaauucaauucucauaacauaugcuuagagaagacaaacaaaacuacaaccacaacaaaaaagaaagaaaagggaagaaacaaagaaagauaggcaaguaggugcuguaugcuaccuauccugaccuagcacuggaugcagagaccaccaguagcuuaguacuacucacuggcuguccagguuggcuuacaagaaagccuaucccaaagauaauuagaacaauaucugaugagcuucaagggacacugcucuugggccuccaaacacacauauaugcauguacccagcauucauugguaucuucacauacacaaauacacuuucacacaaaauauuugaaaauaauauagguugcucuuacaugcuaauagaaucacacucucauuacugcuuccagauaauaugaauuuauguaaaagcgaaauauuauuuuuccuauaauauauaggaagaaaguagcaauucaauauaaauugaugcaucuuuuagauaucuauaauaaugaucaauauuuuuacuugggauaguuugaauauuuagaauaucaauguccuguaauuuauucaagaagaacgugaaccacaugaacgccaucauaaagcucuuauucaaagcuagggggauaacuaggcaggaggaugagaagaaacaggaauuugauaaauuugcuaaauacacaauuucagaauggauaaagaauccaacaugggacgcacccuguagaaauuugucauuauugaaggagaugauauaaauaaagaaaaaauguagauaagcacauacauauagaagaaaagucuugaucucuuggguuaguucuggguaacugggguaaggaccugacagugcuuauuugauugcaaaauauagcuugcauguagaauuauaccuuuccugagccagugaagcacuaaacagcgagcugggcugaagauggaaauuugugagaaucucuacuucaggcuucuccucugcccugaacaaucagaagcaaaaaauaguugagagucuccuuuaaacccucccuuugaaggaaacauaggcauggcuugcaacaggacuaagccucucugagacgaaagaaacugcucauuccccgggcagagcuuguggucacaauaccacuugcauguuauaagaagauauuguuguccucucuaacagcucuguuuugugcucaggaaauacuuccuuuacuccugugcaccucucuaggauauguuucugcgauuagaccaaaguuucuuccaguugcauuaauuaccuuguuuauauguaauuucaaaacuagauaggcgggacaacauuauggcuuuaguucuuucuuuauccauugaaguguccccuccuuccuuccuuccuuccuuccuuccuuccuuccuuccuuccuuccuuccuuccuucuuucuuucuuucuuucuuucuuucuuucuuucuuucuuucuuucuuucuuucuuucuuucuuucuuuuggaaaccaggauaauaguaaccauguguuguuacuguguuucuauaauggaaacucuaaauguuaaugugagaugugauauuuucagugauggcucuaauuauuguguucuugagaaagauaauacaugaagggauuauuacauaugcaguauguuuauuaauuaggcaacaugugagcauauaagugugcuguugugccuuuuaaacuugauuccaagaguauugcuuguaauacaguuuaaacauuuuaaguguuuggauggaaaucaagagccuuauugugucaacuauagagaugccuuuucuugauuguguugguccuuuagaaacucaaacauuuauaaaauugauaauuuuguacaaauauugaggaccuaaauuuccaaagucucaauaaaccaagaacuguuugcuggccuggcagaaauuaauuuuagucugauucucccuuccauuuucaauuagaaguacuuguuugugacaauauaauuuucaucagaaauagacgcucuagggcaaagaaagagccacacacaggcuauuuguugaauacaagauugauuuguuggccauuuuuccagcgucagagccugccaugcuuccucuugaaacaaauccuaauuugauauuuucaugugcuaacuaaacuaacaacuaguccaaacauuaaacaauuagaagauauauauauauauauauauauauauauauauauauauauauauauauauauacacacacacacacacacacacacacacacacacacacacacacugggcaucucauuaugguuagcauugauuuuuaagucugagacuguguugugccauauauuuugcuguuuguugaugcuucuauauccuucaaguuuauauauguaggugaucuagauuguaucauaaagaauucuggcgguaaaaugaagccuguauaaccuuucaucaggguaaaauacuaaauaauugugaaucgagcuuucuaauauguagcauuauuugaaauauugauguuccuuucuuacaagggguucauaguauuucauuguaaaaggugagacagcgaugcuaaaguagguccacaauucaauauaauuugugcaucacuguuuaauaaucucccuguauuauuaaacuagagacaaugaaauuuagacugcuguuaucuguuugagaaaauggguauccauuguaguccauguaucagugaaccuaaacugcuuucuuuacugacaaaucuugacaggucucuguauuuuuaaaaaauuauaauaaauucaaggaagaauuuuaaaguuccaccaagcagcuauaaaagcaaauaauacagguuucacaaggaagggaaacuugaaugaguuuguauacaauucauucauuauuagaaauuuacauaauauuauaaucaaauauuuguaucaaaaucucuuuccaucugcuuuagauguuauucauccugcugcuaauuucauaaccaguacauggcucuuuugcuuuaugacaaaauuucauaaaauaucuuuguuaugacagugcuauauguagcacuuaugcaucguuuuaaaccugauuuuuuuuuuuugccuaaucugcuuauggacauagagcucaaauaguuugcucuauaaaauauuguauuuucuuuucuauaucauagcucaggaagaaaccauuaacuuuacacaucaauuucuuuaugaaaggccauuuaaugcucucuugguuacuuucuuaucgacugaaguuuugugugccaacaugauuuugugcuuuuuaaaaacaaaguauuugcuucuuugguucguauguaguagaggggucgccuagcauguggagggugaaggguuuaaacccaagcauuauauucagacaaaauuguuuaacauacucccaaauauccuuaggguucccuuguaacuuacuuaaauuaaauuaauaaaaacuacauauuuuguuuguaaaauguguugacuuugcauauaugcauauauacauauauguauauaucuguauaucuguguacauaucuuuauuagcucaagagaguaaacaguuuucuccuuucucuaaugacagaagaagaaauaaacuucaacuauaguuuaaaagauguuaagugcagccaaacucuugcaacaaagagauacuguaguuucuuagucucuucuccacuuaaauuucuucugucuauccauuuuauccauccauuccagaguucguucuaucuaucuaucuaucuaucuaucuaucuaucuaucuaucuaucuauaaucuccaaauuagcauguuuuauaacuacauuuauaaaucauuuucaugcauuauuucuaggaaauuuuaauacaucacgacuuucaauucaauuauuuucuuuccuuuuguuuggaggggguuaccuuuaauuaucucaaacuucagaaguuuaaugguuauuuuagaaaaauauauuuagccauugguaaucuagagccuauaauggauaacagguauuaaagaaaauccuauuauuuccaguaagcuacgugauaauacaccauucaaguuacccacaaauauuaugaagguccauauccccugaauucauuggcucaaugggguuuagaaacagaguauuuuauguaggccuucagucaucuuuuauguuugguguucccacucauaccaugaaagauuuuugagauuuccauggcauaaaaugucacuuucuuguuuaucucagugaccugaugcuuuaggccacauagucagaauucacaauuuauguggggccauguccuaaauauuaaugcagcuuacaugaaucuuggguaacauauacugccccuuugugcugaaaaauaucaugauuuuuaugauaguuguuaugcaccuaggauaauaggaaugaaagucaaaaaguaguaauuaauacccuuuggaugugagcuguuuuauugguuacaugcuaauuaaggauuauagaugucacugauugaaauaagcauaaaccauuuguucaacaugaguaaaagaucagccaucauucggaauucuuuaauuaaggaugcugucagauuucccgaugccuuuccuuacugcuuucggcagacuuuggggaagcaaacagaagagagucauucuaacuagaaguaaguaacauaggcaguacaaacucucugauauuaagaaaguuauauauauacugggaagaaaaaagauuugccugucucaugaucaaggugccucauguucacauaaguugucaugugccuucuaauuuuguagaugguaguuccacucggccacauguuuagguaauacuaucaggggagaagguccucaugucuagcauugcuugcuaugaaaaauaugaauccauaauuagaaauacauauucuaggaaacaauaaguggaagauuagcuuacucucaaagagcgcuuaauaugcagaaauaguauuccagaaaauaggaaacugauucuccgugcugccuaaggguuguggugcuguuguuauuguuguuuuccugucuuauaauguagugagcuucagguaagacagucauuaacuuuuauuuggcagcugacugucaacuguuaauuucaauuuuauuuucuuaaaugauauauacugaccauguuaaaaaaaaauagaguagcuccuauuuuaccuaauaguguuaaaauacaaaauuuaauugggugauuuuuguaaaauuauauuaacggaacgaagcaaagugauuuaguucuucaaaccaaagucugaaaauaccuagcacuuguucugucuauauuacauauguaauauucaucaauaguauuuuaacuguaguuaugcacuaauuguuuuaaaaguuauaacccaaucuauuaacuauauuauugugcugcaaguauacauuaaagugauuaagucaauagaauauaaguuuaaguauacagaacucuauuuuguccaauucgguggauauccuuuguugcauggaaucauuuaaacuauacauuugauaccuuuuaauuugcauauauuagucaaagccuggaaagggcagugaguuugaagugaguguaauuuaagauccaugauacauagaacauucuauucugagaucagaaguucucuuugauccuaaucacccacacucuucccccagcucuucgcagaucacccucccaacuccugucccuucucgacuuccugccuuuuauuuauuuauuauuuuaauaaucuagagaguuuagucugggcugcucacauacucacucauaauugugaggccaugcagugaaucacaggagcccuuccaggggccacacucuuuugguuuuuugagacagggcuucucuguguagccuggguguccuggaacucacucuguagaccaggcuggccuugaacucagaaauccaccugccucugccucccaagugcugggauuaaaggcgugggccaccaccacccagcuagggaccacagucuuaaagugauuuuccccuuccaggagccaucaacuguugguagccucuuaccuaggggugaggacuugugaauuccuccuugcuucaugcauagaauguuaacauuugcaagccucaaacagaggacaacagcugcuauggguucagugcugucagguccacaugaaauucucaaagaauuaauaagaauguuaaauuuaguaaauagaguagaaaugcuaaauaauguuguuagaaaauugaaaagaguauaguaugcauacaaauaauaaguacuuagagaguucuggaaaugaauauaccuugcuguuguuagagucaagaggcagucgguugauauucuguacucauccacuucauagaaauaguugaucuaucaaagaccagucaugugcagggugggccugggaacacaguguguuaagccuuucaugaucaagagagagaguucuacuucuaaaggcuuucaaaagaauuaagcuagaaguuuaucaaaugcauaguguuuuauguuucagugguugguuuuaaaauaaauaagugucaaccauuaauggccuuugguuuagaaaugacaauuugauuuuugcuauauucaauuaggaaauauggauaaaacaauaagaaggaaaacauuuacucucauuuagcccauuuacaggagccgccgccaaacacucccuucuuccacccagcugcugcaauucugguuaauucuuaaucuucaaaaccuguguuugugaugucaacgguaauaaugaucaaggagccucguaaacaccuuuaaagagaaccuugucacacuguuucauguugugaauucugaguuuuguuggguuuagugugugcauguguguguuacaugaaguccaacauauuuuagauaaguaauauauugugucuguuuuauuaugagucuuugguuuccaguguccgccccgugcauaugaacuucucugguaggcaaaagccaucaucaucagugcgaugugcacuuuaagaauaacucuucuaacgugcucgucaggguuuuugcuauuggaauugaaaaucuuuugcagagaccauuguauuuugcuuaguuuaggguuuaauuguccuuagagacugugucuaacucagauacaguaaccacacacuuaacaagugacuuaccaagaguuuggaaaaugcccaguuuuccacccacccuuugcuucauuauuacucccuuuaauucugggagguuuuuuuuuguuuuuuuuuuuaaagaauucucauaugggacccuguucauuuguucauuuauucaaagggaauuguuuuuauucccaaagaauucuuccuuucucaaauccuggaccagauuaagcaaaugccccauuuacauaaauaaacuuuuuaauuaagcagagucuguaacuaugucaaaaacaauaaaacggaugauuugucagaaauaaacuacagggcaucugauccuuugaacauaauugaaaauuuaguauucagaaacaugaaucaaaauacagggugucuguacaggguucuuggugagccacaguuuacaauaaugucugugcuauuauuauuuuggaaauuuuaacuccacaacaaaaaccguguccuccugugucauuuuugacccaugaauacuggauaacaaggaauagugcucuucauggagagcuuccauagaccuggaaucuccagaauaugcccgcuagggagaacaguguugcaagcaucuuccugauuuacacccagcccugugguacccagggcuagacucaaggcuggggggauauucuugccugcaaaggaagacuuucauuuguaaucuguugaauugauugcuaaagcucuagacuuagacaauaggcuuuuguuguuguuguuguuguuguuguuuuuuguuuuucaagacaggguuucucuguauagcccgggauguccuggaacucacucuguagaccaggcuggccucaaacuuacaaauccaccugccucugccucccaagugcugggauuaaaggugugcgccaccaccgcccggcuaggcauuuuuuuuuuacauugcuaggaguuaggggaggugcaugacacaagaacauuaagaaauuuagugucugagauuaauuucucauccuuauaaaagcuacuuaucauuuaauauagaaguaauauauagaacauauagaaauaauaugauguacauagaaauuauauuuaaucguauuaucucacucagugacuucauaguuugcaaacuaucaugcucugcuuuuuccucuuuauaucugcugacuucauuuccaguguuaugcuucuuuggccuauucacuuaagauuucuuauucaaucccaugacucuaagacacucagauauaauaagauauaauauuugagagucuaacaggaagaaaacauuuccauagaacacuucagaauaauugaauuauguugagggugaaagucaaauggagauauugacacuuaaacauugacaaugaacaaauucucugcuuugaagugcuuucuccauuaaccaguucaggguccuagaacaagccuugucuugaagauaguucuuuauuugauuuuuuuuuuuuccuacaaauucugccuucucuggguaggaguuauuuuuuuauuaaaaauaaaaaagaccaaaacaacuucuuauuucuuaucuauauaauguuauccugugacuuuguauuuguauuggacuuuuuauuucaucuuuguaacuuccccaaauuuuaaaauaaucaguucugguuguuucccuuccaaaugugacauugguugagaaauucaaaccuguuaugggaguaccauucaaaauuucuuuaaaauauuuaaaccugacuuccaauacaggucuauaugagaucucacuaaccauuaaaggauacaauuacaaugaguaaaugauuuuauuuaauucugaggggaggucuacuaaaguuguacauaauuucagaacaguucucuggagauuaacgguuuauggcaaaaccaugccauguaaccuaaugcuaaucacacuaccauuacaaaaggaaauuaaaguuggaagaaucugucaaaauauuaugaaaguugaugaauugaaguuuauugcuuuauuuuuagaauuugcgaagaaugccuccggguauuuguaaaaugggagugaaaugaaaagagcuguaacuaacugccaagagcccgugggugccuucagcucgcuggccccucuucauguucaugcugcugcuccuuaugugccugcuguagagggagcugcuguaggugcgcagccugaagucuugagggguuugcugauuucagauauguccugagcacagagcuuucuguauacugaguguucuuccagcugaagcucugucaggauucaucuaaaccuuccuugguauuaaugagaagauugcaguaaggcauuggaaauauuucagacuucccacuuguuucagaaaggcaaugaagcccucauccuuacuuuauucaucuacaguuuccuuugcacacagauuauaaguauuuuauaaugcuguggagucagccugucugcagaugucaccuuugaaaaugcauuaaaaucaauacuguuauccaauauucuucuuuaccuaugaagucacagagacuuaaugaauuaguaaauucauuaagaaaucaaguuauuuuucaaguacaccuuaaaccuuucuuuuggcacacuugguguugagcuaaaagcgucauucauacuuggcaaacauucuaccacuucgguugugcuauagugccucagguagaaauucucucagaagccuauuuucacccguuccauguugauuccugaaaguauauauauaaauuauaagaaugcuaaauauugagaaaauaacauguaguuuauguuuauuuuggagguuuuugaauucuguguugaauuuuacaugcauaauacaagcuuugccucugagaagauaacuacguucuuauaggaauccuucauaauucaaagccacagcaguacaccuucaccuuuccuuaugauaugcuuccccaguguuaggaguuuuaaaauucauauuuuaaguuuuaagguucacuguagggaucagaguccaauuaauuuauauauaaaauagugcuguuuuauaaugaaacuaucggugauaugaaaaauuguaauuuaagauuaaauggguucucaucuugaguagauucuuaauaauuauagccuaaagccucuaugccauauucaguuauuaugaguaaaguaaaauguuauauucuuggagaaaaauuaugucuuauaaugccgcauaccauuucauucuuagguacccaggccugauagugccucagauauuuuagucaucuuuucugauagagaacaauggauguagauaagauguacuggggaugugguucacuguaaaacauuugucacacaaacaugaggacuucauuuugaccucaguagccaagugaaaccaucaggcaugauaguuccugcuuuuagucccagggcugggaaggugaggauggaggaauccucggcucacugccuagccuaauugggaaucuacaagcaagugagauacacagucucaagaaauaagcuagauagugugaaugaggaugacaccgguggguuuccuauggcuuccacagggaggaccauuuucaugcaugaacacccaaacacacuuaugcacuuguacauguaaguccacacuuguaugcggacugaaagaaagaucauaagaaaaugcaaagagacuuguguuuuauacaaaugucaccuuucaaaauuucaaauccuuaaaacuccaaucucugccgucuuuccccaaaacuuggugguuacuauauacuagcuaacauguucuuuuuuaauggcuucuguuggcuaaaccagagugucccagauguguccugaaacuuuauauuaaaaacguuuuaauauugugcuuaagcacacguuuuuaauucucagacuaugcugaauugauuuucaaaggcauuuagaauuuuucuuuauacucuggaaaaaaaaaggccuuuugaaauacuauccugauuuaccaacaaaacauagcaauuauaacaugaugcauuguaaaaauauuuaaauuuccauuuguguuccuauauucuuuggugguuaaguauuuaaaaaucuuaacucugaagugaaguugaaaaguuauuaugaaaagcaugcuguuguuacagagucuagggugggagagaauaauuacacauagcuuuuugauaaacagucuaaauugugcuucaaagggagauguggcuuuaauaaucugaacccuuugcauuuucagauuaaacuucacuugauugcauuguacuugauacguauacuuaaaucuauauguuaaacguuauacuuugauauagcacaucuuguuuggcuuuguucuuaugaucugacaagcuucauuauauaauaaacuaguuuaaauaaaucuuaaagacauaaaaguguucuugacaguaagaaaaaaauuaaaagugcaccaaugauauaucgguuagauguuccagagcgagucaaaguuuuuuuuucauucaaaucuuugaacauguguuuugaauaaagcuguaaggcauuuuccaguaaccaguguuguauuacagaaacgaguaaaggaaaacaaaaggaaaacauguuucaacauuuuauucgcaauugucacauacuguugcacauugccuucuggaagugaaugugacauuugcaauauaaaauuuucaaacuuaaccuuuuacauuacauaggaugcuuaggauucuaugcccaugugagauaagcagagaucaagaaucaaucuaucaagguugaaauggauuuucaagugcuugagaauaauuuauacugcaagugugauaugaauccauuacugucacuuucagauuuuucuaaugaaucuaccaagaaauaaucaaugauaagcugauuaaagaauacuggauugaaggaccuaacauuuucuaaaguuaucacugacaaauaauaucaucauuaauuuccagaguuaacaaaacuauugguguaucaaaaagcaagaauuucaccuguaacaggaaaaccccacaaacuacuuuaagauuuuacugucacuuuagcuggaaauuauugcacuuccaaaacuggaagaccaacaaaaucacauacuaauaucaggaagcuguuugguuguuuucuuuuucacaauuagcaguugcuagcacuaaccuugaggguuagaagcauugagcaugcgcagcgcagcucaccucagcccugaaugcacuacaaagcaggaggagacacugaacauuauuuaauaagcuaguaacuuuaggaagauaaguguaauugauuuuagugucaaaacuguucuguauuucauagguuucaaauaaaaauggggaucuguauguuauauugugaacguagaauuccucuuaaggggagauacagucacucauauauggacuguugaaacaggcuguugaguuuggggcauugucuuuuauagaauuaguguauuacaugguuuuuuuuuuguuuuuguuuuuuuuguuuuuuuuguuuuuuuuugaaaauugagagccugaaaucugugacacauuuuagcaauuaguucuucuaaaacagguucucaugcugaucugccaggagauggacauuugauuucaugcacugaguguggucagcagcuggccaaacucucucacaucacuccaugaguucccgugaucugaccugcaagguuagaaauauuuacgugaguucugucacuguugugucuaggaauuuagacagaggauuuaugacacucuguuucacucagugcuccucggaagagaguuaaaauauucugugaagaaggaacauuucgugucuucuuuuucaaaucugucauagugaauuuaauauuuccguacagccucugcucuuaguggccuguguacagagcucaugagggaaaagguggccauuuaauacuucuucaucuaaguuggcaguucaagucguccaugagccagccuuuauuagauagagcaugucugcccagcuacuuggaaguacugcuauauugaacauauuuauauuccaaugcuaccccagcuuccacacaguucuguuaaacaaauauuuuuauuccuucucacagcaacaggaugaggaaaaggccugugagcgcucuuaguuauuauguaagaaaguugaaucucagagguuuuuuuuuuuuuuaagguauuugauaaaggauauuuuuugaauuuugcuguaacggugagccuaguguuuagugugacuuugagcaauucucuggguccauccuacugcauuuccaauguuuaaaacaccaauagaaaguuguuagauggcugcuuaugaaggcaucauauauaaaaacaaauucuaaaagccagauuaucucaguucuucuuuuaacagcaauauuucaggcaacuucugcgaaacaauagagccuuuguaaccagaauuuggaguguuugcuucucuuuuucgaucuauacauuuagcugaacaguuguuagauaugauaaacacugccuuuuauaaaauauugacuauaaacacaaccauuggucgcgaacccauucucgacugugcaagauagucuuccaaguaugaauauacuuuaucugcacacgucugaaagaguuguggcugucuuguccucauuccuuguaggugagaaagaagacuugauuuaugcugcaugucaucucaugaccuaaggucucaaaacccugagcccuauguagacacuauugcaugugacuaucucuuccuagacuauacauucguagucuacuggaauaaagugguuucaaugaaugaaaacuggucccagugguuugucucuuucaguaaccaguagaugucugaaaaaaaaaaucucuucauccucucugaguacaggaguagcuugggaaaugucuuccaauggaguucuuauuaccaugacauuguugagacugggagaugauauuuccucaaauaagcucauuaugcaauucauuuucuuauggccauaaaauuuuguucuuuuggugaagaaacaaacacacuaaguuuggggggauaaucaugcuuuuuggaaagaggaagagggcagauauuauuaugagguaaucagaaagcuucggguuucagugcuagauuugguuuguucauuuuuauuuguguuauuuguuuuaauuauacuuaguauuuuugcuauuugauguucaaaauaauucccaauuuaacucauuuagaggaaauagaacacaucaugaucuauaauaaguacaccagcauuuagugaucuucaaaacguugaguucaagaauauaaaaugggcagauggcuugaaguauagacugaacuaagugugcugugaggcgaguguaaaccacauacucauaauaagagguagagacaaguuucagaguaacuggggcccugucaaaaauagauagguugaaauuguuugaaucauacaaauauuaauugcagugagugaugccauaaagagauagucgguccagauguucuucacgucccagaaccuuuaccaugggaaggaaaacucaguuguugcuggggacacauacaugaaaaaaacuguuccacaggggacaccuagucuuuagaggaaugauacuacgguaaacaaauaauuguaaucuagacaauugauuggcuaguaauaaaacuaaugggcaacaaucuauucuauuuuauuauuuguuugucuuucugccuacuuauucaucuuuaagucuauaguguuuuucauuucuccaucuauauuuuuacauaucuucuaucuuuugucuauccuuuauacauagaaaacauuuauauauguauauaaacucuguuuuauagagauuuaacauauguuccauguaugauugugugcaccuauaguuccaggcacuuccuuguauuaagcaccaaguuggggagggauuucacccagauucuguuuuuaugcuccucuugcuucugucucuaagacuaugaaaccuuccuggaaguucuuaagcaaaauuauugaugucugaacuauuguauugacauguaagccccaugcauugcuauaauuuuuggccauaauuaaauuauuugcuaucuuauuugugguauuacugggcaucaacuuuagaugaacucauucauguccuguauucuuaugugagaacacaagcuuuugaauacagcagaagauguagaaagagacggcugcaggguaaauuaguggcuuacaaagauugcugucaagaagaaguuaaauguccucacugcuuuuuaggucuuccuuugauugacagcaaguugagggguuguaaacagugagcauuauggucuugguuaaaagucaauacacuuguaaaucuagacucuacuagaaaaagagagaaagauauccacguaacuaaaucacaggagggacuaauuugaugauucucaugcgcaagugauacugcuguaauuuagcaacaaaauucuuaaauacuuauuuacacacagcaaauucaauuaaugauauguucaagauauuaaaauaaaacuaaaauguucaucuauuacucagagauuuuuuuaacuaugaaguucuaugugauaccuauguaugugucuacauguguaugugugcauguguguguuuguguacacacacguguguacauuuaugugugugggugagugucuguauacauggguguuuugagacuggaucucacuaugcaucucugccuagcccagaguucucuacaggccguguuaaccuugauauugcagcauuuuuuaugcuucuaccucuaaagcauugagauuacuggcauguuccaccauuuuccuuuaaacgaacaagaaauguuaacuuaguuuccaggucauaacuuuagucugaaauauaggcuccucacugagauuggugugugugugugugugugugugugugugugauuuauguauugaacaaacuacacaaauuuuaccuuacauguggaaaaucuacagucccauuauaaauuuaacuguaucuggcugaacaucagcacucuuaacuggcaggcauuuuguucauuuagaaacuauuucuugaauggcaauauguauucugacaguauuuaggacacuugagguauauguguaaauaagagaauuaaguccuccuuuguucaguagcuuccugauaauuuaauaucaaaccuaaaaaaaaaaaaaguccaguaaucaauggcaggcaaagauuuuucuuaaacaagaaauuauugguauuaaugaggucuauuuuuauauaucuauuauguacaugauuuuacauuuuauauuuauauauauaucauauuaaaguauaucuguauaugauuggucauucuuuuaguaaguuuucauugagucuucaagccccauauagaugugacuauuuaauuuguaagagucaguguggugaagguccuagccuuagaggcauauggcuaccagucuuaguuugaacuugucuacacauaaagacacgucaagguaacacccaggauuccauagcauaacuacaauaaaacuagggagaauucuacacaacuaaauaccacugcauaacugaaucuuugauccuggaacuuccacucaaacucucucagauugugcucuaauagucuuuagggaccagaguuucucaccucccuccacaauuccaugaacucagucuuaugguaagaauuauuucccuuuaccguggccuucuagauuuaaagacagacucauaguuuauaauacugagagcuauccagcaagugccacagaucagaaguuggaaaacuauuugaaacuauuagugguacagugcaagaguauuacacaauacucuaucuuguguguuaauuugguuuuucauuguuguucuuuuauguacgugucuccacuguguauucacaugaugugcgugcccucagaggccagaaaaaggcacuggauccuuuggaggcauuugugagcuuccagacaugggugcuagcagcaaacuucugccuucugcaagaauaggaagugcuauuaaaugccaaacucucucucuggcccgaucuugcuuuuaaagacagagccucccuguuuuacccaagcugucuuuugagcucauccuucuccccugugcuggacugaugggauuaagucaugauucacccugucagccuauggcuacgcuguuguucuuuucaacuaacuuuguuacaguugugacugaguuaucugaugcuuaggcuuaguuuuuuguuuuuguuuuuuuuuuguuuuuuuuuuuuaguauuuuuuuauuuacauguuuuuaaaauauuaaaaauuuuaaaaaguugagagaauuacucuuuucccucugcauaccaagauagacucagacucucauuauucuauaagucaucacucaggguguuguaagaaugccuaagaggcauuaaugucauacacugaugcaagcaucuuagggaagcuuugaaaccaaaaauaaaauaaaaauacauaauaagauacuuacuuuucauaguaaaugccgaaauagaaaauaggucuuaaaguauugggucaaaaaggagacgaaguuguggugagauuggcgucaaauuuuccuaggaguuccagagaguauuaacuugcaucuauguaagcaaaaacuaguugugacaaguaugaccaggucuauguucuugaugaaacccagacagagauaagaaccugucaugucucuucuccacaaagucacuugaagcagaucccccaguuuagagcccugcaguacugaaucuauacugcuuuuucucuacgcuuuguguucuagaaucguuugcuguggugggugccauguuaggugugcgguaugcucagaaaaguuggcauuacuucacuucuuagccacaucugauuuuucuauuagaacgcugcuauguuucaaugaaagaauuagcacuaaugcucacuggacucaucacuguugacucuggugggaucagcagugagauccguauaucauccuagagguauaccgauugaacaauaaccgaucaaccaagccugcucuaggcuguuaucuauuaaugcaucccauucaaaguauuaguuacaacacauuucuguuugugaagaacaucacaccaagagcaccuccuucaaguuagaaguccuaaaagagagauccaaaacauauccuaaaccauuuccaaagcaguuuuucugagcaaagcaacagagcuucuauuucaggcacacuauaaacaaucuaagaacacagccuccugugagucauucuuuuaucuaccagauaucuauaucccgagggaaucucagcuuugacuagcccuucaguuuccucacacgcagccauugcagaucaggguuaaagaggaacuucagagucaucugaauuaauauccugccaaauuccccuuuccguuucuccccuccucucagccaccucauggcuucugacuagucauccuccaggacuuucccgagggacuuugguuuuuccuucuucagcucuuaguccacacguaacaacccauccucaugucuaacgcacagacaaaauaucuaacucagucucugugacugcugaccuuguuuuaagaaucaguaccaaggcaggcaaaaaugacucaaccagaaaugcacuuacugccaagcaugacaguuugaguuugauuccuggguuuugauuccugguugagggagugaacccaguccuugaaguuguccucugaccuucauaguggcacuugugaacacuuauaaauacacacaaaauaaggaaauaaaauguaauauauauauauucuuaaaucaaagccaucaacaacuuaugucauuuuacagcauaguccccagcacuaucuguguugcagaaugaaaaggaguuccccuccccuuuagaagcugaauaaaucuaugauaugcauacaauaauuuguucauccauucaucuguggaaagacaaacaagcuugccauuaccuaaucagccuaauuaaucacccuuucucuuuuagacaucucucuuccuucugacauauaucuuuucuuacuuuuguuagucccuuagaucuuuucuacuuauuuaugccuaaauacaaugagaaauauuuuagacaacuuuuuuuuucuguacaagucuuaggaugacuuuacuaguuuaaacacuuuagauaugaucuuaaauucgccccauuucuucuuuuuuaauuagguauuuauuucauuuacauuuccaaugcuaucccaaaaguccccuacacgcucccccacccauucccccacccacccacucccacuucuuggcccuggcguuccccuguacugaggcauauaaaguuugcacaaccaaugggccucucuuuccacugauggccgacuaggccaacuucugauacauaguagcuagagacaccagcuccggggggguacugguuaguucauauuguuguuccaccuauaggguugcagaucccccccagcuccuugaguacuuucucuagcuccuccaugggggggccuugugaucccuccaaaauucaccccauuucaaaauaauuucauuauuaucuaacccucuaauacuuuucaguuaauuuuuuucagauaaacuaauauuguaaaagauagguucaaagacuuaauagauuaugggucaauuaaguauuuagaauguaccucaaguuuuuucaucagaacaagaauuuaaucuauaucaucaaaaaaugcauaggcgaaauucuaaaccuuaaagugcauaggcgaaauucuaaaccuuaaagaagagagaacuagaaaagaucaaagucaacagggaucaaauauuuauaugaccaaaguucaccauagguugucagauuuuuaaccaugaaauuuuuauauuauuuuuaaaaacacacuuucagcuuauuauaaucuacauaagaaaaaauuuuccucuuuuggagagaagccauaaaaagaaauauggcuucggauaaaaacauaaagauucagguuaaagauggcauggucucuuaguauguguauuaucuaauauuucagcuuuauaucaaaaucuaggaaguuaguucacauagcccauuuaaguuuguaaauaaguuacugguauuguuguuuaagucuacaacacuauacuauuugcaugcucucauaucaaaccaccacauuagcucugucuguacucagcuguaaaccuuguauagccaugugaugcuccaacuggcauugauaauuaacauuauauagaaaugaaacagauaaacuagaaauuugcauguacuaauauauuguaguuuccauuauugaauuaaaugcuaaacuccauauaugaaaagcaugaacaaccccaugcuacuaaaugacaacauugcaggcaaucuggaaaagggucuuaucgaugugacaucagacauccuguguggaagcaaguccuaguauagacaguacuguuuccugacaccugacaguuauuuaacucuugcuuuuagagcccacuguauuuauuuccaguaguagguaauaaggaccccuuuguaguauaaggguacaccaauggauauuuuucauuaaguuauaacuaaauuccuacaucauuuuagaguauaaaauaaaaaaaguaauuggagaaauggccauguuugauuuugacaagacauuacaguuuuuauagagagaacgaugacugagaacugaguuugauuccugggaccuacauguuaggaaaagaaaacugacgaccgaaagcuguucucugacuuccauauauaagccaaggcauguacacccacacacacauacucaaaucugauaaaucaaaaauaauaaaauguaaugaaagaauguaaaaguaaaagaaaacccacagagcucugaaaaccuaaaguucacagagagcauaucacugucaccuccacaggcuugccucuuaggaauacagagaauguguauaguauggugaacuuuaaauuaaguacccgcaagaggauaaauaaaaauuuacaaugauacuguguagauuuccauuuuacauacuauccuaauguauagaaugcaagucauuugaaugcccuuugauauagagcacacauccuuaaaaggaucugccaagccaagagugcuggcagcuuccucugaacccaacauuccauucuaugugaguucaaagccaguuuggucuaugcaguggucuaugagcuuaagguaagucaggguuauauagugagaucauguuccuuccuuccuuccuuccuuccuuccuuccuuccuuccuuccuuccuuccuuccuuccuccuucccucccucccuccccccucucccuccuuccuucucuuguuaauauuguucuuccucucuugcuccuccuccucuuccuucuccuguuccuccuucugcucccucucccucuucuccccucucuguguguguguuugucucucuguguaugugugucugucucucucuucuuucuccuuuuucuuucaguauucaacaguucuaauaauucuaauuaauaauucauaauaaugaagauuauuucucacuucuaaaugagaaaucuaacacugcaaaaaccaguagaauuaaugggaaguauuucauaagauucaccaauaaauauuuccaccaaaacuagugguagugaucaugucauuugcuauaucaaugagcuugauccagaaccacugccuuuggcucugaggggagaauuaaaaaaucauugcaguagugugaauccugugaaagaacugguaauugaaauucucuuauuagauucaauaugucaaaacaacuuauacagaguggagcuuauuuuucaucccaaaacuugaaaaucuuaaaaagacauaguaauauaauuauuaaaaucauaaaaagcauaguaguauaauugaaaccauuuaaaacauugcuaggaaauuacucgaguuuucuuaggccagccaacuugaaugccuguguccagguuaauauucaaaauauugaaaggucagcauggcagauacugacaagcuccagcaaggcauugugcauaaugcaccuauaccuugcauaagaguuuucauguuguugcuaaguucuuggggguggagagcuuuaagaguugguaagcaagcuaagccuggguguucaugccuguagucucagaacuuagaaagcacgaagacugcaauuugaggccagccuaggcuacacagugaaccaagcuugagccauauagcaagaauauguauguagcccccagccucgcaaaguuuccuaagaauugucaagacccugcucagaagcaagcauuucuuuuucagaaauaaucaaacugacaggagcaaacagguaugauaaucccugaaagggauggauggccuguuucagcuaagcucacagugcauagcaagugaaugaauucacuuaccugugaaauucucagauaaccaauaacauuauuauguugaauaaaaacaaguuucucaaccaaagauaccaaauuuuccaacuuaguucauaccaaauauauauauuccuggauaaaaaugacccuugugaucauaguucauuaucuuaucaaauucucacaaaacaaggccccuuuacaguuuggguacuuuagaaauucuuggguuuugucauucacauuacagaagauauaugaccuuugacagauguuuugaaaacaacuuuccucugaaugugucucuaaaugugacuuuccuaggaugguaagaucaguguaauucacauuuuaaugagcuuucauuuuuauuuuuauuuuauuuuuuaucuaagacucaggauaagucugaagggacguguagaacaggugcauugaaauaucugcucuugcacacacauacauauucuuucacauacaaaugaugaacacauucagaaaaaagugaaauuaaucucucagauuuguagagaagguuuaugauugugugugugugugugugugcaugugugugaguuuuggcaguuaacacuggacuuaugugacacauccaacuuucaguuuaggacauagaugccauaugaagucauauaguuucaaauauuauuaucuaaauacugaucguugguucuugguuugauuuuguguuagccuagucuuguuaaauaucaauuuccauagugauauaucagagagaguuauuaauggugacucgacauuuuauaugucagguucuuaaaaugauuuagguaaaagagacaucaguuuccucaauuuuaacuaaaaugguaaguuccuguguuccacaggaauuaccaucagugucaucucauuuacauaagagaugucaaacaucuaauuugacaggcauaugcuuucaucugagcauccccugauugugguauauggaccuuucuuuguauuucagucuaugguaacaaacaaagcuuugcccccccacccccccacacacacacaaaagcaguuugaacguuaucacaucaaagggagaaauaccauggucugcagacugucuuagaucuuucugaauaaaucaauuaugguauaggauuaauuugacauaucauuucuuccaagagagauauucccucccccauuuccuccucagaaauguaaauauauaauauucuuuuucuguuuggugaaaagauaccaguaaaaugauaacaucuggcuggaguaaagagcugccagcuaaggaaugguuuccucucugcggcucuaagcagcccugaugcugugcagaugugcagccaggccugacuguaaaaguuauaaacauugucauaacauuguucgacuucucuaguauuuccugucuucugcuuagcacuuuauuacuaagucuggcuagcugccaagugaaaugcagggaguuagggccucuggcuugaaauuuaaaacaaguccagaauucauuggguuuaauuugauaugcgaacucugauaacucacacuuguuaaaauaaagcugcuuaccauucaaguuagauuuacacagcuuugagagaacaugguagaagaaggggaaaacacguuuuucagaacuuuccgacuggcucauagugcugaguuuuugggaccgggugggggagggugaaggcugcugagcagagcagcugagucugaagcuggacagcuuacaacaaacuuguguucauuuccuguauuagaugcaguucccugggcagagaaugggccuuucuuucaacacuucggagcacguucuuucucuuggcucauuuucagauuaggaaggccacaugaggcucauugccuauacaucauagcaaaauggugcggcaaaaacaaacgcacaauacaccagcagaccacauucagcagagggugucuugugcccugguugaacagaacaucauugaagcuucaguaugaagacauguuaacccaauuuucccuguaauguauacaugauugauuggcaauuuuuggaccacaggcugugguuaggauuacaucaaucaggaagcaguaacucuugagggacuucccuuaaaugaucuaguguuuauuggugaaagugguugcaguuugugcugucugucucuuucauguguucaucaguuccacuucugucugagaugagguacaugggugacgcugagguuccuccuuuuaucccacccacucauuuaaaaggcacgaugaugcaaguagcacaaggggcauugaaugucugaacaaaagaagaaaaagaaaaaaaaaacguaaugucgaaugaauggaaaauaaugaaugagacugcauuugugggaacagaguuuaaugugauguuacccagcaggaggaucacuuguuuggauuaacaugucacacguuuauggaacaucauucacucaaauagaacacugcacaugcaacaugucuauuaacauccaacauacauaucugggcuuaaggagguacugggaaucaaacuaagagccuuguucaugccaagagagcacccaucuaccacgcuuaagcguucauccguuacacagacuuucaacuuccauggguaauuauauuuauuauauuauauuacauauuguauuucuuacaaauaaaaaugacgauauggaaauaagcuaggaggugaauuugcugaaugucggcaguuauuaauuccccauuuggucucacuuuugcacacucuuggacuaacaggaaacauuucaucugucacgugcuaucagaauucugguggcugucuuuguuauucugugggcuuucauuacaguugugaauguacaucaccgugguguuccccgaaggauguguuauggaucuaugaaauuuuuguaaggugugaacacuaaaaagcugucccaaggcucugcuguuaauuuguuuuuauugaaggggaggcaggaauggggcacaugugugugaagcccuucucgcugcucgguuuucucauguguacaccguguucagagauguagggguaaccugugaguuacaguucaugagucuugagaagaguggugcucugaccacugaucuucccagguucugacauuguaaccugacuggaaaaagcguaucugugccuacuuucacuucaggauuaaaacaugggaaaaaaaggaaagaaaucaaaacaggcgcagcauacgugauuuuuaugaaagugucccucacaaaaucauuggcacucaauugucuuaucuugauuuuagaaauggaauguaaggcaucugagaguuaaauaccaugaagaaugagaagcauguucaaagcauccauugaagaugcuugggcaaggucugugccauuccagucagcucuuguggacacagaggacucuuaauaucaucuaauaucauccaguucaggauucacugucuagguccacaucaccagcagaacggauguuucucaggcuccauugguaggggugagaauagauuuccaaauuaacgugaccauauuuacaauuagacucucauuggugugggugagaauagcuuuccaaauuaacuuaaccguauuuacaaucagacucuuguaaggcauuugucuucguauauuucagacguuuucauuacacagagguaguaguucagcccaaggcauguuugaggaugccauaacccuuccuucucugcacuuguuugcuuucaugaaagugguguuauugcucucuuccccuacuguguguguguguguguguguguuuucuucaagccauacauuacuucagcuucucagaggaaaggcaaugcaaguuuuacagaguuccauaaaaagcucaaaguauuuccuguuauuuggaaauacccuuggacacuacuucccccugccccagaagucugaugggaagucauacauuuauggagcucuugaaguuacacagcuaguugaacaugugagcaauauaaacaacaacaacaacaaacccuaacaacaaaaaucuugccuaauuuuauauuccuacucucuggcacaauguuggguguugcaagaggaaaauguaacaaaggaaacagagacaaaaaucaagaaauccugguguggcgccaacagaccucuaaaaaguugguggauuaguaagaaggcagcguugugcugucagagucaacauuacucagacagucgcagaagcucugaggccauuggauuuguuugcaaugagagauuuguuguggauuuuuaacaaggcuccugugugugugccaugcuuaguaaauauuggccuucaggguauuuuucagucacacugaauggaccguuaguuuccccaaacuacaaagugcagaaaauccauuucccugauucuguggccacugggguugcaucauaggcucuuugugcaagagcaaaaacuaaaaugcagccaaaacuucuucagaggagcagaaaaaccaucaggagaaauaaugauauuaaugcccaugaucagauaaacaagcaagccaaagaggggccaugaaauuagcuaaucauuaaauuauuagacuaaacucaaacauuucgguuucuuuaaaaauuaaauaaaguaauuaugccuugggugaucaaauaauuguaccuucuaauauuauaguaaauuugaugcaucuuuaaaugucucaaaauuauuauuacuggaaaaauuacugggaaaguagggcauguaugguuggucucucugauauaagaauuucagauuuguuuacagauauuuuccuuucuuuuguugucugugguguuuuuuccuguagcacauuuacugugugaugagaguuuuuuguuauaaccacggauaacuugaaagagguuugguauuguuuuuuuaauaacuauuuaaaacucacuuucaggggauguucauauuuggccuaagagacagacuuuaaggacacguuguaaauacguugaggguaaauuaauugcaggugucugggcgguaauaguuuuuauuaucacugcuuuguggcaaagagaucuaaaaaaguaccaacuagcaauuagugugcuucuuacacuuucugaauucuuuuggagaauguuuaaaauccuacaugcaucccuugaagugcaugacauaaacucagaagcacaaaguggcugugagaaaagcguuucaagugugucaaauuuaaagacaccuaccugagcauagaguuugguaauuguggccuacacucucuaccaaaagcuuagagaauauagacuagcagaaaagaggguauuuucccaucuguuguccauuuggcugucagcacuuguugugacagaagagaaaaggagucuugagugacugcuagucugucuuaaaguaugguaauggggcuaauuaggagagauaggagcuggcgagcauuggugggggccauuuucccuaucgcuucugcgucacucuguauccuucucagauuccccuucuccaauuuugucauuucucaagcaacaccacguaacgguaccugcuaacacgacaugagcugugugguugaaaggaccugugcuggacacugcucaaauucucuuuaccugccucccuaaacaaagaucuggcguaugguugaggccauguuuacuggcauuguucagccuacauggauggaaauuaaucacgcuuuauuaugaugagcccauauaucuucuuuggaaaaugagcagcauuuuguaugcuucuuucauguuaggcaccacggcaaggcaguaauuuagcauacuugaaagcaaaagacaucagaggcccgcaaggcaagcagaaaauguauucucuuuuaugugauuuagaaaguugagacauuuuaguuucuguuuucaaagguuuagugcauuuuagcuuuugacaauaauuuugaaaguaaacagcgggacucagaucucuguacauugacuucauaguaggugacacaacauaaguuccuccccgccccucugaguauguaaucagaaaauguuaacaguaaaauaacauauguuuccuugaaaaccugaauuguuuuugaaugguguugacauuucuuccaguauguguagaauauaauguauaagcacauuagacuuuuugaagaguaauuucaguuuuuccccuaaaacauauagacacauuuaauauuaaaauaaaagcuaagcuacauuagugucaauaaggaauuacaugugagucuaaguagcaaauauuugucccuacuuuuacaccuggguauaaaguucuauugauuuuugcauauuuuauuuuaauuuuaauuucaucugccuuauacucagaaauguacuguauuacuagguuuauaaaagguauaaaugagauuaaugcaaaacucaaauaaaccaagcaaaauauagcagaaaaauccugaguuacuaacauggaguuagcaaccuugaccagaagcuaacuagagaaauuucauguuacauuauauuucuguggcaggacuaagauuccuggaaacaaauaugagcaaagaugagagugguugguuugguaaagaacuugcagccgaaccuagaaaaucagaguccaguugccgcuaagaaguuagaaauaauccucacaucugacaugucagaguaacucuugguaaacaugaagccaucugaaucucaaaaccaaaugaaucagauuugauuuuugguggagguaagauaaaaccacauuaauauaaagaguauuccuggugguucuagugagaauaguauaugaaucacuuguugagaaacacuguuguggaucaagaaauauaccaagccaaguaucauauuauagcgaugcuggguauugaacccauagaguaacuaaagauggcuaaauuaagaccccaaggaaaagcugaacuuuuaccuuuaacagaagaccacuagaagcaaaaguuggauacaguagcagccagauaucuaccaaugguagauucuuugcuacaguauuuuguaauacuccuacuggcucacgauuguuuuccauggacucaugacucauuguucaagucuuaagauuccagaaccacuguggcuggauagggcagagguccagugagagugaugccaagaucgaguacuggaaaugaugagagguuaggagguacaccaagaacagggaauccagguuugucacacacaggaggaaaaccaaacagguuucccauauccccacugaaacagccucacccucaggcccaggacacucuccugguuguuuuugaaaccgaaaccagucuuguuacaacuggacccagucccacagguggaagcagguaaugggaaacagcuguuacaggggaaggcauuuguguuguucuuguucuuguucugcuagguaggaaaggaaaucuuucccuguggcagaagcagaguaauaaauauauauagggugacauauacacagcacauuccuuuuuaguugaaagauaugucugagauaucuugaaaacaauuacuggagcauuuuaaacauucccgugaaauacauucuuacauucuuaaugaucuggauagggaaauagucugcccagucaaaacaaaccauagaugcugugacauuugugucacaauccagaaggguauguuucccuacuuuuagucacacugagaauuuaaauacuuuuaaauguguuugaaaggagaaaaaaaaauuuuuuuucagcaaaauaauugaauuuacauauuagcaaccaucaugaugaauauagccccacacauuuaugcuuuauaaauauaucaccuguguaauuuugguuaagagcauuauauuuuauguuaagacccuauggcauuuacaagugcuaccuauaugcugauauuacagaaacaaauuuucauuauuuucuucuaguuagauggucuuacaauagacccuucccucuggccuuuuauuaaacaauguuuggaggaaauuuaccuuugccuuuagugcucaugucccuuucuaaaguauagaagagcucuauucaauucuuccucgauaaacaauagugugcugagugacuuaaugucauaguuuuuuguuugcuggaguuugaagucacaugauguaacacauacccacuuuugcucaucgcuuuuugccugucuucauuuuggaguaguaaauugaguaccaauuaguuucaaaaucuccaggccaacuuaaagaaguuuagacaaaagcauaguggauaaaaugaaagaaaguuaggucugacuugagaaagagugauuuccugggguuuuagagaaaagaauaaacagggagaaaaacuaagaggcuuaauuaguugaugaggcgggccugaacuauuugguagaaauaagauaaguuacccagggguuccugugaaacaguccugugagcaagauguuaccauuuagagcuuucuguauuuggggaucaugagcugggcacacauggaugcacuggucuucaguccugaagagaagaguagaauacaugaaggguaugagcuggauucauggaagcauugcuagggaaccugggagggaaccaguccagaaguggaaggaaggcagagaggcacuguaugaggucucuagguuggaagaacauucaaggguaaaaagaugcuuguccauggagugguacaaagauggaaguuaugaacuuaacuuaaacggaaauguaagauuguucgcauacauuuaaccuagaaaagacacaguggaauagacugugaagauccaagugcagaagcuaguccuuaggaaaugaaaacauugcuccuaagaaggcugcagcccugagugacugauuggacaugguagggcaaguccuuuaagcuccugccaguuugagaggauggagaccacaaaggaugagaaaagaaaccaauuguggagaaaagaugaucuucuucaacuagugccuucguguugagaugcugaaucauccgguaauucaauacuugaguucugcuuguuuggaggcauuuuaggaugaaauggaagaaaaaauguaaagcgugguauuuuuugaaguuguaguuggcuaaggauaaagcugugaucacaaacacuguugaaagagauaaacugugaacaggguaugagcuaccaaaacaaacaaacaaacaaacaaacaagcaaacaagcaagcaagcaaacaaacaaacaggggaaugagacugaaccgaagaggcagagauacucacucccaaacaggaaugacaaauaauuuaaaggcuuuaagccagcccugaguaaaggaugggaagaucuucaaagcuuguguauuugcauucauucugggcuuagaaaguuuaagccaugcaugcucuaaagaaugauggcuauuaggcauugucaugggaaaucacuuuugucaucaaagaauauaaaagcuguccccucaauagauggcaagugaccccauguaaauccagcacuggcuuaucaaaauagacaaaaaugaggagugagaacuuugcuguuuccugucuaauucgggcuucaagcaguugaaguaaagcaucaagaacaauauugaagacacugugaauucguauugaaaaggaaaaaaaaucgauggugauguauuuacugauauauuuauuggccguggggaaucuucuaaccaucacccacauggccaaugucaggcagccagggcagguuuaagauggcuaagguugacccuguggucugaaaagggaaauccaguaaugacuucuauuaacuauuuauauuaucuaaacagugaauuaauuccugugcuccucacacccaccuaauaggagcaaccacuuuccccgguuuuagaugcaucuguuggauggggagcauacugagacaucuuacccaauguuaguuacacagugagcaugaguagcagggauuaacucaggcccauggucuccaacagccccauaucaaccguaccuguggagaaggaaaaggccuggcgugauuagcaucaaaagaccugaaaaucauaguggcacuaguggcacaauuaagaauuccuagcagccggguagguuguguaaaugucaagguuaagaugccugugauauugcaaacacaucuccugagaaggacagccagucacuucccccaagugucacuuagaaaaugaagcugguaauacuagauuguacugcuaacaucagaaaaggccuggguuuuuaaugugagauuacccucuuuucuagugucaacgaguaguuuugaggguuuuugcugcauaguguagcucaucuaacauacacaggcaugcacacacacacaugcacacacaauaccugaaacauagguccugccauguguuuaucaguaggaaauuauaacuaucaauaagaauauuaucucuguauaucuaucuaucuaucuaucuaucuaucuaucuaucuaucuacauaucuaucuaucugaagauauauugcagcuauaauagugagcacuucuauuuuguuucuaccauagacaaaauuaaggaauguuagauguauuauaaaucucuguauuguuucaauuuuuauguggaaugugaaaucugugccuuaaaccuucugaacuuuugcaugcaaaaauaaaauuagauguguguguguguguuuuuccccucugaaaaucaacaggaaaagucuugguuuccaccuccacuguguuaugaagucagaacugacuguuuauauaauaccaaugaggcuaaauaugacauuugaagucagccuccauguguuuccagacagcacaugcccugaaucaugcagacuaaauaauaagcuucacugcuaucauuucuacccagaaaaguuaaaauauuagcaaagcggcggcuccauucauugacuuggggaaccucaguauuugugaagauguuuuacaauaauaaaaaacuuuaaaguuagacuagcacugaaagaaaauaaauaacaucaaauacucguggauaaaagccuugggagacucuccaccuaacacacgcacacacgcuuacacagacauauauacacucacaugggaauggggccagaguacauguguguaggaggccuaacuugguugaauacagccaggcucaccaaaaaaaaaaaaaaaaaaaaaaaaaaaaagacgaugaaggggaaaaaaaaaaaaagaacagggauaaugaggccauuuuucauuauuuucccaagggauuuuaaaauaguuaccucauaaaauaaauaguuuaaauuuccacauuacuuuuuugccuuuaaucugugccucuguugcacguaaaugaauggagauuuugugcucucugugcuaaaacagcauguuagagcauacugagguugauggaggggagagccaguacgaaaaggagucugucuauaggcccaguuauuuuuauguucuuugcucaauuagauguuucucuggacacuucugcauccccagacaugggcuucucaaacauaaauguagcuuaaacaggaaucuuucaaaucaacccaggggcugaccgagcagagaaauacacauuuuguauacaaggcuccgcagcaaagucucaagcugcuuuugaguugagcaucaacaaggucaguuaagguguuaaaaaggaacccgaagcuuuuguaaaacuaaaaacucaugugcuaauguaagagaucauuuaugguccucauuuaagggccaacugaauuaacucagcucucuggcuaauaaacagaaagaguccaccuugcugaaggucuaauuacagcucugaauguucagugaguuuacagcuuuaaacaucugagugagucugccucuugaaagccaugugaaguuggagagccagccuaauuaaaacaaaucuuggauaaaccacuucacggagauagaaguuugaugguucgguauaucaaaaauuguuagcagauguuguucagaggccuuaacaguucaaagaucaggaggguuuucuuucucgucccccccccccuuuuuuuaacaaagcaaaaauauucuaauugaaguugucagcaggagugagaguaauaugccuguauuugauuaaauaauaguuuauuuaacauucaguguggaucagaauuggccaagaaaagucggaaaacauuuuagccaggagacugagaaugaaaacacacacacacacacacacacacacacacacacacacaaaaaaaaaaaacacacacacaaacaaacaaaaacaaacacaaaagucccaaaccuacaguggcaucucacuaacucacucacugugguuugaucaugucagcucuuaucucacaguccauuccuacguuuguuuuacuguauggacaggaggacuuagcacuuuuccucuuuaauuuauauuauauuuaccuaaaaaggaaggggagcaauacaaacgcgcuagaagacuuauugcuggaagcuuggagaggaaagccccaugucuuuuucuguuauaaaaauguaaacaucuauauuuuuaggagcuguguguuuucugcaagcugcuguuccgacucucaucgggaugugaagguuuagcuuuauaaaacagaagaauguaaggcaagcauggcccuguuacaacuuacaggcaccuuuuccugauuacacgauagcagcccguaacuacuuccuucccguggcugcacagcugugugcugcucacagacacagggcagccauuccuuuugaaaaacaaggacacucacucaguccacauaaccuuccuacugacccccagcccuuugugccaauccaucuucucccucaacauacacacacacagcuaacccugaaccaauggacuggcucugccuugacuguuccaaacuuuuaucugacuucguagacaugaaaguuuuacacaauaucccaauuagaaucaaucuuucuuucuuucuuucuuucucucucucucucucucucucucucuuucuuccuuccuuccuuccuuccucucucucucucucucucucucucucucucucucucucucucucucucucuuucuuucuuucuuucuuucuuucuuucguguguuuaagcauuuaaaacaaaaaucaauaguggccaaugcccgagcgaucauuugcucuccauaaauacacagaggucuggauuuuuaaaguaaauugcagcaugcucuauggcaauuaugcaaggacaacuagagagucauucaucauugaaacauucaaauaaaacuaaauguuucuuuuuagaucuaaagugcagcccauaaggcaaaugaaauagcauuaauaggaggagggaauuaaaggacagaaaacagcuguugcccucugccagccuucccugggacucgaaccagagcaggguacuguauacagugagggcauggauugcuuuugauucgaucuuuucucugccauccugagcuuccuugguuucagggggcuuggggugauauucucacaugucaaaacacugccuuuguggacauucagcagaggagacaaacggcuggaacguuuaguuuuacagcuguugccgagcaguguuuaaaaguugcuuguuaucuacaaaguggugauauaucaggcugugauuguucucuauaagggagaaaugcuguucucauguagaguauuuugcuauuaaaauaaaguucaguuucccuaagauuuguuugaaaaacaaacuucguagaaagcuugaagaagccugccucacucucccaauuuguccuugaggauagaagggaaaauagcucagagguccauugaagaaccaaugaccacguccaacuauacugugaucucucugacauuuuaccugguucaguuucugcccuuugaauccugucugaaauuucucaccauuagguucugcuuucaacugucacguccucuaauuugucaucauuucuauaacaccaucaaugucaguacucagaucagaccgauguaaaagaauaaauuaucugguucuagauaaaguguacuccaugaugaaucugcuagugucuaacucagaacucugagcuccuacauucaugaccaucauuucaggaagagaaaaaaaaaaucacagcucuagaccacaaacaccauuaccucuccuguuuagccuaggaauaagauaggugagcaaaugcauuccuaguugauagaaaaaauaugcaguaacuaagauuucaggguucaacccuuuaccuugggauuuguuuuguugaagcuuuagcaaaacaaagcaaacacaaaaguaaaugcaugcauuugaaacuaccugacucccuucaaccaagaacaaaacuagaugguuggacacuuuaguauaggugucauguguauguaaaaagauugaaauuaacaccacuuuacugcauugcccuagcuauugacauucagauugaucugucacuagucauuauuuauuuccaaaacagcauaaaaagagaaccauacaguaaaggcauuaccgugguauaugcauaguguuuucuuuacauuuucaguuuaucaugacuagaacugugauagucuauaaacaauaaguggauaaaauuaugaaacggagggaaagaaggauggaggcaguaauggacuacaaaaaugagggggaaaugcuuuaaacugaaaaaugcuacauuggggauaauuuguggcuuuucauuuucuauuccuccauaauacagacagacaacagagagaaacuaagcuuuagaacucugugaaacagaugacauucuguguacaccaaaggugugauaauucugaauaacuugccacuugccuucuuccuuuguuuaggauaaaacacaggguacuuaagaauuaaugauaucuuuguuuauguggauguccuuagaauuugaaccuugccuucaauuuccacagcuguauguuuagcuaaguuuccauaguuaggaaguccagcaugguguucaaugugacacauguauaagaguguuagacaugaaugauugaaugaauuacagauaaaugucaccuuguaguugcauuucaagggucaucgcucuguccuguaugcagaacuauauugcaccagaugccuaucauuuggguuguaaguaaaacuuuuacuguuuccugaccacauaucuuacuccuguguaucuuucguuuugugauacaggauagaacuuguugacaccagaaaaauauacuaugcuuuggcauuuucaucucagaaagaucacauuuuuacuuaaaauugacuucguaaauuauuaaaugcauugaagccagagagaaaaauggagcccccaaauuucuuuguuguaguuucaguguuuucuuugacucugaucuguaaccaaacaaacuagacacaugccuaguaguguagaauucaaacaaaagacaguauuggcuucuguaggaugugaagagagccauugcugaaacugauaguuacuaaucuaauauuugcuguguaaauaugagcuaggaucagacacggggcugggaaggcugcuuacauuuuuccuacucuguuuagggaccucauacaaagguaggacgccauccuccuguacaguuagaugccagcuuuccuagcaaaugaggaugguacuuucagugaguuuuuaguucccuaacauauaugccaguggagacaauuauucgcccauuaaauacuuuuugauguuuagcagacgauaguaaacacacgcacucagauaacaaaucugaugucaacauugugucaaaugaaaagcuuccuuggccuuugaguuuagauaaaccuucaagagaagucucuggucagcuggccacagggcucuuauugugaaccucccaaauguucccugugacuguucacugagcacugaggaaaugacacugauugaaugucaaagaguugaucacagcaccugucuuggggguagugcuggucauugugccagaguguucucgccguguucuuccacacagauucuucagcagaaugguaggcauucuacuacuuccuccacagacagcuuuuguagaaaggagaaaaugguguggaucaguuuuguccaaacaguuacaugagaaguguagauaaugauggacucuuuuagaggcuauucaaauuaaagagaauaccagcuggcuuggacugagcauccaaguguuuucugcagcuauaucagaugcuuuacuuagagaaagcccccccccucccacgcccccguuagaaagguagugccuaggaaaaucacuuaugcauaugaauauuugcauuuuaaagauacauauguauacauaugaaauguaaacauuuaaauuauacacauuggaaucaucagcuucauuuuaauuuuaaugcuuuacuucucauaguagucuuuaguuuuucuauugaaaguccauguauuucuuauuuucauuuaauaugguucacauaaaacugauuccugugcccuagacucagugccaaaaugcacggcuuacaguauuuuuauucaaauagaccauauuagaaauagcauccuaucccgggccugcugauuaaaggucaucccuuuaacaauaucaccagcuaauuuguucuguauauuaaguucugaaaguugaauguagacauuauuucuccauggccauagugagacaugguuuagguuuagccaacaaggccucauuucaagauauuggguugggcuauuuggugauuggucuagguaguucccccaagacuuuuacaauauguggagcauacaucauaaaaggcucugaagguucagcucccaucuugucugugaacaggaagcauauuccagagggauggaaacugaucuuaagauagcgcuggaauccgggauaagcuauacugaaagucggucucucccagauguucaacuguaugagucaaaggauuuccuucaugugaauccagucuguguucuauuuuuuaccauaagcgacugacaaaaaguaaaggaaauaaaggugauuaaugauuccuugcuucuucaugucuccccaccuauguaugcgggcuucuuagcugaaugugugcacaugugcuucacuuucucauuaauuagaagccauuuagaaacauaagauucauaaaaagucucaggauugagacaugucugcucucuugcguuccuuuuaauugcuucacauguauuuaccuuaccuccccucaaaauuauaaacacuucaaagguccuggacuuuucuuacaugaggcgauaauuuaaaguaauaagacguuuauaaauaaacacagcagaacuuacagaaagaggguagacuuucgaaaucaccaccugaggaagcugccaauuuauucagguuuugcugacuuuggagagaacauuguuguaaaucuuuagaaaaaggaucagcaccgguaauggagcccugcgaguuuccugauguuuuguuaguaccaucugauuuccacuggaagugacgcugacacugcugggaagcauauccccccccccccccgaaggaacagauaccauuagggucuuccaucgggucuccuaaggaucucagauaccucccaaaagagagcugccuccugagaaaucucugggagcuaccuauguccagaaaagaaaggccuuacagaugcauguagaaugauccuauuccaaacuaagaagcacuuaguuauacugcauuucuaggaguuuuauaauuuaacacuguccuuggguacuaguucuauuucuuaaucuuuuucauuuuaugcauacauacacaccuacacacacauacaccuacacacacacacacacacacacacacacacacacacacacacacacauucuuuccccucccugauuucucucaaauucucccuacuuuccuacccacccaacuucauguuccuucuuuauaaauaaauaaguaaauaaauaaauaacaaagauaaaaacaaacaagauauaugaaauaugaaaccaagaucaaaaaaagcacacaaaagaauguggagucuguuugguguuggacauagucccugcccuggaguauacuggaugaauccaaugaugcuccuuuaaaaccagauuuuauuuuccauacguuuuugguuaggcaugagauuuugugucauucuucugagucccaggauuuugucuguuuugaaccuguccaggucuuauacauacugcuauaucccuaugaguucauguguguccauugguacuguuguuucuauaggauguuguuaccuuaagucacccuccuccucugguucuuaaaaguucucaccuuucagcaaaauuuugcuggcaugugcaauaacccuaauauagcugucucaugugagacuaugccagugccuggcaaauacagaagcggaugcucacagucaucuauuggauggaacacagagcccccaauggaggagcuagagaaaguacccaaggagcugaaggggucugcaacccuauagguggaacaacaauaugaacuaaccaguacccccagagcuuguaucucuagcugcauauguaucagaagauggccuaauuggccaucauugggaagagaggccccuuggucuugcaaacuuuauaugcccaguacaggggaaugccagggccaagaagugggaguggguggguaggggagcagggcaaggggaaggcauaggggacuuuugggauagcauuugaaauguaaaaagaaaauaucuaauaaaaaaugaaaaaaaaaaaguucucaccucaucugcauagaucacuaagucaaagugggaggggaugaugaagacaucccauuuaguaaugaguguugcaaagucucucacucucuacacugucuagcuaugcuucucugucacaaucaacaucugcuacaaaaagauucaucucuaaaacugaucugggucucagcuuaaaggagauacuuugaguucuaguagagggcagaucuguccaucuucagaaucacacacacacacacacacacacacacacacacacacacacacacacacacacacacaacugucuuauucauuaguuucacucugaguacuucagucuaaacaugauauugauuccucaaaagaaugauauuguauaagagauggaacccauuuaauucuuauuuugaauauuuaccuuugagaaacuuucuaaguaaugauguuaguuaaaaggagagaccuugagauaauaccaguuugggugucuuguuuguuuauuguacgguacuuguguuggcccucagguuucauccuugcuaucucuguaccacuaugugauacugugcccauuucuuuucuuuucuuuuuagacaagaucuucuuaaauuguccgagaagaccuuguauuaauuccugcuuuagcuucuugaguagcugggauuacaggacucuaccacaaggcccaggcuuuguaauacuaaguagcagaagcuaaauuguugucuuuagagauaauauauuaacaauuuauaauaaacaaguaacacagaucauguuucuuuuccauaugcuaucauggcccaagaauguuguuuuucuggaaagcugagucuuuucauuacuuuuucuaaaggaaagagaaaaauccucugcuuacugaugaaauaucaagcauuuaaguuguaaguuuauaccuuuccuggcugcuacuuuugcaagccaagaagauuucaacagguaauaaacauucaaagaaauaaagggguggagaaggcucugcauugguugcuaaggaaaauuuaaaucaacugagaaggcagcuuaaggaaacccauguuuaugaugaggacugcaacacauguuaauuguaguguuagugcaaacuugcaccaauaggaucauauuaaacaucacacucucauuuaggaaagugagcacaucucaaagcugaaauuuugaauucaaagaucuguuucucaaauauugauuuuaguucauuuuaugagcuuuaccucaauggaagaggucauuuuuaacaaaauauuaagaacauugcaguuuuaugauauuucauuguggcauuccucuuuagguuguagaaacaaagucucucuguaaauagucagggauuuuaggacuauagcagauccuacagaaaaauaagaagacaucuaucuauaucuagaagucuauuuaaagugaaauuucuuuucagaauuuauuuugaauauuaauuuuuuaaacuuacauggcucccuuuuaauaauuauuauaagucagaccacugauuauuaaaauuuucucuaaucauuuuuauaagucuauuaaguagauacacccauguguuuaugugcacaugaaggugagucugaacacagggccucacucaguguucucugucaugcugcugcauaugggcauuugcagcaauggcaggcuugguggaaugcaauaauuauuuuuacauaauccuaaaucuccaaguugaaaggauucaggcagcauaagcuuuuaaacagcugcacugagcaaaacagaggcugcgagcuuuuaauguuaaagagaaagaaagggaaccauuauccucaagacucuagaaacgguuggguugucugaauucuucccugucaaauguuucugccacuugcuaaaagcacagugcacgugggguauugggcugugguugauguagcagcagcagaaaacagauaagcagauaauuuuuuaaaaauauaguuacccccagagcucauaucucuagcugcauauguagcagaagauggccuaguuggccaucacugggaagagagaccccuugguauugcaaacuuuauaugccccaauacagggggaugccagggccaagaagcaggaguggguggguaggggaaagggaguguauagggaacuuuugggauagcauuugaaauguacauaaagaaaauaucuaauauaaauauauauauaauugaggccgggcaugguggugcacaccuuuaauccuagcacucggaggcagaggcagguggauuucugaguucgaggccagccuggucuacaaagugaguuccaggacagccagggcuauacagaaaaacccugucuggaaaaaggaaaaaaaaaaaaacaacaacaacaacaaaaauauauauauauauaauugaaaugaagaauagcuuucacacaggcucuucagucucugucacaacuuauuucuugacuaaaguacuaucuucaauucugauccuguauggagccaaaguauaaaacuacuauuuuaauauaaccaccuucacaagaguaaacuuguguacugaauugaguagaauuagacauaagaacuauucagugcuuauuuuccuaccucacauuauaucuguaaauaauccacuauuacuucuuaguauuaagagacuuuagaguaaaggcauaguucaaaugaaaucaaauuauuuauuuaauugccacacgaaauauuauuguuauuauuuacuuuuaugauaaauaaaacuccuauuacagcugaaaauuuuauccuguacaaaaucuagagauuguuucugaaaugaucuacuggauccuggcuuauauuugguuuuccaacauuaaaucuuggagaagguguaacucacagacugaacacagagcauugaaugauggacacucacugccuuucacuuacguuaggaacuuggaagaucaggacauuccaaauguuugggguuuuuuccauuacaacaaucuaagcuccuuauauuaauaaacggaguuuguaaagauaauuucaacucucuucuacaucauuuguucaacagucaguauguuccuaauuucgugaguccuuguauuuuaaaaugccauuauuucucuauaggugauugcucccuuccucacuauuaucaagaaguaggcaugcuuuaaugaaucgugacuauuuucauccuauacagaaaugucaaguucaaggaagaauagcacagcuguucacaaugucauaccuuauaaaacaaaucuauuagagaggucaaguccuagaaggggucaaguuaaugauauaaguggaauaauuuggucauuuucugaaauuuguaaaacuaugcacauaaaagcccucuguuagauugacuaauuagcuaaaccucugcuaauuauucucuuuaaaauuuugacucuuucuuuucuuuaggaaauacuucacaugguuuuugaaaaugugaaucauuucagauuuuaaacuaguaccagucaauuuauacuuauaaauuugccuuccuucuuuggaguggauuuaaaggaugauaguagucaugucuuccuuuauuuuaccaaguuuguguguguguguguguguguguguguguguguguguguguauacaugaaauuuagcuuuauauucaucuuaguaaguaaaaaugucuaucuggaaauauucauauguuuuaaugaauuacaaaaaauuauagauguuaguuagaguaaaaggauggcuuaaaccacuuuaaaaucagcgaauaauacagccuugugaaacauagaguaucuaaaauguuaauaauauauaaauugauuccucaccaaaugucugcugagauaaaugagagccacugaguucacaguguaucauuauauucaucacauccauauuuuucacaaagagguauuuuaucucuuuggucaaauauaaucuucuaaauuuggaaacaaaaauaauuuaaauuuuaauuuauauaauacaauauaaguucauugaucuuuaaagauuuuagguauauuagaauaaaaggcuuucaaaccacauuuuaaaaggcuauauagacauauagagacagauauauuuaacuauguuuaaauguauauauguauauuuaauugagaauauuauucagauuacaaagcaauaugauuuguagauaucaucccccaaaauuauuauucauuuucuaaguaugaaucuauacacauauaaguaaucaacuuucuguuuccaugaauuaaguauucauuuuuaugguuacuguguauaaucucuauagcuuuauuguguaaagaaagaaacuuucuguaacuguggagaauauacagaguaggccuaaagcaaugugauccauauuugagacaguuccaaaauucauuaauucuuuccccaaauucccacuucauuuuuuacauaagauauguauaucuugacggucauggugguucacaccuucagucucagcuuuugggaaggaaagguagaaagaucucagugaguuggagacuagacucaucugucuccauagugaguuccagggcagcaaguagucccugucucaaaccaaacaaagaaauguguaucuuugauagucucuugguuaucaucucacugaaucuauuaccaggguggauuuaugugcugcaauucuuaaagucuuaaaauacagugaaaaaaaaaacaaacaaacaggaaugggaaguagggauacugaaggaaaaaauacagaacaacaccaaaaaaagaggugggggagguacucauaauuugacauguguaguuaaaaauggaaaaccauuuuaaagucaugacuucuacaaagaagucuuagaucaucauccacggaaucuuuguucuugugaaaaauaugaaugaaguuuuuccauguaagucgucauauaucaauaaacauauugccauaguuauugagcuauaccauauugucaaaagguaugcagguaugcaauuauaauguaaaauuuauuucuugacauauucaauaucuucuaaugugaagagagaaagaaaauuucagcaucaagccccauguucauaucuguuauuuagguaugugugagaguugagaguacucuauaacccaggaaucagagaggcugaugauaaaacaagcagugauagacuuguuuauauuccuuuccaccugcuaaaguaaaucaucuuuaagcuggaguagaguacacauccuugaguucucuaucacgcucuuauacaauccuuuuacauacaaauucauguuauaucauuaauuuaaauauucuuguccauuuguauuuauuuuuacacugcaagaaaauuguggacccucuuaagaccaugccaguaugcagguaucacucacacucacaauuuauaucauacugacuuaaugaaaaugaaaucaagcuauguuauugcacucuggguuacuacugaaaguguuucauuggauggcuuuauuuauuucagaauauauacuugcauaucauauguuugcaaugugaacacauauauaaaugcauauguccacauaugcaauucccauauguuuuguaaauuguuuagaagcuugaaucaauaagaccuccuucugaucucagagaauauggaguguaugcaaggugcccaauuuuuguuuugaauuucagcaaagugaaacuauuuacaaauucuucagaaaugagauuuauauuucaucgaaaagcuacacuuaaaauuggauuauuccaagcacaucauuugccuaugggcacaaacauuuuguuucaaagagauaacucagucaaaaaaaacuucuucugauagaguucucuugaacuaaguugucaauaauucaaugugcccauuauaagcaaugcuacaauaauaugaauguuaaaauagaauuaaguccaucuuuucagaaucccucaggucccuaaguacaacuuucaauacaaauuauuaaugccuguagucugucuuuuacucuaaaugccaagaauguaaagcuguuuggugauuuaaaaccauguaauauauaaaaagcuagacauagucccucuaugggcacuccagacagcccuaaccaagagaagaauagcuuaccaugaauaguuugauguaaguauaguauauuuuuaaauaaaaaugggcuacucaagauaaaaaccauaugcuauuaacuuuucuuuuaauuuuuuucuucuguuuugggcauugcauuucagcuuauuuauuaauguugcccuaauuuuucaauuuuagaauaugaauuuagaauauucauauauuuagaauauaauuuagaauauagaauuuucuuuuuaaaguucauuuuccucauaauaaggagacguauuucuuguaggauacuuggggcauugguuggcaauucuuagcuauaucuuaguuaugucuucugcagauacuauaggcaguuuaaugaugucuauucagggcaaguuuagacauccugacagaaggaauaaagacaugaggcagggaaauaguuuuccaaaaguuacucuauucuauuugcagaaagcucacucugccggaggcuuaugucugcauuugcacugcaaggucucagguuugauuuuccgauauuaugccuaauguauaaaaugccaaaguuaaagaagauuuuaacuguucaucuugguacugaugccugagcagacaccuugaguguccuuggugugaugagguaguucuugcuguggcuuaugaugcagugugauuaacaaaguucagaucacuuagagagcuagguacaaggaaguguaugauugaaucauauauaaacauauauguguguauuacacagacacacagacacacagacacacacacacacacacacacacacacacauccaagcaaagacaaaaacggcuuucuucuugagcagcugaaggcagccacaguaaugugcaaaagcagagagaggcagcauaagguaugugcgcuuuuuuacagaugguacugcagacaaguugguaauugaaaaggaagucauguacgugagcuauuugaugaggggugggggcagagucuuacagaacuuucgugaguaauuuacugggacaguuacuaaagaagcagucuucccaugaaagguuucaguuauuaugaaaauacgucauuauuguuaaggaaauuccaugcacucuuuuugaaagucuuguuauuaaacuuuuacaaaucaccuucgauuuuccugucugcacggugcuuugauaaugaaguugucugcugagguucuguuuaccuguagucgucaaggagcucucaauaaagauggggcaucugucugaagaaugauaucauauaccaggugccuauuucagccguuggcaucaucucuuuaaauaacuaccauuucaugugucccuaggaaacacaaggcugaauucaaaagugauaagacuuuaaaguauguaaaagauucaaaaugugggugaaauucaaccucauuuuuccuaguuguacauaacaugcacauguacacacacacacacacacacacacacacacacacguguuuuuaaaacucacauuuugaaccaaauaucugagaaacugcaaugugucaccgacuguaauuuugaaaaauacagauuuuauaugauugugauuguuuuuggacucuaugccuaauacuuguauuaccucuaaaauguuuguguguuuguauguauuuauguguguauauuuauauguuauguguauauuugugaguguuuuggguauauguuuguguguauauauguguauuugugucuuguguauaugugucugugugugcauguauguguauuuguguauauguauuuguguguguguauauauguauauguauauguauauguauauguauauguauauguauauguauauguauauguauauguauauguauguauguguguguauuuguguauauuuuguguguauguguuuguguguuuuuauguauauugauguguguguuuguguauacauguauaugugugugugcauguuuguguguuuuguauguguggauuugauuguguauguauauguguuuagaguauguuuaugaguaugucuguguugguguugauguuguaauaggauagauacaauagcuaccaucuuugggauaagaggauuaauacucuuuuucaauguuuuauuuaugucguauccucuagacuguagaaccugaaggguuuggaguagaggacguuuucuuuuugguuaaauggaaagugucuaacucauggaaucaaaaaaugcaugcuuuaucaguagacaaaaaugcuaauguguacacacaaauaaaacaagaguaaugaaaauuaauauuuucaaauuaucuaauucuugauauauuugguuaaaagaacuauccuucuaacuuagcaaauaaugaucuuguaugcuaaugucacccaguauugugaaagguuuauuccugaaaauauauaaauggguaaaguuaagguaauaaauuuuuaucugacauguuugcuuauacauuuugaaacaccagcaucauuuuuuuucugucucaucucuagccaagucagguacaaaagcagaguccuagaauacagcauccuucacaugagacaggcguuguuagggucuaucacuggggucaccaacuauacucucaauccagacacuauguuuagguauaucuggaucaaagcacauauguuauauuuuccaugugcccccauucguuuuccaccacuaaccacaugcucucuucuucuagcugucaaccucagagcaaggaugagccauuuauuucuguuaccuuuuaaacuuacauaacuccaauugucuauaggaugaaaagauaggaguucuuuaaaggcagcuauagugaagugcuuuugauaaaacuucccccaagucaccuccauaauaagaagauuaaaaaauucuacuagaaaccauaguucugaaaugaggcaggucuguuuuuaucccgggcuuauuaacugacaauugugaaacaucacuaggccucaguuuucucauccuuagaguagauggaagaauaauaacauaugucugucagaaucauuuugaaauugucaggugaggugaggcccuugguaugcauauacauaauuuaagugcaaaauggauuauuaaaaaagagauaaaaaguacucagugaaaccuguaucaaauaaucauucaaaaauauucaguggaaauugaucauguucuuuugccuagacauugagaugaagauguacugauguaggcguguguguguguguguguguguguguguguguguguuguuguuguuguuguuguuguugauguuguuguuguugggaucugcaugucuaugguauaucugggugauagauucaugugaacauguucauucauggguccaugcacauguacagaccaggaaucaacaguggguauguuauucaauggcuuucccacuuaguuuuacagguagggucuuucacugaaucuggcacuucccaauuccucuaagcugaccaaccagggaacuccaugcacccaccuuucuuuguuucuaaaguauuggcacuguagcuggauuuguaagaggaucugaaguuuccacauuuguauggcaagcacauuagugacaaggccaucccaccugcucugaaaucaggauaucuuuuuugaugguauguaaguuaaagcacuauucugucaucaucauuuacuucaucaacaaaugaagaauaauaccuaauuguucacaucaaaccuaagcuggaaacauauauuucacaguuauuaucccugggauccaguauacuuagaauccuguguucucaauggauuaucuugaaagaggcagucguuugaacauuaugaaguuguuugugaggaaauuugcaugccuagcauuuucuguugaaaguaugauaucuuuuuauaagaauguacaauucccauauguuagaagucauuuaaguacgauuuaugaauaaauaacugcauugaggacaguacuguuucaugggccagcuauuaucucgguaacuaaccuaaaaauuaugggcauuuuuguuucuuucacaucacacucaucacuguaaaaugguuucuccauuuuuaucuugggaagcugauaacuguguauuguauacuuacuacaaaauaguucucugccagugagguuuuauauugugaauuauccucaugauaaaugugcuuauaaaauaaaucccauaaauaaaauacaugauaaauuagcagaaucaguucauguauuuucccgagcagcaguuuuauuagaaggugcuaaauuguuuaacagcccccccaccaaagccuuuuaauauauauauuuuuagugucagauuuugucacuggcauugaagaaaaacaaauacccaguaaauguagcuaaaggugaaagcagcuccuugguggcagaaauagaagcauagaggaacuucaguagaucuuugaacaauaaugacuuucacguggaaugaaaaaugacagugcagacauaaauuuucgaccauauuuuuagcuguccaaaugcauacuugcugugacagcagaguguuauuacagaaacagcaugggccagaagucuaaagaacuggccuuuuccagcucugaugcugugguauaauuuguauguacuguggauugcugguuagcucaauugccaaacuuaggguauaucaaagaaaggugaugucaccuucagaccuaagaagugaguuuucuaucuacguaauaaaucucuaaaguaaucaugcuugaagacuauaugaguagugugugugagacaugcauuaggaaauuuugguuuucuguuauuugcugccagggccauguguugcauauuagaaaagauagggcuaauguucuggcacccuuacaguggcugguccacuauacuuaagcaucaugggaaagaucauaugcacacugcaccuggauauaaugugugauagcuagaauguacauugccuccuguuguagagcaagaguugugcuauugcuccugagauauauguuuaguuaacacucgucaaugaugugcgaacugaaacaggugauuauagaaugggagcuugggugaaccuuaugaagucccuuugguuuucuggcaagaaaucugaggacagccagggcuguuuuagagcaggcacagucaugcuguacagcccauuucaacugauucuucauaauuuuauuuggaacaaaagucagccagaauaucggugacuguugcuuucucuuggcagaaauuuugcccuuuucuuguuaaauuauuggccagcuuguccuucucgaaugauucuggcuguucaaguaaagcugaucacugcccacucuucacuguuuguauuuucuuucccugguguacagugggaucauguauaauaaaccacuucuauuucuggagaaagagaaugcaaauauggcggcauucacaucucauugugguaaaugaaaguaauuagccguaaaacaguauucaguauuuguccaauaacagauaaguacuuagaauggaucucguaggugaacaucauuaaaucauauuuaguccaauuuguugagucuuauuaauaguauauuuuuaccguuguacaauaaauaaauaaauaaauaugaacuuguuuccaaaauucuagaauguugcauauuauuacaaaugcucaccaauaguauaucuucucaucauuaggggaaaaauuaacccuuaaaagaguuguguguaugggaauugcuuugaaaagcuuuccauuuaauuuucuuuuggcacucaugaaaggucucagcacuucaacucuguguccaccagaaaaucugcaagaucccaggccaugggaaguuguguauugcuuaaaccccauauuguagcacagugccagccacaggcuggacacucaauaauuauucccagaacugaauugaauuaaacuuaccacugaaauuuuauuacugcaaaauugaaccagaagguucuaucguagccaucuguguguuucucuaaaaugaaauuugcaaagaauucuugauauaaucaaauaaacacagaaaauauuuaaagaguuaaaaauauuugaggcacauccagaguaacaguguguauaucaaguuuuagauugauuugauuuaaaauggccaagauauaaaaccauaaaaaaugugaguaaauacucuuccuaucaaggcuuguuauauaauuacauggucccagaaugguucuuauucauagaaaacuauuauaaaagaucauuucuccagaaaugucuuugccaguggagacuuuaauaucauagaaaugaauagucuugucucugaauguuaagccacuugaauaaauaauucaaucaaguuuucauuuuauuaaucaagugaauucaguucuucuuaauaaugaaacaugaaaacccuaaaauuucuguuacuggaugauucucaaguaauaaaauaaaauaagcaauaaaagcagcugaaacaauuuagguuauuuuuuuuccccuugugucauaucuggauuaaccaacacacguggcaaaucucugcaucgaaagacauguagcuaacugaggaagcacacccuugucugagcaaagcuugacuggguauuaaugacacuccuauagggcuuugaugugaacguaaaggcuaaagaugcuucgcuuucuugaaaugcugguucuagaugcuggguuguuucuucuguagaagugaauagcugagaggacuuuauguagguuugggguuagaggacaaccuucuaccacuguagcauccaguaaaagccggcagaauuagaagauccacuuggucugugucaacaucuucugugccucuguuuaaguacuuagcguuagcauuccuuuauccagggaggaaagauuagugcuaaguacauuccucaggaaugacaggugguguaauacacuagcuacuuucccuauucuucccuccaccagcacugcccuuacugcaggccuguaauucuccacucucuagcauagggucaaagcaguacauguuuauuacuaucucuuaagaacagcuuguaggaaauggugaaacuugugauuuaaacugcacguggacaugcagaaccaucagaaauauaugacuauuaucauggagaguucaggcuuuggucuuguaacugccaaauguaacuuguaacuuguaacaggcuuuggucugguaacucuaacaccuaccaaaacuggcauuacaucgugcauuguuuucucgauguuauucccuauacauaauuaauuguugcuuccaagcucagauuaauccucuuaauccgaaggaaacauauuuaaguuuuauuucaaaaauagaagugaauacaaguggugaaacuaaucauaagcaaugcuguuuccagcacuguccuuggugucuucuguuuuuaagaagcucacuguaaaggagaaaacuuaaccucagacaugcaggaucggcuuugaauccauucguagagauuuucuuuuaguuaggguaaagcuucuuuacaaagaugggcagaagaacaucuucuaccuucuuuugcuaacuggcccuuguucugccugggaguggagccaggaagugcuuaccccagggaaaucccuuccuguguucgguccggguuagagagaugagguucugugguuacuaaacugaggacaggguacacauuuucgaucuucucugccacuucgagaaguuuuggugccucggagacaugguucagcaaguuucaaagugcuaaauuuguugagaugagacuuaacaucuuacgugugaaauacuucucaccucccucccacucuccacccgagcaccagcacccuccuauugaguaggugugaacaccuagauauuccacucugacucaguuuuccagucucauaauugauaagagaaguccgagugagguacagcuagcugacgguauguaacuagauauguuaaccacgucuugaauguucaaugaugacauuuagugaaaacaaaacuaagaauuuucuuuucauaaaacguguagccaucauugaauucuuuuaaccaauauguagacuuccuaggcauuuaccaaucaaguuauuucaucucugccauguuuuaauaguaucuguuauacaguaugaaugcccugacucucuuaucagaauacgguuugcacuguaagcccaggagacaguucaucccugugagguuaggcagcacuuccuauaguagguccuagugaagaacagaaacaaguuugaauaugguagccucaguucucaaacugauuuguaaccucuaaguuugaguuugagaauucaaaguacaucugauagauuuaaauuaagauauggguuguccuaaaaaauacagugacuuuaauugaacucuauguaacuguuaagugugagauacagcuaagaaaacaaaugccguaauuucaggauuccccccuacuaaugaagggcaaacgaauuagacaucagauugugcaaggauugaaaugcucaccgaaagaagaaauacgcccacuuuggcaugcugugucagguauugaggguaugaaaaaagggaagcaagauggggggaaucauuucacauucagaccugagcaguggccugggccaugcaugugguuugguuuccauaaggacauuugugcaaacuuagugucacucacgcuggagccaauauaccaauuguguuucuuagaucuagggcaaugacaagauggcaccaugaaaaauuaacaguuaaaacuaacucgacccccacccucagcuucccuuggauaaauggugcugcguuugcuuccuaagugcaaccuaggguugcuaguugguuucuagauugcagcuugcugugugcuucuguagcagacgccaauggggacccacagaccucugcuuccagugguugauagugcuguuguggagaaacucgccuugcgcgcuccuggaucugacggguguuaggggcaugcagcaaaggggagcuggagauuaucuuugugaaaaucuagcuuuuauugcaucaccuaaaguggcacaaacggccacacuaaugaaaucguguucuugguuuaaaagggcaauuguuagccugacuuuugugcucacuaaaaacagccccccaaucuuguuaaguuauugcucucauuucggacuuuuauagccaugcagcuuagcggcccucauuucuuuacguuucauucauuuuccuuguauuggugauuaauggaggaugucgaauguuagagugggcaggcaucagcaauugcaagaucauaauuaguuuagcugacgagggccucugauagcacuugcaucuggauggaaaaauuacccuauagggagcuggcugcucaccaggucuuuuuagugauagauugugaaacacccgaugaaucaaaugcccuuucaaugccaagaaaguguuccagucucgaagccaaaauuaugucugcagaaagcuuuccauuugaaauguaucagaguacaauuauaaccauuguauuuuuuuggcaggcacaccacuccccuacaguauagacuuuaguuaaauaaauugccuaaauuuuaugaaucccugaaauuuugacuuaugguguuuguaauauuuaauuuauaauaaaauuagguuacagcaagacuuuucccacuccuuaucucacaggccuauucuaucauuaaaggcuuugcugcaaaaggagagcugagccacaauuugaacauuuuuuuuuuuuugcaagaguauuccauuuccugccuguuccuauuugugccuacacacagucugacuuuuguuuaaaugagaaguucagcagaaucauuacuugcucagggaaaaaaaaaaugcaaccaguauuccuaauuagcaacuuuucaauauucucagauaauuuuuggauuugguguuugcgcaauucagaccucucaaaucaacaugguaauucaacaagcucuucggauuuccaauuauaaggucggaguagauaaagagccagugacaggagggucuugucugacuucagcagacacuucagaaagguuugcauuaacaaugcuaugcuucaccuaggcagcaaugucuaaagauccgcucagguuuggggaauagaggggguucucuuucugauuuccuaaucacaagggaagcaccgggacaggccaucuuguauucuccuaauacuuucguuacaggaauggcauacaaaagguaaccagucuggauucacguuaaacgauugccauggugaacugcucuaacccacauuugaagucucagguagcauauccccagcuacuuccaacaucuugcccugugcuguguuuuuuaguuuuguuuugacacuuuuaaaagguauguuuuaggguugagcauuuaggagccaucauuaaagccaugcaacccaaaguucaaaaaguuaaagcuguuucugugaaaagccuuugguguuccacacaccucauccaucacuguaggguuaauuauaaugaaaaucagcggugccuauuaaacacaauugaaccugaccucauuaugggcagugugguuuuauacugucauuguugggagucuaaagacaaaacuccuugguugauuuggacuuacucucuggaucaugugacucaccucugaccuuguuucuuuuuuuuucucccucccauuucagaggcgaagaggaucugguguuuuuugugccaauugccugaccacaaagaccucucucuggcgaaagaaugcaaauggcggauauguaugcaaugcauguggucucuaccagaaacuucacucgguaagaacuuauccuagcccuuuaggggaagcuuacacagaugagcuggccugaccacgauggauccguccucuuccauugcuucugcugucugucuuugcagggcuggguaguacaguuauuuuggguguauauaugauuuauugugaaagggccuuuuauuuuauaggagauacauuugagaucauuaguaaugcguuaugcuucuuugauuuagcacaggaaaaugauugauuucuggaaacuccacauaguugaacuaucuuaguaguugaacuaccuguuaacugaauuggcugggauuaauuuauguaugaagagaaaccucgaaaacuaacaguauuuuagagagaaauagaagcacccugaauguucccauuccaguuuaccuuugaauuuuaaugagccauuuuggcuguuugcaagcugggaguaugagcacagggcugauacuugaauccagggagcacucagucacacaguggaagagaugcaggugcccuaugccucagaucucccgcuggauggcuuuggcucauggggguuauuugaaugcauuucaucuaaaaauuuaguuuuuaacucuguaacugaacuuaaacuggcagauucccccagauucuacgcaggaauuuuuaaguuucuagagccuguuuuuauaguuuagacaguacaucuuggucaggugcugacuucagaguaccaauggcccaaguaguaaauaguuuucccugugccuuuuuuuuacacuuuauuuggcaucuuaccacagcucuuagcacagcccagagaaaggauuagagcuauggggaauacaauuugagacgaaacaucuuaguaaguggacacugaaaacacuuuuuaaaaacaugcccagugccagcaguggugcuaauugagaauacuguaaagcccuuggucauuagcauagaguugguagaaaggcccuuacugccacuuuacauuuuuuuaacccucacuauuuaagcacagcaacaacccucuguuuaaugagcacugacauuaaugguuuuaauugaacuuuggccaaucaacaggccaagaauuaauuaaauugcuccucagccaaauuaugauaauuuaaccacugugaaauacaccaaacuuuuuucaaaauuauuuuaauauucaucucugcaaaggcaagauggucucagauuugagguucuuuuuuauuuuaucauaaaugaaaauacauacaauuuguaugcacacaaaaauuacacaacaauuaugaaaauuauaagaauuaauuaaaguucaggcuucuuuguuguauagagacuaaauguuauguauuuuuuacuauauaauacaaauguauagggcauauccaauucaacuagguuuuucauuaugaaacuacuauuuguaucaccaguaacaaguauguaauuuuuauuucuaucagccuaccuagcggcaauagaaauauucucccaaaguucuuacuuacguuguuuuuauaucuaaaauguuuucuuuuguacugaagucucaaauauuuuaugaguuauucacaaauuauauguuuauauaugcaguaauuaucaauaauauuuuggaaaaaaaucagaccaucugaacauuaguccauaaauauacauuaauuuauuauaccuacuuauuucauuuuacaagucaaaauuagaauucuucugcaagcaggguuuuuauaaucuuacauccucauuguugucauauaguauaaauaccuacugaacauggacauagguaccaaucaugagaugucuaagcugaauguaauacuggagcugaauggaaagccaacauucauuucaaguccacuggaaucacaguucaguuaucugaaccaaacaugcaaaggaauuuagguuugcgauaccuaacuaauacuuuaccugugaacacguagugaauaugcagagauuaucaaaacagaagaguaaaauuaaggccaaaaauuucaugcgaugauuuuuuuuuccucacaguccugacaauagguuguguuugauuacguaugcccugguacaaauaacguauauuuaccuuugcaauucuuuaaaaauauguauauguuagucagcuuaaaccaucaugaaaaaacacuuaggcugacugaauggcuuauagcagcagaaacugauuuucuccugguuguugauggaggauggaaggaccagcuugguuaaagccugucucuuccuaccuuaguuucuuaauuuccucuuaagguugugcauauaucccgaugugucuguauagaccuuugucuuuaaugggggagggccgagggcaagagguuuuuuguuuuguuucguuuucuuuuuaauuauuuuauuuuuuagguauuguuccuaaaaaggaauaaaugcauauaccuguuugucaaaacaaacaaacaaacaaacaaacaaacaagaagacaguuguagacaccaucauguuagaucuuugauccaugaacugauccaggggagaaacauguuuuaguaccuagguugcagcaauguauaauuuuucuuuguuuuguuuuucucuacugccaguacuuauucaucaaauuccuuggcugagguaacuuuucauaacucaagagcugauguauuguagaacaaucauuucuucaacugguuuccucaguacuuuucguuaguggugacaguugccaaaucuucuuaggcugaaaacacugcuuucaaggaaauuaaaguuuucuguuccuccaccacagcccuucaaagauggguguuauuuauuuagcuuaaaacacuacacuuugguuacuuccuucaauuuugccuaaggcagaaagaagagauuaguagcauaaaggcuauucucacuaugaauuucacuguuguuuaugauugugaggaauuuuugaugcauuuaauuuauuuuuuaauguuucucuuuuauguauuguguguguucccaacagacucccaggccuuuaaacaucauuaaacaaaacaacggcgagcagauuauuagaagacggacaagaaagcgccuuaacccagaggcacuucaggcugagcagcucaacaaacagcagaggggaaguggggaggagcaggucaauggaagccccuuagagaggaggucagaagaucacuuaagugaaagucauccgagagaaauuccacuuccgagccugaguaaauacgaagcccaggguucauugacuaaaagccauucugcucagcagccaguccuggucagccaagcucuggauauccacaaaaggaugcagccuuugcacauucagauaaaaaguccucaggaaaguacuggagauccaggaaauaguucauccguaucugaugggaaaggaaguucugaaagaggcagccccaucgaaaaguacaugagaccugcaaaacaccccaacuauucuccaccaggcagccccaucgaaaaguaccaauacccgcuuuuuggaguuccuuuuguacauaaugacuuccagagugaagcugauuggcuacgguucuggaguaaauauaagcucuccguuccugggaauccgcacuacuugagucaugugccuggcuuaccaaauccuugccaaaacuaugugccuuaucccaccuucaaucugccuccucauuucucagcuguuggaucagacaaugacauuccucuagauuuggcgaucaagcauuccagaccugggccaacugcaaauggugccuccaaggagaaaaccaaggcaccaccaacuguaaaaaaugaaggucccuugaauguaguuaagacggagaaaguugacagaagcacucaagaugaacuuucaacgaaaugugugcacuguggcauuguuuuucuggaugaagugauguaugcuuugcauaugaguugccauggugacaguggaccuuuccagugcagcauaugccagcaucuuugcacggacaaauaugacuucacaacacauauccagaggggccugcauaggaacaaugcacaagcagaaaaaaauggaaaaccuaaagaguaaaaccuuagcacuuagcacaauuaaauagaaauagguuuucuugaugggaauucaauagcuuguaaugucuuaugaagaccuauuaaaaaaauaauucauagagccugccuuauccaacauaaaauuccuuuuuuuuuuuaaauucuuucuuuugaugaguagguuaccaagauuuuaaaaugaaacauauggucagugagaaagaaugaaauuaauagauaauuaaaaaaaaagaaaaaaaggaaaucuagagugaaaacuaucuuaccuaauguauacugcggaaucucuauacagagguccaccaaauuauaguuauuuuguuuguaaagaaugcucucuagaauucgaaagaguuuacauacuaucauaugacagcaguauuaggcuggcuauuggcccauccauucagaaaccugcaauagguugucuacaucuaaaacuaucauaaaauucuagccaaaugagaagaaaaugaaucuccagggcaauggaagaaaaaaaaauggcaccucucaaauuagucuccucucauugaccauguuucagauuuagaccucaaaaugugaacugugguuaggcuuguugaacgagcaguaagaaucgugacaguugguggcacaauguuuuuugggccagcccugccuguacauacacauacacacccucuuugauauuuuuguccuuuagauguuccaguacuugguagucauuuuguucgcaguuuagauucauuuuguucaaauauauucauucuuaaaacaauguccucagugcuuauguaguaacuuuauuuuagccagauauuucuuucuuguugaugaugaaccgguuuggaauuuuuuaaaccuccuguuggucacuaaucucacuuggcacauuguaacuaaagcaaucccuucacuucaaaagacuagauaaauacaaaugucaggccauggcuuuaauuugcugagaacacaugguauuucucuacaagguaaccugcuguauuuauuuauuuucuuuugguuaaauauaauguccaaacuuuguggucaggcagcaugcaagguuacguuaccacagacugacaguugguauauguaccaaucaaucccuucauuagauuuauacagauuuaguuaaguagcauuaaguaggcuucuuagaaguaugucuucauaguccuuuuaauacuuaaggcuuuguaaaaacuauccaugaagggagagcuccucggcauaacugcucagggaaauagggcuaaauaauugaacauuaaauaauugguuuaaggugcuguuagucgagccucaaugcuugcuacaaggauguauguacaaggacugacuuuaauaauuugcauuauauugucccaaccaguaguuuauuuuuugccacggagauguagaagauauuacaagcuacuggaugcacugucagauuaacuuauuucauuaaagaaguugggagaacaaauaggaaaaaaaaacuuauuuuucuaguaaauauuaauguauuacauuucaaauaauggugccugacauauugaauaauuauuuucuacaguguacguaugcaacaaagauauuccaucaugcauuagagucaguucuggcucugccuagcuguuuacauuugcaaauguagcaaacaagguaaugaagcaacuauuucuauugcaguagguaucucuaguguguaugugugcguguguguaugugugcauuaaaguuguaaacgguaacaugaaacaaaggaaguucucaguguaaugguguggaaaacaagaaggaaaugaaaauauuuuuaugccuacuuaggauacaaggguagcacuauucauuccaaguacuuuuuuuuuuuuuaauuuuaagcucuuaacucccauuguuaugcuuaagaugauaaacauauauucucuuuuuauugcuuugucuguuucagaugaaacauuucagaaauuauuuugauauguguugcuggaauccgcagcacggauguucuuauugcauucuguaguggcguuugcacuccaguuuuacauuaauucgcaguugcuuuuguauuguuuuguuggguugggguuggcuucuuucucagaugcgggagucucauugcuuagaguuuggauggcagguagaguuaaccagucugugacuguuccagcaaaugaaguucaaauuaccuuccugaugcuauguuguccucaucuucauucuugcauuuuuuuuuguuuauuuucauguuuuaaaaaaaaauggaaaaagaaaagaaaaaaaaaagaagaucgagagaaagaaaaucaggacuaaggccucugcuuugguuucauuguuaaaggacccuguuuuaaucucaccugucuguggcauagcucaaauguucacaagaacggaaauaaagagguggaaugaggagcuuugacauucaaaugacuugauauaauuuaucuuucuuaggauuuugguggcugcaucucagaauaaagagggcaaucugagaggagucaaagaucugaaaaggaaauuucccaaacaacauauuuaacuuccuuaguaacacgaauaucaaagugcacuguacugauccucaaggcucauuauguguggacugcccaauucaacaacaugccagaaauuugaucaacuugggcaauauugcacauuacaucuuugauauccuuaugcaaugucuucaguguguuagacacaaguagaguuuucauuguuggcauguaugccuuuuguuuuuucauuccauuuuuuuucucagucagacauaguagcaaugauuagcauugaaaauacauaucacugugcuuggaauauuuauggucagucuacuuucaguagauuaucuuuuggauagcauuggcguauuagaucuuauuccguauuccuuuauuaguaauuacuuuuauuuuccuguuuguuuauguuaugcauauuuugguugagaaaaguugggccuuaaaaaaugauggacauuuauaauaacacuaaaauacucauuuuuuugaugaccuaaaguuuugauuccauguuucaaaauguauuacaaaaaugaguuauauuuuuaaaggcauuugaagacuuuugucuuaaauugugaaggauuuuaagugagguauuuagguacuuaaccuuuuucgaaggacuuucaagaugauuuugaaacuuuucucucuuggaaaagucuucuggagauaccaacuaaaguacugugccauuucaacccugccauucuucucaaguuauuugucacuucuauacugagcuuuggcuucaacacugggccagagucaacucaugcacguccuuccuuuuccuacaucucucucaccuucucucacccccaggaaaguacuguuguuugggauauaaaaccauaaggagccagcccaccucagagcauuguggccugggagacacuacacgacucuaaguacaugagaacgggaaggagcucacagaguuaauauauucucucuguuguuuagacgacaaagaguuggcccguucucucuacaugacauauugagauggguuuuuuuuuuguuuguuuguuuguuuuguuaaauccacuuuuaagauagugauguucuguucuaaacuguucucuuuuaguaaagguagaguuuaggaaacaagcauggggauucuuuucuaaguuaauaaggaggagaaaacagugauuaucuucaagagcuuuuuguggaagccugugguagcacauccuguuuaugauugcacaugugcacauaaucuauuaugaucuaaugcaaauacagcucccaaaacauuaaauguacauacauauauuuuaauugccuggggaaauguuuuucuuaauaaacuaaagaugauccauauugcuaucaaaauaaauauuacccucuugccuuguggcuguaaaacaucacaaagugaccugucuugagacuuuuguacugucugccuaccuaguuaacaaacauuaacaucuuuuauaagugggaauaucugcccucuggagguggaacuauggagagacuaugcugguagucugguggucaugcugucucuaggccauaguccagccucuuacccauacuugagaucaauuacacucuuuggguugagggcugcaccaaaaaauacuaugugacaucuuuguuuagcugguagguuaaaggcuuucugacuuugcuagauaaguggggcugaggaacuguacaccuugaauaugaaacuaaauguacuaaccaaagaaacguacgguuaaguguaccaggcuacugaguauuaacuaacaguuaauggugguuagaaauagacgcauggagagcagagcucucauugauuuggccagugcuaagauauauuggcuucuugcaggguguuuccuugugguuguugcuugcuaguucggaguguucucauguguuucugaucauagugcaacaguuucucaagcauuucccacuuacauagauucauugggcccucuggaagaugccagggcagagauguaccaaggcagggaugaagaagagguaaaaauccacaacaauccaccuaguucaauggauaaaguaugcucacauauucucucaaaagaaauguuagcauggugagcuuaugcuguccugcacccgagcaaagcaaggauaacaaccauaaaaaacaaugcuuaaccuuucucagacccacaagucccaaaccuggaucccaguuuuaucccauaauuucuucaauacaacaacugcaaaguagaacucuuucuuucugcgccucagguuccucagcuguaaaauggaaaguauauuaauaauaauaauaauauuaaaaauaauaaugguaauguaguacuuguuuguaacgcacuuugagauccuugguuggagggcaccauaagagugucaaguauuauuauguggccaaggggguuauuuaaaacucugguucccacgggccgagaaaguuuggcaucauuuuuauuaaagaugagcuguaaauaucuuuucuaagcagccuauaguguuggcuaugaagaggcaagacuauaaccaggcugauaagaccauaguuuuuuaauggcuaccaaaaaggcacgugucacaauaacaaaugcugaauucuuuaggguguaauauuugacaacaugauugaucugggggaggggauggguggaaaaaaacaucucaaaaugccaauguaaaacuaacagcaauauucaccagcagaaaaugucuuucauauggaaugauuucauguugauaagaaaaagcauucaauuuguaguccugauuugaacaccagacugugggguauaauaguucuguuuuuacaacacauggaauuuuuuuuucauuuuauuucauuuuguuuucauagugcauguucauuucgacucacaacauguucuugguguauuucuuaugcaaacaaucuucaggcagcaaagaugucuguuacaucuaaacuugaauaauaaaguuuuaccaccaguuauccaugacggcuuugguaugguuuauauggaucuacguucauccaggcagcaacagaagcuacggauccuuaacauaucaaugagcucugaacuuaaauaauaaaacugaaaccaggucaccuauuaaaaaaaaagucacuaagauguacuaagcuggauucuuuucaacuugauuuuucauuaaccaaucuguuacagguagauuuuucugcuaaaaaaaaauuauacuauauuuuuaggaagguuaaugauacucuuguuuauuucaaaaggauucugaacaucagacuuugaguguugcauauugaucugcuaauaauaccuuucaguguguaaauacuuccuuuuaagaacuauaacuuugauucuauucaguauccccaugugcaugugaaaugaagauccugauaaauaucgcaaauuaaauucguauuuuaaaaccguug

SEQ ID NO: 7748 - RNA, 5145 nt, Mus musculus
aucugagccuuggaaaccagagcgacuucaaacugcaguagcccccagagucaggagggucaaguucagccgccggggaggaggaaaaacaaaucccgauuugccaaaaaaagaaguuucaggccggugcccccucccccucccagccccacucccccucgcugucucuugcuggcugauuuuaauucucuccuaccgggagcagcagaggaucuggagguggcuggacccgaggggccgccgccgccgcugcugcaaguuuucugggggcuccuggcaaacggggagcagacuaggcaccggcaugcagaguaguaaguugggugaacuugggaggguagggaggguuucugcgaggggucuuggaguggcccacaaagugguaaaacagcauagacugccuuuggguuugaagaguuuaguuuguaaagccaggcuucaaacuuuuuucccuuaaaggcccagcagggcuggagggagagaguguggcauccucuccugguauacccgucucugggcagcucagggcagccugggcccaggggucugugcccugucgguaccaugaggcagggccuuguagccagggcgcuuccguaggggcugagcaaggggcagacuuccucugcggugcgguugaugcgccaugugucgagcgggucaggggacacgggcuggugauuaaacgccugacagcggugggacaugcaggcagacaggcucuuugcuuucugucuaguuccuguuugggcuguagagucugaaacgcaucuuugaaaggccaaggcaaacaccucuaucccuccaaauaacuccaggauuauaggaccccaugaauaauuugagggugaagcagaagugggagcuguuugaagugcaaacuguuuuugaggcugggaaagcuuuuucugugaguaccugucugagaugaugguguuuccccuuucaccagggaagucacuaacuguuuuauggcucuaggauccuaaagccauugaagugagaggacccgaggacuuacuuaugggggcuucagagagaaccuugauuggacucacuacauuuuaagaccuggcugacuuccccauaucuuuuuaggccucagauuugaucuuuugaaaguuuuugagucagagcuauggauuuaaugaugaauccaaauuaggauagaauauccauccuuuauccgguuuggggaaaucaccgcuagcauuuuaaacaagguaagugaagagagacuggccgcgagaagaagcaaaaucagacacaaguuaggccgauucauugaacuuguguaugcucuccaggugaacaggcaagggccuggaagagauaguacaaaaacaaaaauacagauaagggccugagacaagauuacaaagaagugaucauucuaggccugguuagcuaaauuugauuacucaagccuaaagaaaaaacuaaaguagacuuccccgauaagccuuuggagugcuguaaacucuuuagcgcaaacccagcagccuccguagcaucucgauccuucgcuacagguuuuaggaagacuugauauuuugaaaaggcugcuagaguuaaacauguuagggacugucaggaaaguacugcagcuagcagguccuugacgugggcaaaaugagaaugaaagucucuaaucucagugcugggcagcuucuuaguuacuguucacuugcuucuaaggcucucucaguuaaugcaguauugguguagaaaagcagagguucuaaaauaaucaccaugcggcuuuucccccuuuuccuuuccccaaguaugacaggguugugaauaaauacaggguuuguaugggaagaugaagcguuuccuguaaguuucgaugcugacaagacagucuggaaaugauaccaacauucugaggauuuuuuuuuuuuaaaccuuugagcgaaaguuuauuaauggcaugcucaaacuucacaaguuaaacuuguauguucaucauguuuauccuucuguaagauuucagaacuuccuuuuaaagcuauacucuugaggucaaaacgucuccagucaguuaaguagacagggcuccgaauaugcuaguuuggugauuaugucuagauauuaguacggugaaaauaaaacugcaaaggaggaaaucaugucuuaaugccucuauucugccgugauuucucuaacugcaagauauugggaaccuucaucagugcucggcaaaauuuuauuuaccuuuggugagcugauuuucauggcuucccaauaugccuguugcaugguaagcuauguuuguguagaauacuuuuacauacauaauaacuaagucugacacucuccaaauaacucguagaaaguagcuaggaaaaaaguuugucacuucugaauuuuagauucuguuaguguuugugcugcuggguggcucuuguccuuuguuauagcuagcauuaaaggugcggaagagacugccggaguggcugugaauccugaguugaauucagagcuccacacuuuugacuacuaauauugugaacaauuuuacauaaauuucuacauacuuucauacuaaccaguuuagcauccaaaucgguguguauuuaaucaugagugacuuacaugugcccuuauguuguuuuuggcauuauuuuuacuuuucuuuuaagucauauaacacuccugaauuuauucuaguuuucacuauaggucucuguaaaacacauagggaaaucuucauucauaagaaaaccuucucaacagggaugugaaugcaccugugggaaaguugcucuuaagauaaaguauuuaauggugcuuuuacuaauguugguauuuauuauuauuauuauuauuauuauuaugaguccaugcacagagagaagccacuauuugcuucuaaagauauaugcauuuucuauuaagaacuaaggccacggcgugagguuuuguaaacacuuaacgcuauuuuuugaaguaaauugacauugcugaaaaauuuuaaacuugcaaaagacuuuguuuuugaguuagaacuuuauuuugaauuugaaauuggugucagcauggauaacuggcuuucugauaauauauacauauauauuaucaaaaaauaacaaauuauauauauauaauuuuguuaaucuaauacauccuuugagagcaaacaauaauaucaaaacacuguguuauuguucauagaacaaaauagacuuucagagaguugcggacaggugucuauaauugauuucaagggaaauuauuauuuuugaaacaagcgaugaacuuuaaauaaaacaacuggcucccauuaaaacauauccucaugaagauauucucugguguguaaaaugaagccauucauucaacacacugacaacuuuccacuugguauuugccucugcuuaauuuaguuuccucgggacagcuagugugguagccugcaucuguuuuuggcaggcauagaaaacuauaaacucagacaguucugacucaaauauuguauuuagcucaugaguuacaaucaauuugauaaagaacaggcaaguuguaugagcuugcuuccuguuguucauccuuggcccagcuuucagguaacagacuucucguucuucuuuuucuaguuaugauuacuaauacugcugauagcuaauuauucuuguuaugcuuccuuauuuauuauuuuuuuugagcuaugggggaaugaauaauaacauauacagacauacauauacagcauaucuauggaauagcuacauuuuauuuggggcuauguggaagugaauuguguugucauaacaggauuuaugggaucuaauggagccauuguagauauaauauaaagacaauuuacuaucgagcugaaauuuaacaucauuuuccaaguauacuuauuaugcucauguauagaaaagauuuaacauacuuuacauuauuacuugcauuuuagaaacugagcaguugguuuuaacaugaccaaaaucacuuuucuccucaacuuuuugaucagucuacugaaauacccuaaaaugccaagguuuucuuuuugacuaccgcuuaguugcaaauagagaucagcuuguuuuaucuuucaauguaacuugguccaaaguauuugcauuaaauauucuauuauugauaaccuucauaagugacacuucaaaugguacaguuaugcccauguuggggugucuuuauaucacucuaugacccuuguuucccugggaagugaauuugcaaaccuuugguuuguuucucuguaggauauaauaauggagaaauugauuuggguuggaaagagaucuuggggcauaaggaaacgcuuuuacugaauucauaagaugcugaacauuauuuggauuguuaaaagcuaguccagagaagccugcuagagauaauagcuaccggaaccauuguaacuuugccgcacgguacuuuuuauuaucccaucucuuuuugaccccucagagcgcaguuccaaguaccaaaaacaaagaugaaauuaucaguguacuucagaucugaagcaucauugaaauaaguuuuugacucaagguauaauugaaauacaagcaucaaggcuggccguacagcauguugcauucaaaagaauaagauaaaaauuacuuuuaauuuuuaagauguugcuagcucuuuaaaaaccugcaguacauacuuuacaaguggcucgacaccuucccugcugcucaguuuauacaaguaggaaacuuucucuccugcucucucucucucucucucucucucucucucucucucucucucuuguuuucucuaaaccaacugacgucaugacaaacuuugcuuuaaaagaacagacagaaguaauugguagcuuuuaacuuuuaauaauguucugcaaugguuucgguggccaaaaugcuauuuuuuucuuaaaagggggaaaaaaaaaguucaaguaaaaacgggcuuguggcccgaggaagaaaagcuccguugauacaguuauuuuuauucuuguuuuucaaucuguuauuaaaacucauucaugcuuagcucugcuauaacuccugagcuguucucagugauggcuggugcauuugagguugccaccauuuaaacaguuugggaguuugccgggaaaauggguguuuguguuacuuuauuucuuuacuauuugaaagaaga

SEQ ID NO: 7749 - RNA, 37896 nt, Mus musculus
cauuaugacgucuucuuacccuugagccugggaccaagcagcugugggcuucagucucugaaacuaugaacaaagguaagucuuuuucucuuuuaagugguuuucugucauguauuuuuuucacaccuacaaugcaaaaaggucauuaauaauaauguuuuuaaucuaaacaacacuaccugaauacacagaagaggcaaguccucagguaaugaauuucuagagguuacagaaauggggcaugagcugggcgugguggugcaagccuuuaaucccugcacucgggaggcagaggcaggcaaauuucugaguucgaggccagccuggucuacagagugaguuccaggacagccagggcuauacagagaaacccugacucgaaaaaaaaagaaaagaaaugggguauaaggacagauuugcuaagcaggguuaaggguucccuuuggaaauaauauaauuagucugaaacuagauaauggugacuauuauccaacuuuguaaguguaguacacggcauuauauuauacaauuuuuauauaaccaaugugaugaauugaguauuacauguaauuuaucacaaaaagacuagagaagaggaacugaacauaguaaacaugaucaauucuuucuggaaguuguguuauaaauagauauggaaaaaaugggauggagggaaagaugcuuaaaacaucaaauauagugcauauuauaguaauuauuaaaaaguguuucacgaauaaauguaugacuagcaaaguauagaagguguccacauucaccucaggaugaacaaaugacgacugccauugaauguuuuaguuccuaaugaccugugcaacauuauccauuaacauucauuugccaauaaaugaaggaacaauggcacucagaccacauuauaaaccacaggagaacaugucuuaacugauauacuucuucaaacaucaacuagauucaaccacagauugucuucugauauugaaacaauagacaaggauccuuaauauauacuaauagaaagauguguaaaugauaaacccuauccugaauuguuggcacauaucaaagcuaagcaucucauggaauuggaugguuccagaugauuuauugugaauuccuuuauucuacuacuuaaaauucuaucauugguugaacuagcaucuuuuuaaaaaagacuuauucauuuauuauaugugaguacacuguagcugucuuuagacacucaagaagagggagucagaucucauuacggaugguugugagucaccaugugguugcugggauuugaacucaggaagugaaugaaguccuaaguucauggguguugcugacgugaacaaggacccagugcuucagccccacaggaguggcaaagucuuacucagaugaagcucaaacggaggacaaagccuucccuggguccaagucugcauguugacauaugcauuaaaaagguccauuuuaacugucuccauagaucagugauucucaacuugugagucccuaucccuguggcaaagcucuaucuucaaaaauauuuauaucacaauucauaaccguagcaaaauuacaguaaugaaguagcaacuaaaauauuuuuauagucgagggucaccaccacaugaggagcuguauuagagggucacagcacugggaagguuccgaacaacugcccuagauguuuucagccugaagauuguucuccggcagagacugcuccucaagauugacaaaagcuguguguaaccucucugccuccuuguccagcugugugcaaugaucccugcccccugcucaacuguguguuuuuguuuuuuuuuuaauuauuaaauguaaguacacuguagcugucuucagacacuccagaagagggcgucagaucucguuacggaugguugugagccaccaugugguugcugggauuugaacucuggaccuuuggaagaacagucgggugcucuuacccacugagccaucucaccagccccucaacuguguuuaauaagcaggcugugcuucgagaugcugcauuuucuccagcugagaacccaaacaaucuaaucacaucauuucugugucuguccuuccuucaucuccucacuguugcaggauauuugauuacacggugaacccuaagauuguauuauuuacugggaaaaaaacaaaaaaacaaccugccuuucauugugauguggcucggccuuagaacagaccuuuaauucaagagcuuucugauugaauauuauaaacaggauaaauagucagccauagcucaagagaaggagcaaacacgcugggugugguggugcacaccuuuaaucccagcacucgggaggcagaggcagguggauuucugaguucgaggccagccugguuuacagagugaguuccaggacagccagggcuauacagagaaacccuuucucaaaaaaaaaaaaaaaaaaacaaaaaaaacaaaaaacaaaaaacaaaaaaaaacaaaaaagaaggagcaaacaaccaguugacaggaagugaauacaggcuuuuuuuucuuuuuuuuuuuuuuuuuuuucacuuuacagcugaucacaggcccacccuucucucuucccaguuccauccuuuaagaaaccuaccacuccccuugaguaccaccccacccugggcauuaacuucagcaggacuaggcacauccucucccucugaggcccaaccaggaaguccaaguaggggaaagggaauccaauggcagggaacagucacagacagcccccauccacuuguuagggcacccacauaaagaccaacauggacauuugcuacaaauguguagggggucuaggcucagcucuugcaugcucccugguugguggccaaggcucugugagccuccacggucccagguuaguugacaguguggguuuucucgugauguccuugaccccucugauuugcuugcuucuguccccuacucuuccacaagacaucuuagguucagcgcagccugauguuuggcugugggucucugaauauagauggagaucugcuuuuggaugaaaccucucaggaggcaguuaugcuagguuccugucugcaagcauaccagaauaccauuaauagugucaggaguuggcucucauacagaaugugucucagcuuggggaagucauggguuggcuauucccucagucucugcuccaucuuuaucccugugcauuuguagguggccacuucagucucucuauagccccccucuaguaggaaucucagcuaggucaccccccuauccucucccaucccaugccuucagcuagucaccagagaugccccccuuucaauucucacucccagcccucucucaccccacuuuucccacaccugauugccauaccuguuccccccccccaucaccucuccuacccaguucccucucccuauccaccucuaaugaccauuuaguuugccuuucugagcgugauucacccaaauauccuccugggaccuccuuauuaccaguuucuuugggucuguggauuguaacaugguuguccugcaugguaugcauaauguccacuuauaagugaguacauaccuuauaugucuuucuggcucugaguuacagaguucacaaugauauuuucaaguuccauccacuuuccugaaagaaucaugaugucuuuguuuuguuuuguuuuguuugguuuuucgagacaggguuucucuguauagcucuggcuguccuggaacucacuuuguagaccaggcuggccucgaacucagaaaucugccugccucuaccucccaagugcugggauuaaaggcgugugccaccacgcccggcgaugucuuuguuuuuaauaacuggauagucuucaguuaaaggacaucuagguuguuucuaguuucuagguauuacaaauaaagcuacuaugaacauaguugagcaagugucccugugguacaguggagcaucuucuggguauauguccaggagugguauaguugggucuuacuacuuccaguuuucugagaaaccaacaagcugauuuucaaagugguuguacaaguuugcacucucaccagcgguggaggaguguuccucucaccacaucuuugccagcaucugcuaucacuugaguuuuuuauuuuugccauucugauagauuccuagggucauauuguaauucccugaugauuaaggacauugaaauuuucuuuaacugcuucacagccauuuaagauacuucuguugagaauucuguuuaguucuguacuccauuuuuuaauugggcuauuuagacuguugguaucuaucucuugaguucuuuauaaauuugaauauuaggcauuuguuggcuguagguuuggugaagauccuuaaccaaucuguaggcugccauuuugucuuacugauguugcccuuugccuugcagaagcuuugaguuucaugggucccauuuaucaauuguugaucuuagagccugagccauugguguucuguucaggaagcugucuccuguaccaaugaauucaagguuauuccugacuuuacauucuaucagauuuaauguauccaguuuuauguugaggucuuugauccacuagaacuugaguuuuaugcagagugauagauauggaucuauuuguguuuuuuuuacaugcagacaucuaguuuuccaacuccaagcuucucuauucuuacuucaacacuuauuuucauuguccaaguccauugccugaguguuaaccauugaacuuguauuccaagaagcaagaaagaagaaacagaagagcagccugcucccuuaaaaaaaaaaaaaaagccaagaacgaaaaaaacccuuuaaauuaccauagagugaguuucucuuuuuucuuucuuucuuuuuuuuuuuuuguuuuuguuuuuuguuuuguuuuucaagacaggguuucucuguauauuccuggcucuccuaggacuugcucuccaaaccaggcugcucuccaacuuagcgaucugccugccccugcauccugauuucugaaaguaaagaaaugcaccaagcucaauuccauauauaugaacucauuuauacuuccauggaaaauugauuguggaacauagucuauuagguaacuggcauaugccaaacuaaaggcaaagaguuugggagucaauucuauauaauuggcuauauaauuacuauauaauucaauacagauaaaagaucaauagagaagaaaaaucaguaaguguugagaauaaguauguaaacagauacccacaucuacuaugagcaaucaugauaauacuaacaauuuuaauguauugacuucaaugugccaaaugcucugcuaaguacuuuaaauacauuaucacguguaauaagcaccauagcaccaaccagauggauaacauuugccugacuucauaaauaaaacuuaaccgcagggagguugagcaacuugaaaggcaguagcuucuaaguggaagauuguaaucaaaucucaggccuacaugauuccaaacucugccuucaaaaaauaggauccagauagcagaagacuugcaauuaccugaaaacuguuuauaaagcauauucucaggccuacuucaacucucuaauucaaaugcaguugaaguaauauuucaguacaaguaguaaaccaaaucaaaauuagaaaacaagacugccagguacccugcacaaguauaccagagacagagcaauaaacagacuuuuucuucaggaaaaaaguugugucauaauacagggcaaaucuuuacaccaaguguuuguaugguuuuuguaacgugaugauuuccaaauaacacagaaacugcaguaguuaauuuuauucuuaucaagagacaagaaccaguugguguucgugacccccaugcagucuuagaagggucuuuaggaguuugccuuuucacucuacuuuucuccuuuaucaaaauuagcaguuucucucuuuccuuaugccccucaucaaacucguuuaauucuuuugcagugaaaauacuauauuggugguauccuuuccucaacugguaguaauuuaauacauuuuaaauguuuguuuguuuguuuguuuuucgagauaggguuucucuguauagcccuggcuguccuggaacucacucuguagaccagacuggccuugaacucagaaauccgccugccuccgccucccaagugcugggauuaaaggugugcgccaccaugcccaacuaauacauuuuuuaauuuguaaauuuuuuaacaucauaaggucuuccugacauuauuuuaagagcuccaccccagcucuauuugcccauuugucaauaauuuuucuaggcaguuuugcuggauaaaagaaacaaugaauaccaaacugaaacaacacaccuggaaaaaauacugucaaucuuauuuuauuaaauuucuguuauaaaaauggucacugucaaauauuuccagggagguaacugaaauguucuugguauugaacuguuaauaugaugaaguuuuuggacaaaagucuuaaugaucuauaaggcucuaauccagguucugccuccccccccccuucaguucuuuguaacucaaaucaacauaugcacucuccauccucucuaggcccacuccugaacccagaugauuuugauuuggugauucacccauaugccugggcagauccuacacccagccuugacauggccugugaaauccuguucucagaguugacucaaaucuuuccuuucccaugagguggguguaacuaugaauuaaacuuaaauguaacacacacacacacacacacaccccgagggauuauuuucacucauuuaauucauacauauuguauuguguugguauuugaaauacggacuguuaucccuaacuucuuugcuucucuaugucugugccugauuauauuuuacuacauaucuuauccuuaaaugacauuucuuaucaaaauccagauaaacagcaaaaucauuaucaguguuuuaucaguguuuuaaacccauuuccuucugcuuaguccaagaccuuaaggcauuuuacuuggggaguuuucuuuauuaaacaaaugcuuuuuuuuuuuaaacaaaugcuuuauaccuuauuuuuuucauuuacuguaaaagcuuuaaaguuaugccaaaacacauugugauauucccaaaaaucuugucaauccucuuacucuaagcuuccuacuuacucuaguguuuuugacauauauaauccuuuuucaagaguugaucaguuccgaggaacagcucugcaaaacugugugcaguucuaaaccaaaaucugcuacuguauguuuuauaauccuccuaccguuuuccucucucaaauguguuguguguuaucaugagacagacaagcagaacagaacugcuuuauaaaaaggcuuuagagaaugacagcaagcaguuucucggucaguuauuaagucaaaucauaaaagucauuacuacguagccaaaaaaaggaaaguggauuauuuuccaaugaauagaggugaaaucuguuaauuaaaucuguccugucaaagguuuguuaagcaaacugccuaaaguugacacacgcaccuucagcagguguuuccaaacugucaguagcuaacucccacaguaagaaauuuacugaugaaccauaagcaagcaucugcuucaaagaaucaaauguuguuuuguugguuuuuguuauuguuguuuugguuugagauagggcuccucuguguaguauuggcuguccuggaccuugugaccaagcuggucuugaacucacagagaugcaccugccucugccuuccgagugcugagguuaaaggcguguaccaccaccgccagagaaucaaauguuguuaaagggaacuuucaagaacauauaugagacuccaugaaugggagaccaaaguuaguuuaggaacugcguguaaaaggaaucuacucucaaaaaauuucucccagggccucgguagcaugcuuuuugcugcaaaccuaauauaagcacagguuggccgaaccaauuaggccuuacuuuuccagcagcuagcuuaagauuuuuguuuccuucgucgcuguacaaggucauuaaaauaauuuuuauuuuugccgggcgcaaagaaaacuggccaacagcaaagaccugcuuuaacucgaguucaaguuaaaccccaauuaguuacacgguguugcgcaggcgcugcauuugccaacucugacgcuccgcaaaccucuucaaggaacccuuugcgccugcuccguggccaauagguggcugguccagagacaaggaaguggucagcgcgccugcgccgccccuucuguggguggggggcggcuccggcggguugcgcaggcgcacacguaccuuuuugaccguaaacauccugccgauuugaaccgaggauuugggcggccggaagagccgcgccguaacggccgccaucuuguuuguuugagugaaucggaaaaggaggcggcggccguggcgguggcgggagcagcuccgaggcuacaccgcacaagggcucccccucuccccgcccccuccccugacccuucccccccuccccgggccacccaccccucccggcuccccgccgagauccagguaagcgaucgggccgaccccuccucgggcucuggcucccuccccggugcucugccccgccggguugcucccggggcgcgggcuccgcggcccgcaguugcggugcgaggcggccggcguugcggcccccgagugcugccagcucccgggcagcgcccggcgaccccgcgcucuccgggcccccuacgucccggggccgcccucgccuggggggguuccucgcugccccggggccgugcaccgcgccugcugacuuccuaaugguuccgccgcaguccagggcccacaaaagcgacccucggccgcgcggaggugggacagcgggaucccggggcugacggggagagaaggggagguuugaacgagcccgcucucggagcuggccgcccccucgggggggaagauggcugucugcaaagacgcgggacucagggcgggagccgucagggagacuccugggcgggcgggcgcggugcaucggguguggaguccgggguccgggucgcgccaggcgugugcuggccgcagggaucguggacucacucgccuguucuucugucucccucaaccggauuucucuauaauguauauauuuguguguugggcaucucagaaauuggaccggcuguuuuaaaacacgaucgaauaacauugcuuccaagaacaugaguguagcugguauuccccuuaacuuuucuaaacuuuuuuuuuuuuuuuaauuucuuuaauggcuaaggaucgaguguuguagagacguuccgaggcugggugccuuuuucguggcacagaaaggcuuugaguaggcucugccaggauaguguaaggugacacugucgagguguucaacuagaccaagcggccuucuucaaauuuaagagggaaacgcuguggacguuuucuucgugcucucugauuuguuaagcugucuucagcguuccaaaacgcguugguguuugaauggcuuauggaaguggcuucuguacuucggcuucucuuuacaaaggaaaguuaauauuugcucuccuuaaacuguauuggaagagcuucggcgucgucccgucccgugcccaccacccccaccaagggugcaaaauccuauuaaaaaucaaaugccagugaacugaaaggcugcaggguuuuggaacagacugaagucgcuuucuuaaauuguaaauaccuuuaagguuggaggcaacuuucuuuaagaagguauuggugaaggugugugccuuguccaguguuugaauuaucuuagaguuuguauaaccaaaguuacagaguuguuuaaggaguggacacggugcuuuuuguauuaugcacaguaaauugggaauuucuuuucagacuuagcaaaacaugcagauucugagagaguuauacuuggguaguugggaaaacuuaauucuuauucuuuuuuuuuuuuuuuuuuuuuuuuuuuuuugguuuuucgagacaggguuucucuguauagcccuggcuguccuggaacucacuuuguagaccaggcuggccucgaacucagaaauccgccugccucugccucccaagugcugggauuaaaggcaugcgccaccacgcccggaugaaaacuuaauucuugagaaauauauuuuguuuuccauccuaccuuaaaggugugaauauucuaacugggcaaguugauuuuugagacuucuguuugaaucugcuuuugagacuacaugugcuguuccguuuaauugucauuaucccuaaagaauauuauguugacuuuguaguugauauaaagucaggcuuguguuuuguuauuguuguuaggagaggugaggaaauccgauuauguaccccaggcugcccuugaagauccuccugccucaggcucaggacuccuaggaugauggacaccaaggccaggcuaaacuucagacaugaaaugacuucuuaaccauugcaaauaaccaaguaaagaaggaguuuaaauuugaaauaaaacucauucuguccauauuagagccaaggagaguugagcaguaguaauauguaagcugaauauaacaugcuucucucucucucucucucucacaaacacacacacacacacacacacacacacacacacaccccuaccuuucaggccacuaccaggcagcucucuuucugugugagcuggguauugauguuuuuuacagucugcagccugcccuuuagguaguguacuuuuccuguuauaaaacacagaucacaguuggguauuuugcuaacuugauagcugaugcagaucaggauuacaucuugacuucuagggugauaguuucaauuuuggauagguaugccuauguuuuguuuuuuaaauauccacuuauacgcaaaauaauacagaaguggagagccccauuuccagagggcacugcugucaccagauuuuuuaguacuccacagauaguuugaacuuaugcacaugcuccuaaguauauacagaugacccugcuugcucuuagcuccucuuagggggcuuaaccaacugcggauuuaaaaugcucuguagcaucuuuguugccuuucauauuuacuauggcagguuuuguuuguuaaaccagugggagguuuguaagaacccuuuacccagccaaccuauagauagaugccauuuuuuccccaacauucagaucaugauucgaucacuugguuaguaaaauccugcuuacuuacagugugcaccuaguuuucuuagacacaaagcuauuguacaauuaauauccuaaaacaauaacuuuaugcauagugacaagcaaaaaccuccuuugacucaguagcaauggucuagaaccaagccugcaguaguucugagauguacauguguucauguaaaauuugagagggccaucauagccgggugugguggcacacgccuuuaauccuagcacuugggaggcagaggcaggcagauuucugagugaggccagccugcucuacagagugaguuccaggacagccagggcuacacagagaaacccugucucgaaaaaaagaaaaaaaagagggggggggggcauugugcuuuggugucuguaagaaauuggcucuagggcacacugugccccagggauugcaacuucccccauacccagaaaaaacucuggacauaguuaaauucccuaauacaccguauuguuuagggagugaugaaaaggaugaaaggugcgugcucacuacuaacacacuuuaaaaacaauauuucauauugcaguaggcugaaucuaagaauauggaagcuuuacauuugaaggggcaacuguauauacauagaccacaaccuuuaaaucacaaagacuccacccccaccgcugcuauucuaaguuuugcugucaaaucagcaaaagcuacucuuccaucaagcacuuaggaaauacagugaucauguguaugcucuauucuucuguaaaauugcuauuauuuagucauuaggaaauuaggcaaaacauuugauacauacuuaguucauucucuuucccucugucucuccacacauuccaguauaucuuuaauauugauuacugaaaguguaguuucuguccagaaagcaugaaugugugaaauuuuccuaagaccuugccaaauugcucuugaaggaggguggacggguuuauucugucacuuccuaguaggugaggaagaugcaggugaggaagaugcuggcgaggacggacauuggagcagaggcaugcgcuucacuuggacuuucucugcaguaggaagaaacugcuguaguuuugcaucagugaggaugcucuaaauaccuucagcuauggaguugcuugcugcacuagaaaaacagaaaacguugguucaagaugaugacaagcucugcuuugguaucagaugcaaaggucuuuugcaagggaucaagagaauuuagaaucuccaagaucucugcagaugaaacagccauauuguaaaguuuagauuuacugagggagagcggguaaugaugcuuguggguuuuuucuuuauucagauacaggcuauagcugagugacuacuuacuguaacugcucucacuucuugggagagugcucuccuguuacuaauuguuucccagauuaauuuuaguuccccucugcuuuacuuaccaucucccaccccaugccaaagucuauuuaggagucugccucugcauagcuggaaugcuuuaggcgcagcccucugaccagccgcuccaguauugccauaaacuacugacaccuguugaaacauaguaguggguuucaguucugaacucgauagaaguguuuuuuuguuuuuacaauuuuuaauuaagagauuaguuaguauauuuuccuaauaagcacauauuuaguaacugucauauggccaacauuauuguagccaguuuuucucuuauuuggaacaguguuuugaggauuuucauguaggacaguuacugcuaagaacacacugccauauugaauucccauacauucucuagguuuguuuauaacacuaggguuaguugagguuuuucuguaacuuucuaaugcuugaaaucuuugaauugcaaaugaaggacucuccaugguuaugguaagcauauuguucuauaaaauauuaaauggcaaacauuuaguacccaugaaguauuauuucauauaccacagagcauuuagucuauuauuuucuguuauaauauucauuaguucucaagcugauauuugauagaaagguuacaguauaauaaagaauugaugaagcuuggcuucuuguuuguuuuuuuuaauauuuauuuauuuauuauauguaaguacacuguagcugucuucagacacuccagaagagggaaucagaucucauuacagaugguugugagccaccaugugguugaugggacuugaacucaggaccuuaggaagagcagucggcgcucuuaaccgcugagccaucucaccagcccugucuucuuguuuuaauugagaaaacuuucuccuguaaauuaaugaugcucuuggaauauuaggcucagaaaauagaauuucagcauccuuuguuacuaaguauuggaaagggggaagcugaaacaaaccugacugugucugucuugcuaucacacuccugucccauagagaacauaucuuuuucccuuucuauuucgaucccuccaaacuuucccuuguaccccauguucuucaaauucaugcccccccucucuccuauguguguguguguguguguguguguguguucaugaauaugaaaauaaaagcgguugagucuguauguuaacuuuguuuucugggcugaccauguggugggccuuccuccugcucucugcauuccuuaguugccucuaguucuuugucuaggguugaagccucaugagcucccccauccauguuggcaugucuauuggugguguucuuguuuggaucaaguuuuggcaggcuuuauggugagacuucauggguguggcuucucugacauuucuaguagacacagucuaaugguaaaccuaacauuucccuggcucuuaaaaucuucccaccacuuuuccucaaugaccccccccccccagccuuggguauaguuguguuguagauguguccuuuaggacuggaucccacuauucuggauucugaaaguuguggcuuucuguaaaugguuuguugcaaagagaaguuucuuugaugaggguugagaacuguaucugugggucuaaggauaauuauuuagacuguaagaauugugaugguuuaguaaaaugacaaguuguagguucuccuccaagauacaugacuucacuagcccuagggacuggcuagguuuccaguaccaggcuugauuucccuggagcacagcuuaagcucaacuagagagcuguugugucaucaagauuugcaugccacuccuguacccuuaggguuacugugccaugcuggucaucauuguaguucagagacauaguagcuagguauaacugaugguugcuucccuuugggucuugugacccggccuccaaaguguaugaugucuuuagcaauaccauuuagaacucacuguuuacccaggacagccaagagcagucgaaauguuuuggggagucucuuggacaacccugacaacuucagaagacuaauagggacuuuucaugccuguguugaguuuugguuaggcaaucuuuggcucuuggauaaagcauugucauccagaggggagauuuuuauguaaaguauuguguuuuuacaccaacuuauacauuacauguaauuuuagguagauaauaugauuccuuaugacuuucagauguccuucuguauugugucccugccuccucccuaauuaaccccauuucccucuucagaucacuuauaccccgcuguuucuauugcccccucuuccuuuguuacuguacugauuucagcaguaggcuggguaauacacuuaucuaggaaacacaugagagaaaacauucaauguuugucuuucugaguuagcucacucaauaugaucuuuacuaguucagugcauuuaccugcaauuucauuuuugguuuuuugcuuuuuuuuuuagccacaaauaauauuuuuggcauacaugaaauuuccucccuaugauacauuuaaagcaaaguuucuuuucaucaauagaaagaauggcauguuguuaguuaaaauauaagcaaauuuucauuuuaaaaauuacuaaucccuuucauuugaaaauaggaaauuauacuuacucuguuuuuaaagcuaauauacaacauuuacauauucuccaacauuugauauugcuucuuuuuuuuuuuacuuaaaccauugugauaacaguacauuuucuuaguggcuuacugauaccuauguucuuauuucucaugggggugucuuugcugugaauuuuuuguuuguuuguuuucuuacuggauuuuccucucuuuuuuuuaaacuuaccugucuugacaguucuuuacauauccaagaucuagcuagauuagucuagcuagauccauauauugguaucuuuugucuaaaaaaugguguaguuuacacuuaaggcuuuggucuaauuucuuagagagauuuuuauucagauuuaauuuguauccuaugaaguuaauugggguuaauguaaaauggccagauggaaugauuucaaacuaaaacuuugagaucucuacucucuuuaggcuuuguugaaugugguuugucuuugguuuuucugcaucucuguaaaaagccaguuuggagauacaugugugucugaguucuuugcuugguugcaauggucccuguguguaucuuucugccauuaccaugguggguguacagcucuguaagguuuaaaacuaaaugggcuugcuuuuuguuuuacucuucauuuuugaagucaucuuaguuuuucugucugcuuugcugcucccuauuaauuuuagaauaaucuuaccuaugguucuuaaaacacacuguuuuguucauuguguuaaaauagccuuaaaaccauguguaagcuuacuguacugccuagcaaccauacuuuagagcuuuggcuguaaagaaaagugggcucccaguaagugugcacacuguauguacauuagcuuuaucagcaguagcccagacuuaauaaguaacugaauguucuucaaugggugaguggcuaaguagacacuguaccuucuuuccucucauaauguuccucaguaauaaagggaauguacuauuaauaaauagcaaggugagugaauuucagcaacguuguacuaaaucaaaaaaaagcccauucuguaugacuuacuuuauugucgggguauuuauaugaaaauaucaaaaugaaaugugugcaguuuuauuugccaaggcuuuggcaugggggcagggguaggcaagucaguugucuggcaaaacaguuggcugccuuguuuauaguguugaguacacuugugcaccuuuggcaugguggaauagagacgcacacugagccaguguguugucuuagcuuacaggauaucacuauugaaucgguuaaaaagccaaaacuauucauauucuguuaaagguaugcuuuuuauuucuuaaaaguaggccucuuauauuucagaaaagggcacaaauucauuugacaaaaaagguggggcuuaacauuuucaugugaugggggaauuaaguaacauaaaacaaaaguguuagucuuaaaagguaaucaaaaauuagauccgagccgggcgugguggcgcacgccuuuaaucccagcacucgggaggcgaggcaggcggauuucugaguuugaggccagccuggucuacaaagugagcuccaggacagccagggcuauagaaaaacccugucucgaaaaaccaaaaaaaaaaaaaguuagaucugaugggcuccaccuggccagugggaccauccacuuacugugugucacucagcugcacuguccugcugccuguacagugccuuucuuagacuugguggguuuucuuuucugauacuacggauuaagcccaaggccucauaugugccaggcuuaaacauuucuuuccauguagaugcuagucaaugagcagaauuaugucugccaucaguaauuagauuagaaauaggauuuaauacuugcuuggaugacagucuuuacaauaggaauucauaaaagcaguuugacccaugucuuuuuucccuauccgucuuaauacuuggcgguggacuuugccuuuauacuauaauaauaggauuauuuuguaaaaugcuugcuguacuuucaggcucuuuauauucucauacucaauguaagaaacuaguguuuucacauuuucuacaucuuaauaaauauuucagucuucaaaugaaacuaauaaaaaaauuuucucuccucagguuucuucuuauuucauagcaaauaagaaaaauguucuacgcacauuuuguccucaguaaacgagggccucuggccaaaaucuggcuggcggcccauugggacaagaagcuaaccaaagcccauguauuugagugcaacuuagagagcaguguggagagcaucaucucaccaaagguaggugcugcuggugacgcucagcuacucgccgugagaugggugggcuuguagaacaacgguggcuguguccaaagcaagagaagccgauguggagagucucggauuuucccucauuauuuuaauuuuuaaccauuuaagauaacaaugaucauaauguauagacugauugaaaauuucucuuuagaaucgcuagcuugacucacauugguauuaauauguauguauguauguauguguauguauauauauauauauauauauagagagagagaguugauaguuauuguaggaagagugagggauccagaggguaaugagcugggauggaaggucauguccuuccuagaacaguucuaauuugaaguuuuuaacaacaugaagacuugacagccuagagaaauccuuucauaguauuugcuuuucugcuaggauauugaaacugcauauguuguacacaguauuaguuuuauugucaacauaagaguaaguuauauugucuuguaauugacuacauucagaaacuauguuuauagcucauuuaauuguugcacacaccagaguccguuaccugcagaauuuacaggauuugaagcagaccucagcuggggugaagucauucauaagaucaguauaagacuuuaagucuggaacuauaagucauuguuuggguugaguguggcuuuccuaugccuccucuguugggauaguuuacauuauuucuaacuuuuugaacuccuaauucuguucuguguaauccagccauugaagccacggcagcaaaaugauauaguagagaaaagguggucuuuucaggccagggagauggcuuaaggaguaaaagugcuugauguguaagccuaaugaccugagcucgggucccuagaacucaguaaaagcagacugaggugacucugauccuguggcgagaaaggcuuuggaaaaaggaaacuccuccuccugccaccaccccagccccacugcacagaggcuccucggcuaguuauagugcaguucacagcacagugguaaacuaggagagacgggcccuuguuugccuuuaaaaaaaggacagacagacagacaaaugcacgaggagaagcccaacagugguucaguagguuaaguuauuugcuuaagguggaccgaaccaugugaguugagucucugggaccuauguaguagaaguaccuacuccugcaaauuguccucuggcaaacagacaaaugugcccacuaaauaaauguaauuagaaaaaaugguggugggcaaauucugagcccugguguuguucuguaauccuauagacauguaugcacauaaacauuauaccugcauauuuaacaguugaagaguaaauguuuuucuuaaaggguggucuuauuuaauaaauagugcuagaacaaaugauaucagcauguaugaagacaaaucuggagacauaacuuauuucuuguaaaaauaaguuaacucagggucauaggccuaaaaugugaaguauaaaacuagaauauaaccuauuaagacucaaaaaaagccuaugaugaaauaugccaaaaauuuuaggcagauguuaacuguaagcccaaagucuuuuuccuugauacuuacccagaaguaguugaaaacuuaaugucuauauuuaaaaacaaagagauguucauagcaucuuuacucagacuugccacaacauacaaagcguuuaggagcuccucaguggauguguugauaaaaacuggccuaugcauagacugcucugcaaaggcuuucuacugcagaguucugacugcaggacacgcuuggaaaggcacggcuggcuacaaagguagugaaaaucugagggguuggggcaagaaggaaguaugaguaggcagaccacaggcuugauuuagagcaguagagcugucugccauaacugugauggugaguucaugacccuguccauuuaguccaucuaaguguagagguacuugaaaaccaaaagugggcuuuggguuaccauauauugcuguauaauuuaucacuuauaaauguaccaguaugccgggugauacagagaguaggccacuccugcuggaacaggggaguguacaggaaauaccuacuuuuccuuacucaugugugagugaaaggugcucugaaaaugugcuggcuauagcagacauuguacuacagcucagaauagagcuuuuuaaaauucaguccuaaaaauacagugccauguacaauaaacaugcacguauggaacuauauguaugugcaggguuuacugucugcacauaaaaacauacacacacaaagccuacaguaugcuuucugugcacuaguuggaaagcagaaguucguguacacacacacacacacacacacacacacgugcauacuuguugacagaagaugagacuggagagauagcauucuuuucuuucuuuuuuuuuuuuuccuuuuauuuuuguuuuuguuuguuguuguuguuguuucgugacaggguuuuucuguguagcccuggcuguccuggaacucacuuuguagaccaggcuggccucgaacucagaaauccaccugccucugccucccaagugcugggauuaaaggcaugugccaccacacccagcgcauucuuuuuuuuaauauccauaaaucucaaaacuacuuuggcucuaaggauacuuguuauaauguacauagaguacuuuguacacuacaaaaagucugagagauaagaguguguuagcaggcauauguaucaaaagauggccuaggcggccaucacuggaaagagaggcccauuggacuugcaaacuuuauaugccccaguacaggggaaugccagggccaaaaagggggaguggguggguaggggaguggggguggguggguaugggggacuuuugguauagcauuggaaauguaaaugagcuaaauaccuaauaaaaaaugggaaaaaaaagaguguguuagcagauauagauaguuugacauuaaagauaacugguggaccccacaaauuacucacuuaacauuuuucaaucauugugggucuuuauuaggguuuaguguaauauggugugaagcuauuggcccagggagcuggccugaaacugcugagcauuucaugcugaggaaaugguuuauuuguugagguugggguugcucugccuuaccugggagcuucuaugaacuuucccaacuccucccauuugaagaaccaucccaggcccccuuuguuuagcauauagccgguggccaacuuacuguauuuacauccuucugcuuaaagcacgucuuaccuaacuuuacccacucuaaaccaaacuaguacaggcgcuacauuuggagguugcucauuguagacauggaagggguucugucauucuuucuguguccuggauuugaucagauuuguuauuauuugagaggucuaaaaauuuacaguagcaaguuuguuagucuugcuuuaaaucacauaagaugaccauaaauacagaggcuagauugcagaggaguccuagacagaugcggugcuaacauacaauggacauaauuuuaaacauaucuuuuaaugaguauguuuuuaccauagaauuugggaagcuugaguuuaugguaugauuugaaugaagaacuaucugggggaacuuuugaguucauguuuuuuauucuuugaauuauuuguagccaggaaaguuuugaauauuucugugucuguuuaggucauuauugugucuucugaucuaguauuaggaaguaauuaacagugcuuaacaaaaggaaaaguguuaaagggacauuccaagacagaucuaauuggucccuagcacagagaugagccaaagccuuagcucguugacuguccuuuggugcaucaucacccacacagcaggaaagggagaagacagagacauucuguuauuucaaagcccuucucagaaauccgcuggcaagccccaccuuucuuucucaguugacugagguaugugugugcgccugcucaauaagacguuuuaaccgacaggucugaaauaaucuuucuuuuuuuuaaggccaggaguguuugcuucuaaaacaaaaucacaauccuuggugugcugauggcaacauccaugggaagaucggcuuucugcuucauagcugccuuuaugucuaagugaauuuaugaauuacugucguuuagucuguguuaggggaguuaggaaaugguaaggugcaaauauuuauuaaccgacuuuaaaucacccagaaaauaaagaaaaagcacaagauccuuauaaauagcacaggauaugcacuuuccaguacacugcccucgaauguaauccacugaccguggauguaaugcucaucucuugcucaggugaagauggcgcugcggacgucaggacaccuucuccugggaguaguccgcaucuaucacaggaaagccaaauaccuccucgcagacuguaaugaagcauuuauuaaaauaaagauggcguuucggccagguagugugccuuucuuuguuuuuuaaccugugaggcuucccauaccaugguggaaacugcuaauuguguguucuagauaggugugguuuuuuucauagcagcucccauuguagggagcacuguccauuuuuagacucgguguuuaccuagucucagcagcuugcagcagcugagucaucggagcagacaugcugcaaacuguugaugugugaauuauaaaagguggcucaaaaugcaacuggguggggggcuggcuuuuucccccugaacagucuuaacauaauuuuaaaaucacaugcacuuuuaauccugagacauuucauuuaauggucuuugucgugucaguuuuacaguuuugcuugagguaagauuugguucuagaaccaaccaaaguaaauaguaucuguaguauucaucuggacucacauucuacaauuugaaaugaugaaauguugcuguuuuaaaugaucagacuaugugcugcggauaguggaguugucagggugcuuggaggcaagcacggagggccugagggcagucuccagugacgauggaaaaggcuggcaaugguggccccugccucugcuguguacuguagggaggagaugggcucaucccagggccucucugaccagcuagcuuuguagaaucagugagauagacgugaugugucagggugcuuuuauauagcagcuuccguugaugcuauauucuaauacuucuauuuuaguacaugauaguaaacuaccuacuacuuuauuuuugugugauaaaguauauuuauugcauauagcacgcuagacaguaguuuuuuuuguuuuucgguuuuucgagacaggguuucucuguguagcccuggcuguccuggaacucacuuuguagaccaggcuggccucgaacucagaaauccgccugccucugccucccaagugcugggauuaaaggcaugugccaccacguagacaguaauuuuuuuguccuuuauaguugucauguuauuuuuaaauacuuuuaucuggaaaauuuugaacauagccaacauuuugugauccuuuuccuaagauaaccaccuccuacuuagggaguugcuuugguucuguaaacaugaagggcaugagucccucgcccacauuauaagaaaaaaacgacaaacacugagcuucaguggcaccuguaaucccagugcaggggaagaagaaacaaugccuugggcuucuuuuuuuuuuuuuuuuaagauuuauuuauuuauuuauuuauuuauuacauguaaguacacuguagcugucuucagacccuccagaagagggagucagaucucauuacggaugguugugagccaccaugugguugcugggauuugaacuucggaccuucggaagagcagucgggugcucuuacccacugagccaucucaccagcccuugggcuucuuuuacagccuuggccugauaauuguugaguuccaaaugcaaugagaccuugugucaagaaagguaucgagcaguuggaaaaaguccccugaccuggaccucugccuuccacacugcucacaaggaaaacacaauuggaauaagaaaauauauauuuauuguacuucuuuguaaccauugauacuacuccagauagauuucaugguaaaaaguagaagacuaacccuguuuguuuguuggcaugcuguuuugaaagcuuagcuuccagcauacugagugccuggacuacuuguguagaacucaugcuaacaugacagcagacaagggcuuccaucuggagauacuuggcaugugcuaccucugacccacauguaaucuacucagcuaggccuucaagcuucaucucucuuuuccagguguugucgaucuaccugaggaaaaucgggaagcagcuuauaaugccauuacuuuaccugaggaauuccacgauuuugaucagccacugccagauuuagaguaugucugucuugugucucuccucccuucucagucccuucuucugcccuaaucccucaucuuuuagauuguuuagugcaucucugaccuccaguuuuguuuccuuaagaguguuugauccuaagguaccagccaucugaaaugcauauacuuugauuuaggaguauguucauuacaagguguacgauuuaggaaguguuuuuuuuuuuuccccucugagaaaaucauguggguaucaauuuaggcaaggcucauguaucugaacaccuguauagauaaauuauuuauauggugcugucaguaagcuugggacuuguuucaagauuguuuuucagagguauguauuacaguuauguacuguugucuuaaacuacugaaagcugcaccuuuuaaaaauacuuguauaugcugacuuaacauaauagcauaaagaauacagaagcaccacuguuuacacacacauuuaaggaaaaaguuacauggagaugauuguuuuggcagagaacuauugucuguuccuccuuccuuccccagucauuaaaauguagcuguuaugaugugauggcaggugucaguauaccuuaccaagucuuuggguggcacaguugacagccagccuguuuaccacccuaguugucagugugaacuuaggagaguugccucuaaauaugaggcagacuaaagguucaugaaauagccaacuuuauucacaguguccugcaauuuauacucugaggcugaguguguacugugagcuucuaaucccaccacugcgaaugcagaggcaggcagaucucucugaguucggggacagcuggggcuguuacacagagaaaacccugucuccaaaaaaaaaguccaaucacaaggacaggcucuaugugccacaugaauaauaacaacugaaguaaacuccugucugcugcaccuagaggagcgcagaaacucauccaaagacaauucucugcuuugaggaaauuaaggucagagccaggcucuuggguuacuuggaguuuucucacaagaaaucucacacuacuucauucuuggacuguguuccaaccagcccuccacacugaauucucuauguaguucacaacaaaauuuccuguuuuugaaaagaucugugacuccuagcagguuguuuguuugcuuguuucccaauuuuuauauuguguuaguuguggcuuggugcuaggugccagcuucuccaccccucagaaaaaaauacuaucaauuacuuuagccuuuugaugcaucuaauaucagcuucucaaacuccucuucccaucuuacuccaaucaugggugauguuuuuagaggcgaagaauuuuugggggcgggguguuucaagacaggguuucucuguguagcccugguuguccuggaacucacuuuguagaccagucuggccucgaacucagaaauccgccugccucugccucccaagugcugggauuaaaggcgugcgccaccauugccuggcagacaaagaauuuuuuaaacacccauacuacuaccauuuguuugguuugguauuuuuguuuuguuuuuuuccaugucucacguguuagcucaguuuuuccugaaacucaguacauagaugagauuggccucaaacucaccugucucugccuucugaguacugggacuaaagguaugcaccgccaccauccaucacaagaaaugccagacugcagacugcauuuguuugguuacucuauccaauaaauaccacuguuuagaucccuagcucugcaucgcuuuccggcuacugauuguugucucugcauuugccagugguuuucucaucacuaccauuauguacuucagauuauaugagagaaggucaugguuggcagaugagcaacuuuuagaaacacuagggaaaguagggaaaguugaguucauacagauccuguaaguuucaccuaguucauaaacccuaauuuaccaaauuaccuuagguaguggauuuaauguaugauaauuucuuuccugucauuaauagcuuuaaauuucuaaauacaaaugaagcuuggauuguauuaauuuuuaguauuaauauuuaauauaauauuaaacuucucaaagggguaucuagaagaaauuggggcuuuuugugaaacuugauguguuuccauuucuuuccaagugauauugacgucgcccagcaguucagccugaaccaaagcagaguagaagagauaaccaugagagaagaagucggaaacaucaguauccuacaggaaaaugacuuugguaaaaacagauugcuaguccucaguuauguuuucauuauguuguuacauugccaggaacuacaaaggaucucuaauaugugcuguuguuaugucagacaucguuucugaccagaguugggauucuuguuccuccuauucaccguucagugagagaaccuguuugcaguuguguggaaaguccaagcaguauaguaauguuuacuuuugaacuagccauuuuggagcaguugguuguauuacuauaaacauuauucaaaaccuuaaguggucaaauuggcacuaagucacauucauuuaugcauagcagcacuuucuaucaaaguggaagucugugaauguuaauugugcuugcuuguuuaccuuaugcaaucugauuuuuguuagacauuccccagagguacaaaguuuacagcagauauuuuaauguuugccacauaaggcuucaggaagcaaaacaguaucaugauuguaauaaaacaucaacuguuguaacagucgcauuucugacuuuucacagcuaaugacauaguuaauauguuuaggugacuucggaauggaugaccgugaaauaaugagagaaggcagugcuuucgaggaugacgacauguuagugagcaccagcgcuuccaaccuucuccucgagccagagcagagcaccagcaaccugaaugaaaagaugaaucacuuagaguacgaagaccaguacaaagaugacaauuuuggagaaggaaaugauggcgguauauuagguggguggcugugcuucguuucguagauucuguuucagaagagucaccaacucugagugcugagcaguugccuagacaguauaugaaugggaguuuguugucucacuaaagcuuucuagaaaacuagccaaaaacauugagcuuuguguacauggcuuuuaucaaaaucuaaauuucacuaguuguucaagcugccguguuuguuugguaccuaauaaguagauuuggggguggaggaucaagacagggaaucacuuuguagacagagcuggccucaaacucacagggguccacuugccucuauuucccgagugcuaggauuaaaggcauguguuaacacacucuacuauaaguagauauguuuuuggaaguaugaacuuuuuuuugaagauuuauuuauuauuauacauaaauacacuguagcucacuucagacacacagaagagggugucagaucucauuacgagugguugugagccaccaugugguugcugggaauugaacucaggaccuuuagaagagcagucaaugcucuuaccauugagccaucuugccagccuggaaguuugaacuucuaaguggaagaauuuuuuucaguuacuaaguguuuuugcuuuuauaaacuaccuugagaugaacaaauugaauauggauuuaaauuuaaucuccccuuaagccuguuuguccuugggugaauuaguuaaugugaucauagcacuuuauuuucagauuuuuaacuguuacguuuucuauuucagaugacaaacuuauaaguaauaaugaugguggcaucuuugacgaucccccugccuugucugaggcaggggucauguugccagagcaaccugcacaugaugacauggaugaagaugacaauggcucacgugagcauuuuauguuuugggauucuugggguuucgggauucuuggcgaucacaaagcaaauggugacacagaacuaccgccugguaacuaagcacccuugacuggcuugcuuacaaugacugccaguucuuguguuuucaguguugguuacucuguccuguuacccucguugguacguugggguugaacucugcaggggcugccuggcaaaugcaucaguacuuuucuucaaccccuugggguuuguuccacuuccugaaugggauuuuuuucuccacuuguagaguuugaaugcuaucgcuaagccuguuacaaccauguugcuuuuacagugggugggccggauagucccgacucuguggauccugucgaaccgaugccaacuaugacugaucagacaacucucgucccaaacgaggaagaagcuuuugcguuggagcccauugauauaacuggugagcagauagacuucacaguguguagaacauaagguccuaggugcuuucuuucucugaugucauucaucuauaacagucgucacucuguccguuguaauuugaugacugguggaagaguuacacaggaagcugcaagguguaaaauuacagggcagauuuucuguaacuguguuucagucuuugggaguccuuacauacuaacaacaguaaucuugaggucagcgagauggcucaguggguagagauguuucucagcaggccugaaggucugaguuccuucaaucccgguggugaaaaaggagaagcaauacccccaaguuguucucuggccugcagugugcuccuacauauacacauacacauaaacacacacacagccuuuuuguuuuuuuuaaugcauuuuuaggaagaaugccauggcggggguuuucuguggagaggauucuagucaauaagaaugauagcucacuuugggagaagggaaggcacuguagcuggagggcaguuauggagauagacccaucauuaguuuguuuuuaaccuugugaaugcuuuuuugugaaaccugggcuaaugugugacagugagauugaaucaaucccagaagucuuucguuccaaagugguaugaaagagaagcaaagagcugagggaugucaggaugcguuuccagaccaugacugauccugagcugcuuccccuugaucaagcaacucugcauagcugucauguaugugucaugcaugacauacuagugcgguaaacgccauagugcuggggccguuuguuggcaacuugcucuacuuuagacacugugcuuuguagcgccuagaaauaguuggccuauuacaaacaaaguuuuuucauuuuguuaguuuagaauuuaaguuucuuuuucauagucauagucauaguuuaaaauguuagaacuagccagguaugcugacacaugccuuuaauuccaguaccugggaggcagaagcagguagaccucuaacuugguggcuagacuggucuucauaucaaguacccugccugucucaaaaaaaaaaaaaaaaaaaagucagaacuuggccaaucacuaacagauggucaggccugaaaacaugcauauauacaaguacuguuauauagacugagcaggauauauuuaugugcacuugcauucacacacacgcaguaagaaagagaaagaagcuaugaauuuaaaggaaaaggagagcacgugggaagggcgagggggaagugguauaauuauauucucaaaagguaaagauugaauuaaagauaaauaugcauuauuuuaaaagaaugucugacaggugugcuauguguaucauuuacagaauaaagcuauguagguuuaaagguauugauccuugaauuauuuuaccuauuuuauaguaaaaaucagcaaacuucuauugaauaucuguuguaaauaaugguuggaaaacauaaguuuagacauacugucuucaugagggcuuuugccuagcucugugucuagaaagucagaggauaacaccagcccaagaagaggaagguguuccaagcuggcucucaagaaagugaccuuauuauauucuuuuauucuagucaaagagacaaaagccaagaggaagaggaagcugauuguugacagugucaaagaauuggauaguaagaccauuagagcccagcuuagcgauuauucugauauuguuacgacucuggaccuggcuccgccaaccaagaagcuuaugauguggaaagagacaggaggaguggaaaagcucuucuuuuuaccagcacagccccuguggaauaaccggcuacugaagguagugcccugggcagagauugucugucuucuagaaacacugauuccuacaaccugugcucaaacugauacgugcuucuucuuuucuaccuuaaaucacgguaugcuuagggcagcuuggcucacguacugaugggauguguuuuucccagguguagaaugccaucgugggaauuaguacacagcucaauagucucacuggcuucagagccggugggugcuuccacucugcaguuagcucugcugcuccugcaguagagaccuggcucaguagaaaugccccuccacacccccagacacauacuaguuagcaguuuucagcucaugugaauuccaaacuacuguaaaguaacuguguggcaccugcugguggaaaugaugcuguuagauuuguaagcuaaaaugugcagagaaacagcuguuuuuucucuacaguacuccaaagcaacaaggguaugaugauggcuguucuuuaauggaaacgcugucaaacaguuuugaaggauauccauagaaauguuuaugcuuuagaaggauauauuuuaagagugacccaaccacuggucauaugccucuguuuguauaaauaaucccuccugugugcaucccuaaacuuacugugcuuggcucacaggagaaaaaagagagacuugaauguagaaggacuagcuuauguaccuguauuaaaaugucauaauaaacccuauuuauaugaauguaggcuaauaaaaaucuaaaauuagccuuuguuucaguagguucacuuuuuucuaggcaaaaauguaaaauuugaggaaaaccacuucuacacguguaccuguguaauaugaggugcucuucaucugugauauaaucacauauuuuacgugcuuguuaauaaguaagaauguuguguggugcugggcgugguggcgaacgccuuuaaucccagcacucgggaggcagagggaggcggguuacugaguuccagggcuacacagagaaacccugucucguaaaacaaaaaacaaacgaacaaaaaagggaauguugugugguguuguguaagauuucacauaguaguuaaaccuugugaagacaagcacgauguaaacuauugagcacugugacagguugaguguucgauuuaucaaugaaaauaacuucagagagaaauuagaaaccuugaagcuuaauagauaucauuuuccacuuucugaaauggcugcaguuauaauuugaacaguuauuuuucaaaacaaaugugagaaugugaaguaaaacugcuaagaugcucauaugcugcuuagugcuuaggaacugaacugcagcguuccucgugcgagcagacagcgcgcggauggcgaugagccuucccuucuggggcuuuacaguugaugcugggcuucugucuccauagcucuucacacgcugccuuaccccacuuguaccagaagaccuuaggaagagaaggaaagggggagaggcagauaaucuggaugaguuccucaaagaguuugagaauccagagguucccagagaggagcagcagccacagcagcagcagccacagccgcagcgagaugucaucgguuaguucugggagcguuccuagcugaaguuugaaaugucuuaaacuugaccuuugugcugucagagcaacggugcuccaggaugagggggcggcgggcuguuugguuuggaggcauggaagugcauggaucuccucaccuugcaggauuggaaacccagcuucagaaagcaguaggacuuugcugacugaaggggcaguuagaagaauaucugcuugggacuggggagcgagccaccuuuaacacuucucaagcccugugcuugcgguguuauaaauggaaugaaucaccugugugcuucacaggcuuucugcauuaggcaaaguaacucuagcugggucuuaagauaccagucuuagaagcagauuaucccaaaacucggaaaacuaaauucuuuucuugugauaauugcagaugagcccauuauagaagagccaagccgccuccaggacucagugauggaggccagcagaacaaccauagaagaaucagccaugcccccaccacccccucaaggaguuaagcggaaagccgggcaaauagacccagagccuucgauaccuguaaggaaaaagaaaaagauugaaagagagauggucauacaguuagcugcaaggggcguuuaaggagucugaguuaggagucucgguuuagaucuggaaguggaucggagaaugacagcagaauuuaggagcacagccuuugucauaucgggaaagaugucaaugcacucagcagagacuucuuggcucuuugggaauagacuugcuucagagugguccaaaaugaguaaccuuauugaucugugaggucaguggcucugaacuguacugguuuauaugaaaauucuuaacaucucucaaguacuggacaaguuauuaaaugauugguauauacuugaacugaaaaccaaugaagugauaacugacaacugcacucuuuggcuaccaugaaguccugcuagaauagaaaaacuagccuagaauggagccaucgaguuaggacuucugauuuuaagucuguggaauaaacuauuuugaagggaaagcaggucuucgguaauacuaggcucccauuucaguccucaucagaaauacugucaggacagcugauugccagccuggagcaguugcucugugcccuaugcuggaaaggacuugucggcccgagcucuuucuucuugcgcaggucacagagcaguaacugugucacugcucuccgggucgucucuuaaagacuauuuuaaugcucucaguuaccuuaaacuccaaacaguacacgccauuaauaccagcacuuggggggcagaggcaggccgauuucugaguuugaggccagccuggucuacagagugaguuccaggacagccagagcuauacagagaaacccuaucucaaaaaaaccaaaaagaaaaaggaaaaaugacauaguauaaaugaacucaggaaacaguguccuuguccauguuaccugcugcugagucccaaaggucuuucugaaagagcgagggauggauaguaaguuacugugauagcuuuaaaguaguugaucugauccugcauuuuagagaagcuacuguucaaaccugcaccuuuaaccuuguucuuuuauuguuuaagccucagcagguagagcaaauggaaauaccaccaguagaacuucccccagaggagccuccaaauaucugucagcugaucccggaguuagagcuccuaccggagaaggagaaggaaaaagagaaggagaaggaagaggaggaggaggaggagguaagagcucuuuagagcguucagcaaguagacauccccaugccugggguggcggagcuucuugaccauuccuguuugagcucagcuaguguugggcaucaggucagugaaacauggcucugcagugacuugaugugccagaguggguugguaucggggcugggaggacaggggaaccaugaucgggauauaaaaugaaugaaauaaauuauuaaaaauaaaaguuuuaaaaagaauaaaaaugaaacuagauucuuaguguagugaaucaucggauuuugugcuguuguaauuccaacuuucccucaggaaagacaggggacugcccuuacagauuguugcuagacuuguaaauggcuuauggcuguguuuuuaucaucuaucuuguggucaguagccaauucuuacugcuauuaaaaccagccucuggucuaacccgccuguggccuagaaaucaaauauccagacauagcccauuugucugaguuucgguuuuguuuuaauuaaugcagaguuagcccuggcucgugugaguagagcuuggagcacuguuacucuuuacagaguggagauguuuuauacaugccucccuuuucucccucagcuauguaagguccucucuaaaguuuuuaucuugcuuauuucugaaccauugagggaguguaccuuaucaugugaugguuuuaucaugcaucuauuuaaaccuuuaccauuaaaauuuuuuccagauaacuaaaugaaauuguuaaaauuguuucucaugcccguuguuuauauauugaauucaguuuacuaacagcuguuuguuucuaguuaucuucauaucauugacaguagauaauuuuguuucguguaauguauuuuaaacuaaaauuuaguuucccaaauguuagauuauggugucaucucagauuuuccugugaagcaauuuuaaaacacgauugccauucuaggugaagcugcugauugcuagcuuuucuuagagugugcuguguaauaccaguguuugugggcaacauggcagcuccuggccuguaccaccuuaggguucaaaaaaauuauuuggacaguucagguaaaauaaagcauauauuaauaauuaacaaacaaucuugagcugcccagauacaaugcaggcucuuugauauuguucagugaugauguagaauaucacacuacaaaguuaguaucaaagauuaauuaacuuuucccgguaucuagauugacaccauccaguguugcacaucaugguguuuugcuguuuauuuuaaguuuccaguuauuuauuuguuuaaggguucuuaacuagguguucuuuaacaguccauguuguaugacuuguagagcauugcagagaaauuauguacaguguuugcuuacaagagcuauccuuuguggucagaguucguagcagauggcaaaugauuuugaaaaagccguuuucuguugcugagucugacuguuaaugaaaagguuucuggauauggggaaguagucauuucagcaggcaguuuuuucucaauucugguggccauuuauucaggaugaagaugcuucagggggugaucaggaucaagaggaaaggagauggaacaaacgcacucagcagaugcuucauggucuucagguaugccagcacaguccacaaagaguccuuucccagaaagcaaguccuguuaaaccccgaagcaugccuuggugggaauuucuccagggcugcauuguuuuaaagcaucuuaguuacauacaugaagugucaagccagggguaaaccuagagcauuuaguuuauguagccaugauuauccuaaaaaaccugaugcauggugcugugauggggagcgcagcugcguacugucuuguuugauuagcaaaagccaugugcuaagucauagaguagcagaagucagcaaccucagcuaggguuccagauacaggugaggcuggagcacccgugacaguucucccaaguuccuuccuuucugcacauggggauggaugauacuuaggguuggaagguuaucaggggccgguuugauuuugguuuuguuuucacuuuaaaaucugcugaguguuuguuuuugcuaacucacaucucuguuguggcgccuucacuuacuucuugaacucuguaugccuuaagauaauaugcuuuagauaauaaggccuuuaccuuagugacuagcaugggaaccacuugcguaacuacacgaauguccagucccagcuccagccaaacggagcucacuuugaccagugccaaaauugcaucuucugguuacuacuuugugcgugaguuacuugaaaucaucugcuuuguuuuguucuauuucagcgagcucuugcuaaaacuggagcagagucuaucaguuugcuugagcugugucgaaacacaaaccgaaagcaggcagcagcaaaguucuacagcuuuuugguucuuaagaagcagcaagccaucgagcucacacaggaagagccguacagugacaucauugcaaccccuggaccacgguuccauauuaucugaggagcuagauguguucgagcuagugauaacucacuaguacauacaaauugcccccgugugcagggcaccaaaacccuuuaagaaaguuuuuagauuucuguuuguacaaaaaucuuugccuuuucuuucuucuuuuuccccccaguguuucuaauuuugucaaccauauuuuuaagggaaacugcuuauuuggguuggguuuguauuccuggagaaaacaguagcccaagaacccagaagacuuuuaacaguucagaacagaugugugcaauauuggugcauguaagaauauggaguaacagucaaaaggcaccauuuuuaauguuaguuuuccauuacuauguugaaaggaaaaccugccuaggaaaaugccugacacuuuaagaacugugguuugagucccuugacaggaagagaaaaaugucuucccaucagugaaaccaacggucugguuaaccacuguaguagggauagugugugaagcaucgugcuugucuucuugaucauguuuaaaguaaauccacacugagcaagaauuugugagguugugcugacugaucuucuucggcuauuauguucugaaaucauuccgugagucuuaggaccucugaugcuaugcaccgcagcucagaacgaucagacgucuacaguggcgugacuccucaggggcugcagaucacucucagagguguuuggauguuugcuugaauaaugagaucauggaagcagacauuccccugccugcugaagggcagaccaaugagagacuaccccagauugacuuccuuuaagcaaacagugcuguaaaaacuaauggcuucucugauauuuauuauaaauguuaguacucaucuuuuuccaaggcugcacacuccuguauuugcaacuuauuuuuaauaacuuugcaacuauaauccuguaucaguuuccuauaauuuaaguggagaaaaacauccuaauaaaggcuuuauuauuaacagaccagauagcaccagaaauuaugugacuauauaaauaucaaaacauguucacuuuguaggacaaaauuauguugaaaaguucuagcuuaaguguuggcacuuuuaugggggggaaaucaguuuuaaaacuaagacuuccauguauacccaguaauuuaaaauuaugugaaauauuuuaaauuugugaacucguaauuacuacuuuaaugauucaguuucucgagaaugguaauuguauaaaauugcucuugcaguuuucuuuucaauacgacgugccuguaaccauggauguccccuuuguaaaaagacacuguagauaauugaauguuugauuauagaaaggucguuaguuucuuguuaaacauuuuguuaguccaguuuuugucgcuuauuggguuuaauauuguucuugaaaauagucgaugcuauguuauguauaacuuuucuaauaaaaguuguguuucaagcuguacauuuuggaacauacucaguugaugauaugucacaagagaaauguugacugaaaaaguuaacauggccaaauauuucauuugcuuuaccuaggaauauuuugugcuaauuaagugaauuuuuuuuuuaaaguucaguaguuccacgaacacuacugaccauugucugacagcuuguugaaaggcagcacugucuuaagguaauucuaaaucuaagcagagugcuuaguguccauguucugacagggaaacaagucacaguaacugaagucauaggugcagauaguugguuggcugcaguauuaguguaggguagucagaauauaccucuucgagaaggugaguuucugagcaauaaaagauuuga

SEQ ID NO: 7750 - RNA, 935 nt, Mus musculus
acucggccugacagggacuuagcccacagagaccggcccacgcgcgugaccccacacccacccacucguccaccuacccacuccccgcaccuccuccucccacccugagcagagccaccgaggaugauaaacacccaggacaguaguauuuugccuuugaguaacuguccccagcuccagugcugcaaggcacauuguuccagggccucuguggugcuccugaugccccucacccacugucgaagauccccggagggcaagggggcggcagggauucuucucucucagcucuaauauauaaggaccagaagcucucuguaacucaggaccuccccgugaacgauggaaaaaccucacaucggccacuuccaguauguggucaccggggugaaggucucuuccugggaugcaguccuguccagccagagccuguuuguagaaaccccagauggauuauuagcugaugggagcaaagaaggauuauuagcacugcuagaguuugcugaggagaaggugaagugaacuacgucuucauuuccuucaggaagggcugggaagacagaguucuacucuugaagacauucagcaucuugggcuuugagauugugcacccaggucaucccuguguucccucucggccagaugugauguuuaugguuuacccccuggaccagaacuugucugaugaggacuaauggucacagaggaugcuuugccuaagagccacagugggggaagaggggaaguuaggcagccuugggagagaggagagggucucugacugucuagggaaggauauugaggggcucagguugaggguugcucauuguguuuucgaaauugacucguugaaauuguuuuccauaaagaacaauauaagcauauuauucacauguaaucaccaauaguaaaugaagauguuuauggacuaggaa

SEQ ID NO: 7751 - RNA, 279052 nt, Mus musculus
cagcgcugucgugucgggaauggaauguguaaguguaacauucagaaccggguaacauucggcgaccgaacgcggcggucggcagugauagcgcggggccugcgaagcaccgcucggggccggcacugcccgcggggaggacgcgccgccgccgccgccccgcgccgccucgugccgccggccgggccgccgcgcgcccggggagccggccccgugagcgcaggaguaaacaccggcggagugugggagccgcugcagaagggaauaaagagacaugcagggauuugugagguuacggcgccccagcugcaagaugcacuagccggcugaagccggggcggauugacuuguuggaaccguagugcucugcaccggaguguggaugaguugaaguugcuuuccccgggcucguucuccacgccgccgagaggaauccgagcggagaggcagucacuucgucuugccauugauuggguaucgggagcuuuuucuucccugcucucuuucuuuuccuccgucuuguugcaugcaagaaaauuacaguccgcuguucgcccgcccugggugcgagaucuucugcccggcucucucccgugcauugugcagcccaaagaugaaagaccgaaggggagaaaguuaaagaaaucgcccacaugcgcuggaucaguccacggcuuggggaaaggcauccagagaaggugggagcggagaguuugaagucuuuacaggcgggaagauggcggacuggagcugaaaguguugauugggaaacuugggugauucuuguguuuauuuacaauccucuugacccaggcaggacacaugcaggccaaaaaacgcuauuucauccugcucucagcuggcucuugucucgcccuuuuguuuuauuuuggaggcgugcaguuuagggcaucgaggagccacagccggagagaagagcacaguggucggaauggcuugcaccagcccaguccggaucauuucuggccccgcuucccggacgcucugcgcccuuucuuuccuugggaucaauuggaaaacgaggauuccagcgugcacauuuccccccggcagaagcgagacgccaacucgagcaucuacaaaggcaagaagugccgcauggaguccugcuucgauuucacccuuugcaagaaaaacggcuucaaagucuacguguacccgcagcagaaaggggagaaaaucgccgaaaguuaccaaaacauucuagcggccaucgagggcuccagguucuacaccucggaccccagccaggcgugccucuuugucuugagucuggauacuuuagacagagaccaguuaucaccucaguaugugcacaauuugagauccaaagugcagagucuccacuuguggaacaaugguaggaaucauuuaauuuuuaauuuauauucuggcacuuggccugacuacacugaggacgugggguuugacaucggccaggcgaugcuggccaaagccagcaucaguacugaaaacuuccgaccaaacuuugauguuucuauuccccucuuuucuaaggaucaucccaggacaggaggggagaggggguuuuugaaauuuaacaccaucccuccucucaggaaguacaugcugguauucaaggggaagcgguaccugacagggauagggucagacaccaggaaugccuuauaucacguccauaacggggaggacgucuugcuccucaccaccugcaagcauggcaaagacuggcaaaagcacaaggauucucgcugugacagagacaacaccgaguaugagaagugaguaagggcugccucccuucgaggcucggcccugggcccuggauaccugaguccaggugggagggugggggaugcgggguggagacagaagcccucaguucuguugcuuccuugggauccagcggcuggguucaaguguguggggugagcuugggcuucucaggcaaacucgacaagaguacucucuccagucaaguuggugaagaagggaaucuuccugauacuuugaaaaccauucaggacccaugugucuuuggcgcauuaugggggcucggauccaaguuuuggaaaggguacuaaaggguauuugugacgacucagagagacacauguucuacgcaaguccacagacucugaccccugggcuuugucuguuucucucaagaacauggguaccuguucucugugcaguuggcuaggcuuaaauuugcaccuuccccccuaagcuuuagauucuugauuccuagaauauuuucauuuuuaccuucccaacuugugacugccucuuacuuccucuacagcacugauguuuaugaaggguagaguguaagcugguuagggucauucauucauucauucauuccuauaagcccucucuuucuuggggaaacuuuaaaaucugggccucaggcccacugcagugaacuacccuuacuaauuuagauuucccuuucuucuuugucuuuaucuauuugcauauaaauguggacuguuacucuuugaaugggcuugagaugccuccuuagccucuguggaggggagaguuuuguuuaguugcuaaguaacugaguugguuacuuuguagccccuuucagucuuccuuuuccucgucuuucacagucgcugacacacaggauuucaggucaaaguuagaauccacaaaucugcuugaaaccgaggcuggccuguggguccaucggucagcuuccugauagcugaggucagugccccagacucacuuguguccggcugggaaagagugagcgccuauggugcauuuccacuuuacgccaguuaaaaaccagagcagccuugugcuagcuacccagggaaggaaggagaaaccucucagcugaguacaagaggaacuggcagagguuggcagauugugcaauugauucaugaaaugcagaauaggggaaaaggcuuccagaugggguuggaucaggaagggguggggguggggguaaccgggcccugaaaugaaaggugugauuauuuauuguccauggauucccucagacucucuggucuuggugggagugauuggaugggauaguaaaguccuccccgacuugaucauagaagggagaggaaauaucaagccuggggcuucugcuucugagccccuuggacguuuuccguuucaauccugggaaaagccugaggccaggaucaauugugaauccaucguuccuuuccucuuacacacggaaguucugcgugaauguugaguguuguugugacagaguaaaaauacucuuuaacuguggucagaaagaaacugcuuuguugaaaggacaauauacuuugauagauucugggggugcuugugccuucuaggaauuucuuuggcuggcgugaagaggcugaucuuuugauggcuucuaaagcaaucucuccaagcuuuauagaaagaucaugacguucuucauucggaaagagcggauguuccuuguguguucgacccccccacccccaccccagaugccaauucuuuacauuuucuauggaaaacuuuuguuuucuagagagcggagauggagaaaggugugguugauuggcuucggagcaacuuuguuuugcuaauugaauguaauuaauuuuucaccuuucgguccuugggccaagaaaucugacacccuccaccucuucuugauuuaaguuuaaagaccaccugggacggggccucaggaucgucucuguuugggacuguggcauccagaaagaaaacaaguuuacuauucuccugagcaggguuuuucagggcuuucuguuuccuuuuacaaucccgcuagcucugauuuuguuuacuaggauguguuaguagugcagacuggaacuccuagagauuuaacuccuuacccaucuuggauugucagaauuguuuacucacaaauauugcuggguguuuguuugcuuuugacuuuggaauacacaggguggaaauaagaaugcaggaaucuggaagccgugacuauacaccaggcuacaccgaugcugcacucggaaguaaagggcaaugcagaauuccucagccacacugaggcuaaccacaccagacccuuggagaugagaugcugaagucagaucuguggaagugguccuuccuggagucaucucugaguugauuuuuacccaggguuuaagcaguuuccgagguguucuaggcauucauuugguaauggcuuguaaagacgagaucaauuuucaucuacuucucuucugcauuagcaaguaccuaugaaaagguuucaacuuaauuugccucggcaagcaaccugguauggguuugcuggggacaccggaucugauaauuagauuggaaauuuauagccccuuggucaaguuaggcuacuagaagaacauaagcagauacuucaacuccaagauaucgugaugguguguaauguuguaggucucaagggaagugucccacuggugauuuugugaaaagcacaugaaugucaccggugcagaacagcuggguggcaugaaugggaauuacuuuugcucuagagaaaaaguuccugcaaacuuugauccagcuucucaauuacauuaaauaucauuuuuuuucauagugcacauaauuuuuacuaguuacauaucuuuuucauuuuaauuuuuucacuuuauuucauuucucacuguccuggaaggagcucuguagaacaggcuggccuucaacucagggauccaccuaucucggccuccggaguacugggauuaaagguuugagccaccacaucuggcuuucaguuacucauuauaaccgguguaguuggcaccagccgaacugagucacugcugggauuuggugaucuggagugagaccuucgagaaauucacuccauuuuagugcuuuuggccucucaggcauccugacaugacgacuacuuugcaugaacaucacagguucgauaccuuuggaggucauuauuagggaacuucaaguuuggcuaucucaaacagaaggaagagaagguagugagagguguccugaaccuuuggcccuuccaaggaaagcagggugauucuuucaaagcagcuuuucugagagcagucaaaagacuaucaagauugucagacccuuuucuguuugcuaaagcuguacuguacugggguuuuuaaaacaaaacaaaacauuucuuuagugcgugugugcgcaugcgugaaggucagaggccaaccuggagucaguucuccucuuucaccaaguggggucuggguaucaaaugcgcauccuuacguaggaugggcccucuuccccagugucaccucaucagccccagacauguacuguuuaaggaugguugaucauuuagcuucuagcacucgcuuuucgggaggaacaguuggaacucugauguguuuuaguaguaguuccagaaagcaggccuuuggaaucuuugauuagucagcguuccuuucauuucucauugcgaacacucuggaagcgcucagccucuaggacaucccauuuggugcugcugguguuucuacaacuugaugacaacuuuucaaagguggcuggcaggcauugaaaaaaaaugucaacuaguuuagagcugauguagcccuuugaagggacaugcuuagagucuugcgugagguucacgguucccuuuuauuguugauaaaaauaauaaguggguguguucccaaaacugcuuaguguaacucauucuuucuauuuauuuauuuauuuauuuauuuaauugagccuuucuuucccuuuggccuuaagaguugcgggaacagauggaauugaccaaauaaguuggauguagaugccauugcagaggagggcgacugugcuuaagacaagucauaguacgaaagggcuuuuucucucuuuccuccauuauccucaacugguuucaccgacacuuggagcacguuccucaccugggccugacucuuuggugaauguuuuccucuucugaagggaaaggcagaaaccguaagguccagccuccaaauguaaaauauuagcaccuuucuccccguaauugugugauggcccaaaaguguugcuaaaguagcccacagaugggaaaucaaaguaauaguccugugccgagcuaugaaguugacacgugugucuucugccagcgcaguuccccgucucccugaaccugcuuucugcagagagccccugaaagcucaacucacaagaaauucgggugcuacuuggagggauauuugcgagucgaaugaguccagaguaggaaauguugaaagguacuguuacuugagauauggguuuaaaggauuuuacuaugcuuaauucgugacaagcugcuaagauuuggacggaucccucugaaagggggccaccuuugguucucuugauaccguuugggcgacacagaagugaucaaaggagacgccauaccccgaggugcuugugguuugcuccguauccuggaagaucuacugucacagaauaggauuccagaaaauucugugagugacuucgugucagugucuuaucaaagguuuggcuggguagggccuggcugcauuucucucagcuaaccugcagcgugucuuguuagugcaucguaguguguaagcugaagccagaggugcugaggcagcguguccaaggcuucccagcucguaaguggcagaacuugggcuguagcccaggcuuccuggcucccgguucucugucuucucacccuggccugcuacugcuuucugacacucagucaaaucaggucagauguaguggucauuggguucugcagucuucagacagaaacguggaacccccuccuugauugaacguaauaacuaauuguuuuuauguaaggucucguuggucagauuugagcugugguuauaucagguguggauauaucagaugucucuuucaucgcuuugcggauuucccaaggaaaggcuuuagcuugugcaugugguaguaggaccucaguccugacauuucaacuuagaacuacucgaagggacgauucgugaacauuuccaucugaccugcauagauucugcuuuucaguaucuccuugucucuucaaggcaaacuuggccugcaccgaaguguccccugugugucugcuuucugggauuauacguggaccuccugggaugaugccccagguggcugugugauccaacagcauagaaaggcuuacugggagaguuugcugcuggcuagggugcagcccagacguagagagcuuggugggcaagcucaugcuuaguagucccaagucaaaacuguuuguuuuuuuuuguuuuuuuuuauaguaauaaauaauuaauuuuaaguaaugcagguagggcuguggagauagcuuagcaagcacaaggacccgggucuggacucucagcacucaugugaaaaagccaacuaugguagugugcuuauaauuucagcacuggagagucagagacgggaggauucuuggagcuugcuggucacccagucuaguguaauugguucagagaguaacaguaagugacugaagaaggcuccugauguccacauugaccucugcccuccauaugcaucauacaagcuugaucucuguccacuguaugcacacgaacaccccugucauaauaccgacuccugggggaaauagagaagaugcaggauacagcaaggugguacuccacuucguuucuuaccccauuaggagagcugagccaugcucaaguuugauuuagcugccuaaccuuuauauuuguauuguuuuaucucugcauauccuaacacuuuguccagcuaugugaauuauuuagucagugguaaauaaaucuucauuguuuguccaagcugcccacgugucgaagcuagggcuaaaacauugggaaguguagcuccuggccugcugcugcguagcuccuggccugcugcugcuacucuguuuuuugaaaguuaaaguuagaaauaaaaaaaaaaaaauucugcggcuuguguguuugcaacaacucauuaaagguguaugcagaaauaaaaaaaagaaaaaaaaaaagaaaaaaaagaaaguuaaaguuagacccaaguguacauguaugcuuuucccuuuaacauuauuuaagaacauuuuacuguccuaccgaaaugaagugggacuuuuuuuuuuuuuuuuuuuugguuuuucgagacaggguuucacuguguagcccuggcuguccuggaaguuacuuuguagaccaggcuggccuugaacucagaaauccgccugccucugccucccaagugcugggauuaaaggcgucugccaccacugccuugcaugaaguggggcuuuuaaacacacuauuuuuuuuaaugcacagcuguaucauagauuaacuauaugugcacacacauauuuauuuauuuauuuauuuauuuauuuuggaggguaaauuucaccagagugccugguucuugcucagggucucuuucaaaaacaaccaaggauuuaugugcccuucccccacucuucaucccacuggaguuuuuaaggugaggcugagcacccaguuagggaaguagcugucauuaaaugacagcuuagauaaacauuguaggugguaauuggugcugcagggggucuuugaagcuucaggcucuguucccuuugaaguuuuguuuuggcuccggccaaaaaccucucuggucucuuuaacugugcuggcagccauauagacuucucuugacagacacagugcuugcuuucuggggaucucagggucuguugacccaaccuggggaucucggcccuuuuucuagcaucuucuaucagucaggccuuuacuucuguuuucccuuugauuguggacucugugauccaugggaggugaguuuggacagcuuuuuuauaucuggaccgccaaauaaggaauucuuacaccuaguguaucguucuaaguaccuuuaaaaccaggcacaaaacaguuaauguccaguccagccuuugaaacuuuugggcaacauaacuccuuuugauggcacugagagauuugaagcaauauacacuugaguuuuccuuuguaccuuuuugucuuguguggagccuuagccuuaggaagcagagccugagauucucugacucauuuuuuaaccuuucagcuucaguuuuuguaucuggaaauggagauuagguuaccagccucacagggucauuaagaggaucaaaagagguggaguguaugugaauguaccuuguaaaugauaauauacucucuaggguggccguguuauuaaaaccaucuuccugucauggucuagucaacuguggaguggcucaguuaguuucauaacucugccuuuuaacugugccccugaaagaguucugcucaucucuucccugaaacugaauucccagguaaccgugggcuuaagugcucugguguuuaaucauugcccaguggaauguagaaagauauguguggaguuuucaggcuggagguggcagcgauugagagcagccucuggaguaacccagcauuuccuugaucccauguucucuguguucccugcaucaagaaugcaggcaaucuuuuucccauuuaccaauaccagcugaggacuacuuguggagagccacccuguaugaaugaaacugagccacuuaggaguuuccuggagcugguucuguuggguucuuaagcuacagugacaagcacacuaucucucaggccauguuuaguuacaggauuuauucuaaggggacaugggacagaaaccaaacuaaaaguguucugcuaaguuccuagcauacagugugauagcuggacagggugcuuuguuucugcucugaccagcucuucuguuucucuaugccugccaaccaucaucagugagucggucuugagugcuguuguccaugucuggggguggggguggguggggagggagggaacugagucugguugacuuuucuagagauugauccuugcuuuuguggagaggagccucucacagugaggccaugaauugagugugguggagaccugaucaauggagggauugaccugccacauugccacucuuaacaggugaacacauccuuuuucaaaaaaacauccuugaagucauuuccuggauuaggggacugugguuagagaaguuagccguggcagguacuuugaagccguauccugcugacccuuuugccugugaagccagaugauggcaacagccacuaggacuucuggaccuuguacugugugcaggcaguuggguuguugucuccucuuaaucuuuuugagcccuuaguaggaacggagcauuucuucuucacguuguaaaugaagaaacagaggcagagcgucuuuacauugaccuacacgagagcaugcggacuaugaaaauggagguguucugauuucuaggccugugcugucaaucauacagagcacccagugcuuuugaauaguccccacggcuagcaaggccaccacacgcucagcacuuuucggguguuugauugauggguggagucucacuugggcuuuucacccagaauugauuucaucagguuuagagaguguucgaaccauuucacggaucugauuucccagcucuaguggcuuuggagcagugcauuuaaagacaagauguuaguuggguucuugcaaauagagcugggaagauggggcagcugacaagacaaauacaaggaaggaggacagggaguuaugacacguagcacucagaagcaaagaagccuggcagguuaugaagagcuggcccggugcuccagagugugcccuccacauugcacagccugagccucugagugccuguaguaccuuaccugucacgcaguagaguuugguaaauauuugauaagcuacacugugguuauuguugacccgaggcaucauuuguguguacucaucuuuaauaaaguggaaaaacacugcauuucucuaacuugcuuaaucauaugggagauauagaaauguuuggacgaucuuaagaguaagcuguccuuuugaaaacuugucagccaagcuaaccugagcaccuugcuuacacgcucaagguacaggcauggaauugagaugcagagaaaggaaggacccaggagggaauguggagaccucuggccuauuuccuauaguuguccccaucagguauauugagguacaugauacccacacucuuagauagaugagaccugaugaacggaaggauagaauggauuccacccuguauucuguguagauuccagcacccuaagagcucaugauaggaucauaccucuauccucuuggaauuugucccagggcuucuugacucuguauggcugcugcugccucaguuuaauccccucugcaagaaauagccacacccuuccuccuccucccuuuuccagcaacuuucuggaaagugcuacccugcucuuucucaugacuacagucacuuccuggacuucuagucuguauuuucuuagagcauuucaugguuacuguagcuucguguuuccauuuauuugacugacuguuucucuuuuuuucaguaaauugcauaaaugcugaaggaaggaguccuggauccaguaauguuucuauuuuuaauuugcuuuaguucauccuuuuuucuuuuuuaaagaggaucagccucuucuuuuuuucuuuuugaaauauuuauuuauucauucauuuauuuauuuagugucuguggguacacugucgcugucuucagacacaccagaagagggcaucagaugcccauuacagaugguugugagccaccaugugguugcugggaauugaacucaggaccucuggaagagcagucagugcucuuaagcccuaagccaucucuccagccugaacacuuuagcuuaucuuaaucaauguacauaaaacaguuuugugccuaccauacgcauacacuauauaucagcagugacaugcacccccccucugaugucaugcagauggaaucgcauguuagaagaugccagauuucuuugaagaaaagcaacaucauaggcauugcaguagucccaugauaugguuguguacugggaucucauugcagcuucugucagugggucuugggugaaguuccagguuacugaaaagauuagccaggguuuuggaagcccagugaaaguaagacuaagagaugguuucaugcuuuuaaaaucuggauggaagaaagcuuccuugggaacauggcugggaacuuucccacaguaguucugaggcuggccagggugaagguugaaaggacaaucuuaggucugucuaccuugcuugaagcaguucucuaggcugcuugcugcugugugcccacugcuagguggcucuugaguuucugucucacauaggaggacugguauuagagacauauaauacugugucuguuugucuuuauuuguggacuggagauacaaauucaaauccucaggcuugcauagcaagcaccuagcuauuuccucaaccccaguccuaucaacuaaaaucaguuauuuuuaucgacccgccaagaacguugucacucucgaccauagguucaaaauaccaggucuguuaaaccucacugucuuugauuuauaaaguaggcuuuccagucucuccaccaacuucauuauguuauuuugcucauuuaccugguuucccuuuuuguuuucaaaggagaaauuucuuucaguauuuuuugaaagguacuuuuuccucuaaaaaaacaaaucaaaccaaaaccuguugcauugguaugagaaguagugaaaccaaaaucaaacgaagcaagaaggcuugaugcacucuagccuaagguauugaugcggaauaaaugaagagccauuaguuucccuuuaucauuuaauuguaauagucucuagcuacuagggacucccacauuuuuuauuuuuuaauaaacuguuauaaaauauaaacagauaaaaauaucacauacccaaauuaacuagaccuagagucuacacaacuuauggacuuacauacaguuacaaauggcauucggacugggagccauagggcucuguguuaaauuuagugcuuucaguaucacacauacuagaaaguccaugacagaauuagaacuagaaagaaaagcagcacugggcagugguggugcaugccuuuaauccuagcauuugggaggcagaggcaggcggauuucaaaguucaaggccagccuggucuacagagugaguuccagaacagccagggcuacacagagaaaccugucucgaacucccccccccccaaaaaaaaaacaaaaagcccagcagcuguaucuccucugucauaacgcguguucccccauuaccucagccagccuuuaucuccuuguguucagccuuucuuguucucuuuccuucauacugugccaaagguuuacaugugcauucauuuuauuggcuagauucuacauaugagagagaacauguaguuuguuuguuucugagauuucuuccccaauuuauuuacaguuucuuccauacccuucucagguuugguuggauaaaaauuuuggccuuuuuuuuuacaucuaagcugggcuaacugguacuugaaguauugcugcggagcacacaggaacaucaugcuuaauaaagcuuucaggcuucuaaugaauucauguggagauuuuucacucaauuaaaaagcacaggguggggugaggaagguguacuguuauuccuccugccggccucuauuuccugcguuuagacucugcuguggcucaugaggacccggaccagacaugcuguaucgcucacagaucgcaggguaucuagccuggacccgaugcacuguagugcaauuacuugaauucuuaguaggucuuaaaaacugacucagauuuggugacggucauaugacacuugauuaaguaugaauuauguuuuauggucuucugaagguuguaaaggcuauuuuccaaaauuauggcuagcucuguguaucugaagaaaucugaaaaucuaaucagagagggaucugacacuaaaaugcuuuugcuuugcugagaggcaaagaauaauuuucguguguuugugagagcaccauuucguauaugcuacaggcuccuuuaaaauucacaucacauuaagaaagcuaccuuuaagcagcauguuuuaugaugacuacauuuuuaagagugguguaauguggcaaaccuuuaaauuuagagaguggucuuuauugacucaaggaguagaaauguguauuuuuuuuuuggauuuggauuguagaguuacagugcuuugcuuuuuuuuuuuuuuuuuuuuuuuaaaugagcuguaguuauguuaugauaaaauuuaacuaccucacuucaggguuuagcacagguaauagauuccaguaguauuuugaugaauuuauuuuauauguugcccugucuaaggagagauucaaguaaggguaauaugggguugggggggggaggauuagaugccaaaauaaagauagauuucaguaacgaugagugaaacagucauuccgugugaguucaagaagggaagagcugaucuuaggaacaaugugagggcaacgucucuggauuuucuucuuuccccuagugagcuggugacccgggcagucggucugcauauuguacuugucugucugcaguuugggaguaugcgcugggggugggaguuuggggcacauaccccuuguuccucucugaauacuuggggucagaccuacuccuuuggaaagaugaacaggaagauuacagaagcagccuggcagaguugcaucaugggggucaccucagcacucaggagguggaggcaggaggaucagaagucuagagucaacuugggcuaaaaagcugcuccugguaauccuugcucccuccacaaucauggcaugguguaggugagaaauucgaggaccaggaaaguuggguaacucccguagcauggagacaguggcagaacacucaucucagcuuggagcucagaggcccccuuagggguauaaaaaugguguagugauuuuucagauagcagaacacgaggcagcagcaggccacuggcuugcccuucagcccagggcguuccuuguuaaucacuaccuucgucuagccaagcuccuauuaaguauuuuucuguccacaaggagcaagugugauguuaauuucagugguagguuccagagcgccugcauggagggucuucuuacagccucacccccaauguucccccauccuuccuaacuuuagggaugcaauaggcuuugugguuucuccuugugucauuaaggcccagcgacuucugggguuuaguuugccaguuaagggcucacuguucuuuugggccauuaaucuuuugacucugaauuacaauuuuuaaaguuauuaucuccucagacucaugcaccuucacgugggaagcugauucauuuuucucuggauuccagacgcucccucacaguguguuaauaugcuugauaagugcuuagcaaagguuauuauauuugacuagaugugugugugugugugugugugugugugugugaaagaguguugcugggguuugaacuuugggccuccugaaugagugcuuuacuacugaguuauauucugccuguaguauuucuuucuuuuuuuuuuuuuuuuaagugcagaaguuccugaaccaaaaggagauagauaagaauauagccagcucugggcuuaaaaaugccuauuuaaaggaagauggagagaugggucaguggcucagagcacuugcuacuccuacauaggaccuugguucaagucccagcacuuaccuaguaguucauacaugcacacgugcuggcaaacauacaugcauauaaaauaacauacaucuaaaaacagaaagcgugaagagaaaacaagucuuggcugauguuccaagcagccugagucugguugugcacaaggcagcucaugacugcacacauucaggcaggcuggccucaacucacagagauccuccugucauuccuuuccaaaugcugggaggaaaggaauucuccaguguacagacauuuuuuuaaauugauagagauauuuaaaauauuuuuagucugugucuuuuugcaaagaggccagaccccucuggccuggcuccuggugcaaaaaaauguucuggagagaccucuuuuccuaccauuugaccuaaauagauuuuaucaccaagcucuuuggauacuuucuccucugcuuguuaagcugcucauagcuuccaagggccacaccaugagaacaggaaugguguuuauuuguuuucugucaguuucccugguacugagccuauauugaauccugaagaaauauuuguuggaugaguaucuuuggucaugguggccuguuagugaagaaagacauauuuuagagcugauaugccugacuauuaauauauuuuuuugaauaaacaauucaagggauauugacucguaaaaguaaauuuagaagaaauuauuuuugcuccccugagcuucaauauaacaggaguaaaauuagagauuuaucaaagugagaugaugaccugcaguuuuaaaauaacuucagccuuuguuauuuuaacgacagguagagccuacuuuuggcccacagaauacuggauauagaagguguauuguucugugcugucuaagcugggcaauuagcccuuggucaggugcaccugacauugccucaaagccagccucuuugaguagcacacugaggaacacuccucuuguccuguugucuuuguaugucagcuugauauaaguuaggucguuucagaaaagggaaguucaacugagauaaacauccccuugaaaaagaccuguguccaagacuauauggcauucucuugauucugggagaguccagaccuuagugggcaauaagucuuggggcagcuuguccugggauguguaagaaaccaaacugaaaaagccaggagggacaaaccaguaagcaguuuuccucuguggccucugcuucaguuccugccucaagguuccugccuuaaugucuuucugugguggaccaugguguggagguguaacuaagccaaagcaacccuuuccuccccaaguugcuuuuggugguguuuaucacagcaauagaaaccuaacuaagacaaugguaaauccaugggggucugguggcgccguguguuccuguucauuucucugcugccuaucuuuguacuccuggguaagagugcuauauacucagugcuucagagaucuguagggacugggaagcucucagggacuccuccuugguagcaucaacagugcaugagggcucacagauagaauucugggcagucaucuccuagggcauggguuccacaagcuagucuuggguuccacugaauccuuagggcacuccaucauuuauacaugggcacuucuucccauuucugaaaggcacggguuuuguacauuuccucuuaggugugcuccagcaucaaggcugugcacagaagcccaucuuccugucagaugacuguacucccugguacuguuauuuuucuccgccuccucuuccuccucuuucucauucuccuauucuuuuuguaauucucccuuucuucuuucaagaacacacacacacacacacacacacacacaccccuaguuuaucccacauuuggucuccuacugcaguucaguuaagcucuucuagcaacuaagaauaguuccgcucagaguggagaguugauggcucacaccugaucucagcacuggagacugaagcaggaggaugacugugaguuuaaagccaucuugggcaaucgagugagauucuuuucucaaaggaaaaaaaaaauucagaaguuugauugauuuugaauugaauuuuugagagagagucauauaaagauuacagcauaacuuuggggaugcuguggggaaacagacggagaugacagcaccuacacagaagaaguuugggcuuacaggaaggaagucaugugauauguuucccaugagcacuuuggugcgucaguauauguucuuggccuagcacacugucaugagaaucaugugcauggucuuugggguaaagaucuugugauaguguaucaacuugcauucugcaucaacauauuuagcucucucguucucuuuugauagcugagaguuauuuuguugugaaaacagcacuuugauuauguuauaauugaguacaguugaugaauauuccuuacucgccucugauuuuuggagaccaauaaguacuuugaugguuucuguuugucuguuuuagcaaaaugaauucagggauguguaucuaugacuuaaaugcuacauuuucuguugcccauauuuauuaaauccuuuaaaggcugaaaagcuguaggaugugacuuuuuaaaauauaaaaacaggguaacauuucuuuucccauuuagccaaaaggccaaagucugauugucagacuguuagucuccuggagaaaaauaaagacaagcuuuccuugaggcaucgggacucuugugagacucggacuuguagagaguggcacuugggggaugaccccuucaacuccugugaguaaggguagaguuaggguugccagaccaggcccuggcuuucagguuacuuccugcagcgcccuuaaagugagcuuaguuucugucuugucacuagcaacuacacaucauaaugccacagaugaucucaaaucuaggaccugucaagagugguucguacugugacuggaucaaaagcaaacaacaacaacagcaacagcaaaagcagagagggaaaagguaagggaaggacccacauauuuuucuugugaggcucccuugcuguauguugaagcuuugcucucugauuagaacugaccguugaacagagaggauuuacaucuuuggggucaggaaggagcuucuagauuguagucucaguguucucuuuuucuggcucuccuuaggcacccccauccgauguguuuuuuuguuuuuguuuuuuuuuuuaaagcccuuaggcacccccauccgauguguuuuuuuguuuuuguuuuuuuuuuuaaagcccuuaggcacccccauccgauguguuuuuuuguuuuuguuuuuuuuuuuaaagcccuuaggcacccccauccgaugugguuuuuuuuuuuuuuuuuuuaaagcaugcuugauuuaaucagauggcagccacuguucaucagcaacccucugaggugagcagauaaagucagaacuacgcccaaauccuguauguauguauguaugcauguauguaccuacccaucuaucuaugacaguaucuaucuaucuaucuaucuaucuaucuaucuaucuaucuaucuacccaucuaucuaucuaucuaucuaucuaucuaucuaucuaucuaucuaucuacccaucuaucuaucuaucuaucuaucuaucuaucuaucuaucuaucuaucuacccaucuacccaucuaucuaucuaucuaucuaucuaucuaucuaucuaucuacccaucuaacuaucuaucuaucuaugacacaguuucuugccauguaguccugcuggguaugugaggcuggccuucaacuucucaugacucuccugucuuaccauuccaagugcugguaaugggcacacaugaucccauccaaugucuuucucucaacaacuuucccuaaauggcucauaaaggaccuauguaauuuuguaucagaugggcugugguucaguauaacacauugacuuuguauuuucuucucaccucuagacuuuauguucccaugaguguugguucuaguuuuccucaugcaagucaaugaaugaccuuguucagguaucccuugcugauuuccguuccugagaaauaagcuggggagugugcuccucccuuggcagcgcagagaagaaggcauucagcaguugcugguugauacauuuacuuucuaccugcuggcuuucaacaguauuaauuuuuauguacucauuguggauuguguuuaauuaaaagcaguucuauucacagaggcacuuguagguuuuuuuuuuuuucccugaaaugaauaaaacaaauaggcaucugguauuuguuuuguauaacacaauccccauaaaaugaagaguaauaaaacauaauuaucuguaaaggcuuguuuuauaagccugagaaugggcuuguuucuaucaggguuuucaauucuacucaugggauaaggacucucuuuguacauuaauacacaacuacaauagcaacgaaugccucacaauuacauucaugauccugccuuuauuaaacgaaugggguuucuuuugguuauaguguacauacuaaaagguugucauuacguucugucuguauaagcacauuccauuggaagaaaauucuauuuccuguucuauauucuguuuaacuggcagaguacuauuggugauuuaugccgcucaguacaagugaaaaaaaaaaaaaaaaaaagcagguuuaugcuuuguuguugagucuuuuaggucccagaccacuccgcagauuccuccgaguuggaaacugcacauuaagcauuuacauguguuguaucugguuucaugugcaaucauauaugcauucauguggaggccauaagacaaccucaggagcugcggggucuuuuacuggccuagagcuugcugaugguacuacucagcaggccagcaagccacagcuaccuucuccaucucugucucucgaacccuaggagagcauaugcaugcugugaugauggcuuuuauggguguucugggauggaauuuagguccacuugcaaucacuuuacugacugagccauuuaccuugucccuuacauaugcuuuuauaggguucauagaucuucugaccauuaguuaugaccuuugcuguauuuauaaucugaagccaagguuuuaucuuuagcaaaugaguaucaguugaaagaaauucauccagguuuuuuuuuguguguguggauuuuuuguuuuuuguuuuuuuguuuuuauuuuuuugcuuggcauugaauuuaauuucagggcuggguuccuuuguaaaaauggagcaguacuguuaucugggagaagguacagaacgugggaagucugagaauuauuaacucaaagguggauaugcugucaaauugacagcaaggacuguguccccagggacuucuauugccaggacuauuuuuguuguuucuuucugugagccuugaaguggugaauucauccucugagguugugugcccauugcugcaaggaaaaaaaaaaaaaaaaagaugggcggcagaaucaugcagcggucuauuucauggugacagcuuuaugcgguugugugauguugcagagccuugugugugauaucgacccucuuccuuugaaucaaaccacagagugugaguggagaaggguggcuucagaaauaaccaaucucugcaaaauugaaacccuacauaguucugccuacuacagauguaauuguguauaggaaggagaaguccaucugucuaauauucauggccuguuugaggaggaguuucuauguuuagaaugcacucuaacuuuguacacagaacucauggguaccaugcuuuuguuaugaacgcaagcugaaugaagagcauggaagcccgugguucucccccuucuccgcaucaucuuguggagaaugaacagcuuaaaauaagaccucgguuccuuauccaaggggaagcugcagguuccagcucccgagaagcagaggcucugcacgguuacuggaaauaccauuucugaacauacuuggcaacugaaaguacccaauuaaaaagcucuguggaaagaggaagucuguggaugugcaauuagcccuucagcuuuagagcgguuccuuuauguguggaaggccguaacacgaaaucacuggacgcaguugcuuggugccaggugguuagaacaggcuuuugcaugauggauuauuucuugcuccaaaaaugguucaccuaaagagguuguauuccugacucuaaaaaaaugguggugugaaaaaauucugaauguuuucuuuucuuuccccccacaaaauuuuagguaauugguaaccauaccuagcuauaaguggauguagugaacacacagagcuguaucuaagagucacuugaggcucgggcucuuuauuuaucuaguuguuguucuguucccuccuacuucuuauuuauuuuuuauuaaaagcggauugcuggguaccacugcuggcccuuacugccaugcucgcccuuacugaaaaaaugaagucuuguucuggaaagccaaaagagcuguauauucugagauuaucuuuaguguuuaugauagagaaagcagaaacauuaggggcuuaauagcuuuucuuauuuacaagucagauucaccuaagggauauuauuuuauguugugcguguguucgaaauguuccuuuaaaauagauuaucagagagaauaaacaggggcguagaauuuguugcucaugaaaauacagaauagaaaaagcuuuccuuuuggcaugcuuuccaacaaagcaguucuauaguauuccaguaaauaaacauacacacucacaugugcccuugcuuuccaguuguacaagagcucauuccauugaaguuuaguacaggaauuauuucccuccagagauuucuauaaaaauggcagucgucaaccauacugcucauguuguaaguucccacauaacaauacaccugaaagccacccccccaaacaaaacaaaacaaaacaauaagcaagcucuuuaaauaugguaagucuaaaggaaacauuuucuuuuuucuuuuuaaagguuuauugauuuuauguauaugaauauaccauagcugucuucagaugcacgagaagagggcgucacauccaauuacagaggguugugagccaccaugugguugcugggaauugaacucuggaccuuuggaagaacagucagugcacuuaaccacugagccaucucuccagcccucaaggaaacauuuucugauguggcuuuugagggcacucaaaauguugucccuuuauuuaugcuauggugggugucacuucaguaaucaguuggcaaacgacagucuccucauuacaugaaggucacugcuguuuuuuccucacucuuuaucccauucuucccaagggaaacaaaacucugacggaggcauuaacaaauagguuuguuuguuuauuugaggcgccugggauucagcccagugucucccacaugccuccucuugagcugucuccacagccccacaguugggguguuuuuaauaacuccaaccucccuaccuucagaccuuauaaaauugagauacaagcucuuuuuauuaauaugagcauaaaaguuguauucaguacuuucaaaauauuuucucccaacccuuuuccauuuugucacaagaucucugaaggaggagugcuugcuaaugaugcauugugcuuagccauggaagcauccaugcauucuuagcagcacgugcucccaccagcuccuuccagugaaccgucaugguggaauguuggguggccgcagugcuuugguccccagcacuuuaugucuguuggggggcgggggggacuguacuucccauguucucuuuccucuaguccuugcaaaagcuccacagggguaacacuguucugaucucuacuugcaagguaagcaaggugagaaguagacuugucccauucuuccccagagacaaagaaaagaugcagaguuagcaugugagcccugcuuccaguaggcucugaauccugagcacuuacccggugcuguccccuggcuguuuccaggagcugugcuaauaucuccaggaguguggggcucugggcagccauugcguucuguuuuagaggcuucgcccgugacccugauacucauugggcaacuuugagaguggcugcaguauauaacauguccagccagccucauuacuugcuuagcuguuuguuugacguuagcugaagaucuguucccucgaagacuuugagccuacauuccagggaaggagguuuaugcacguacagacauauacuaaugggaaacacuaugacaaagaauuacagcucuccagaucugggcuccacagugauucugcugagagaucucacacuggcucagaagguaauaucaucuggggucagagucacuuugcugagcccuguuuuuuuguuuguuuguuuuaaaguuuggaagaauuuugcaucuuuacauguaagcccuguaaguagcaggcagaagcagcuuauagggaucuugacuuuuucucuauuccguguguuugaagaggcauaguggguacuggggacugaaccuagugcuuugcacaugcuuggcucguaugcuaacagugagaucuagcccagcauuguugauuaucuuuuauguuaaugggauuauucagcuaagccuuaggcaugagagaagacuggacaggcauuaucauggugcugguuuuauuugcauugaggccugcugaccaaaagcuaauguuuugcuuccugaguuuuaaacauuuccuacuggcggcaucuucugugcccuaagugcuaaggauuccaaucugugagugacuuuguaggagccaauuaaucaaacuucagaggaggacccagacuucaugauacgacgggguuaguuguggaauucuuuauauucagacuggagcuggggccagguuggccuugacaaguggaacauuaaacacuuauggugacugguggaugauugcccacauaauaaaaggauacauucauaacagguaagugcugcaguggggacuggauggagaguaguaaguagcucaguguucucugacuguucuauaauuguggaaaguaccauucugugcauuuagucauucgugaauggaaugugcauuuuugacuuuuuaucuucuaggcacauucauuauuauuauuauuaccuuauuauuaaucugaauuucuggcuaauuaguuuguuuuaguuugagacagagucucacuguguaguucuggcuguccugggcagccucaaacucacagagagccucacuccucuccucuuggguaugaggauuaaagguauaccuaccacacccagcauuuaugucugucugucuuucccucccucccucccucccuccuuccuucuuccuuuuuugauguuuguuuguuugauuuuugagacagguuuucucuguguaguccaagcuguccuggacucucacauuauacaccaggcugguuucagagaucuuccugccucugccuccaguguugagauuaaagguaugagccaugcccauuuuuuuuauguuugaauuucaacgucaguguuuagauucuucaaguucagaguuuaccuaagagcacccucacaucuggagaaguaauuuuguccagauugcauauuuaaaauaaggggaaagucugccucucucugccccaugccuucuaguguugauugcuuuugccagucagcugccugggugaugcagaccucuggggucauaagaacacaccgugcucucccaguggcagagauugagagcgugguggcaccuguaaucacuagcucccgccuccucugucccuucagcgcagacuuaauucuugcaucuguguuuucaguuucccaagaacuuugaggaggauuaugaggaguuaggauagcaucugggacauccgaggagauuucaccagugacuggggagagaauguuuuaaaguuggauuuuuaaaaacuguggccagucagucuagcuaguaugguuuggguugcaucauuugaaaaauuggaacucuugaugcauuggugcauucauucuuagaauauugaugccuuacauauucauagauugaccauuccuauucggaugggagaggcugcgagccucugcuagaacguucuuguuucuuaaggacguagccgugacuucauaauguuuuuauuccugaggaguguugguucacacuggugauuggaaaagcacgggcacaucuuacuggaaaaauaaagucaaauuuuuccaaguagcagugucagaagguuugcagcugccaucugaagacauccuuuuauggugucugguuucaggcuauuuccaggugugucauccaggugugacaagcucugcuucucaggacaaagguaggcaucacguaugaauuguguugccuugcuguagggcgggcaaagcuuuagaagugagcacaucaggccugcauuaagacaucuacuauuuuuaaugcauuuugcuauuuuugguuggcacguucugucagggugagaaaagccacccuguugccugagugugaggucacauguggcugucacuucucuauaauggacucaaugauguuaugguuuuaaaauaacuggaaauuagcacuucucaugccaaugcuugugaccacagaacucuauuauuuuuauauuguuaaucauacucuucuuuugucuguuucccugucucccuucccucugaagugaaaugccauaaauuaauauauccaaauaauuccuggcuagcaucuuguaacuuuuuuuggcuugguuuuguucucagcuuugcaauguuacgggguagacagguaaugcagaggcugguugagagagaagcaaauagagcaauuauaauuccccagggauagagucagagauugugacuacguuauauuagugguaggagagccucugccuaaaauaugacccuacaauuaaaugggcuguuaaagcaugccagcaucaauucauuaagugacagcggcgauuucuuuuaagucccuuuccucuuucuccuucugggacuugguagggaugaaaaacagaugugcaaagucuaggaagacugcuaaggggaggcauggcuauucaggucggcuuccucaucuuugaggcugagucucugaugacaaagcucauggaagaauaggaacuccugaugcccguagauacccgggagcagaaaacacaguauuccagagacgaucaagccccuaucugcaggcaucauuugucucuuaaagcaucaccagucuaggucuagacacuuagagcagccuggauauuaagcagagguuuuuggggaaaaaaauuggauugggauuuucucauucaaauuuacacauauauacucaccuuaaguaaaaauugcaaaauucucucccuuuuuaaaacaaauguaauuaagaaaaaucagggcuaucucaguggguuaaagugcuccuuguguaagcucugcagacaaccugaguuugaugccucgguuccacggaaaaaugaagcuauuccucaaaguuguccuuugaccuacacucacacacacacacacacacacacacacacacacacacacacacuaaauaaauaaauaagugaaacauuuaaaaguuuaaagagaaaucaguuggcaucucaggguuugcgugagcuggcaagagaagcauuugacuuugguggucaagagugauuaacgucaucucccuuuauaucacauaacaaacugccuaagccacuguuucuccgucacuaugacaggauucuugucuucgucuuauuauaguugcugcaugacauacuaaauggaaaaacauuuagcauucugccugguguaaaugcccucuaauuaaaguauuuauuaugauuuuacuuugaggaacacccccacccccacccccaccaccacuguacaugccacagaaacauuaaugaguguaugcuacaguugaaggguggggaagcuggggccagagaugaugugucagaggaaggaucucccacuuuggguuuuaugaagccugguuuugagcuuuuuaaguagcuaaagauaauuguuaacuucucauccuccucuucuaccuuggaagugcugggaugcccccugccuucacucccuccccucccuccuuccugcuuuccucuaccccccuuuuuuuugauuaugucuugcuauuuagcucagucucuuaucacauucacggcccuccugcugcacugucuguccuucauacuagaauuagacaugugccaccaagcuggcuagaauccauuucugaaugauuucccacucauucaugggaggggauuucuuuccucauuugggucugcucugcauuugguaaagagaagucaacaucuccuuccucuuuguguucuauaugaauuauggcacgagacagggucugacaguguagucuuuuaugaccacauaccuggccuugaaccgcagagcucugacuacugccucaggacuccuaggauuaaaggcauaugccaccgugccuagcuuaaguuauauuugaaaacugaagaacacaguucccuauccucuaucauauaaguuccuuggguggcaaaaauccuuucaguuuugaaguuuuuuaacacuggcugaguuuuaaaagaucaacccuuggaagaaaaaugcaugaauuuugacuacgcugugcuuaaggccuucagaauaccauuaaaauuccaaggaacauaaaugggguuggggguggggagccagucuucuuuaaagacaaaugcuuggucuccaucagaucgucauuagugggacuugcaugugcuuugcugguagucaaacuagaguaugggaaaagcaaaggaaaggccagucaacagcauaauucaucuguuagcuucuaaccgugaucauuaaauccacagaaggguaacagagaugagagggcacagugccuaaagaugcaugacaucuguugcacuucaaggaagcuaagggagaccagauuucaagaugauacuacaaaauucucacugauaacgggcaaguggaauuuaugacccucugcaacucaggaagcacagaugauuggagcuguucuggguaucuguacaguguuugugugucugucugucuugaguucuguaucagauguaucuggccuuccuauuucuaguuuggaucauacauaguguuuuauauuuucauugucuggguaggucaucuaccacaagcauaauguccaccuaaauguuugccuuuguguccuucaaggcucaaguauagccugccuagauaccauccccucccaagagcccuucuuugccacaccacccaucuggucugaggcccauuucuuuagguucguaucuucuacuuuugcgucaucuccuaagcagugugguguggcauuauaauuguaccguuacugggacucacagccucacucuugucacccugugaacuccuugggacagggucuacuuuuguccuuucauccacugccuagcagggugccuggauguauugcugacugcugauugagaaaaaggaucgcauggaacccacuccagccagccuggcuuccuugaggaagugaagccuucuuuucuaagugaaaccauuuuuaucugauggccguuccuggucaucucuaccaaaguuaacuuuuauuucuauugaaaucucuacauguaggguggcuaggguuuuccuuuuuaauuuuuggaggggugugaaguacaagacagacuauaaugugggcuaagccuucuagaauguugagaaaguaauuagugggugaagggaggaggguguuggaagaaauggcugggauucuuuguauccaaaagaauguuucuccuuggugaugagguaggcauugucacccuuaugaauaagucccuaagcaaaggacaaaaacaccagcggcccugcauugucuggugggcucuggcuuuaggauugcaauaccuugucuaaguaaguuuagaaauggguuuccuggcuggguuuuggacaagccauaauguugaguggcagccuaaccuuugaacuuucugugucuuugacuucaaaaggaauuccgugcuuuagggggaaaaaguccaaguaauuaauacugcugaggcgcagagggagagcagcugaaauguguacucacgaggaagcugaagccuccucgaacguuccucccuuauuuauaugauaauuuuaccuuaagaugaggaggccaaggcauccugagagguuuuguuuuugucuucuguuuuuaauacuuuacaauuacccuuucagaugggaaaaaaaagccucaauuuuuuuuuauuccccugacucgcuaaucuauauaauuuguuuaauuuuacuccugagggaguauggcuuaugaggggguguuuuagcaacauuuuaaggacaucugaaaauguucauaacaaaacuauccaccaguaaacaugucuuuuaaccuaacuuuuaauggaacuucaaauuuuaccuugugcuucugcaggaaaucuuggugauuguagguuccccauccggagcuaggagaacuuggcuguccuuugucuccucagacuuguuguuuugaaaguugaaggugguuuggguucaauugugugucaguugucauugauuuuccuucucuuuacuauuuuaaaacuaaacaaggccuuucguuuguuguucagcauuccccauguuuugaaccuggcauuauaggauuaauaugaacuugauauuauaugaugaugcuuccaacacaguauuuucauauauaugauggauauugggauccagaggggauagauauuuguuuguccuaaccuuuuuuuuuaauuuucccuucauuucuauacaguuaauguccauauuuauaauguaaaacaucuucuuccauaaugacuuuuugggcugacaauucauuuuaccccaagauguuauugacauagaaggauuaugaauauaaguaaagcaacgagaaaccaagucagaugccucuuuguuguuuaacauaggaccagugaguuggaaaaguugggaaagaagccuauauauucaaacugauucaguggauauagguuuuuguguaauacauagaucugacuaaaucauaguucaugguugaggaaugaaaugauaaaugugaucagcauuaaaauaguuugcaaauacuuggugauaccacauagaaugaacaccuaacuuaugacauugucucuguuuuaagaaauuacaucugagcugggcagugguggcucacaccuuuaaucccagcacuugggaggcagaggcagguggauuucugaguucaaggccagccuggucuacagagugaguucuaggacagccagggcuacacagagaaauccugucucgaaaaaccaaaccaaaaaaaaaaaaaagaaagaaagaaagaaaaagaaaaagaaaaagaaaggaagaaauuccagcugaaaucaacgcggguaugauuugcaccgagucugauaguugaugagaaagugcuuuugucaauaaagacauuuuuaccccucccuuuggaaagauggagcuagcuagaaguacuagguaggaaguugacuccuuaaauuuuaaaacaugaagcugugcauuuaaugccuuuaauucaagcacuugggaggcaaaggcaggaggaucucugugacuuagaggcuagccuaguuuacauggugaauuccaggacagccagggcuauguagaaagacugucucaaauuuuauguguguguguguguguguguguguguguguguguugcauuacauuuaucuaauacauuuguuaucacuugcuugauauucauuaccagagccacccuguuaauaaauccggccugauugcucuucagaacagguagccccuuggcuugguccugugaagcugcuucuuguuacugaugucgcuggugcuucucaguccuggucucagguuuagaugaaaacuacagcagggucacucagcuuuaaaagagccccccggguauggucuggcacaccagugagggcuccuugcuuuugcugugaaguuuauggagagcugucugugcugcaguuacugggggaugcaggcuuuuuuuuuuucuccuuugguucaaauauguauguauguauguuccucuggggugagaauuaggcauggcagucacagcgggcuucuccacuauggcugccuccccaacccccccccccccccccagggcuccuggcauuccuugaauacuaccuugaagagauaguuuagugcuuccuaggaacucuggucucuguaggaguuguuuguuuauauauagucuaaaaugccuccccucccccaaagaaaaauguaccuauuuauuuaacuacaacaguuuguacuuuucuguauguuguuucuuuaauugaaaauccuaucuggagacagaucucuuuuuuuuuuuaaaagaggaaauuggaacauuguuuuccaaauacuuaaaaaaaaaacccuaaaaaguuugagaccuuauuauuauugcucugugcuuauuuuacauuaauaauucuugauuuuucuguuuauaugacaucaagcaaaaauugcuucuuaauuucaauuuggguacacagucaguucuauauuccaaauaugagguaaguuggguguggcuuaacaccaaaacugcagcacacaggagagaccuaggaagauguucaaguaguguguucaaggcuggccuugguuacauaguaaggcccuaucucagaaaacccaaccaacuaccgcccccccgcccccccccgcgcccugcuaccccaaaucaaauuaaaucaaaaauaaaugaaaugaaaugaaaucaaaacagcauaagucucugaagcaaaagagaaagacaugucuugauaguucuaucagacauucauucagcaaguaucuuuguacugauaggucacugugugugagcuccuugucugagccagguuugugagugaguaauggcagauuuagcgagaggcacaggugaagagcaacugaagacuuauucacguucauguuugaaaacguugaucccaaaugggcugugcuuggagcauagaguaccuggcaggcauacucgaggccccggauuuuuuccugaccucggcacccauaaaacacauggccuggaagauggugcaguggggaaaaaucacuuuucauguaagccuggugauuggccuucgauucccuugacucaugguagaaggagagagagcuaacgauugcaaguuguccuccaucaaguugcccaccaugacgugugacacacacacacacagcaccaccaccaccacuaaacuccccccaccccaauccauuagguaaauagggagguauuuagguaaaggagguaagguauuuagguaaggagggagaugcacuugaaccaaagcagccagugauaccuguaccccagaauggaaaccaagcuugguugcaguggaugaugucacacaucccacuagauaacuaagcuugauugauugcaauggaugauggucacauaucacacuagaucguauucuauuccuucugcaggaugaauccaauggagacuguaagauuuagcuccugaaacacugacgaugaaacuuugcauuuuuuaauaauuuguuuauuuacugcauguguguaguauaugcacaguaugugggcaccagggcuuguucccaugccaccucugcaugugcacgaggaggccagagguccacacugaguguccuccucugucauccuucuuaguguuuggagacaaggucuuuacugaaccugaaacccuccacuuaggcaagaaccagcuuucugugaguccugaaauuauguacuuccgcuugcuagucuccccauccugccgcccccccccccccaucggacccgucaccaccgccugcuuuuccgcgggugcuggagaguugguccucaugccuguacaacaagcgcucuacccugcaggccccguguuuacuucuaaaguagcccaguuuggguuuuguggccuuugaggucgcggagcucuguguuaagggcuucugacuuuccuucaaggaccuuuugggauugugucauguuuauuucaggguuaugugugucugcccugagccaugcuagcggggaacggauaaaucuaagccgcagucugaagcauaaccguguguucuuguucucuccuccccauaaacgauguaaaacuacauuaauaaaacccaaaaccaccaagaaagguagaacauuugccgccugcugugcaaguaucaacucggcuuucaaaagcuuacuuguucccuauaaguaaggagcaaucugaguucuuaguaacacgguuuaguguacggggcuacauggccuguccuuccuguugcuucuuuaggacgguccaccagccuuucggaaggcuggcgugugaguagcggauauugcacacauucugaagguaggaggccuggaaugaguuagggcuagcuuccuuuauuuauccuuccuucacugggcuuagccuggucucugcagccccccagccugcaugcugaagauucccuugcgcaucacugggaaaucugucguugauuagauuauuggaucuucauuuucuucaucaggaugguuucaagacuuaaaccaaguacagcaagauucaaaacggcaaccuccgccacacagacccaggacccuccaguugagggaaugugcuuucgagagacgaaaugccccucaaggaguguaggguaauugaaaacccacccuuugagcugugguuuauuguggaagggaggaaugaauggcaccagcguccacaccuacuaaauacuuauuagaaccccggcagccagccuucuugagcucgagguccucuggagcuacaguuucauccauuuccaguuggcccugugcugugacccucggccauuuuuuuuuccuuccauuuaacacaguuauaaagggauuuaugugcuuucuuuccauuagaacuuagcaaggcugcugucaugaauauuuaauggccaggacaguuuguuuucuuuugcuuucuuucccagccucgcagccgugggucccccucccccuuccuuuuggagcaauguaaauaucuuggccccucacccucuggagggaucccugaacaacgcugggcuuacugaguuccgaaggagucuggagggaaucucgccugcccccuacccccaccccugcucaugcccccuccucccgcucucccaggacuccccagcagcuggacggugggugggugggugcagugcacgcuuugagguccgcugcgaggucuggcaccgggcucagccucucucggucgcugagugcuccucccaguugugcucugccuccaacuccucagccgcucaauuccuuugaacuucacagcagcacaaaggccuccccgagacuuagcuggggcucccucggaugcauuccugacacuucaugggucgcugccuccuuucucuuuguaacagggaagagggcgaaugucugcgacagaaaaugacuuuugaagacgcucaaagauuuaccgugucuggagcaaccccugaacuuuugugauuaucguagagagacgcacuuucgcuauugguagauuacgccccaaccuucuucccccgagucccucauccuagcuuuuauuuaaggaauuucucccucucaugcugagaccuucucucagugcccaacccccauucugaauuucuuuuuauuccugugugcuuugucuacccuugugugggaaaaggugaggcugggagagggggcucaaggaggagagcucaaggguuagcggagaagaaaggguccagcuuagaaccuugucugcugccaaagaaucauacaugccugggcuugcccaccucagaagucuuucaaagauuaaacauggaaagacucauguuugauaccgcucuuggauauaguaauugcuuaauaaacguuagccauacauuauacaguuuuuaagccauuuuuuucugaaauucuucagucugauccaauuuuauuuauuucgcuugugcauuacuuaugaccgcacauguucccgugcacaagugcaugugcuaacguggaagcccuuggucaaaacugggccucugaaauugcuguugacuguacugcuugagagucaacaacuccaguugaaccuggagucaacggauucugcccaguugguuguugauauucugcucuuuucuccucucuagcucugggauuacaggagguuuuaauaaguaggugcugggccuacaaauugagguggucaugcuuggacagccggcacgaugcuaugcuuuguuuuguugaaccaaguccucuuucuccuuggugcaguuuucacugacagccgucccuccugcucucucuucccgacucagaaggguggacuaggccuaacccgucuccugucuugucauuguagcuucuaagcuagcgcuucacuucacugucuucuuggugaaacggaaauguuuuaaauuggguagcagaagcagacauguguggaaguccuguuuguuuguuuuggaaaggccaaguauauguguauguauguguuuuuacagagaaacguuacaaacauuuugcaaguugagaaacaaauucuguaggcaccuccuguguuauucugaccauagguucuuguagggcuuguguuuaccuucauauaaggguacaguggaaaaacccuacugggugagguaagccacuagccuuagguacaggaagggccauugaaagcacagaaugggagcacaggugagaucuugucagggaggcgucguucagggugaacacugaggaaagcauuucugguuacguuucccugaauuccucugugugugugugugugugugugugugugugugugugugagcacacgugcauaaggacguuguaaguuagcuuccgauuuuguuccuaagaaaccauuuaccuuggucauuguuuuuuaguuuuucaagacgggaguuuuucuguguagcccuucucuuggaacucugaagaccaacugguuuggccucacacuccgaaaucugccugucucugccuccugagagccuccgccacuagguuccuuuugcuuuuugaggcaguaugacuagauccuagugagccccagggaucuccugucucugccucuccaguacaagguucuaagugcggggcgccauaccuggcuugacauggguguggauguucuaugcuguggauggagcaggcugaguuaacccucuagcucuuuguaagugcucccuuaucuuugaugcucuccuaccucauuuaagucucccuaagagaccuaaaauucaauuagcuagcugauguguauguaaacuuacgucacaguccauggcauacuuaaaucaacuagaaucucuucauuaauuucuacaaggauuauuguaugaauugguucuuuggccuauuggguggaauauuuacauauguauauuuaaaaauccugaauagaguuucucccaaguucuuagcuggaugggauaaccauuggauucugcccugaaacauaguaccacgcacauaagacuucagccuaauuugguaagcuuguccuuagccuuucugguuugucgacaagaguaguaggucagagaccuccgauucacccuuuuagaccuaccugccuugagcuaggguugauucauuagcaggucucuuugaguaagaguuuccagcagcacugucuuccugucucucucuuauaccaggaagcugucuggaaagauuuugcucagugccucccgcacacccugccacaccugcaaacagauguugaacugauuaggcugggugcacagaaaaaaaaaaaauguucagcuaccuccaucuauagaacaaaccggucuccauauugcuuuugaucucuuccuguuauguuuucuucaaguaacguuugcacugcaaauguuaauugugguaagccaacaaguccugagaguuuagucacccacggcaggggucuaggaagggagaguaagagaaagggccucuuuuuaugggaggugagagucuuguugggucagauaauuagguaacaguguaaauauauaauuaaacagggugguugugaaauggaaauggagaugcuacuguaacaauuccagugucuuuagggggcuggagaguuguuuccugugauucuuugaucugcuccagaacaaucccuucuauuugugaucacguguuguccuuucugcuuauauuuuaugaugaccaagucucugccuggucucuggugauggucucagaacccaacuauuacaaaaucccugccuguaccuuucaggggcuagucuuuucuauucuuugcagauaaggaauccaagccagagaggcagguuuguuuuuguuuuuauuuuuuugcuccaaaugagcucugauuaauuucuuccucuuuaugauuuuuggcccuuuggugagugugacaaaguguagacauguuguauucugggggaaaauaaaaagacuuggaauuucaucuggauggcuuuuguuuguuuguuuuuuuguggguuuuguucuguguuccacccccccucccccuuuauagauuguuaggcaaguugcuuaacccuucagaguuucuaggcagaaaaaaaguagauuauaaagacugagauacuuucugugcaauagauagauggucaguaagugggagcucuuguguauugaaaauacuuaggauguugcuacguuuuuuccaccaaacaagaccuguuuuaacuauacagaaagggcucguuucugccuugguaggcuuuuaaaauuauuguaugauguauggauguguguuauaagucuuucauggaauauuucuaccauggauagaugggaggaagcauaaggagacagaucucaagugaaagguauggcuuuucaguuguuaauugaagcguccccuuuauagccuuaccuuccacugguaagcacccaauuuguugucuucggaagaaaauaaacaaaacuaucauuuccugugguggagauauuaacaguaaaaacucaccuccucauuauccugccuuauauucuagacaacaugaaaggacuuugucauauagugucaauaagcaaagaacuauguaauuuuaccacauauuaauacagugucgccugaaaggugcugucauuaguuggcagucuauaaaaaugguccccuagaccaagcacuggcaaaauuauguguucuccaauuaguuauucauucuaaaggaugcaagcacugacagacagugggaauugcuuaccuaccaauuuacaaaacuugagugauggaaucauuugcagacuaaagugguuuuuagugacacuauuuuuauuuauuuaaauucucacuuuuugcagcuuaauuuucuuuacuacaccuacuugcacaauugaaaugagaggcuguuuuguucauaaaagcuacuuuuauacaaauaaauuaauauuuacucugaaagggucaggaucccaaauugagguuuuauaacaggcccuggagcacccauauccugacuguuuuauacgguuuuuuauuuuguauuagguuaugcauuuuguggaaagucucuugccccuuacugaagcauggaccccuugaauuccuuuuugaguggcacuggagagaaccacuccacagguucccuugauaguagguaaucucaauuuagugcaugcauuccaagggaaugccccagaauaaccuuaaucuccucccccccccaacuucuuacuuguguuuagauuauucauauuuagucuaguauggcauuuuguacaguauaacagauaauauuuccuaacuuucuguugugguguuaggguaauuaaauucacuuuagcuguuaccauuuauuacugauguuuguugauccagaaauccaaaacuggugugaauucuuucucugugaaucaguuucaguuucucauagugauuucucuaaauucuugguuaaggcccaauuaauuucaccuucugauguaucuaaaaguagucuugcuuuaauuuaugcuagcauguuccuuuuugcaaacuuuauuuuuauuuuauuucauuugaauguauauuuugcuuuacguguguguuuguguagacacaagcaggcagugucugaggaaaccaggagacagugucugcugcccuagaacuggaugugcaaguugguccuuuggugauagagaagcuaauguucuuaauugcugagcuguaucuucagcccuuaaaauacucuuagaccaaagauuaguuuuauuuugaggauauugaaacauaauuguacuggaaagaauuucucuuauuuucauagauaccuuuaaaaauagacauauccuucucucuguuugugugugugucuauccuguacacacacacauguacacacacacauguguacacacacauguguauacacacacgcgcgcgcgcgcacacacacacacacacacacacacacagagaccacugaaguucagccacaaaucuaagguuucuucuguaagcacuuuaaacuuggacauaauuaguuacaucugccauugacuucccuuuacacaugaacacacuuuugccuagaagccucauuuucauggguaaaggggguuugugaaucuacccugcaggaguauuguuguaaauuuucuguauuuguucugggguuauagcuacucuuuacaaaaugauauugguauuagugcauuguucuuagaggcaggcuuucggccugucucuuccugggaucacccuguuguauuuggcaugcuguagaacaguaaguagagaacggauccuuaaacgaugcuucagcuagcucugguguggacuucacucuggaggugaaauuggcugcucagacuuuuuuuuuuuuucuuucuugguguccauuugguuccugcagcccucuauccaaauaguguuguuuaugucuccuucucugcccaaugggaaagcauugagaggagaggguguuaguucuguaagacuguucuccagcaggaauucugggaucacucauguaaagaagaagaagaaaggaaaacccaaaucacccguacuuagugguuaacauguaagacugccagguucuaguagaagaaaauucgaacggaaaaagagagguguauguccuucuauugugugauacugaucacaguaaguuguggcugaguacaaagagauggcuugcuuuaguacacagccuuucccaggcucuuguuaguucacaucaguuguuccuucuggauagucucucuauucuggcuaugucuaucugaaucugaaccugcucugagccaggcacugggcuagagggagcauaggcacuucagagaagaggacuucugcaacccauucuuuacucagagcugcuucuaaaaggcaagaguggaagcuugcuaggcuagcuuaugcuuggagcaagcaaauaacagacacagaaaagugucauagauugcugaaaauagccuuccaggaaacucaggagaaacauuuucccacugacuagcaaaauaaguauuuccccacuaaagauuguuuuuaaauuguuuugaguuugcuauuuuucaagcacaugaacuugagauuacgugugugugugugugugugugugugugugugugugauauucugauucacaauaagaggcagaguuuaugugcauucagauguuuugaaaguuuacaaauucuggguuccaugcucucuggcuauugcuucaugagccuguuuaacauguggcuucagaaguagacgugacuucuuuuccuugauguagaugggcauugaccuuuuuaaguuuguuucaagguuccacaaaaagucuggccacacaguuugaagacuauugggaacgugaacuuuaagauacucuugaauucaacgcagaaagagauggugcccaucuuggggaguuagaaaaagaugggugcuauuauugucauugcaaaugcuucccagcccugccaccacgguuaagucuuggcauggcaaauugacccuuaaaucuacccuugcaaaacuugaagcauaagucuugugaauaacagggcaguauaaacguugucaaaguaaagcagcagaaguagccagugcuaugauaaugucuuucugauuuaaugagcacgucugaaaacuaaccaacauuuaacucgcuuuauucuuacugagauaggaucucggcauaguugcuuggcaauuuuaguaauuggggaaguaugauugccauuauuucaauuacuauugaccugaccacuguuuuugguccggcccggauaucuuuguuucagugugcuuucuaugcucagggcuuucuuugugcuuucuaugaggcuugguaugcgcagucugaagcaaggcucuguccauuugccuuccugcccuuggagaguucgcuaugccuccaguagagcaguggcuuuuccugucaaaaccacuggccaucuagugaguaccacagagcuucuucuguccugcuucuuccugugugucucuugcuguagaaugaacaguuaaaguaagccagacaacugugcugugauaaauaagguauagucuggcaaaugacuauaccuauccccuacccccacuccaaccccugcccccgccccaucagguuggcuucgcccugguuccuaugaaggugguggcguccugagagggcaaugguggaaacugcagggcuugugaacgcuaggcuugugaguccugguggcgcauuucaaguaaagccucauggccaaaaggaaucacuggauuuauggggaaaauuacuguggccacacugcaaacaguuagucacguuauacuaaguacgcacuauacagauaacaaaaccaaauaugacagugaagcaucggccccacuucugcagcuccccacugucuaguuagcagguuugggauaaaugaaauguuguaaaaugucuucuugcuaaauuucauuuuccaaaauucuuuccauauacaaaaaugcuugaauucuuaaacaaacaaacaauccuguuuuuuuguguuuggguugaaaucugagugacaaauucucccgcuacaggaauucuaaauguguagauucaaaugcagaguuuuuuuuuuuuuuuuuuuugcuugaaugcuuuaguaggguauugcaauuuuuacagccugucccagauucacagauucauuuggugaaaacuccacaugaaaaccuuguaugauguuuaccauuucaaaccagaagagaagggagagauuugauaacacuucucuuuggauagaacuuggugagaugaugguuuuuuuuucauguguguugcuacaacuuaucuuuauuuuaaauuugauuugucccucugcccacuuuggagccucuggaaugauagcuguugccuccagaggacugagaacuguuuucaaaggcuccaucuggaggcauauuuaaaagcacgucuuacagcauguggcugcacagagcuccagucuuaaugaaugcacggugugagcuauauaauacuaauaaugcaaacuucaacaaauuaguccugugaguacacacaugcaggcaaggcuuuuuucaauuuggcuggucccauaggcaaguccaguuguaaacugaaggucagaauuuguaacuacugguaccuugguuuuuuuguuuguuuugauuuauuuuuguuuugguuuguuuuuaaauaaaaagucuucuagugugacaauucaacaacacagaauuccuacagagauguaaagccguucacgguagguaaggaccccaaccuacagaacaucugcgugugucuggcccaucaggugaugagguuggagcucguggcccucgccaugguucagucuguccuugcacgauuucaguagcccugcagugaagcuuaggaaaaugcuuccuguacuccugugggagauagaagaguguuaaggagagguuucuagugaacauuucaacccuguuacaguguacaccuuucauagagaaacuuccagaagaacugccauggaaugugccaguuugugauaauucugaaugaugugugauugccaugauuagcacuauaguuccuaagcagauacacacgucuuuguuuuuaaaaggaaccugauuuuuuuuuuuaauuuaaaaaaauuuuugaaacugccacugccaguucuuuaaacucaguugcuuuuauuuuaguucguucuuucccagccuggacccccaagaucuucaaccugauauguauuugccucugcuggcaaguuuuuaaaaguaguucagauuaagaaauaaaaauaaaggcagacuaugguggugcaugccuuuaaucccagcacuugagaggcaggggcagguggaucucugugaguucaaggccagccuggucuacaaagagagucccagaacaaucagggcuacacagagaaacccagucucgaaaaaccgaugaaugaaugaaugaaugaaugaauaaaugaaugaauugcacagaaacggucaccugccaaaggcuugaguuauuuucccuuggagcagagaagaaauacucuguauuucugcuuuuuggauauguacucuuaaacuuugugaacgcaggcaucggcacuaugugaagucucagauuucauaguguccuaguccugguuaggcgauguuugguaggaaggacagggugaguuacagagcacauuaggcagaaucaauuguguguucuucuuuuggcaagcaggccaguguguuuccuacagccuaaaugaaggacuauuuuuuuccucacucaaggauccaauuaagccuguuuccuguuuaaggcucggugugccuaccugcccuuuucguguuugaggcacagcucuuuugaaauccacccuaaucauucuucccggucaccuuuacuacugccagcauugcucagcagcgcugucucauaucugggcauguuaaccugcuauuucuucugcuuggaaucccaugacaccuccuucccuuuuucccuagcuggugaccugguguucauuuacauagacucacaucaaacacucccaccuuguaaaguccugggcuaauaagguggguaaggcuggcuccuccccaccuuccuggucccauucauggucuuucuguucagcaucaagcaccagcauugggaaguacauguugucuaccugucucccucuguaggugacagcguauucucccuuggaugucuuucuaggcaaaccagaguguuaucuauagugccguuuaauuaucuauugagcaagccaguguccacacaguugagcagguaacagacaaccuuuucaucucacgacauuugugucccccugggaaagauuguugagcaguacagacuauuaucuaggaaaugagauaaagucacccaacagguguauuuccaguuucuagaaacaaguaaaugcuaccuacuacuuagugucuggugacucaguuccuuucuuccuuccuuccuuccuuccuuccuuccuuccuuccuuccuuccuuugcucucugauuuuuuuuuuuuuuaaacuuagcacacuuaauuugauuuauguguauggcuguuuuaccugcauguaugucuguguaccagcugcauuccuggugucuguggaggccagaagcgggaacuggaguuuacagauguuugugagcuaccaggugugugcugggaauuaccuacugagccaucucucccguguguuuguguuuuuaagcuuuaacaugacaaaccauuuucccucuggaaguuuuaaguggaauuuuuuuuacuaucuaaggaauaacacuuugaauugcuuuuaaaguuaugucuuuuuauuuuacauguaugaauuugccuguacauucauguaccaagcauaccacuugugugcacugcccuuugaggccaguagagagcuucuaguauccuggaauuggaguaacagacaguuguaauccaccauguccgugcugggucuugaacucaggucuucuacaagaccgccaaguauucuuagagcuaucucucuucucuauacuuucugaguuuugaaucucagaaaucccauucaaaauauuuucucauucguccuacucaguuuuuaaaugugcaaaguaaaagugauauccuuucuauuaauuuaucuuauguggggauggaauggguguguuauaugauguauaaauccuuuguaaagacaaacagcucuaauuauugugcauuuaaaaucaucaaauguguuuuggcugaccaacuuaacaugaaaguguccugcuuagcaagccucauuauaaaugauuggcaggcagcuuaaucuugagguucaaguugugacugaaguacuuuucaaauuguaccaggaccaggacauucuuagccugacagagggguguccugaggcagccaugggguauuuauauauuguacguuagacauugaccuuuuuaaaauuugagcauuuggguaaauagcuuggguuguugaacuuuguaggauacaaaguguuuuuaugaguauauagagagacacugauucauaacugauaggcaauuuuauuagcccauuuucuaugggauguauuucuuuaacccaagaaaaauauccgucaccucccuguuggaaauccuucauuuucaggucuuucuuugauggaaucacuaucaaaggaaucucccuuccucuuuugguugaauaugcuuuuaauuuuggaaugggcuuuuuuaauuguuaagaaugagccaauuauaauaccucaaaccauggcggaauguguuuucuuugccaugcucagacuggcuagagccccuucacuaaauccuaccaacaaaacacauccaguguguuuuagaaugcguguugucaggucagagacccggagcaagguugagggagguaacucacucuccgagccacuuagcuacagggcacaaguugguggugcuucagugccuguucagggcuuucucguuucaaacucaggcaccuccugugcaaaucacauugauguuugagcagccauuuccgucucugcuuuuacuuucucaugauguaaagaaacaaaaugacacuaggcagaaacuuuggaauaauagaaagcagagcucucuuccucagacugcugucccuggugaagaguagcagacgugugccagaggcucugccacgugauucugaccagaagcagcugggcuaggugguguuucagcuuguuccuuggcguguugaugcagcccuuaauugcugaaaguacagaccucuuuuuaacagaaucuccuuuaagggaagggccgcgcugcagcaugacccggaaaauggaggcuuuuaaagcaacagggaauguaaauggccuuccccaacagaggccacucagauugguuccuccagcugaggaaacuuaaaugcucgaggaaggcgaaugucugucuuccaaaaccacggggaucaauguccuaagagggaaagcggguagcuucaggguuuuuuauuuuuauuuuuuaaauuuauuauuuuguggguuuggauauuuugcuuccuaguaugucugggcguuaugggccuguagugccccugagagccauaagaggggguuggauccccugggccuagaggguaacuccugguaguugugagccauggugugggugucagugaucuaaccuagguauucuggaagaacagggaaugcuaauuaauugcuaagacauuuucccugcccccgccccccauagcugcagcuuaaaucuucucaagguaggggcagguauugccagcucagaguggcagaggagauguucuccguaagggaaagggggggggugcggggagggagggggcuagaaugaguugucagaagcuggugguguggaauugaaugacagcccccccaacuucuaaguuagggccaacuggugcuuuuaaaaacaaccuugggcuagacucagucugcaggguuuuucuaggcuccauucuugauacccacgagugguauccuaccacagaaaaucuaagaaaauuuauguuaucuuuucaacaagaacauaaccuauaagaaaaaagagaaaaaagccauuuauuuauaaauacucaggaauuacuuguacaucuugcaaaguguuggaagcuuuguaaucuugugugugugugcguguguguauauguguguguguguugaguagccacuccuggugacucugaugcuuguggguaucugcagugguuccccaggucugcaugugcuagagucauaaaugcagggcuguagagcuguguucuuuauggaaccauauuuuagucccagcauucuuuuggauuagagugcaaguuuuuaaauccguggaacaguuaguaggcuacacaggcucuaugcauugagguuuucccucuguuuuaucauacuuuucaaccaggugccagucaacgaaacagaaacaugccgaguauuaugggauuaaaggauuuauuauagaaauuggcccuuccucaaauaugagagaugcuaggggaagcgaaggugcugcgggggagugagaggauuaaaggaaaguucacgugaagcccuggaguaggggugggcaggucagaaguggaggcugcugaguggaccacaggggauggguacacaaaaucucugaagucuguugugucuccucugugcaguucucagcauguggccuaagccaggcaguugcugaugggcugagccucugcccaucagcugggcccuuagacuggaaggugagaacagaagaaaggaagagcaggcuggcagcugcagucgccuuccgcaggcucaccugcaucuuguggggagguggggaggcgggcauagccuuacuuucccuuugcaaaucauaggagggcaaaguucaauaccgcguaaccuauggcuuagaagaaccaugcccuucaaacuaccccugagagcuguuggcucugucuccuggccucacuaaaaauaauuaacuguucuuaaacuuaggagugaaauaacagauuuuuuugacugcuggacaggccacauuaggcacuuuucugugaauuugcccuggacaggccacgggaggcucuuuucugugacucugcccuggacaggccacaggaggcucuuuucugugacucugcccuggacaggccacaggaggcauuuuucugugaauuugcccuggacaggccacaggaggcacuuuucuguuuaggaaccaccuaggcguuccuccuagcaucuuaucagcugaucauaugcacaucgagauuaacgauuuucaucugacuuucuuccuggaaaaauugggucuggaggauuguagaaauaaagaagcaaaacuggauagagaaacuuuggaguguggacugacaggagcuuaguucaacuuugccuugaguuaaaaauaaggaaauacacagauaaacacagacacacagucucucuuucucucagcacccccaucauauggauucauuuaucuaugguuauaucuagugaugcauuuaucugaguuuauauucacugcaauuauccaaucuguuucaaugggaauuuuaugaguauuuaacuuacgaguaauuaaaaaauauucuguaucagauaguugagaaaucuuuccaaagauggucuaguugccgaaauugccagucuuugucuuuccagcacauaagaaacucaaaaagcagccuuaacauggcuuugccucuuucccaucaguugguguaaaaauuggcuuuucucuguuugaggagaugcugggauaaauguaagcucccgguaccuaauuugccaccccauuaccugaccacaguguugccagagagguucaaucucugcaggaaagggaagcauauuuguaagucuguggcuggagcuggcaguguuugccaaagcagaagcugcucuucggugauacuucaacuuuuuauugaaauauuggcuacuucuccuccuugacugguagcuccgguggcugcugaacaagauaagguaaauugcuuucaaaccauagggcauuaauuuggaagcccgagagcaagcgcagagaggcagguuuuuccuccucauuuccuacagcugaaacugaacaguuuaucgcugacucccaaguugguggauccucguuaguaagcaaguguuccuugucguaaacacgaccaccggcuuuccuccuuaugcaguguguugucugugucugugucuguaucuguauguggacagagcagagagucgugugguaucgcuauaucccuaugaggguguauccuucugaagcuauuaaaugacaggcagagguagucguuugagugggugcagaucauuuaaagauuuuaagagaggagaugugaaguguuuuggugugaaugugugugcgccugugugaguagcaugaacuagacuggauaauuguaguacgcguacacucagauaaaauguuuuggugugaaucugaaauggccccauagguucggcuugugccugaguccuuagcuuggggaguggauuuggaggcuguagagccuuuagaaggaaggaccuggcuggcgggaggccauuaggaguaggccuuugaagguuguacaugcuucugguucuggaauguucuuucagacucgugcucuggccuaucaaaccauucuggagaaacugcuaccacacucucccgacaauggucauggcugccccuaguagacuuucauuaccaugaugcauggagucuauucugaaaccaugagccaggagaaagcuuuuaucuccuacauugcuuuugucauagcgacaagacaaacaaugaaaaugaccccuaagaugcuaguuauucacauccuugaugcuuugcugccccaggccaagcaucccccgugggaagacuauguugagacagaaucauugcuauguagcucugacuagccuuaaacuuacaauggauacaccgacucuggccucugaaccuugcugaucaucuuaccucaaccucuuaggugcugaucuugccuuagagaggcaccauuacuggcuuggaagauuaccuuuuuaaggacugcaggaaacuggucaugacccagguauaucuauauaaggaauggguacugagcauucaagaauccauagaucucauuucuuaguucaguggaugcuuauggagaaccuguuaggcacugagcauuaagcugggcacugaggauacagugguaagguaaauagcugcccuguuggagcuuaucauagacuagcuggggaagagacaauaagcaaacaaguauuucaguaaacauauacauuaacuauggcagaugcuuugaaggggagauggaccaugggaagacuggaauaagaaagugugcgugauauggcagguguucaggggagagauacucuggggaagggucauucugccugcucuucaagucuuugauaccauacccugaauucugcaugcugucuucagaaaggagagcaucucugaugguggcccugcccugacucugaucuugggaaacaaagucacaucaccauggccauuuauuaacaggaccuaguuggcuuucuuucugaggaacaugaugucuucccguguucuugaacuuugccugccaaaaccuagcaggcccugcauucccagccuaagguugggagcacacaaaguucuccgaaagcuccugugccuuaggagcacccuugacaaauggugcccugauucuauccccgucuaguuagagugcuugcugaagaggaaaagcuuccugccugccugagccacccucccagcacuuuuccugacuuccucacagacagccaccugaggcgagugacagagccaguuucuuccucauucagggugaugacuuuacucugaaagcuccaguuucaaacuugcccacccaugugaaaggccaagggacaaagcucagggggacugauaguuuugggagauagggccaaguaugcagggaauauuugcucuuccuggaaacuggauuucacaaguccauucauuuccuucucucugaaugacuagucaggugagugagucaugggcagcuccgguuagaaggcugcagcauagucuuacucugugcccuacgcuaccagaggagaaagcugcaucugaugcaguuuguaggcacgacucgucuaggaucuuuuauccaucuaucuaucuaucuaucuaucuaucuaucuaucucaaagaaacuaugguuuuaaaagcacuauguaagacuuuguuuuuguuuguuuucugcaguaucucaaaguggcaaagucucaguaaaaucaauguugggaaauugauaaaaauaacagguauuuguguuugaaggcaguugugaggcaccugaugugaggccugggaacuuggguucucuacagaagcaagaagcccguaugacugcugagcccgcucuccagcccccgcagaguuugguuucuuacuucuuuuucuuuauauuagaaaaaguguuuaaaguggaucauauguuuaugaucuggcaaacuuuucuugagaugaaagcgaauguaaaagagaauggucaaaugccugugaauguucacagcaguuuuauuaauaucugucaaagcuucaaacaaugcagauggccaucaacaaaugaauugauaaacuaugacaugucuauacaaugaauuucuauccagcaauaaauagugaacuuucauauauggaugucacaucauuuauacauauauauauauauauauauauauaauaguacaguugaaaguaaaaauauuucauugaguaaaagaacccagagaaggaaagaguaggucaguuauaugcugcaacuuguguacauuucuagaaggugugaguuaacugacaauaagagaaagccaaauguaauuucauuuuggucauugggaaaacacagacgaaggcaucuauuucaaggccagcguaaggguuagcaauaauaaacauuaacagcucgguuuaaauguggacaacugauagaaacguggagguagugauuauguugucagugaugucuggaggugacuuuuaacuguggaccugagacacccguucccuagagagucauugacucggaggccaucuaaacaccacgggcuacagugaacugggcuucucuagcaaaaauguccuuaaaauaaguuuugaaguauauuuaggugucaagcgaaagcacagaaaugaguccguacaaauuaguuaggucuugugggaagugggagaagggggccaggagagaaagccuacacagagggaaucguaauuccuuugauaguuuucagugugguauaaugaugggaaaaaggaaagggggaagggagaaagauaggaggacucaggccaugaaagccuucuguugacuauucacuuugcugauauuuuggucugcuuggcuugugcuuggggaucuacccuguauguuauagguuucuuaguucccacccucuaccugccagauaccaguaggaaccucaccucucaucccugugacaaaguuaucucuugcuugucaaaacauccucugggguguucaguaggggacuacaguugugcugagagguagcaccguugauguugaguuauuaauuucuguacuggaagcaggaagugagcaaagcccauuggcagugguagaacucacugcucucauuguguugguuuaguggaaauagcugguucagagcauucaccucagaggccacggaccaacagucugucugcgagcucccuguuuguaccacagggcaauaauaguacuuaccugaguugcugugaggaauaaauaaguugaagcaucgaguguuugcuuaaagaaaacagugguguuuucuuuuuuaucugagagacuuugcaggcagcuggaggggaagaaaagagacuuccgccugcaguucucucgaguugauuuuuaaaguggucaucacuugaaaaggucuguuaaaaaauuauucugcagugaugguauugaaggauaaauguaggaaaugguacuuugucccugagcugauucuucuucccugggcccacugaaagauccucgaguuguuacagaagagcaggcuccuugagugcagcugaaaaugauaucgagagcaugaaguggcuguuagugaugucaguggcagaguuuggagaaggaacucuugagaaugagguuguccccagggaaaagucuuucccugcauucaccaaagacuggaagccaucuuggaccauggagcugccuggccccuauuccagcaggacuuccagugacucaggaccuucuguagccagauugugaacauuuucuaaccuggcccggugcuggcuuuuuuuuuuuuuaaagauuuauugauuuauuauauguaaguucacuguaguugucuucagacaccccagaagaagacaucaaaucucauuacggaugguugugagccaccacgugguugcugagauuugaauucagggccuucggaagagcaagucagugcucuuaaccgcugagccaucucuccagccccuauugcugucuuuuagacauuuaguuuuagaaguuuucugaaaaugucuuuaaagaugugucaggcuucaacuaauuagaauuucuuuucugacaaugguuaagagaguauauacucuggcacagugacugguucaucggcuuaucaaggucaagaguagcagcuggccccauugucuucccagauucaaggaaagaucccccaacagcacccagauuucccggaucucaaaugcacagagaagucuccacucuuggagccaucauaaggcagaucauuaucaugccuucauccugucccugucgacagaugggcugcuccauccuaagcagaggacaguuaauaacauuugccuccugucauuagcuugcuuucuucaccuaaugggaugacucugaaccgcuuccgaacagcaauuugaaauguuccaaaacaaagcgagaauaaucacuuugcucaugacuucuguuggaaaaugaguauuaaacaggguuuaaaguuuaaaaaguuaauuuuaaccucucagauuuggggccuguucugugaccuugcguuguuaucgucuugcaaauaugaugccaacauuaucccaguugucuuaaaaacaauuuaaaguccucccagcaauuuaggcucauuugacauucuugcuaaguuaccaggguuagggcuggaagaagaaaaaauacagaaaugcaaauaacuggaaaccaguaagacagcagcuaggcuugguggcacauaccuuuauucccaguacuccugaggcagacauaggcgacaucuguaugagugcaagaucauuugcucuacauaguaaauucuacaccugccaagguaacauagggagauacuauuucaaaauaugauguuaaaauagaauauaaaauaaaagcaaaauguuuauucauaucuuuuuaucuuggccugcugaguguaugugcuggcuaguuuuaugucagcuugacacagguagggucaucagagaggagaaagccucaauugagaaaaugccuccacgugauguggcuauagacaagccuguauggauuuagacaagccuguagaacacuuugcuaauuuuagugauugaugggggagggccuaguguauuguggguggugucaucccuaggcuggugguugcuaaaagaaagcaggcagagcaagccaugaggaggaagccaguaagcaauacccuccauggccucugcaucagcuccuucuuccagguuccuacccuguuugagauucugcccugacuucccucacugauggacauuaccuggaaguguaaguaaaauaaacccuuuccuccccaaguugauuuuuuuguuguuguuguuguuguuauggugguucaucaaaacauaacuaacuguacaaugauuuuuuuuuuuuaagggcaugaggcgaucauacagauuuucuugaguacuuuuucuuaaauauuucaagcugauuucuagccaccauauagguuaucuucucauguuuuuuuauaccccaccaacucaaaaaacacagcucucacuugaauggaaaucagagauaguuuguucuggauccaaaucugaaugacuaugcaugccccaggagcacagauuuagguaacuccaaacuccgugguuucaacauggaaguuguuucaugaaguuuuaucaaggaaagcugugaacccaggcagguuuaaaauacuuuggugagcauauaagagaggcuguaauagcaagaaggaggaagcuuuucuauagaccucagaugcuaucugaugacauuuuggcuuuuggguuggugggaagcuaaguucauagauucagaaggcucuuaucuguuagucacaggauauuaguuccaucacagagguggggaaaggauggcuuuuuauugugccucgggaccuguaacauuccaaucucuccauaucacccuaguccuaaucacucuugguagacacucucagcuucuuucuaggcauucucaucaaccaccuuuaacccuugaguucuaggaaguuguuucuuuuguuuuuguuuguccuuuuccgauagugccuugguaggucacuuuggcuagccuggaacuuguuacuuaagccaggcuggccuccuacuugcccucgugcuuguagccauccuccugucucugccuccccagugccucgauugcaucaggcaugugcuucuaugcccuacuagaagugauuccccccaccucccuucaugccugugaguguauggguaagaagugugugugugcuguguacuuaaguggacaucuucuggugucauccucgggagcaucauuugucuucucugaaccagggauuccgaucagcguggcgcugacuaguuagguuugauuggcagaucaccggguuuagcuuuauguggcugugcuggggaucagacucacaucuuggagguuuuaaagcaagugcuuugcccacugagcaaucccaccuccagcuuaggaaaucauuuuaaaucuaguugccuacaauguucuugcccaugauuaaaaguuggaaaaugcugucagcuguuaggguuuauauauaaccucagaggccggugacacugaaaaggcaaagccucgcacuuuguaaguccaauucauggaagcucuuagaaaaucaugaaagcucuuagaaaaccccucguguguacauguacuuucccagaaguucacagcaccacaguuccccucucccagggccaguagccaggcuguuucugacuucacagugcgguugguuacaucuuaugcauggauguauagcgagucauagagcagccucguggagaaugaagccagaagagacaguauauuuucaggagcaauuuagagcaugauugaucuuucugaugcuguuaguguauuguuucuagcugacuggcuuuacccgcagcuccugggcaacacugugcuuaggaagaauugugggagaaacugcaucgauuacuugguaaguuagcucuacacucugaaaugaggaaaucagauugucguuuacccgcauagaaacucugugauacugucacaugugucaccagucuuagagauuucuaugcccaauugcauguuccucuuuauuuauuuuuaagcugucuuuauucaguuuuuguuucucauuggaguagcaguucuucacagaauaguaaccgaaucucuaagaugaaucaaagauauaaaaaaaagggggaaauuguggggcuggaaagcgacucagaggaugaaauccuuugcugccaagacugauaacuugaacuugagccccugagcucaguguguagcacaaaaggagagagcuaacugcagaaagcuguccucugacuacgugcuguagcaugcucacaagcacugguauacacacacaugcacauacgcaaauacacacaggcacacauuccugcauguacacgcacauagcugcaucacacacauagcugcauaacgcacaugaguacauaugugugugcacaaagaguauuugaaauuguauacuaacaugaacugaguuugcuuuaauuaaaucaucacuuuguguauauaaauucugucauugcuaauaugcugauagauagccguguucuucuguuuuuuuguuuguuuguuuguuuuaagauuuauuuauuuuauaugacuacacugucacugucuucaaacacaccagaagagggcaucggaucccaugacagaugguugugagccaccaugugguugcugggaauugaacucggguccucuaggaagagcagucagugcucuuaacugcugagccaucucuccagcccccauucuucugguuuugacuugugugguauacuagaaaaagccaccacaagggggggggggagggggaggaaggagagagaagcaccuuauuucuguuuugcuggcauguauuccuugcauagacuguuucccccccccacccccccccccccgaacaucgaccauuucuuuuacgugugucaucugaguauaagucaggggacacucaaugacauaaaauuuauccuucauucucccauuuaauccuuagaucauuaucaccucucuuuaauuuccuuacccccagauucaccuaacuagcauugauggguagugagagggaaagucugaguucuugggagccacauuuuauggucugugggcuaacaauaguauucacauuccuauaauaguuaaaaaaaaaguacaauacucuguaguauaugaaaauuaauaagaaagucaaauguucauguccauuggauuucugucacaccuauccaguuacauauauaccaugucugacagcuccaauggcagaguuaguauaucagggucucagggcucuguaaagucuaugauguuucuucuugccucuucauagggaagucugcugacccuggguacggaggcauaucuugagaacaacgagugacaggaaaaguacacagcccuuuaaguuagacagucgggugucaugccucaguuuccuuaaagguaaaguugacucaaguuaucccauauuuaaggguuuagaugagggcgaauugaagccuauugagugcgagagugcccacagccugcuaaccaggaccucagggacaaaagucccuugccuuuacaguuacuaguccuuaggucaucuguucaaauagacaaacaaaccaaaaucaaaacaaaacuaacaaauauaagcaaccaaaccaagccuuucucaagacuaguaauagcuuaugggauagaaucuuggucuuugucucugucugucugucugucugucucucucucucucucucucugucucucucucucucaaacaaacacacacacacacacacacacacacacagcucccucaccgucaccaaauugguggcauucggugucagugggcuuuuuguugagaugagucucuguagaacuagucuugaccuugugugagugacagugacuggggcaguagggagcugguggagcagggagauugcuugagagguugaagggagccuaagucaggaagaaucuugccuccagucuucggaguccuuggccucagucuccagggcuauuuccccuguuaaauguuucucguuaggcugaggugcuugcuagacugcacgucuagccacuggcaggcaagaaaacgcuucgccacaugaagaugaaggugcguuggcaguucuucagucucucuacagaaacugcaguuggacgccucccuucuuccugauuuaagugaccauguuuuucccccuuugcucuuccuuuccugccuggcagccuuguaagaguacuguucaagcagccugcuucagagaugcggggugccaugaugggcauuucuuguccuccugaccuccuccuaguccuuucugcugccuuuccccauguuuucuuagccaccuugcagugugggaacuuugccaaggucugcuuugaguccuaggcuguugugugagucugcugcuuguaaaguccagugaauuacuuucucuuguuuauaggggggaucugauuguaucagcuccacuuaggucccuaguauauuuauagcucagaaacugagggccaugcaggggcuaagugcuucuacaugugaaucaaucucucucucucccucucucugaaugaauguugaguccucuggccuuucuugucuuucucuuccucucuugcuguuaaaaauauaucucguauuauucuuuaaaaauaguguuuucaugugaucuaguggucugagauaguugcgucuaaauggcaaaaagcguugcuuguacccuuuuaugccccuggaugucucccgagggaggaagagcgggaagcuaaguuucaguucucauuauuggcuucugaugauagucuggaauuauuuuauagguuguguuuggcugccagcauggugcuugggugugauuaauuucugcagcuugccauuggguaaauaauuuucauuccuuggauccuuguugagaagggauuagccaagugaacuggaaaacaugccuuuguaggagggcuuuggcuguuugugauaaucaaugaacaaucuaguggccaauuuaauccagcucuuacagaacuagcugacucauuggcucuuaaugcuucuaaacaucuucaacgguguuuuuaaucuuaggggacuagguauaauucagaauuuagcuuuuccccagggaucugguucugggcauucugaauaaacaucuugugaaauggguuucaagaugucuuuuccaugagaacucuuucugucuucuaaguguggaaaaaaauacaagaaagguugguaucaauuuagcucuuuuggaaaugaaaaguuaaagcacaauaaaaaggaaacagcuaaaacacaacccagccgaacaaaaaccccagagaaucaggaucuaucuugcagaccuuggaggcagaggaugcucagagccugggacacgguucucggguuuggcaucacgucauuccaggaguaaauaaucuacagcugagccuuugccuggugggaugguuggaacacuuucugcccagggggcacgaguuucuacucacguguuccccccauuugauuuaugcaccgacugacugaggccgagaggucacuuuaggaaagcuuucuccucuuguccucuuggccucgaauaguuuccuccuguuccaaguucucuucugaacauugccuugcccugccugggucugcaugcuggcugguugcuugcuugugaguugcagcagcaugucuacugacuuccaagaaauagaauggucaagaucuuagguacuugacuucgauuuucuuuuaaaggaguguggugcccuuguggacuagacucaggcuuugacaauuuuagccuaaaucuagaugacaggugagugaaggcccgacagacuucacagagcaaaauucaagacauccaaguaaaauugaauuugagauaaauaacagauaauguccuauuagcaggucaagcuauccucugacagucauagguaagucaguauagagaagcugggggucucucucucucucuccuuaaaggcucccggauuaauccaggauccauggauuauugugaauaggaaaauaaucauacaaccaggaaaagagccugccaauuauuaagaauuuucuauauugauuaccuuucaguucccaacuuacagaacaauuguugucaaucauugcccauuugauauauauaguugauguguguguaugugcauguaagucucuggauuuaucuuugugaugcuucuuauguaugcauguauauaugcaucuaguacuuaaaaaaagaugaacgguuauugugauuccauuucaaaggaggggaaacugaggaagagcagcgagcaagggacuggcugagguuaaaguaaaggauggggggugggguagggauuuaguccaagguuuucugagucuuggguggcgccaggguucuaagaugguucuuuuucuccauuaggucuuaucauggcguauuggaacucacuggacagcuuuaaaaacacaugagucugagcacacccccagagggguacacucaguuggucugauauuguccuuggcauggggucagguugggauuugaaauuuccccaggcgauguuacucuagugccgggguucaagccugcugcuuccuucuauuuuuggagucaaaugaauuaaucuucucaggaaaucuggucccucuauguggccaugccuguagguucuaccccucccccacagaaacucacuauuccaaauguggcagcuaauuuuucauggucuuuguuucuucagaauuauuuucaggaaguccugguggaauauauguugggguauaaacaaaccacaaagaaagaccucuugggggucuucuguugauggauuuucugagcgaucuuuucuuuuucauuccuccauuauacuuccugcaccgggaaaugucccuuuguucuucauuuagcuccagcuggguaccaggcucaguauuugaggagguuuacagauuaauaaaacuagaccacugcccuccgggaguuuucaauuuuggaagggaaguauauaaauguaauuccagguuuaauuuucuaagagucacuucagagggacagaggauuaaggacuuccgugucagcagugacagagaggaaaugggaagaauguggcccuggucuccccuuggcuugguuccuguccagcauuauacccccuagaguaguacucagaccuggcuccugagcccaucugucucucagugggguccugaugaauuugugcuucuucagagcacaccagugaucaggcucagggcaaaggcuuggucagugacagcagccauguucagugugccacuggaagcucucaucagaccuucaaggcuuaccucagugagcugaaugugucaguaacugguggccuaaggguguucuauuggccuugaaaucacaagguuucucuuaauuugacagucaaugaagagcugugaagguaucugaauacaaaguuagacauaggcguggauaagaugaccuguggcugagaguagauuagaauggcaagccuaacggacacucuaauuaugcaagacaaagaugaaaaccucuaggccagagagagggggauugucuuugcuuaaaggcagcagcaacugaagagaaggcauuuggagcauguuuggaacacauguggugaugggugggaguguggaacuguggcugucaguuucagcggcaaucagacaugggcagcauggaaggcugauuguuaaaagggaagggggugagaacugggcucuggguaaaguucuuuugguguuaguguacgcagugcagugucacaugccaugcgauuacacacacgcugugauuguacacuuggggauaguguaguaugucacaauaucaaacuugcagugguuuaaggaugcacugccacaaggcuucccaccacagcuacugucccaucuguccuuuaugucaaaaucgagcuuccuuccuccuuugcuuaggucugugcauaacucugcauaggaaaucaguaaaucuuucuuuuguaguuugaccaacagagcaauuucuuuuauuaccagauaguucuguaagcaauaaauaguucuaauauucugagcauauucaucucuaaaugggagcuagacuaaggaggcauuuaguaaugccaggcuugacuuacaauucacaaacagaagguagauggcuuucgauaggguuuuaaggucauuuacacaauuaugugcaguuggaaacccuguacuuuggguauggugugaucgagccuuucagaaguuugguagcaucaucauuucauuuugcuggaauagcauggauuagggcuugguagacuuugcacaaggggccacacaguuaacauuugcagcuuugcaguugaaucucugucccaauuacucaguucugcugccuuaucugcaaagcagccacagacggcacgcaaacaaauaaacuuugugaugucauuguguagcuuugcuuucacagagugggcugggcuugagccucaggcuugucgcuuucugucccagguuaguauuugugcucugugacuuguuuucucuaguucugacuuuugucacccguuaaaaugguauugauaggaaaacucauuucacggggcuauuuggauagugaauggggucucccaggggguuuggcaaagugucugggagggcuauagaaaaggugagguaaaggggauaaaaucuguuuuagucuguacuacacagugacucugguguuuccuggcgacuauuuaaagguaagaagaagagaguagcaaagcaaacuuuagaagccauuuagaauaacaguucuguacaggggacagaugggagcagguagauacugacuuuuaacagacuaggaaaaaaaacaaaaaaacaaaaacagaucauggaaaaugccacauggccaauguuguuuauucuuuggauuuuuuuuuuucuucuucuuucucuuucuuaaaaauuguguuucauucccuugcuggauuugaguuaaacuuuggcucagguuuuggcauaggcuugcucauucgccccuccuccccgcccagcaccccagcagcugaaguguaagaagagcuuuuccuccacauucuguagggagcauuuaucaagugccugcuaugugcucacauugugggagguguugcagcuguagagggaggugcgauaauccuagggccugucacagacuuggacagaaacacacgcacaugcaacagccgugcacacaugccaagacggcguauaaauaaagagggcucguguagcacauccguugagaugaagcugcagaaggacgugaacgugagcagagucacaucagguggcagcaguccacagaagcaccacagagaacacuccagggacuuuguaaguggaguucaucucaguuugguagaaccucuucccuaggaagugacucugcucgucuuaccauaggcgugaagcuuggucauuggcaggcaaguaucuccuugcuuuaaaggcuaaugaaucuccaugacagugaccuagagguagaccuuccuggggacccuuaaaggcuuugaggcauuuggcuuugcuucacaauucgaagaacugcaaagggagggcgacuguucauaagaauaugccagaugcuugacaucuuugccucuggccccuggacggcuugcuaggcuaaccugcuaucaacaguuggcgaaagcaguaaggagcacuuccccauuaaggcgcaaguucagcagagcacacugggacucuuggguugguucuaguguacccagaacaguagaacagaacacaccaagagucagugaccguuuguuucuaauuaaugacugagagaaauaucucagguuugccugugcccuacauuuaacguuggugauaaaagcaugguugucaaaggacagacucgacacauugcaaggaagaugaauucagugcauagggguuacuuugaguaucaagggggcacaugucagcaugaccaccugacuguuuucuggcagcucacgauggcggacagaugugcggugugaauugagccacacaauuggucacugugcuuggauguguagaauuauaugucucaaauauaucuaggaagggcuguccagccagaagaacaggcaaagguauacuagaauuaaagcauaauuagugccccauaauuuagcuacuuugcuauggacuuuuuaauguuagacaggaaccacaauuggauucucagaaaucuugcuucagcucuaaauaucaaagacuaacuguauggcauucccuauccuuaauggagagagugauaugaccugggucagcauuggggaccaagcagagaggagggccucauuuacauagcuggcuaguucccaugcauuaaccccagcauuagugaggucccagauacggucaccuagucugccuuccugcuuuccaugcuucucuucuucuagagaaacccagcguguuuucucuaguuugcauggauucauaguuccugcuuuugauacuaguuauauauggacagacaugauucaugugccagauucuauuaguaggauacuuguagugcuuggugaauaauuguuguuguuguuugcuuguuuguuuguuucuucaagacagaguuuuuuucuuuguagaccugguuggccucgaacucaagcaaucugucuggcucucccucccaagugcugggauucaauaucaguaugagacagaaugagagaaucaguaugauucugucauguccauugcuaccgcaggaaccucccuauguauuuuauuuacuuuacaguguccuuugccuaggaagguguacaaacuaaguacuggaguuugaauaggugaauuaaaaugucaaauacagacagaguuuggccguccaugaugauuguugugggaguuggagaccaggucacuaaagcaccaaguccugugccuauuagccaggggugagggggguggcaguugcaucuuuuauaugucacucuccuggagccucccauaaguuguaaaauuguccacauugauuccuuauccucuaauuuauuuuuagauaaacauuuacaacgaaucgucauguuuuaaaagguagcuuuauguuucaaacauuugcagcaauauguguaugcagcuuccucaauuccuucucuuggccaugcacaauuuacaggaguauuggguaccuaugcaauaacgugacucuaaaacuaguagauugggcaccugugguaacaagcacaagcccgaguccaaacugguuuuauaguuggaaacguaggggcucaaccgacagagcuucugggaacaacuguuccuuaguaacuagggagagcucauuccguucucagacauuuccuuagacccugagucugugccaugagaaacaaaaacccagacagauccuugagccagagagcuuaguuucugauggaggggauaaacuguaagagacaaaaaggugggaagggcagcuucgcagagggagcaaaugcaauggacgcccugcggguuaagcuguggccucugagacaugguguuucugagagagugagacuuaaacucauggacauggcccucgcccaggagguuuguaguccaauuuguugagacaaggcaaaaauacagaggagaaaaggcacuaaggggaaauaucccuggaauaaucaaaaagguagacgugggguuggggugcgggucugugguagacgugggguuggggugcgggucuguaguagagugugugcuuaaucugcacaagggucaggcuuggaucucagcacaccccuaaaaugagaacccaagcagauaggacuggaaucucuucacaccuuaguucuugaggcaaucaaaguacuucugaguagauaguuuucuguaguuuacugccaccuuaaaugcacuugguguuucuacuucugggauaauacagucuggcuauaaggggguuaguguucugugcucugaggucagcagguuuuuaaauuaagcuaaagaguauuuuguuaagauaauguuuuucaaaaacaaaacaacacaacaacaacaacagcaacaaaaaccaaaaccaaguuucuucccauaaugaggagaaaaguucagaggucaaacauuugcgauuuauuuauuuauuuauuuauuuauuuauuuauuggccaggaaguuucuuuguuaacuugcagugguacccaugcaggccuguauguuuucuugagccauggucuuauagaauuuuugaaaugugccacaccccagaauaaaaauucuaggcaaaaaugccauguggucuuaacgaagccaugccacccucucuucuacuuggguggauuuguugcaauguugugcuuguuuauuuuuggaagaagccaucagaccuaccuagucaguaguccaucuugccaggucaagcccgaggggauucuaacccuuucuuuccuuccaucauucauguaaauucuugguggcugccuguguguucaguggaagccauccaucagcauuuccuucacaaauucuccuuucuaugggguuuugacuuggcauuaccacuugguggucuuuucauuguguacuguguucaaaccauagcuuuaacuuuggaagaaaacaaagaauuggcaaguaaauugucaggacuaaucucuguccaguguauauaaguuuuuguuuguuuguuuucuguuuuuguuuguugagacugccuucgcuguccuggaacuuucucuguagacuagguuggccuccaacucagauauaccugccucugaaucuucaguguaagaauuaaagaugugugccaccaccacuuggauggucuacacaacuuuuuaagaaacaugccagcuggacauugguggcacacgcuuuuaaucccagcacuugugagguagaggcagguggauuuccgaguucaaggccaaccuggucuccaggacagccagggcuauacagagaaacccugucucgacaccccucucccccacaaaagaaaaaaaagaaagauaggaaggaagaaagaaagaaagaaagaugccaaugucacugucaauccucgaaaauuuuauuuauuuucaaaaauuuaucuucuguguaucaacacucauaccaaauaccaaguucugggcuuuaaaagaagauuuuuuuuuuaaaguuauguauuuguguuugaaggauuuauuuauuuuuuuaacucuuuuuuauuagacauucuuuauuuacauuucaaauguuaucuccuuuccugguuuccucuccaaaaacacccaucuccuccccuuucccccugcuccccaacccacccacucccauguccuggcccuggcauuccucuauacuggggcauagaaccuucacaggaccaagggccucuccucccauugauaaccgacuaggccauccucugguacauauacagcuagagccacgaauuccaccauguguuuucuuugguugaugguuuagucccagggagcuuugggguuacugguuaguucauauuguuguuccuccuauggggaugcaaaccccuucagcuccuuggguccuuucucuagcuccuccauuggggacccugugcucuguccaauggauggcugugagcauccacuucuguauuugucaagcacuggcagagccucucaggagacagcuuuaucaggcuccugucagcaagcucuuguuggcauccacaauagugucuggguuuggugguuguauaugggguagauccccuggugaggcagucucuggauggucauuccuucaaucucuguugaagcauuuauugaacuggguguucaagguaguauucaguggccugcacaucagaguucaaaacacuggcccuggagaugccuguguucuucuuguucauguguaugagaaccugaaugaauaauuuaacauccuaacaugaaucugagaaguaggaauuagauacuguccaaaaguaagccauucuuccuggaauguuuggucauuguuuauuuauuuacacauauuuaauugcaugguaguacuaaggacugaagccagugccuugaguguauguguguguauauguguguguguguguguguauguguguauguguguguguguguguguguguguguauguguguguauggcaagugcuguacugcugagcucugucuccagcccuggaguguuuuuguuuggaaggcuuaaugagauuaggguccagacagauugcaacgguagaggaaagaugaguaaaauauguucaccagucaacaaggugacagaauguguucuuuuaugaauuugucaaaucuaaggucucauaaugacaagguggaucguccuaaaggagcugucuugucagccuggguuuuuccuguucuuuuuuuaaacuuggaagaaauccaaaauauagaaucuuuauagauuaaagaaauguaguugugugguggaaaaaaaaaaugcuuuucugaggaagcuaccuuuuaaaaugaacugcugcuuccaagaacagugacacccgggaggcagaguugggagacguucccuaaguucaaguugagccugggcuaugugccgaguuccaggccaacuagagcuauagagcaagacuuuuguuuccaaaaccaagaggcuauauuuguaauccuagcacuugugcagguuaaaguaggaggauugccuugaguucaagacuaccuagugaguaccaggccugccagggguccagagugugacacuguuucaaauggcaacaaacaaagaagaauggacuucugggaaacagcgacuuaggaguuuuggagacugauacuuacuugaauggaauucauugaaaaugcaccuaaaaucacugacuugacuucaggaggaaaugaauucuccaugccuuuugcuccuuugccaacauucuaugcucuaaagaggcagcaaaguugaaauuccacauuuaaaaugugcaacuagaacgaugaaauuuuauuuagccucaaauuagugaaacauacuuauaaguggacuugugauagauaucagcagugguuuggagagagcacugccuccuggggaauucacacuugaguguuguuguucugagauggggucuuguuauguugcccaggcuacauacacuuggaaucccaugcucaacuggcugcuuuggucagccuuccaaauaguagggauuuagaugugaguuaucucaugccuacauagacuuguuuuugagucucagcugucaccccagggucugggaaaagggucuuugucucugaguaucagguuucacacuugcauaugagggcacugcucugaaacuguaggguaguuggaauuguaccaaggaagaaagcccaggcuagaucaaaccugacuagggugguguaaagacaucuuucuccuucccuuccuauucuccccucccuuccuuccuuccucccuuccuuccuuccuuccuuccuuccuuccuuccuuccuuccuuccuuccauauauguaucuaucuaucuaucuaucuaucuaucuaucuaucuaucuaucuaucuaguauguauguauguauccaucuaguacgcuuucuaauuuuuaauuuugcucuucaguuaagacucaucuuuugugaaugucaccuauaagggucauuucuacuucugcuuuuccaauggccaguaaugaguuuuguuugcugugugcugauagaaagacaauugcuauggcacuuuguccauugguuugauaagcucuuuucucuccauguccuguauuaaggguuaaucagaaugguuccaagccauagcccccacaugcuuuugaauucagucaccaggauuguugagcagucucgaauaauggaaauagcaaauuuggacacuugucaguagccacaguccaucccaagaugcugcagauaucaagagcucugugacuucuggugggggaaugaggcucaucuguuguccguccaugucugugugguccccuaaugucaaugugugccuucaucagugucagccugcuguuguuucugcuuuuucuaaaguuguagacuccagcaagccacccacacugcagaacccuggaagguguuaucacauuuaucaguguucucuccaagaagacauagacuccacacagcuuaagauaccccaucuuaagagaucuggaaggaaguguuugaaauggcauacauguuugugguucugguaaccaaggaaacgugucucuagauacaaagccuccuuuuuaaaaaugauggcacuguacugggauugucucagaaucacccucagcaagauuccaaagggguuugaaguuaaacuaggucaucuucagaaccugaauccagaguuagccgacacgugggcaacaucucuuaaaacaugcaguguuuagaaggggggccagugcucuguggacacggggagccgccgucugcauagucagaggcuuguuuggauagauguguaaugaaucccuccuggauucaacuucccuugacucuuguuuuuuuguuuacacuguuuuaauuucuuguuugcuuccuuuagcacgucuuuuggaacaguccuuaaaaucauacagugaaauuuuacucaccagccaccaauacuuaagguauaguuuuuaguaacagauuuuuccuguccaucaauguagaaacuggacuuggcuuagaaucuuuuuuuuuuuuuaaagauuuauuuauuuacuucauauauguauguacugucgcuaucuucagacacaaaagaagauugcaucagaugcccauuauagaugguugugagccacuaugugguugcugggaauugaacucaggaccucuggaagagcagucagugcucuuaaccgcugagccaucucuccaguccuagaagauaaucuugcucaaacuuuguauuccuuuuuuuuguaaaugguaccugaauggaaccuggugcuugagccugcuaagcacacguucucccacugagccauuccccuaguucaugucacuccacaaaugagaaagcaagccauuaccaauagugaagaggcagaggcuguguaugaaucugaauauacacaccagggcacgaggccuggaccauugguacagauugcugucauuuccccgacacacagcagcgcuucuuuauguuacagaggacuucugaguacuuggcaacaggaaagacaucucagggucaucacuaauaaaggaguacggcagccuuggccaugagcaucucacccucacacucuagugugccacacaggacuuagaaguauguagacaggucuagggcagcggagcuugguguggggaggcuuucagugacuugcagccgccaugaauaccugcaguuacuuaacucuggauggacucuugacaggcagaucgguagcaaccucuucucuuagacuucauuguaauaaccuguaaacugaaauugugcuacguuuuccuaagugauacacuucauaauuaaagagguugaagugggaagaaguguucauagaauuuccgcuugagagcaauuuugacacccgcugccugguuaccuauuaauuaaauuauauaccucaggauaaaauuucaguuuaguuagaaguuaaguucuuguucucuggaaggcacugugaagcuuugauggaauuuuaaaccagguuauuagagagucaugaaaauuagcauagacccccgaaacaaauuuuuauuauguaccugcguguaagacuucugggccuuccuccaaagcucccauucacuagagccaagggaccuugagaauuugaguguccaguaaguucccagggaauuccuacagcuggugcucuggacuacuguugaggguuccuguauuggagagagccugcuuacguccccaguuuaauagagguauuauauuuaagcuggugcuuuuauuuccaucugaacugaguugcucugccaguuacuuaggcaucuaauccaggcuuugugcuugguggcuugcugaugaacggucaccaggugacuucagguugggcagcaguccugaagugcggcaucgcagguucugugguaucagcaauuucugagguucucagagggcaugagccagcuuaucaauuucuuguaugucuagcaggccucucuagaauacucugcuaucacauaaguauauagauuucaaagcauguguugaacaugacccuuagcugcgauaaccccuuaucauccuuuaaaggucagguuuggggaagauggaaauuaagucauuguuuacccccaaggaaagcgugacugcacaccaagagguuuuauuggcucaaacugauuuucguuuugaauuggucguugacuagagauuuuucacacaggaaacacaaacaaacaaaaaaaaccuccaaaaaccuuguaucauccucuaaagggaacuuaaagguggaggcaguuccagccccaauucucacuuagcauucuuugagcugaagagaagggguuugcccgggcacccuugccugcugaagguggggugggcuaucaccugcuacuucucccguacauucccgaugaccuccucugcucacacaccuggagccuguuuucugccuccacagguucaggugaugguggucuaggcauuugaucaccuugacugaccucuuaacaagcuagcuguaggugagaggguacccauugcuucuuccuucaguguucccuuuacuuuggggaggagggcggugaugacaagaaggaaagagaaaugacauugucuccaaguggaagucaaauucuuuacagcccucuaauuccucugucugagcuucagaccuggguucucagucacgugcuuccugaagaaugaaugaauguuacagaugcguucauuauuguuuaugggccucauacauucuccuugcuauacuccuguuauugguuuaucuccccaguguuucuguccccuugcucucugggucuguccugccuuguccaguuuaguauuuauauucuuagcuuuuuuuuuuuuuucaaaggaugggaaaauagaguucauauagucgcccacagaagucacucugugguuguuuuauuugagggagcuagaaggagagagauguuugaagagcaucagagacagaaggcacuguuucaaucuaaucauuaucagauugagagcucagugcgcuugcaacauuuuucugaggaaauacuccugggaaugaauguucuggguaaauaccggccuuauaucuuggcaguguucacauuucuggccacccacaugggguguauggggucuaaccuguuucaugaaguucaaggaacauguuucaagaguuugcgugcucucguaauuugcccugggaaacaacagauaguuucccuugggaaauauuuguguucagaaaucaauagggagcacggaagcgagucucuugcacucugggcgcuggaguuugcagguagaguuugugccaaguggcacugggaaagagccaguggacaacagcagaguagacaggaagggagggguugcuucuugccuggggggucaguggcuugucuaaggcacucugcuauuggcugccuggcucaaguucauaugaauaaucccuaugguguacucagcagucacuuggugcuauacaauauaacacaggccuuuugcauucccacaauccuugcuugggaaauagaaaccaacugcugaagaaguuggccacauugccauggucucauagcuuucauuuagaauuaccuaucuguagaugucaugucccuuaagaaagcguuagugguaauuuuaagaagucacacugggacagucugcaaacagccagagauucaggagcacucaauccuaaauggaaugucugcaucagacuccucccucagggucagggagcccugcagaagugggguuagaaagauugugagaaccagagggcuugacaccaaguaaaacaugccuuccagacacaguaggaaugaugugcugacguauguaaagaguguggcagcacacacagggccugcacagguucuucugugaucacgcacacacacacacacacacacacacacaggguauucacagguuuaagccacaugggagcccagugcugagcaguggaaguggacaagaacaaccauccuuaaccaagaagccgucuccaguugaccucugcuugcaaggaaaaauuaaauuucuccaguggagucucauuggucauauuaaucacauuuaaagguaggccccaugcccaguaguagaugacccacagaaugugaacuuaguuuuguaauuuuguacacuuccuuuugucucuuagugauuuguuugggucuuucuuucuuucucucuuucuuucuuucuuucuuucuuucuuucuuccuuccuuccuuccuuccuuccuuccuuccuuucuuucuuucuuuucuuccuuccuucuuuuguuuguuuguuuguuuguuuuccauacuggucuuuugcuuuauauuaugguuugcaguuuggugguuuuguguguguguguguauguauguauguauggugugugugcuugcauguuuuuuguguuuuuucuuuuuuuagauucuuguuuguuuugguugguuuguuuguuuucuaaagagagagagaaaggggauggaguucggugagugggaagguggggaggaccugggaggaguguguguguguguguggggggggggggaguguuggaaaccauacaagaagaaagggaagaaaaaaaagaauagaaaagcaaaaccguagucauugcugaauguagugaugccucuagcauguacuguuuaccccucuagacacuauucaguauuuuauuucuaauguauaaaacaucuuuacuuuguuaucaugcguuauugcucaguuucccuuuccuuuuucuuccuuauagcugauuuacccaccaacccgacccucgugcauggguguguuccauguguauaugugugugugugcaugugugauaauuuacaugcaaauagacauauuacucauucagaaaaauuagacaauacuaguuuuucuacagccaccuaaagugagcauucagaaugguguagcgugugucuggugacuugagcgugguaggcuugccauugagaguucucucaugcuuccguuuucuguaguugucccgugcuaccuagaaguaaguguguauuuauaaagaauguauuuauuuuuucauuaaggccagauucauuccugcccuuccucucacauggcccuaggccagcaguagguuguagcucugggaagagagcuguugcuucggggacccaagcauugggcuuucuugcuuucaguguucuccuuacuauaggggccuuuaggaauguggccgcagcuccuuccuauucucccauugcagccacauaauuaguuauaaaaugcucacuuggaggagaaaaacuuaucucggcaaccauuaauucccacuguaauuuauuuagaaucugcaguguuucuauuaauggaaaacagagugugagcaucaaacagcgaggcucauauugauaauugcauacugcugguaacugugaacuaugagauuacucucauaaaagguaauucccaugacaaccuggaggggaaccaaggaacagcugcaagguccagccuuugucauuuuugccccucauuugguaccauuuaccacgugagugcugaucuugugcuggggauauuuuugaacuaaauaggaauggucagagagcaguggacauuuuggguagaucgagggcacucggugguugcucuccagcuccuggcuaagagcucaguggccaguacaccugagaaagcuucaacucaguagaaacccacggggcaauaggagucugcucuuccaguucacauuuguguaagugaaugcucagaguagagauggaaagagauagcuggagggagaccgucagacaaacagagagacagacagacagacagacagacagacagacugcccaggcaguagcaaacgcucagaagauggacauuaagccugccucugcgccugccucugggagagacuugacuuuuccauucuugaaacccaagcaucuuccacuuuugcauggucuuaggaagucguccagcacauuaaaugagcugucucccuaauauggcucuguccacugaagaccguucaaaccuaagcaaucuggguuuguaaguugauaucacgacucacacuuuaugcccccacccccccgaauauuaguucuaaguacuauuuacagcuucuuuccucaaaccuuaccaccaggaagucacuuugccucccccuuugggcccaaguaccuuucuggaagcccagguccuugcggcucugugauagguuauuaccucaagugauguggucaccaagaagcauguugucuguguuccagagugaaccauguaggguucauuggaaaagauccuauucagaaguguacuaauggguuguuguacgugcuggacaguguccauacaauaucaagaauccgugacuuacuauauugucuguagaugcuaacccuagugcccaaccuguuauuuuuuggaaagaugaaggaaccagaagaacgaaaugaaauguucuaacuguaacaaugcccaugacagagcugccagucagaugacaguucgcuaacgacuaaucuucaaugcaccucucccccuguggcuuagcaugggucacauguccaacuaaaguuaugaugaugauauauugauuccugucucaaggggaugugucaaaaguuuaauuggucugcuaaacaccugcaaccgaggcgaguuuauuuuauuugcuugauuucaaagaaaaacagagauaaguugaaagcaagaaagcuuagagguuguuauauuguuuuacagucagacauaaauagcauacuaguaacuguguguaaauaaaaaauaauuucaaaggcuuguuuuuaucuuggacugcuaauuaagccagugacuuggauaugcugcuuucucuuacaguuuugcucacugccaguauugagccucuggacagggaaauaugaauuauuuggggggcaggucaggagaauuaucuuagcaguaacugugagguuccuaagaucaaagaucuugacagugguccugguaccucucuaccuagccucacaacugguaccaucuacauuuacccuguaguaacagugguggcuggcaaugcuuauuguaacugcagcauugcugggcuuagcuucuguaacuugugacaaugacugccuccccucaccccacccccauccugacagugucgggccuccaugauuuaugacagugauugucagggacucuugaaggccauccaauuugaggaucuagguucucguuucuugucacuucuggcacauuugauggauucuugcuaucagcuggcauguuucauaauugucagaacuuugauugaagugguauuuuugcaaaaaaaaauuaucaaagaguuauuuaaaaaaaauacuccuucaccacauuuccucaccucugugcccaaaacugcuuugugugagguucacagucccaucauuuaccucucugugacuugcugaccuggcaaaacggucucuucacuccucuuuuauaguccugugccuuguauuuugcuuguuugagccuuuucuccaccacaggauaaaagcuuuuguaagcagcauuaccgaggccugguacagugauucacuccaguaaucccagaccuugggagggagaucaggagucugaggucaguuugaggauagccugggcuacaugauaccuugucagaaaacaacacuaucaacucgaaagagaaacaaaagcaaagcaaaacaaaucgacaaaaccagagcuaagcaaaggagaguggcaccugggaggaaguugcucagcucuccuuugagcagccauuuaaggcagaugugggugggguggcacuagacgguaucaggcucccuucuuaucuuaaaccuggugugguuuguucugcuucuguuuuucccccacaagccaacauucuuuggcuggaaugccuguucuguagaucucuggcugccauugcuacguagaaaucugccccuggacuuugaaacucuacucuuggggaagccacagaaaucagccaggggccaggaauaguucuagucccuucacacaggaaggaaugcucccucucaaugcugaguaucuuuccucucucccucucuccuccuauaugucagucuuacccagugcaggccggccucuaaacucucaguguaggaagguuagggugagugugaacuccugaucccccugccuccaccucucaugggauuauaaacauugccacuauccauccaccuuucauuucccucuuucuccccucuuucuccucucuuucuccccuccccccugcucccuuuucuguuuuugagacagagucuaugcuauagucuaggucagcgcgggacucacuguguaucccuggcuggccucuagcgcauccugcuucaggccuuucagagaguagccaccuccucucccuucucugugugccaggcacaguaacaggagguuucuccucuugcuuuaauuacacagcuucuagaucucaguuucuuuucucagaagcaaacccuguuagaaguccuuuuuuguauuuggacggaggcagcuccaugcauauauaguaccagcucacauccaucuguggaaacacacaaacacacugacaagaagauaugguauacacucauaaaccuccacuuuuacucugcucuuuaaacacccagucucuagcaucucccuccugugcuuagaggaagaggucuccugaugucuccuccaauggccaggccuccuuucaagcuuccucuagcccuguuuguucucccuucugccucaacccucuagucuccugagcuguuguuacucaggcaagugugucucaagccccuugcccuggaugcaguguccuggacuaguucuugauagcacugaucagcagagucuuugugguaaguuaauaacucugggguggagagauggagcugaaggcucauggaggcaaaagcuggguuccauacccacaaccuucaguggaaggaaagaaccaacuguucaacauucuuugacacgucugaccugacauguguccuggaaagaguuauggucuauucucaggcucucaacuccucucccauccccuccuuucuuugauuccauucccaucuuucucuuucuuugucuuaugcaugcuaguuaggcaugcacuuaaacaaucugucccgccuccugagugcaguccuaucugggcacuccuggcauuucccccccucuguuguuucuaauaguucuugagaggacagucguacuaagaagccuagcagcaaagcucugagaugucuuggcaguuacuaagaauagcuucuggcuuauuuucccacucuuuccuccucuguuuugucuuaacucugaagcauaagagcucccucuuaucuuauuaacaaaauaauacauucucuccugggcaauuacacgaguguauaugaucucuuccgacugccagccgucugugucuguccagaagucagcaaggggaugaaaaggguucaaggaagggggcaguaagugacaacagaacacacuguagacuacuugucagccugaggcaggucugauguccagcaucucuauguucccagccccggagucacugcuucuaaugcaucauggcccuggaccgugagaaugaaugaucagugggaagaaaggaagaagugcuuuguaugagcuucacagucccauccuuuaccucacugguccuggccccgacacugugguucaggaacugcuagagccauguauuccucgguacuauagccacuucuucaugucauuccuauguaggcuccuuccuccccuccucagcaguagcuuuuuauuuuuagaaguuuuuuauuguuuauuguuagcauuauuuaaagcagggucuaacucuguggcucagaccggcuucaacguuaucaucuugauggcgcagcuuuggagugaugaggcugaggugucccaucaugcccagcuucuguauuaaucuuuggugauuguguucaugugugcauaucuucaggcauacaugcuccugugggcguguaccuguggagccagacgucaacauuguuuuugaaacaguagcuuugccuggaacuugcugauuaggccaggguggcugaccagccagucucagggaaccaccugccucuacucucccuguacugggauaauaaguguauccugcugugcuaccgcaucuggcuauuuuacauggguucugaggauggauggauuucaguuccucauccgugaguggcaugcacuacccacugggcuaacuucccaacauuggugauggaguugacacaggaagguuaaucugucacauggcucugcaucuggaugugaucaucauucccuuuggaaggcagaggacuugcuucugauucccauagcuccucugucgccugggagucuucuaaauguccuccacucggcucagggauguuccuacuucgaaguugccauuggccgacuaagguuucuucugagcaacgccagggagggugucccuguuguccucccauuguucugagucuggugacacuguauuuaauugccaguacucaggacuguuaugcuucguaaggauuacuggguuauuuauaauuaguucauugucuguguaccaguaaugcuacuugaaguucuggaaaauaguuuaauaagucuccuuuucccuacucagagcaaacuuccuuuuucaguaguuauugggaaaguaaacuuuacccucauuuaucucaagcaacguaacucucuuacucaugaacuuuauaucauagucaguuaacaucuaggaaauaaugugaccuugccuugagaugacaugucauauaacauagguauuguguugguuaguuuugucaucuccacacaaacuagagucaccuggguagagggaagcucaggugaagaguaggcugauuaaagugggugccuacagcccauaguagucagggccauuccuggacagguugcauggguaguguaagaaauccacugaguaaaccagggagagcaagccagggaguagcaguccuccaugcccucugcuucaccuccucccuccagguuccucagugagguccuguccucaaugauggacuugggagugugagauaaauaagcccuuuugucucaaguugguuucgccagcguuuaaagaaugcaacagaggacuagcuagaauguggauuaaaacucuagaccuaaguccucuagcccuccuacccccuuuccugccuuucccuuggcuuuugauaaaaccaucacauuaacauaugcuuggaugaaaaaacucuauuuuguucauuaauagaaaauauggaucaaauuuaaaaaaccuuuccuuaaaaauuguacuauaauccuuuuuguaugauuguuuuuguuguuuuguuuguuuuguuuuguuuuuugagaaauauaucuguuuuaaaauagggugcugaaagguugugccaaacuauuuguugguuugaguggaagauaaaccauuuacuuuuuggaguauacacacuugauauuguguguauacuaaucguaaugcacugugccaaaucaguggggguggggugcuucaauggaaagccucauucuguaaauguuugaccaugggaaaaaaauacaggacuuuuuaaccugccugguugcauuccauaaaauaauaaauuaauggaauuaugaaaauaacagggcuggugagauggcucaguugguaagagcaccugacugcucuuccaggcugcucuuccgaaggucccgaguucaaaucccagaaaccacaugguggcucacaaccauccguaacaagaucugacucccuuuucuggagugucugaagacagcuacaguguacuuacauauaaauaaauauuuaaaaaaaaauuaagaaaauaacagacagucauuauagccauuuuggucaaacuuugguaguucauagugaggccucagggaaaggaagaugcaucuuuuaaacacguauuauuuuuucucucucuuuucccaacacuauuuuuucuuguuuucucucugauacauucucauauauauaucaacuucauagacacccaauagguuauugcucauaggcaacauaauuguacagaauauaaagccuaugauuacaguuucauuggugguuggcuugucagagauuuuaugagucuugagacuugcuugaaaagcauggauuucagccacguuucuguuugauuucagguagaccguucuuuauauuuucccucccucccuccuucccucccuccuucccuuuaucccuucauccauauguauauuauaguagguugaucagggcaacuaaaugacuaagaggauggcguggauugagauaaacagcaaaaauauuaggauuugagaguuggaggaugaagagugacguguagaguacuguucuggggaacucacacuugcuucccaaaucccagaaggcuguaauaaaagggcaccucucuacagcagaaggaagucguuuaaguuugaauaaaaggaaaaaggauguguguguccagaugauaacaagcaaauaggauucaucuuccugaguauguuuguagugcucaaggauauguguucuagagugacugggacggagccugauagcagagacuccaggauaauacagggaaacccagacaccuucucuaauccucccgucggucaucacccacagaagggauucgaugcagucuguuugauugcuauuguccuacagaaagucuggugggaacuggacuucugcuugacccugagugacaauuuuuaugcuuuuaaaauugguuaucuuccagacuggucguuuuuauaguucuuacgccucaguaccucaacuugugcagaacaguuuuauuugagucauaaauuuuuaaugucaaaaccuuccugacaauuauuagcuaaauguuuagcucaauagagagauuaaauacauacaucuuagaacuuagugaccaaaugacuuaaccuauagaaggauuuucaagucugaaguaauuucccaggacuuuaggcugauacacacuugaucuaauauuugaagucagaauaaaaaugcuuguaauagaugauuacuguuggucacgugaaaaaauuccauagagucagucucuaguaugcauuugggauacucaucaaugcaagcuuucucccuuuguuguuaaaacaaaaguaauuuacacaauaagugacuuauagagaaauuuuaauguguauguuuucaccagcucuaacugaaauuggaaagcuuugaaaugaacucauaaauacagcucuaaaguacaaaguauacuggaagcuguaaaauucgcugugccuuauuuuugaaaaauauuagccuacauuaaauuuaaauguaauugaacauuuuaauugaaaaauuaaccuacaucaaaaagaaaaagauuugguuuaauucugucuucuccaaguugcucaguaauaucacuauaugacagccugacaauuuguguuguacauuuuacauguagcauuuuauuuggucuguguagcuaagcauaaugucagaagcaucugacuuuauagccagagaagcugugguccagagagaagaaaggcuccauggaaggccacugaaauagcacggugagggcuaaagaaccacacagaccacaccuuaccuuacacauccuacuccucucccuuuccaucaugcucgcccguaugugaugcuguuuaaucaaucagguagaguccugaaagcaacucaguuagugcucagcugcaaagggcagaugcugaauucgaaucaaugaagacugugcuacagccaugguuaacuacacuggcagccuugucucauucuggccagcugauuauuugggaaacuaucccuguguuugaucagauaaugcacuaaaacauaguuguaaggagcguuaucgaaucuguaauguauuuuagauaacgcaauuaaaauaguucuguuuuuacuugauggguuuaaauccaagucucucuucgacacacauaccagcaccuagcaaggaguggaguggaauguggcauaaaaguugaaaucggugauacguaaagaagggaccaugagguguucuuuccaauuccagcaaggcugaaaacaugaaaaucucaaauacugugagguuaaccacuuacuuaccuuuccggugacugcagaagcggagaugggccuguuaucucagcuaguaauuucugcaugaaauucuauuaaaaccgucuuuggguagacuuuuuagaaggaguccuacugaagccccgaauacagaauuuauauucacucccuuuuuuaaaagaccuggcaacuugcuucagagacacuggaggagccuuugaaacgagggcugccugacauuuuugggugucuuuucaacaaugggguagucagaggucugcaacaugagaacauaaaagaaccauuucccguguguugaauuuacugcuuuugguuauuagccacugcuggcuucaaggcugugcuguuggugcuucugugggccggacgugaguaccucaucucugccacuuuccauuguuaacuuugggaagacucguuuaaccuuugccuuaauccaacuauaaaagcaggaugcagacacauguuuaacaguacaucaaguacuuaaaauagugucuggcacccagaaaagaugucuuuuccucuuaacuuguuagaaugggacauaaugauagggaaggaaauaguccgccacccuacagccuugaaggcaugguugaaggucauucugaggagccuuaagcauuccuuuucccagugcagacgaugagagaugcaggaucacaggacacgacucucccuguucuacaguuuguacccauuauugauugugugguggcuucuaacaguguaaugcuggcuucugcacuuuaacgauuauucuucucguaagcaugucucugccucacauucuguuuucuauacacaggcauccugugcacagugguucccagcacugucuagagauaaaugcucgugacuucagucucccucuacggaagacgccauucugucuuucuaccaccucuuuccuuuccugucccauuguccugcuuaccacaugaaaaggaccaaggguggaaaucaaacguaggaaacuaacgguuucagaaacgaagggcuggauuucuaaagccuucauaauauauuauuauuuugauauuuuuguguuuggaucuuuaagguuuuuuuguuuguuuacguguuuguuuucauuuuuauuuuuuccuccucugcuuccaaagucuccagaagcacguuggucaugguuuuacagcuuugcagugaugggugcgauaguugcuuuuuuuuuauugaaccauagauugcagcauuguaaagcuuacucauucggaggaggaaugaaggccauuuuuaauugcacuugggaagugggacagucuuauuaaauuaaaccugcaucuguauugaaaggaagagagagaaaacaagauuguguucucuuugggauuuggaguuucccagagcuggagugaacucagggcugcaugacaaaagcuguagcuccagucucuugggauucugagucagaauuuccucaguccugugauuaaccacaucuacccauaaccaugacaaauuaaccaaccagggacacacacacacacacacacacacacacacacacacgugcuuacagcuaggagaguggcauagagaguuuuauaguaaaaacaucuauggcuaugccuguccacuuuguuaguuuacuaggacggccauggcaaaaguccaugaaaaucaguagcuuaggccacaccagccuuauguuauagagccuagaggucuaagaccuggguaucugcaggcugcuuccuucauccagcugacagaugccuuuuccuuuucucugcuccuuugaccuuccuugguuuacagaaccuuuguccugucuucaucuucaagucaguaaugcauucaaguuuccucucucuccuccccccccccccccccuucacuuacaggcucauccaaacccagacuuucuccucuuguaaggacgugagucauauguguuucagggcccauucugcucuaucauaaccuuuuaacauaaguacucuuauauaacaaugcucuuauuuccauacaaaaucacagucaagagauaaugaggauuauggcuaggagagggacauaauucaaccucaaacauacuugugaguuugccuuucuugguauuccucuguguguguguguguguguguguguguguguguguguguguguguguuuuaguuacaacuuucugugauagguuguugaguaguucucacaaguauugaaauugcuuggaagggggaaaagcauuaugcaacgaacggcacuaauuuccgucuugacauuucagggagcgauucuggaaagugaggcagcucugagccaaugcguggaggagccugugcgagagagcucauuccuuuuguugcauuuuuuuuuccagagauucuuuuggcagcgcugggcccaguccagaugccuuccacgucagguggcuuaagcaugugugugcacgauugugugcaggguugugcgcagccaauuacaguuggaaacaguugcuuagccagcaauuagguuccuugccgucuagaauuacauugcuuuaaauuaagauucugcagauuugaguugcuuugauaauuuugcaaaauccauuuugagguuauagcuaaaaauguaaucuuccaauuaggaggguuuuuuuuaucugauaccuguuuuguucauuaggcugugggccuauuuuaauuuuuuuuuuuuuuuuuugcuugcuuuauaaaucagucgcaagaguguaagucagccagaggaagggaggggaauccugugucuuuggcccuaaaggugacuuuccuaaggagccgauucaguuuuguuacuuuuucucuucuaaaugcaucauauaguuuguguguguguuucaaguaaagcccaagguuuuacaagaggcaaaaccucucacaacugaacucuguuguuuaaauaugaacuaguauucuauuauuaaaccaggccagcugagacaagcuuuuuaauuagccuacaaaagagaggaaacagugugaggcgaaugagguaguuuuacuuaggaggaaugucuuggaggcuuaaaaaccgucuuccgcugaccagauuuggauccauuuacacuaaaaucuugacuuuguucccucugacgauuaccuuaucucuguaaaugcacuuaccaguacucgagggcacagaaugcuacgagccacaaacauuguuaaaguguacuaggaaguugaccaguaugccguguguccccggaauucaucuuuaugguuucugcacggugauccuguuccuuugaaccagcacgaggaagagacugagccccaccaugaucgagaggccugcugcugccugucuagucucuaacucacuauucugugauggugggaaccuuuggcuuguuguuuuuuuuuguuuuuuuuguuuuuuuuuuuuuuuuuguguuuguuuguuuguuuuuuugagacaggguuucucuguauagcccuggcuguccuggaacucacuuuguagacuaggcuggccucgaacucagaaauccgccugccucugccuccugagugcugggauuaaaggcgugcgccaccacgccuggcuaccuuuggcuuguuguaugcaagcaguaagcagaggugaguuugagaugaguuugcacgugcuauagguuauuuuuuccugagaugauuuuuuugcgucuuguucacucugcggcagcuuggcguagcuccugagagaguugagccuucugguuggcaaggcucagagcagaaggugaccucaguggggcuaguccuucagcccuugcuuccccucccaucuucccaccacacugaagucccuuuuguucuuugaaaccaacucugcuuuuauagaucugcaaggccuuguccccauugugcaucuggauggugucuguccccuuuggcuuauuacuguguucguuuucuugggccauugaaagagaacacugcaaauugugugucuuuacacagcaggggagaagucuggagucaugagguuuggagggcagugcucccuugguaguuucuagccuuacuaugucucuguuccuucuggugauagcaggcagcccuggcuuuuggcagcuuuuucuucuaccuuuccucuucccauuaaauucuaauaaguaucucccauaauuguugccaucugagccagggcaauucagauagauuaauuaauuagcuaacuuauuuauucauugaugugcugggacuagaacccaggacuauguagauguuacgcaggcauucuacuguugaaccuguacccucaaccuuagugauacgaauguguauauuacacacuugugcauaagcucucauauucaaaucauuagaacauuuacauuauugaaauauggauugucuguuguacauuaugacgcagcuggaaauacuggugucgacgcugucaucauguccguuuuggagagggagguaacacacauugguaaaacaaaaggcucacauaaaacauuggcucauccuuucugcuucugagauccuggacccgcaagguuuguagaagcuuggcucuugagcucugaugguaagcagauguggcacaucuugcaaggguaguagacagcuuccugauccagcaguuggaagacuguuuacugccugcgcuaacauuaccucugguugccugucuuaauucauuuuagauuaaucugucuuguaguucgaagcaaaaugaauugagucaguaacuucaagaguuauguaaaaaucuguauagugcuaaauaauugaaugggguuuuauguauggucuugaaauuggagugucaauuugacacaaaugcuccgaagcagagugcuggaugaucuggccgcuuccucauagaaagguuuugacgcuuccgucaugggauggcucgagaguguguccuuccccuuccuagcagacucuucaggcuucuuuauuucucuugaggaguguuaacuuugggaaaggcgagucuguggcuccaggguuugaaguacaguagucugcaggaagaaacucugauguggcaacucuauaguuggucccuggaaaucuuuugccuucagaacugcuuccagugcgauguccugagaugugacuuuggaggucuccuguguaggggugugagagagacuggucuacacacuccuaagaagagcuucaaggcuguuucccauaacaugcacuuaugagaaaucaaagauacugguccuuguugcugucacuuucugaguaggaaagaggggccauuuuaaaacuggugaacaauagaauucuugaaucuacgagaaggacgguguaucccucugcuuucaagaaaauguauuuuaauuuuauaaucaguacagcuaacccuguuuuccugguaggaaguauuugaagggugcuguaagugaaggaaacuaaaaugggcugaucacugaaagugccgcugucauuaggagcugcucuguguaccauacuuuuauuuuacacaagcaaugaccucguggagaugccauuugcagguaggggaagugagaauuagguaggugagguaauuaaugagugcuuacacacauaguuugagguauggcccagauucacacagcaaguuuauuuaagucccaaguccaugcucugugucaggaacauuucugguaaaaugcagaaugaccaguuaaauaugaauuuuaaauaauauguuuuugguacaaguacaucucaugauauauguaagcauuuuauacuaaaaaguaguacaccuuauuuaucauaaagccuuugcauuucagucccaaguuuucauuuuuuucucucuagauaccuuaugugaucuaggacuuuagugucauccuucucacuucugacuccaaguccaccccugcuuucuaaauggcaugcuaugcccaguccuguccugucccucuuguggcuuauuugugucagcccucucuggcaaagcaggcagacuaacucaggugauaaaaggcuguccgcaaagacacggggagacacauucccuucagccacagccuggaguuucugcuugagucuagcuacaagagugagaacuugucaugugguuuccagggauauaagaaucaguccucugcauucuauaacaaacagagagaaugguuuguuguaguguuuggcauuagaauauaaaggugaauuuaaaaguaaacuauuaauuuguguguguguaucucaaaaguaaaaacuacuuuaggcuuugauacauaggaucucacugucuugcccauaccacccuuaaacugauggaaauucucuugccucagcuuuguuccacuuuugauagucacagaauugcuucaagguuaaacugacagccuggcacauuagggcauuuguauacaugguucuuauaggcccugggcagcuagucauaauuaccacuucuguuggggagauacggaagucauuagaucaauaaggcccccaggucaauaggagugauggguagagauaugaugacaacugguuuucucuucuaauuccuccacucacuuccucuugguuaugaucgcugcucuguagacagccuggugagacagcuuuguguuugguggugguggugguggugggagaggaggaggaggagaaggaagagaaggaagaagaggaggaggaagagaaggaagaggaggaagaggaagaaaaugcuuuggugguuaagagcggucacuggcuggucuuauggaggaccuggguucaauuuccaguacucccauaguagcucacaacuacugccuauaacuccaguucuauggaaucuaacauucuuuucugaccucuuuaggcauaagacacauagggauacauaaagacaaaacacccaugcacauaaaauaauaaaaguacuagaaacuucgagaacagcuaaauagcauuguggaagcucugugguuuugacagucuggaagcccaaagaacuuucaugggaacaucauugacagucagcuccgauuuccagacucuaguuauguauuccauuuggucuucagaauagucucuucccacacaaaggaucaccccagagguggcucuugacaucugugacaaacugggagccauaguaacaccuucaggaauuaggucugaagaucugcuuucuguaugcucagggugcuuuauguagcucucuuaaccauuuuggggggacagagggcauaggguccuauuauacagcccaggcuggcuuugaucuuguggcaagccucucgcucggccacucuuaacuuguguugaucacauagguacuuugcacuuauaaaccugccaucuggcacaagcucaugugcaggccccuaacuuggaugaaagccugugaguuuacaucuaucaguaaaccaucaggaaacauggucaagacaggaggcgggucaugcuggcaguggcagcuucgugaagaguacacaugaggcaagagugagucugcgggccucucacgggcucuuguucuuucucugggacucugacugucacaaacagcccccuuccuugaaccacuuaugaaaacagacuguucccauuucuaagcgauuaaagggguuccuugaaacagugagaucaaagacacacuucaaguuugucucaaagugaauauuaacugcauguuggagaggcaugucagggggaaccugaucuuagcaaacccaaaugagagcuguaaggagcucgaaggguggggggaugcaggaggggagagucaaagaagcgggcaauuuuggauuuaaacacauuggaaaugguccuuuuuacauaugugaguggauaccuugucuucacgucugagccucuuucuuaaugugaaacccgguuaaugaugcugaucucacagcaucgugagaauugagugaggugaguaaaaugccagguagggugcaagguguagcucaguggaacagugcuugacaagcaugagugaggcucuggguucgguccccagcacugccugaaaaggccagacgccgugacccagcguuuacccgaugcuuuuucaucucuagacaucccaguguaguucacuguaggagaguauuagcgagguggacuaggcucuugccucagucacuuuccaucccaacagggacagggagguacuuagugaauagauuagucaguagagggagcgcacuguaggugaccuguuuaaugcugaagaauauuuggguaaggcacacuggcauagggguuuggcuagaguggcuuguaagagccuuuuugagaaaguaccaaaaguuuuuuuguggugaagcuaagcugcuaaguguuugcagugcuccacacacacuuucacaaaagcaugcucaucuucuuucuugucucucagcuuuccuuauccuccuucucuucacuuucuguuuguccucucaguauccuguucaaaaaggagccgacuuacccacggaaugcugucauuaaucuugcuccccacugggguagcaccaguaaaccuuagcauuaggagaggcugcccuggcaguggcuucuagcaaaugaagaaauugaagucugagauggggcgcagugagaaggagugagaugugagccaagagaguccuuaaacauuuaugacauucgaggcagcuuacacuaaccuuagaacugcugugcugccugugagaauggucccuucuguccaugguaacaggagcugcucagcaggugugaugugccaggcaaacacaucgguaaggaccaggaugguaguaucaggaguuaccgcuccgcuccguagccucugcucuaaaauaggcaagauggauuucaggaggucagugugacacuuccaggugcuauuuauguugguuuucuugguaagcagucacaguuggaauucuucccagcuggcggccaaaguguuguuucucauuuguuuugaugagauuuagggaaaguugaaguggagaugggagguguggaaugagcuaaaauuuccgagaauauacuugggcauguccugccaaaucuaagugcugggcccugucuuuucugggacuaacaaagauacuggugaacagagauuguucuauuacaaguuagagaacaaaccuaugaacguguaauaggccacuuacuucccaguucuuucucagucucuuccgagcugcuugcuugacaaucaguacacuugcguuccagguagcuggaauccuggugcaugcaaauaccgcuuaccaauggaacauggaaguaugaacugguaucaggucacuagcuugacuccugcuucacauuccucucuugacugucccugucagaaccacuacaaguuccguccuuuagccucguuuucaaguuggggcauggggcccacuagaguuuguguuguuucuuccaagacugagggaacccgggaaauguuauuugucuaaggagaauuuuguguuuuuucagacacguuggugguuuauucaaaauagcagagaaauucgucaggaucugguggggagguuacuuuccaaagcccgguuggugggugggugugggugcgugucuuucaccgugaaggacuuagaaaucucucaaguugggauugcauguggcgccugggcacauccagccucaguccucacuaaauugauaccaccucguuuucuugcugcguaugucauaucuugggguccuccacauuaaugccacuuccuuuuaaaugcucuaguaaggacaucaccuggaauguauuccugagguaaagcuaauaaauacuauccaccacucacccgcuugcuggguguuugcuugacuuggggaacucaggguuauauacaucgccaggaccuucuguucuuuuuguuuugguuuagguuggcgacuugaaauauggccugucucccuacauggccuugaaauuguguucuuccugccucagccucucuggugauugggauuacagaccauguccugcccgccauuuucauuuauaaauggacucagugugguugguaccaucuuuauuuacagauaaaacacuuuaaacaggaauaacuaaaaccuagccaaagcuguuuugucuuuauuaagaaagggauugcaacaaccuagucaaaguguguguguguguguguguguguguguguguguguguguguaugaucacaggcuucauuguugacugugggaggugguacaguuuauggaaaauggcaucagacgucgucuucacauacuguuaacaugggaagagcuccauauacaugaagagaaaacagaugaguguauauuuagauuauaguauuccauaguuccacaaggggcuggaggguagaugacuguaauuuguagaacauuccugggggggggggggcagugauaguacuuaucugugguagaaagggacgguagggaagcauauagaagcauugauauuugauuggaaccaugcgacucuacuaucucuuuacuauuacuaagauaaaaugucugcagcauugcuguucgagaacauaaaggaauaagcucuaccuuguaguuuagacaguacuaauggcagcugcuacggaugugccauaguccaagugcuuucuguguaagguuuaaucccaacagccugugaccaauagcuguuguuggcagagguauuuuuagccuuauuucucaggugggaagcuagggcuuaugugguaccuugaugaacaaaagcucuagcuuugagauguguggucuggcugauucugaagucugccaugcuucugcccugcucuuuugggucuuuacaucuguucaaaaggggacuuaggggacuuaggcaaauuaaggcaaaaauuuuggcuacauuguaaauuuauuuuuuugagagcucaaagauacaucauauuuaccuuaaguauaaaucuuaaagcaggacacugccacuguuauuggauugcuuugcuaaaaugaaugcuucuguaauguugcuuugccuuuauuuccaugaaaguuucuguuuaaaauaauacagaggucuggaggcauggcuuccugguuaagagcauuucuuucucuugcagaggacccagguuugggucccagcacucacauaguggcucacagccauccauaacucuuuuagcagggaaucuaacacccucuucuaaccuccacgggcagcacgcaugcacgugguacacagacauacaucuaggcaaacucuacacaaaauaaauagaucuaaugaaaaauaaaaaaggcugagaaguguuugcacacguguaugcauguguguagcugggacagaacccagggcuuuguguguccuguauauuggucuauaucuuuacaugggagaagcugucaauuagcuuuucuguucuagguugucuuugcaagauucugaauuuuuuggggggaacugcuauucuaaccugggagccuuaugugggcuuucagaaaccccugaaagcccaugaaacuguaggcuaacuuugguguaaguacauacugauuucucagggcaucuguccuuaggugggagccucuaguuuguaguaaggucucaaagacaaucaggagccacugagguuacuuuaaacuguuuuaaacgguugucaccgugcaaggaggcagaggaccuuauacaaccugucuauucucucuacuuguucguuaugauugugguacuuagucugacugucaguugauaguguuuugaguuaagagagacaucuagaucugucaggggggaauuuccagaggaguuuaucugaggaggggaaaccccauccugagugugaguggcaccauccgauaggcugggcucccggacugaacaaaaaggagagagccauuguucuucuuucucugcuuccugacugggcacaaugugaccaacugccucuccugcccucccagccaaggcugcccccugcaccacaccuuuccagcugugauggacaguaccaagaaccugcgaucccaagggcacccuuccuuaaguucuuuuugucagaucucauguuauaauaagaaggaaaugaaugcuuuaaucaccaacuguuuaaaucauugacccccccccccccgccccccagcaugauauaaaacucuggauucugugcuuggaaggcuaggcagcccuugguugcauuuuuaccuggagauacucuugcagagcuaaguguccucucaaggugcuuguguucucuaguuuucccagguccuuuuaauggaaaucccagaaugcuguggucuaaaugacauuuacuaacuagcuuggguagauaaggaguagguucuagucuguuuucguucaaaagcaacuucugcaugugcguaguguuugacagauaauaugagacucggagauuagauauuggccuaagacguuaguucguugcaggauguuagaacaaugggaacuuuagacucaggacuaucuggcucagcucucacauugcuuccacagagcuucaguugucucccauuauugugucaguagacccucacaguguuguuagcaguaggaaaguaucauuuccaguucacaaaugagcaacccaaaacuugguccagcucucuaaggaaugcacuaugccugaaagaaagggcuggagucucgccccauguucucccuuaguuguucauagaaccuuuagagguggaagaacuccgaugucauuugcagccaagauauuaaugauucuaacacaucugauauaaagacaaaagcaggaaagguguuauguccccauuguugauguucucuagggacuugugcaguguuccuggagucaguuggauagugauugggagagaccuacuccuagcaaaaugcuaacugguucuggggauuuuaaggccuggccugcaaagaggaggaguuguaagauugggauaaggaauugauuuccagagccccaugaaauuagguagcacaccuccccaauacaguagaaaggacucauuacuuuuuagaagacuagacaucaacgggccauaugaauguugccuuagcuguguucauacuaaagugggaaagggauguucuguugugcaguguuaauggagaccuguggcaguucauugcaugggaauauguuaagcacaguagugaaugcuguauauaauaagagacauuuauaaggcaaagaacaaugaaucauagaugugcuguuuuccugggcaaucuacuuccuaucaaagaguuucaagucauuuuacaauugugauguacauaugacauagaagaaaagguagagagauggcccauuaucucacaggagagcauccauggcgaacacaccucuuaccagauguucguucuggcugccucaugugccaguucucauggccuuauuugacugcugguuucuucaguuuucuccucguaaaauaagcauguaauaaccccgagagacuacuggacagguuauugaguuaccacacacuaaacaccacauagcuguucucagcugcugccucuguuguauguuuccgauaucuccuucugaauucuccucuuguaauaaaaggucaccuagagcguagacacuggugagagcccagacauagaagcuggaaguuuggugucuuuuguugcuguuccuuaacucugagagucuguggcuguagagaagccugggauauccuucaaagacaaguggcauuauugaagcaugggauggccuauggccugagucaccuauuuuguugcucugugcuaucuuguaagucauucuuagguucaaggcugcguuccuccaucuccucauuaaguugggauaaaacgucugucuuucacacauuggcaacauguaauucaugacgauuaagugcacauauguuccauuaguccuuguaacucugaggauuauuaugggaaacauuucuagucucagaucccauacaucuaaauaucucaccucaguccucaucagcacaguuaacucaccagaauaccugaagauacagagauugucuaucaccuguggaagugggcagucugauuguuugugggcagugggugacaugcgugagauggcagcagaaggaaauuccugaccugugaugugagggaagcuggauuagaacucugaggaugcugaacuccagcugcaaagacugagaacagagaggguccaggccguugcugagugcuggggagaugcucagcagacugcacuugguggauguccacacggugcuuccuuccaccuugucccguagugccuguacgcuggaguguccaucuuuccucuuccucagccagacauuuggaauauuuugcuauucugcucacccuucucuuuuccuccugcauuggcucauucuuaaaaacaaaacaaaacaaaacaaaaaccaaccccuuuuuagcguuugaauauuuaucuaggagaucacuucucaggcccacccaguaaaucacauaugcccauacaaauaugcacaugagcauauacauauacacagacacacaugcauggaagucccuguucuaugaaguucucauucuagcuugaaacaggaaaagaagaagacaucuaguguguucuugaggauuguuacggguuucuccacaguuuaguuucuccuucuaagaccugggagguuguaugcucauugggcauucuuucaucccugggacuuacuagucuaauugccuaaacgguacaaaccuguuuuuuaaaaacggacuucagacugucucuuaagaggccuuauuuuuguaauacagugaaauuucagggaaaaaaauguuuaaucugguauuugcuaagaauguugucaacauauuagaaugugaagguggcccuggcuuuuaguucuuugugcuggaagggaaagcagagauaaguacacaaugggaaaaugggccacauuugaaguaaguaaauaagaaaaugaaggauguuauuuagcuaugcuggaggucaguuuccaaugaguucuguuuuucugugggguuugucucugaggauauaauaaauaguagguagguaagcuuuauacugagaaauauuuaaaucgaaaucaaaguggaggaaauguauguuuugacuugaacacguauguuugauuauggggcaaguagaaaguguugccugugagaauuuuaaaaugucugugaaguuuuuuguuuuguuuuugaguucauagauaaaaaaauugcaagcucugucucucugauuuugcucguguuacugucuggcuuuuaaggcaauugcuccuuuucuccuucccuguuuaacauaaacaucugauccccuugaauauuauguaaaaggcuguaaugcagccugucucaagcuauggguugugacccguuagaggucaaaugguuuguauaucagauaacccugaauaucagauauuuauacuaugauucauaacaauagcaaaauuagaguuaugaaguagcaacaaaaauaauuuuuaaaaaaagauuuauuauuauacauaaguacacuguagcuaacuucagaagcaccagaagagggcgucagaucucauuacgggugguugugagccaccaugugguugcugggaauugaacucacucaggaccuuuggaagagcagucagugcucuuaccugaugagccaucuugccagcccaacaaaaacaauuuuaugguugggugucaccacaacaugaggaaucuuauuaaagggucgcagccuuaggaagguugagaaccacgguuuguagugguaucugggaauuauugaagucuguuuccucaguggcuguuuggagcuaaaggaccuaccaggaaaaguguaaauacauguugugauuuaauuuugucugguauaaaguugacaguuaaugcaucaaaagugaccucuuuugcaaggcaguuauauugaaaucugauuuugaacauauuuuauuuggaauguuucccuuguuacauucccuuguauggugcugggcaagguucacuuaaaaucucagcacuuuggcaaucugaggcaggaggaucaguuuggguuugaggccaaccuuauguaaauaguggauugcagggugaccugggcugcagacugaggccuuauaucaaaaccaacgcaagaaguaauacguuuucuucccacagggacucccucuuucucacuuuaaagcaacauugaaaauaaaaauaaggcuggugugaccguucauguccuuaaucccagcacucaggaggcagagguagaggcagagguagaggcaggcugaucucugaguuugaagccagucuggucuacagagugaguucugggacagccacagcuacacagcgaaaacccugucucaaaaaaaccaaauagguagguagguagauagauagauagauagauagauagauagauagauagauagauaaaguuucuuugacaauuuuugaagaaagaccacuaagacagugggaaaacuacagugucucauuggauuucaggaaaccuuuucuuuugaaauuguggguaggaucccagccccauccugguucccuuccuacugcacagucucuuaucuguguuuauuuucucaugcagcuacaacgcucaugaguuccaaguaguaggagaagaaaaagccuucugauuuuacacucagugugaaucacuggcucagaaaucauaaacugagauuaaaaaggaaaaggcguguccacucacccugcuccauuaauguaucauaaacuugcuucagcauugcaucuucaucucaguuuguauacuuaacaauguguauuuuauaucacuacaguagacgguguuuauucccuaaaaguaaaccaguggauagggucugcgugcuuggaaagguuugguguguuaguuuuuguggcugggucuagcuauguagcccuugcuggccuggaaauugccuuguagacuagcaggcuagccucgagcucacugggauccaagugucucucagaaauguuuuuagauggugagauggaugcauauaauagaaaauuuagaaacuuucugugugaggugauauccuuuguuauacaaggguuaauaccacuuagcucucugguaccucccugauaguggccucucuagaauugacuccguguguguuuuauuauagucauuuuaggaaaugaaauaucuuuuuaucaaaugaugaaaacguacaagaucaugagaauaagcuacuguuuuuuuauagggugugcuugacuuuguguagccuggugauuuuguucuguucugggucagauuucuuucuuuaugcacauagaaucguaggcuucucucauucucccccguuacagacacagcuauuaucaccuaugcugaggugacugaaaaagacuugccuuucugguugcaagggaacucugggagacagcucuuggccuccacuuagcuuccuucagauuggcuuuuuuccaagggcccauaagcaccauggugcgugaagugcuaaagggcaguggcagggucaggccguauguauugcuugcuagggcauguuauugaccaauaagaaguuaaauagugccuagcuacacagccgggacauugucuuuuaagcaggaaaagaucaccucaggccauuucccuuuauaggcaaguaugugaaacagaagcaaguugcacaguucuaagacuccuguaugccugauggacugcaggugugagagaugacugggauacuaggguucgcccuacuccuucugccuuuggaauaggacugaaggcguuuuuugacaagugcuugccugcugacuuuugcacccacuguuuuaugacuuucuugacucagcuucuuuuuuuuuuuuuuuuuuuuuuuuuuuuuauuuauuuauuuauuauauguaaguacacuguagcugucuucagacacuccagaagagggcaucagaucucauuacgggugguugugagccaccaugugguugcugggauuugaacuucggaccuucggaagagcagucgggugcucuuacccacugagccaucucaccagcccuugacucagcuucuuuaaggauuguuuaucuugaaauuuuuuguagauacacccaaacucaugacagugcuuugucuaggugagagguacgggcuuauguuuccuaaugcuaaccaaaugcccucccguccaucucccuuccuuuucuuagccccuucauaacaucuugucuguacacaauuuuuuuuuuuacaacuuucuuccuuugaaaauguaacuuaucauuuggugaugcaugagagauuuugguaccauuugaugcaauauaaguucacuuaccauuuugcaagcguuuagaggaauaaggaauccaaagaugcauuacacagacacucacacacagagcauguucuuucucccgcucaguauauagugaaaaaauauuaagguuuugacuuugugcugugguuugaagcuuaccucugagacuauguucuggcuaugaaaaauaaaauguuuuucucugaaguuuuaaaacaacauuuccauucgauuuucuuccuagguguaaagagcgccguucuaagccauugaaugcagaagcagaggcaggaggaaggaaaacaauaagaaaccaggcugaagggcucuacagauuaaaagcaccgccccacuggcaggcaccauacuagagcucuuucacugugguuccuggaauugaaguaucauugaggauuaaaauugugggagucucacaaaacucagaaaucacguguuuuuccaauuuuuuuucaaaagcauauuagaggauguguuuuuauggggcauugaucagagugcuaccagaaauccaaaaagaacgucuaaaacccuagcacagaugucuuuugguaucuauugcuuaaucuaauucaacauaucuaugaagauaauaaauagcauaugucugcauuaaggccugguagggagugcagucuuuguguagaccuuuagcuuucaaugcuagagucacuccccccccccuuuaaaauuggcauaaaauauugacuuuuuuugguuuuucgagacagaguuucucuguguagcccugggugcccuggaacucacucuguagaccaggcuggccuuuauugacuuguuuuuuuuguuguuguuguuuuuuuuuuucaagauauuauaugauuauguuuucauuggcuuagucagugggagauguuuucugcagaacuggauugcuuuagcucuaaaguauggguuuucaaacauucuauggaacauuaaauuaaagcacccaaaugccugugugaugcaugguuaaguaacugcugguuuuguccuuuuuaaaaaaaaaucuuccugucauucaugugacagacucaaggaagaggaagaguguauuacuuuguguuccuagauuggguuguuuguggcuuuuguucuugacuuucccugcagcuuggacccuuaggaagcaaugaucuggacuugacacauguuagugacuucuguacuuccagcccuucugccucuguuuccaugaaaugggugaugcauucaaacuccuauacaguggaugagcuggucuugaggaacauguacuuaggguucuuuaacaugcucaucucuucuguguuuguauggugggucuagcgcacuuucuuauugaugauuccugugacucccuugacaaaaaauccucucccucuggaaaacgccgaaucaucccuagucaugaaggucaccaggguccugucuugcugagaagacccuuugcaaaaacaaacuugccagucaccaaguguaccauaggauggacucagcaaaugugguucacuggagaggaggccccaagagaccuuggggaauagaagugagcacaaaugaauggcggcuucguacucaccauugguuuucagaguggugaaugggagguggagaugaagcaaaaguccuuaugcuguccuguagauucucauuagcuugauaagggacucgcuuauuaucucuugacauugaagaggucagacaugguggugacagcuguacaugccaggauggcagcauguguaucauuugaccagcauucugaaugagugccacuuggcaauggugcugcaaaaggcucagugaggaagagagcauggugggagaugagguuugguaucauuuagaaagggauccugguuagcuccuacccuuuuguggaauuucuuaggccaagacaguuacuguuguuaaugauuuuagaaagacguuaaccuugggguccugagaacacacacagucauuuguggagaacacagcauuuccucuaggaaggagcuggcagaguugagugccaugaucuguggcuuuggguccugagugacuuuucaccagugugggugaguacagcauaaaggaagacuuacucugguuccuggcaucagagauugaaccugcuuggacuucucagccucuagaacagagacacaggugucuacuguuuauaaaugaccuaguuugcuauuuugcuauaucggccugaaugaauuaagaagccaucgaagcagacguggccuuuaaaaaugcuugauacacaaggggaaaagggcuuuauaauucuguggcuucuugugcacuaagauuuuaauggcauaguaagcuauacuuaauaacuuauuaaaaaaaaaaaagaaaugagcuaaucugaguuaaugcuuucagacaaaggaugaaauagguugucucccagucuguguuccuacuaaaugaugcaaaauguaugugucagcuucgcuggguuaaguuuuuaucuuucuugaucucuuucuguaaccaguuuucuucugaguuaauggcauuagcuacuuguccuuuggucuauaucaagagcugacaaaagaugacccauugcccaagucugaccccuuacuggaagaaaaugcuugacucuugucuauacugaugacuuugagguuuuuguaucggccuuuuccuccuccuaguaagcaguuacaaauccuuccuuaaagagggcuagaaacccgaauguacugucuucuaguugcugcuauagagagcugagacuccuccuuuuuaguguacaauggagauuuauaaaaaacaaacaugcagggugagccugguggugcacacuucuaaucucagcagguggaucucuauguauuugaggaaagggaguucuaagcuagcaaagcuaaauagagugagauguucacucucaauaaaacaggagauaaaaagcaagcacaauauggucauugugccgugcugggaaguggcagucagggcuucaacuuuaucagcccuuuaguguagggagagaaagcagaaggggacuucccuuucccauaacuacugacuuucacugcaguuggggcugaaccacggugaucuggaucguggacaucuuggcaucugauucuccaucuucagagcuggguaagaucaugagaauaaaaucaguguucagcaggcugggucucagaaaagagcacucauggaaaaauuuagccuuuucuucaacaaaacaaaacaaaaacauuaguugcuuggcucaggguggguagagggucagugaaagaggaauauucaguugcauuacaauaagccauuucaaaaaaccgacuguuucccauuugcuugugguucuucucuucccuuuuccaauuuacuugaagaacuguaggaauaauguaguuuuacaaaaugucucagauguuccaauaugaagauuuguuuucccaguuacugggcugccucacaaauuacuauaugcuuugccagcacgaacagcuguuuauuacaaugauggauuuaagagaggggagaacauuaaguauuaagauugcagauaccuuugcuuugugccguucagggcccuggcugaagagcaugggugggguucagcucaucugaaguuauaguaauagaaauucuuaugccagggugguggcgcacgccuuuaaucccagcacucgaggaggcagaggcaggcagagcucuugaguuugaggucaaccugaguuuuagaaugaguuccaggacauccaggacuacacagaggaaucccaucuugaauacaaaacaaaacaaaacaaaacaaaaaauacaaaaugaaauaaauaaauaaauaaauaaauaaaaauaacggugugacugugaccacuucuuucccaucacaaaauagguuuuguuuuguuuuaaagacagcccgucaccuggcuguccugaaauuuauuauguagaacaugcuggcuuugagcuuacagauaucugccccccucugcuacccauacuaggaguaaagggagugucacagugcucugguuuaaaaucuguguaguauaguuccuguccuacuucuuguggugccaagaguuuauacaaugccuguuugaggaaauggagugacacagaccugugaucuucaugguaauauauauaaggguuccaugcagacaagcacuaggcuaucugaacaauugauacaguccugagugauugauacagcacauacagugugaauaugcuggacuaauucagaauagcacgcaacaaaacucuuggagaugcucauuucugaagauuuccauugaauauauucuguuguuuucugcgggcucuugaagcuuuggaugaugggaguuagcugcguauuugcguuguccaacaggguggcuaguagguacacaggacucuugagcaauuggacuaugagccaugcaaguaauuaauuaauuaguuaauuaaucaauccaggucaggggcagcugccugaggauucccauugcugaggaaugacaaauuucuagauagacauuagagaauguucauaucugcaaccagucuggcacaguucuucccagcaacccaguccagacauucacuuguugauucugcagacagugcauccuguguaccagacaucauuaacuuagaagauggcaguggacaauaaggaugcuuguaguaaaguagaugagaagguaagcugagguuucuauaagaccaucuauaaugucucuggcaugguucugugaggaaugcauacaagggauaacugggucaaacauguaagucccuuugagaaaguguugugaaacuggaucuuagcucuaagccagaauuuuaaggcauuuuucuuagagguggguccuuuaggcaauaaggaaaacaagagauuaaaaaaaccaaacacaauaugguucuugugccgcacugggacggggcagucagagcucaaacauucucagcccucuaguguggggagaggaaagcagcaggacaacaagcuaagcuuuuuucuggagacuuccccaccagacaaugcuuuuuuuguuagagagagcacuguaacuuccccagccagccacaucuuucacuuggaacgagcuuccccacccacaccaugcauauugagaaccaggaacauacccagcaggucaccaguccagaaaaauccauagcucaaggggauaucauugaugaauuacaggcaaguugccugucagcaggaaacauggauuggauuagagacuucuucuaccaugcugguuuuucuaaagaagaucuggcuccaaaacaaagaugccugaacacacggucagcacugaaaacaaauauugauuggcccccccguggaggagccaagcuagagugggucggaggcugaugucaaaaagugcugggguguggaaaaccauuacugugcugaugggucagaaugcuagcuccauuuauuuguaagaucgcaggagugggaggggauauuuaagugguagaaggaggagggcaaaggagaugguuuggguggacacucccgugggccuuacuuccuaugggcccguccuccuuguugccugcucugcauuuucugacucgaucccuucccacuccccuuuaaaagugcugugcaagauucacuuaauugaaagaauauguccaaacagcugaugcucuguaauguuuagauucaggauucagaccauaggcuugguguucuuauuaugccgguaggaaaaaaaaaaaccaugcugguugcaucugauuucaucugucuacuggguuagaaguacuguggucucugccagauguacgagauacuguaaaaggagcauuuucucuagugaaucagucuuccuagcgccguagauguagcuugucugaaacagcuuguuccucuguggacgaggcuggcuuugguucagucuccucucgugaaauguagaacugcagaagcccaaucuagaguucuuucaaugaagacaaacaaacaagcaaacaaaaucuucaauucaaagcuugcauugaaaccuacgguuuuguugcacauggagagcgacauucuccagaaguaucucuaaugguggaauauucuaaagguacagggcaaccauuagccuuggguugauauugaauauugaaauguaaauagugcgaaugaggucuaaauuccuaaaagguagccuugcgugguccgccaucccgaagcccagagcuugggucugcguuuagaggauguguuagcagagguagaaggagcacuuugucagugcucucacuuucaacagcaucuccguucgagauucauaucuuuccuuccuucauauucuagaaagaagcagcgguggccaggcugccaccagcagggugcagggcugaggcuagagauugcggaaacugccauuaaaauacugccauuuuaacucugucguucauuuuccuaaagcacuccagccagacaugcaggccuuuggcagugggaaccauauccccuaccccugaggagccucugguucacugcaaugcugaaaguucucugucugacauguugacucagccuuaaauaauauuguuacuuaacucugccaaugaguagacauccagguuucucgggcuauacugcauaucccacaaggacagaggaacagauauauacguauaggccaugguaucuagcacuaauauggccauuucuucucuccauagaaagcauaugcaguuguaugcugaucaccgcugugccuuuugcccuugauuucucugagugauugaguuuugugcuucagguuggacaaacaccacuguuucucucuaucucaaacugucuuuucuuuguugaccuuuauauaaacauaagcaugagugugaauauuugcuuaguuauuucuccucuuuuagaaaguaguuucaucagcuagcagggucuacauagaguucucuguucacuuaucacuugagucaagagagggaaagagaaauauaaaaauggagauacacucucuccucauucucuuucuuuuaaauuguucaacaaguuauauucaggaagcauccgucucccaaggaaucaauauaauuugguuucugaacuccgcaugucucccucuggcuggaaggaagugguuuugccacccaacagaagugaaaucagcaagaugcugucgguaaaacggaaauguuggccuuuccaugaugacagaagagcgguagcaagugugugguuuucuguucuacugugccaccagugugggauaagaaacgggucugagaagagacggacaggggaugcguguaucaguguauauguggccuguucacugccauuuuggacucccagccucaucuucugcagcuuuagccccacugugugggagccaucuccacuuccucuuggcuggcuuggacuuuuggggaacauuccgacccgggauuucuaccccaccuuagaccauuuaaguuccuggaugaaagacacacacacacacacacacacacacacacaccuucauauuuauaagucuuaaacaacacaacagcugggcagcugccuaccucuaugcuaucagaaucuacuuuucuacacauaaccucgaguuguuacuuacucuauuuugucuggguugcucuuaacuccaauuggccagcccacagggccauaauuucuuuacuccuaacucauggcagcuucuuccucuuccuccugcacuucuccugguuccccuaugcccccaaauggcuacaucuaaaucccaccuaugccuccucugcccaucuauuagcuguuggcaucuuuauuuaccaaucagaaauaacuugggggcagggucauacagacucucuugucucugggcaaccgucuuggggggagaggggggcaauauuagcauuaaaauauacuauacauagcauuaggcuaacccacuacauuguacugauuguuuugucuagagacuuagcugugaaguuuuaaguaggugccugugcagagugucagccagacucugccucagcaggggaacuagaagcucagaaguccugggagaaaaacgcauggcuaauggacgaagccugaagccucuuguuucuuaagauucaugcauccugcuagaguagaguaaugggguuaggagaagauuuggggccaaagccuuugcauccucugucuaucugucuuucucuggcuuguugaaaagaagagguccaauggaggauuauuuggacaaauauuugcucugucuaauuauucaccuagagaagcuuuccugaauguuuaaugcaaagcuuaauauuuacaauagcauaaggaagaguuuauaauguguuggggaggcuuccgacuugaggcaguaauucuucuuugcaaguauguauauaagacugcuuucuuccuaagagacaugagccauauuuaccuuagccacuauuugaacugagaugaaggaagagggaagaaaacuccagagaaggaaggcacccccguaguccugcugcuaacaaguuuuacagaugcuugucuuugccagauauuuaacauguagggauguaaguacgcauucacaguuccuuccuauguaagggugacagaguugucaugggaccauacuugacugugauccugguaguggugcccuuauagaucuguuccuucuuuucuuucacccagccugcuucuaaccagugucaagguuuagugagucuugacaaagugacuucuagaggcccucucuguacauugcaaagaggcaugaugcagaacggagguugaagucuucuuccauaccauauguggcccuuaagaggguucuuuaccucuggaugccucacuuuccccaucuguaaguaggaacacuauccuaccaugcacagaugagaagugcugcaggccagcacugguuuucaggcucuuaccuugguguggugacaccuaggacaucuucagguuacauagaaagggcccuuguugagacuucuagcguauaucuaucucugagcacugcauuuagcaccaaaacaaaccagaccuuuauucagaggucccauuuuuccuagaacaagagauggucacuggcaauacuagcaaagugacaggcaugcauaugccaaagccucaaggaaaucagaugacagacagugagggacaagugaacggaugcucugucuacagcauuggacuuguggaccuaugcuguucugcucacuuacuauuggggugucagccaguggaaccaauacaaaugaugguguugaucugcugccgggugaguagcauaaaucauacuuagguaaauguauguacccucuacuugcuagcacacuggaauguugagauauagugugcuagauaauaugccugccugcuugccugcccucccucccucccucccucccucccucccucccucccucccucccucccucccuccucuuucuuucuucuuucuucuuuccuaucaggucucauuuagacuagauuagucuccaacauucuauauauagcuaaagauaaccuucaauuccugauccuccugccuucauuucccaacacauuuccuuuuacaccaacauuuguuugucuuuauuuguuaagcauggauccauagauacuguacccaacuguggagugguccuaguucucugagauuuguuuaaaugaagucaguguuuuguuuuguuuuguuuuguuuuguuuuuuccucugucaucuugaaaccaaaucuuccuuaauuguuucuguuuucuccagugugagaaaaacuaaccuaugcuacagucauuugauuuuuuuucuccccaucuuucauuggagcaaauguuuugauuuguagccucauugguaccaucugagcuauauagggagaaaacagccaucguccagagaggauaggauagcaucaguuguucuagagcauaucucaagguugauguugaaagucaagugcugguuuaacgcgugucuuuugagugguugacuccucagacuccaguuuugcaguugguaaugaaguugagcaggcuucaccgaaguacgccuuccacgugagagacccugccugucgauagaccuggaguugguccauuaaaaagcaggauuaagugaguacuaugcacaccuucuugagcuguaggcuacaggagugagcugcacggcugcaaagugccucacacagagaguauaaccuagcaggaacagacaauagaaacaaaagccuacaucagccugaauaaaugagacugguggcaguguauggaaacagggacacccuagagcacucuuuuauguacuugagaacacaguaauguggcuuaaaucagugguggggcugugggggcugugaggggaaggcugagguggaaggccuggggagccagggaaagaauucauucuguguauuagagacugagcccagaccugcuaggucuugcuccugcuguggcuuggucugguauuuuuuaucuguucaaaaccuccauuguuuccuguucuaacugggagauacuuguaaauuccauaguuuucauaguuaaaauaauuguuuaguuuucaccuuuuaccugagcauguguaagugaacaaguacuucaccuuguuuguaaaggagaguccuuguuuuuuuucuagacagccacccgucuggcuuuaauauaggccggcaggaacccgugcuuaccuguccauuggaauccacgggcaauuugcauuaagcuauuugcccugcuucuucugcucuagucuuucuguuagacuaccaacuccuggagcuaccuggccagaggcugggauauucauccugcaggggcugcuguugacucuugaaguggaggaugccaaaacaugucugcugaggauagaggguugaaauugcagaucuggucuucuuccucccguaccugguggguuuugauguuuucucuauccucaccaucuucucugaugcucuaguuucugguuagcagaauggcuauccacgugagaauacagagacaucuccugcaucagcaucaccugagacaauucuaucaauggcucugaugcucugaagcggugguucucaaccuguggguuugagggucacauauuagauauacugcaugucagauauuuauauuacuauucaccacaguagcaaaaucacagcuauaaaguaacaaugagauaauuuauaguuggggcucacuguaacaugaaaggguugcagcauuaggaagcuuaagaaagaaccacugcucuagaccuaguagauuggaauuauaaggacuggaccuagaaaccucuuucaguguaaguccuaauuuuaugaaccuugugcccucuaauuuugagaaucuuuuguuuauaagaggugauuuuucuuuuagaauaguaauaacagcuaauguuuacugaaggccaauuauuugaugauacuguuuuuuuuuuuuuuuuuguggauagaggaagaaucaauuuucaaagcaucuuugugggauaugcacaaagauaaucgugcuuggccauuggggaucgugauuggcucacccacaguuccaagucccaguuccucaacccucuccuucuccuauguucucccuugcauaaugguacuccaugaaugacucuuuguuaaacugagcaagcgcagugacuuccugcugugucucagguaacauauuagacagcauauuuuagcugagccuuagauuacaaugaagucuaggguucagcucagaguuugacugugucucccaagaguucacucacuuugcucaaugagaauccaugaugcauccaggcuuuucuugcccccucugagcugcuguguaccucugugugugggcaggugccuauguaguccugugccugcaucuggaguggcauccuuuuaauuggccagcacgugaagagguugaauccuucauccuucaacugacccugacccuagcuaaaaaucugcaucaugagagccuagguacgaaguuaucuaaauuguuuuccaaguaguuggugauugcuggaaggaguuuucccuucuuaacaauuccaguagugcgucugagaaaaaauuagcugcugaaauaggagcagcccaagcagguuugaagauaaaaaucaaccauuccauucauaguccuuucuuauuccagguuccucgugcuuuauaccccccaggaggaauuugcuaaggaagccucccuaauaacuucagguagagaugguuuucaugaccacgagugccucaccgagcaaugugaagaggaggcgggcgccauucugcucagauuuucucaaaccuccaggguuaugaacuuuucaaaaagcauuucuuauuucucaaagugaauccuauuugccuuucugaaaguggcuugauuuguugcaaucacacuucaguugugcgcacaccgaaagcaacaaagccuaauuuuuacuaaaagauaauuuuaaacaagucuuucacauucaacaaaggucauuuugguuugguuauggccacucaagauucaugauuaacugucccauucaccacuggccaaauguucccaugucuuugguauacauuuugcaagcuguugauaaugagaacccauggggcagccaggcaaguuuucagaaacagagccugugauccugugcaacuuuugucuggaauguauuuauaucacacauuacuuugaguuucuuuucuguauugaaaggcuguuuguugaacccaaguccuuaggagauauaccaugcagaucuugugcuagguuaauaagcuuugguccugcacuuagccucgauguuauucuauaugaaagaagggcacaaagggguagucgaagcugagucugggauacuuauaaaccugaacuucucaaaagaaucaaguuuaaccuuuuuuaucacauacaucuccuucuuagagauguaucauauuguauuagcagcugcauagaaggaagaggagaugguaagaagaaaggaaaaagucuuaggguucaugccugccacugccccaauagcaaucucaaacccuaauaguauuuuauuugauacauaaauucuggagcauacauacauacauacauacauacauacauacauacauacauacauauauaucuguuggauuaugaccacaggaaaucccugauaguuacauguuuguaaguuccuuacguuugcaguuugccccaauucauucauugaagccauguuuuagagucccagugcucccuguuggguggugucucagcgguuagccuggccaggguuugggugguugucauuuuaggugcccauuuuucugagcaaugucucugcagaugugcaagaaaucuuguugcccagaccucaggcacaggcuucucgguucuucgcacuuaagacaaaucagugugucuccugcugacggccagcuuuucugaaaugaaaacaaauauaauuuuucauuauaggucucaggaaaggaacaggcagcacaguguaaauacuuauccagugaccagaggcccugugagcacauggagagaaacacccuauguagaaguggauugcaugacauaaggaagaugcaggagauagaagaaagggggcagaggguugaaagaauacagggggaaaaaggaggaagaaacuuucuuuuguuuuguuuuuuuguuuuuuguuuuuuucaagacaggguuucuccguguuacccuggcuguccuagaacucacucuguagaccaggcuggccucgaacucagaaaucugccugccucuggcucccgagugcugggauuaaaggcgugagccaucagugcccagugacaccagguuuugucuccagugaagauaagaggcauugugcaaaaugucuguguguguguacacauaaacacugguguaugcucacaggcauucacccucauguguagucuuaggauucaucuggauuaucacagguggcaagaguuuuauaccuuuuauuuccaaguagggccugaggauugcauuuugacuguucacugacucucuuuauuuucacugacaguucuuacgguaacaucuacuauuaaaucuucaaugggucuguucaagaauggccucacacuuaggggcccacgguuuucuguuuugguuuuuaugugcaaaaaagaaacccacuauucagaguugcagaaacagugacauggaauucaauucuauggcucaagaugaagaacaugagacaggaggaacaguagggagagagaaagacacacaugaagcuguaguucagcacugccaaaaccaaagccauuucaaacauuucagacuugccuaacucauaauaugacaaacuaaccgaagaaccagaaauuauauuaccuugaauuaggaaaauuuuaaauccaaggaaguaaaucaaagcagcuacccauccccaucacguugucuuuguccaaagcuggaaaaagacaagcggacagaauuuguauuuuuucgguuuuuaggcagaauucuuuauuuugguauuuuccauguauguguguuugugccuaaguguauaugugguccacucgugucuguggaggagcucagaggaauuagaagaggcuuuagcucucagagaacugcagcuaaggacaguugugagcugucacgugggguccaggaaccaaaccccaaucuucaacaacagcaacaguucucuuaacugcugagucaucuguuuaguccugucugacucuuuauuuuuuuauuuuuuuaaauauuccuucuaauaucuuuuccauaaguuucucauugucucagggucagaucuuccuccacuuacagcaaccugggcguguggaugagaguguuaaguacccuacuuuugguuauucccaugugcucuagauaccuaguggacccguuucggaugcccugccaaugucgagccaugucuguguaaagugcuuugaaggccuccuugagggacugacugagcuacaaggugauaacaggcaagaucagugccagcuacaggcuuucucugauaucaucaggagagagagagagagagagagagagagcagcugugauuuguagaaguuguggagagaccuggcuugugcuugcgccugggagagcuugaaggggaguggggaggacaugggcuugcuuaguaguccagaguucuucagcucccugugugcuccagaguucgauuuagcaaucguggacuccuuuuauuaugauuuuguuccguacuuuugaugcuuaaaguaccagacaacaguuacugugaccugauuuauaauucuuggggcaccugaaaaggaaguaaugcuuucucuucccgaucuacccacaagaccguuccuuuugccucagcuaugcuuugaugugucugguagcuuuuccuagcccaggcucuggcuuuucuucuucuugagcaguuagaaguagcagaaguagucaccacuaacuuugguacugucuccuucucguauuuugguuucaggagauugguuggcagcuucuuucagcuccagcucucauacacacccuugagagucuggcuccugucuuguucugccuccagcccuccucuacucuguuuaacaccaaacuccccugaugguccuuuccacauguuaaagcuuaucauggccucaucucuuagaacccaucuuaguggcuucucuucugcaugauauagcuuuagcuacuuuucaggccuggaugcugccaugcuccuugucauggugauaauggacuaaugucugaaacuguaucucaagcucagcuaaaugcuuucuuuuauaagaguuaauuuggucauggugucucuucacagcaauagaccaguggcuuagacucucauagacccuacagaaacagaguggguucuguuuuguccaugcacgcucuaggguuuaguauauacuuguuaccaaagugaagaguacguucuuguauuuucuccuguaugcuccagggagaagagucagagaagacagccauagagcugaugaaaagcacggcuugagcuugcucauuacuguuagcuuuggaaacaauggcuugcccccuucucuaacccuuugaagcaaaugcacacauguguucucauugcauggcucuaaauguuuccauuaaaacgguauuggacuguuugaugucugcaauauugaccuggcuuccgccaagaccaguucugucuuuuuagugggaaagggagcuauuaagugcucaugugugacguuaaagcuauuaugucugaguuagcaaauacaaguuuggauucucuaucgcucacucccucuuucucucccucuucuccccccucccccuuacuuguccuggucacuaaggcugauauuagagacucuuccuaauauacccuggaugaugguagcauguugaaaaaagaaaaggacaaaucauaucagcuaccccuucaagaagaucauagaucuuauuugggaggaagggaaccuuaagucaaauuauugaaguauguagaauauugaauuuaagguuuugugaccaacuuugagugaugggaagaagucaaauucuuuuuuuuuucuccccccccccuuuuuuuuuuuuuuuuuuuuuugagacagaguuuuucaguguagcccuggcuguacuggaacucacucuguagacguuggccuugaacucagaaaucagccugccucugccucccaagugcugggauuaaaggcaugcaccaauuuuuaagcaacuuuacaguuauuugugggggggagggaagggaagagagagcucuuccucuccuagaaaucagaggacaacuuccaggggccaggucccuuucuuucaucauguggcuaacgauucagguuuggcagcuugugccuuauuuugcuuagccaucuuuccagccugguagauggaauuuuaacaugguccccaagacuuccauacucuacuagacucauacucuccaguugucuuguugaauaaacguauaagggcuacuccgaaaggaugauuuuguagauaaaauuaagaccuuagagauaggaauuaucuauuagauuauugugacgagaccuauccuauucugaugaucuggagccuucagaagguacuacauauguccugcagauaaggauugacaugggcuggagcaucuccuugcuuuuaaaaagggagagaguggacaagaaagucagguguccucugauagcagagacuagcuuuuaacugagggcaauaugcaaacagagaccuaaggaauucugccacaccauuccuagaccgagacccauagcuccaaaggacaacacaauuuuaacuauaccuugugcaauccugggugguagagucagccaaauugugucugugagccaacagucaguggguggucuuuccaguugcucuguuuaugguaauugauuaccuuggugauaaaaacaaaacgugugaauucuaccgucuaguuguuggauauguuggaugaugggggcuggggguggcagcggguaguggucaucaagcuagaaaggggcccaggagauggggaaaaacagaggcuauaagggaagccaugugagcaauacaagggccauugcugaggguugaggaugauaguggggcaggggcagggccaugccgaugggaggacaaagaaucaaccgagucugaguauguaugaaaaugccauaugcaaaccuguugcucugcaugccauuuaaaucuuaaaaauuacagagacuauaaaguucuuccuuuaaaaggaucuguuuacaguuucuguaagugcagagagccggucagugccaaccaggaggaacuaucagcguugcuugccuugcuccuuagggacccagugaaaugaauagauaaaaagguuuuguaauuaguagaucaacuguuuauaaauuaauggguagcuccaaaguacuacaggggacccaaaauaguuucugccaaguguuuuaucuauucuuggaauggccuuauucaugcauuauaauuugcuuagccguucguccuccauagacagcacaaagauuaguuacaaccuccucuccuuugaauacuguaguuuccuuauuaguaaagucaaaccugauaacuuuuaaaaacaaacaaacaaacaacggcagcaguuuaaaaacaaaaacccauuuaggaacauuaugaugucugcagacauuuuccuacggacauaauacucuuuaagucuguucacauccucauggcuucacucuugaggcguaggcucacccagccucuggauagaagacaccauauuugggcagucaauaaaccugcaaauggucccuugaaaaggaagcuacugauggaucuggcuuuuccaugaaugacagcauagccacagacagcagaggaccgcuuccuggcccacagcaaacaccacccugcugugcagucccugcauggggcugcccucccagcagggauguguguuuccccgggugccugaggacugcagcuuggccuuuuuguuuacaggagagaggacagugaccucugucuuccagcugcugugaaugaaaacaguguuggagaaccagagugaaguuuccacuuuacgagucacugaggggggaggggggaaggaaugggcaaucuggguggggguggggcauauucucaaccuucccuagugaaagagugggugggauaaaguucagaccuuuggauuagaacacagaugaugggaaaguggaaagagacuaguucuucagcaaacuuucugggcaggcuuuccauauauugaguuuggaagagaaacagaaaaggcauacacacaguuuguaaggacuuacuuuuucaaacaguggcauuaauuguguacgcuuagggaugggauucuccucucucaaggucucucccgaagagaaacagcugcucauuagcuagcuuagugugacuuaaaaucuggaggcuguucagcacugcuguguggcuguuucucaaguuuugcuuggugguaaccgucaaagagaagcuccuguccagggucagggaauauggacgggguggaucccuccugggucaccaccuccugccaggaagcaagcuguguggaagcaagcaguggaagcuugccaaaaagacauccugaucucggcacuccuggagcuugcaaauaccaauuauuuucaauugaaaguuaaaugcauaauuguauacuguaaccuuaucauuagaaauuugcaacguuaccgaugacacagacaggguacagugauucaaaaauaccuggguuagucagagaggcagugguuuuaagcucugacaauucaagaaggucuccgaggugguagcuuuugaacggagacagaaaaucaggaugaaucggccaugugaggagauggggguagaguuguuccaaauaggcuggauguaggcagauguagaccaagaggucaacaggaacucucugcacaugauccuuaugacccuccucuuuucuucauucuucuuguuuguuuuuguucguuuguuuguuuuuuuaauuucuuagauuuauuuuuauuauuuuauguguaugaguguuuugacugcaugugugcaccgcuuucuagcuuggugcacgaggaaguggugagccuccguguaggugccuggaaucaaacccuggucuuucucaacaagugccccuaagugcugagccaacucuccaucccagauccacaggaucuuucuucucuaagguuacuuuagagcccagguacaagggagacauggagguacagacucuguuuugcauuuuaaagaacugcuuguuuuauuugcuuccacuaaccagcuuccuugguccccccucccuacacuuuccaucacccucuuuccuuuuggagucuaucagccuguuuguagagaucaugugaucuuuuugcauuuuaaccuaauaaagcaaugucuuacggucagggaccaaaagcugggccugucacuuagaaucccuucuacuuguccaaguggcaaaccucggaagcuucucugcucugauauuuugucuccuugggucuuauuauaucuugcccuaucucuauggcaagauugcagggaauuaucaaaccuaaaagcggucuaucagaagugcaguuuccccucucauacuuacuguaauguguggauuagucauggaacugguugguuggccacaaaccagaccuagccuucccagugucucuauuuucuggagacagucaguagaaauaugucucaggaggucagcacuaagagugugacucauguagcuaagacucaucuguagauaaacacuucggagcuucccuugcugucccaccacauccccagagagaaacagaaccuucuuccugucccacuccccugucucacuuucucguauugaauguaagacuugcauuuacuuaguuaauguuuguauguggacacacuuuuuuguaccgugaagucaguuuucugauggucagagaacaguguuggggaguucuuucugucuaccuagugggaccggagaucaaauguaguuuguuggccuugcuguccauggccuuuaccugcugagccaucucaccaacuccacgguguuuccucucccuuuccuuucuucuuuuccuuccuuccuucuuuauccuuuccagaguuguaacuuagagagaaacuuucagauaagaaguacuuuugcauaguuaaauacaaacauuggacuccuuaauguaucucagcauuugaaauuaagauuccaaaggggagauuuauggcugggggaggcugauggggugggggguagggggggcuuguuauugcucagucuucauguuguaagcauguggaagaaggaugugugaaauacgaguaugaugauaugaugggagagcugcaaugugguugcuuagacaucacaaggcgaggaccgggacagacacucagacugacgcuagguaugaagucagguuggugguagcauucccacucuacaucaggaaagagacuccuucaugucacaggaagcagaaggccugcauucugugggucucuccagacagacccacauuucacagcccuagacaaugacuguggugacagcucuuucaugugaaaggaaaugaaggccagggcagcauggugucuccauuuacuccuugguugaauacccagguuggggacuagcacuacuaaggaagaucugcaguuucacuggaggagagaagccuaaugguggcuggcuucccccugagccuucagguuugaaguauuuugugugugcacggcagagcacuaguguugggggcggggguagaucuggggcuacuuagaugaacugcacauuguuucuuccucugugggucaaaucccaaaccagacagugauuuagggaagcuaaaacugaacucugguugacagugcuucgugauacaaguauuaaucugcccugucuaugacaguguucauuccuuuuuauggaagugggugguugcggaucuccauagcaccucaacucauuauuaauacucacucugauuucaucccagaauuugauaauucccuuuucuacuaacauuaaaauaucacaacagagaaaacaaauaacccuaccugacuagggugugugaaauccucuaugaacaggcacguggagacauacuagguagaugaaaagucugaggucugaguacuuaauucugcuguucuguguaucucaauaaaaacaccaagaccccagugucagggccgugcucccuccucgagucagaccuaggauaccuauagcugguccuuacuucucuuuuucucacccuuuauuccccugguuuuuaccccuugucacuacauaggagaaaaagaaggauagagggagagagagagagaucccuuaaucuaauuuguuuccuuuuguuucgucuuugaaagacugcuaauaaaccacaucuaaccuucucugaaugaccaacaaucacccccgcccgccccccuccucccccccccucccgccucuggggcccuagcauuuacauauccugugagaaguucccagaauuccaaaugucacaccaugacaaaacaacacgccugguagagcaugaggcaaaucauagucagcugcuguggucagcccgaagcagcccuauaacgcacacaugagguuaaaacgaaaacauauucuuauaauauuucuguguuuuuuuaaagaaaccaaaauuccagaacuuucacagauaccagugcuaacaagucauuauuuuugcuguccauuuugcacuuucucccuuugauaggaucuuuuuccuaaagcuuaccaagggcuccccuuacccccgcuguccccuguguauuuugaaucuucuugauuccacuauuuuaugguuaaauuucccauuuaagauugaaaucuuagccgggugauuguggcacaugccuuuaauuccagcacugccuccauaggcagaagauuucugugaguucaaggccagcuuggucuacaaaaagguccagguuagccaaggcuacacagagaaacccuaucuaaacaaacaaacaaacaaacaaacaaacaaacaaacaaguaagugguugaaaucuauaucauuuccuuaacucauugaauuguaugcaaugccaccuguugaguacccggccccaugagcuuugaugaugccuauguuuuuauaauugccaguggauucaaauaaauaccguaaugccccuugugucucacucauuuguuuugcacauuguuagaguuuauacaggggaagccugggaguauguacucauuuggcuccugcuuuuguaauucagcaucacgucucugagguucauccaagaagcugcauguuucuguaguccauucucagcuauucccaaggaacaggaguauuguggcaacgacgacgaugcucuaguguguuuacccaugcuucucucacugaacauuccauuggacucugguuugggaccguuuaugaauggcgcuucugugcauauucugauacauaucuucauagagccaaacauuuauuuuuguugguuguucagcugcaaguagaauugugggugauuggcuaguuguauauuuuaaugggacauaagagaauuugauauuaaaaauuaugauucccaaaaggcuuuuuagaauauguuuuucauggauugagagagagcucugauguagaccugaaugcauuuuacuuagucugagauacucauuuugucuuuaaaguccaaaacaucuucccuacaucauguugcugucuucucugcuagccaucuuucuuuuccaguaucuagauuauuucugauaaaaaaaaauacuaaugugugcuuagaaucaucacuguccaaaucuugcauuaaaaaugacuccugguuugacauuggacuacagacaaguguaucgaaucaugugaaugaaaauuaaaguguuauaguaguugacuuuucaaauggguuauuuggauauccaucaguugugacgcucuaguucugucugauaccauaaagcacuucuguacucugaaugaagcagccaguuggaacagaagaaggaaccauugucugucauguucuuuaccuaggucccuccuccuuagaagucaggcuguggugucaggaacaaugucgccgccuggauguaagaaucuaacaacaaucagacaagacuuccugagguugugcgucugaaggaagagacaaaauuuagguaguuuuuuuggcgauggaguguuagagaagagucuguccucugggcaaagcaacugcauagcauccuuaagagaaaggaggccaugaaauggccauugucuucagcugucgauuuaagggcuaaaacaucauuuauugaccucaugauguuacugcuaucuacauuucugaaaugccucucacagcuaauuuucaaaccacaucagggggggaaaaaaacagucuugagauuuuaaagcuuuuaccuaaguggugaaucccagcuggagccucacuagauuucucuucugggaggaaggccauauugaauuggcccugauuuuugcuuaaacuagcuaguagcuauaggaacaagagccaugucgggacagcagugaaaaauagaaccuaggcauugaucauuuauggugucagcugaugagagcuaguaaagaaggcagguccagagagccaugggaaaugggguugggggaggaggauacuggggcaaguauagggcuggugaaggcaggugaugcaaccuuagggaggaugcuaacuaguuccauguuuuccccccagcuauauauucuuaguguaucuaacaguguaacauauaaauaaaagugaagggaaaggcuuuucuauugucaauguuaauccuagccacugauucccguuugaucccauugaaucaaaacuaauuaaaaauauuuaauguuuuuauagagugcgugcauuuugugugaguguguguauguauuuauggaugcaagucagugcaggucagagaacaaccugugaaaguucuuuccuuccaccauaugguuuccagggauccagguuugggauugucgaccuuuaucugcugagcgaucuugcuggccaaaccuaguuauuuugaagauaggagugcugcaagagccagugguuggaaggagauagaagcaaugauaaguuugcgauaaauacauccuucaccagcugaagaguggacagcugaggcuggucuguggagaaaucccucgguuucacuuuuccagucaccccuguguuuucuuuaacuugccuugaacaaaaauaccuacaccaaaaacuugaguuauaaaagcaguuuuggcuuuuaccuuucuuuuaaauguauuuuagauuuuuaggugcuaacuccccauguuaacuaacuuaauaauaauaacuuaauuugcaaauugucacuaacaccugugauacugcagcuugucaaagcuuuuuuuuucccuucacuugguggcacucauuucacuacagugagccgagccacacuugagauccaccaaugucucuucucccauccacucaaucagcugggcuuccuuccuuccuuccuuccuuccuuccuuccuuccuuccuuccuuccuuccuuucuuucuuuugcuuuuuucuuuuguuuuuucgagacagaguuucucuguguagcccuggcuguccuggaacuuuguagaccaggcuggccucgaacucagaaaucugacucccucugccucccaagugcugggauuaaaggcauaugccaccaccgcccugcuucagcugggcuucuaaaagccacaaggugaauuuacugucuuuuccacuuuuaucauuuuacuuuuauuauauaucugcgugauguccacauugagucaaggaaugggaucuucagaggagauuucauacuucugcauacaaguacuggccccuaauuccucacaaaaugaaauauuuuauugguggaucaagaaugaccauauauagcagcccuuaucuuggaaucuauacugcuugauuacuugaacaauuuaaagucucacuaugacaccaugagcggcaaguuccauacugugaaauaguucaagcacaaauuauuagggauauuuuauauaauugcgauguaggcuauguacauacaguauauaugaagcauaaacaaaauucuuguugaguccugucuuaaaauauccacucuuauaugugugugugcgcgcaugcaugugcauguguguguguucauauguucagagguauguggguaugcaugcaugcaugcauaauuacaugcaggaauuaugagguuuagaaccugaaauuucuagucucaagucuuuugguuaaaagauauuagccuguaguuuaugucugaaaacugucauugaagguaaggccagcauaggucuguuucaugguuucucagaugcugaugagauauauugagacuauuaaagcaagcuaugcuuucugccaucaugguguguguguguguguguguguguguguguguguguguguguaugcacgcacacacugugugagugcguuuaucuguugcccuggcauguaaaaaggcaaccagaguauaaugaaguugcuugcuugacacuuuaccuccuugugccaucugaucaagaacaauuucauuuaucaucgucuggcaguugaccuuucauguuucucccacuugcuaauuuuaugugugccuagcacucuuccuauucguuugcuucccaguagaacguguuucucggaauguuuauugcacggaaaaguacgcgggcagagguuauaaacuacuuccugugguguagcuucuuccucucuacuucucccucccucgucaugucuauuuugguuuccuucguucgaucuugaaguuguuucguguuauaaacgguccucuuaguuguccugcauacacugcuguauagaucuguagugccugggagguggaggauaaagaagggagugcauuugcagaagaaggcugauccuccugauucgaagcaucuauaauuuuuaaugaauuccuucuaugggguuuuuugcuuucuugggaaggaggagaacgcucauccaguccucucuuagcgagaguguuguguacaguuucuuuuucuuucaguugaauuauuaauaaucauagggcuuuauacagucaggguuuaaucuucauuaaugaauaaaacucaaagacugucuugacugugaaugggcugccuuuaaaucucuccucauagcucacccucuuccuuccuccagcccuuaacucugagacgugagugccuuggaaugauuuugaucauggggagcccuggcaguaauuagucccugcuggguuuuauggcguggccaacguuugucaugcaauucccacuucuggaauuugccuguguucguccggaauugggguuauguggagucagguuggggaaagggaauaauagcuucauuuucuuuccaguuugugcagugagugaaauggucagauuugaaaugagugcagguggcuggcugcaggucacucccuuuccaaacaggaggagugaagagcguuagauuuuucugaaaagcggagggcaagccugcacaggugagcgcccgaagggugcacugugggcagacaccugggggccauuccuguucugcaggcuagcgcugggcagcggaggguuuguguggugaauggagccaggggcgggcuguugucaccuguucuggccuaagaaccacagagaguucugggagauaacauuuccugcagcuggcucccagauggaaaaacugaaaacgccccaaguuacuuauacuuauaaaaaguagaaagugcugaaauuuuacccucugucuacagugagucagaggcacuaucuauagugaguucaaaugcacauucuuaguuucuuuaaguuagcuuuugagucuuuuuguaucggguccaacuuccccaaucaccuggauuacagugaauucaaaauugauguuucucuaaagguuaccuguggaaagcagggaacuugaggacuacaugagagccuuggcugucucuguccuaugagcucagaagcacucgaguugggggcucaaggacaggccuuucggaaguuucuauuguucacagaugaccuugcaaugagaccccuuuucaaugcuccaauauagaaauguuauuuuggagaagggauagccgucuucacagaguaccuguucgugaauuuucucuaagaacaacugcugcuuuuguguguguguguguguguguguguguguguguguguguuuguuuuguuuuuuugguggguggguuuuuguuuuuguuuuuuguuuugguguuuguuuuccuugauugacacacaggguaacugguuuugagaguuuuaguguuaagguucugguguuguugugauggaaugagaccagaacuggcuuucuuucuuccccuccauaguucauuaccuccagccuuuuaaaaaucagcucaucacagcaacuuggauccauuucaauccggucagugacccuacacucaacauaaaagaugaauccugggagaccagcuauucuuauucacacuuauuugaauguugaaaaaaaccaaaacaguacauuucuucagaguucucugcaggagguggaacuauucaguaagcuguauagaaggguuucuaucucauacccccauuaccucccccccccccagccccaaacauacacagccuaaguguucaaaccugaaggaggggacuggcaaacaccuauaauuuauguagaauuugaguauuuggaaucaauuuugucaacuauacauugaaauagcuguguaaauguuaagucagaggcucugaaugggcacuacaguaagagaauuuguuauuuugccauugggguuaauguauauaauuuuaaaggcgagacguuucccucuacagcacagagagacacacuaggugucuaauugcuugacgcauacaguuuuacuuuguuuggauuccaaauaacugggcuucucgggaaagccuuggccccgccuuaggccuuuggucauccaugcagcugauuugcuuugucccgucugguucauuugucaaagucuuuucuugucccaaggaaugaugggcuccuuugaaccagguuugcuuuucacguuguccuucuuuugcacaugacuaaggcaugaacuucauuuugcuagaugcugugaggccccagaaauaaggcaccuuccccuuagagcgaggagauuugaggugacacagacccaggauugaacuucagaccugauucuuacuguuccacccaagaugcacuugaugguaucuauuaagaugcuaagaggcgaugagauucuguuuaguaaaauagccagaauaugguacgguauccacugucauucuuauguauagcucuguagaauucuuuguccugcuuauugggcaggugacuuaauaauaucuuuguacggucuucuuaaguuauugaaacucucucuucacuguccuaaggaauggcagcaaccaugaauagacaucaauaaaugucaaauacaauggguccuguuagcaacagcaaugguagcagcucauuauugcaggggauagugggccuaguuacuacauguucaccucuuuugguuuguggaguuacccacaguuucauaagcauuuaacuuuuauccuuggaauguaacuaguuagauuuaaucuuacguuugauauuucuguuauuuuguuuuucccaauucuuagccaguuuuuuuugugguuuucaucuugaacguauucuccgaugauaacugagguaaaauuuugagagugccguuuaaggacccccuguuuaggacuuuucuuuuuaauuucaugacuccuuaugguucugugugagaggaaagggaauuuauuuccuuggccaccguucaaaacaaagacuaaugacacaaaugagcagaaacagugacuuugugagugacagguggggccuagccacagcucucccuuccucagaguuuucagguacauucugggaaaguuagcugaauucaaaagacucaccuugguggggucaccucuccgugcccagcacaaaacggcaaggagcuuuuccaucccauaauucucccuuucaugauuuucucagcuggauucuucaaaggcuuauuuguaaagaccuuuaugguguguuaugauuuaaucagauguagcucaaauuucccaagauguguuaauuauccuugucaugcaagugcagccgaggaagcaaaaugcuuuucauuuggauggguugaggguuuguuuaaaauguacuuagggccauuaggaucaaaucaaaacauagugcaugguaauuauguauggaauaaaagauuaccugccguuuaaguagccaguuucccgaucagauugcagcaaagucuugagagaaaauuggcauccccauagcaguagaauacaggagaauaccuuauuuaaggaacauagugaacuacacuagucuacaaaauagaaaagaaaaguagguuuuuauuauuaaaauuauaaguggaugucaucgacaaucuuaaacaaaaguaucagcuucaucuuuguuugaucauaucaagaaugcuugguguucauugagguagcugaggaauugauguuucagauaugaugaaauagagaaaagaauaaauccguuaugacagaaaggaaauacaucugugagccuuaguauguuaguugccauagagccgagcuucugaagucaaagaaagcccaaaguuaaaacccagucucugggcuggcugccuggcuggcuggcugugugagcuccaugucgcuuaacagucaguuucuuuaucagugaaaugggacauugaccuaacagacccuguuauggagguuaagggaaacaaugcaugcaaaguacuuagguaaauacagcagugauuuauuacuagauuaauuaauacuagguguugcuguuagcuugccaucggggauauuguuggaagaggaggaaauugcaggagggaaaaugggaagcuuuggaggucugaacaguucucauccuggagagagccgggcaaccucaagcgugcucccgugcugagggcgccgugcugagcggccuuuagaagaacgugggagaaucgugcuuuugucuugcuccuuugagccuuacguuuucuuuuuuuuucuuuuuuuuuaaaaucuuccuccuauacauugccuuggucaugguguuuuguuuuguuuuuauuuauuauauguaaguacacuguagcugucuucagacaccagaagagggagucagaucucguuagggaugguuaugagccaccaugugguugcugggauuugaacucaggaccuuuggaagagcagucgggugcucuuaccugccgagccaucucaccagccccggagccuuacauuuucuauuuggaaaaauauuguuauuaugagaugguuuugcucauaguaaggugguccaaguuaaaacaaaauugauaaacucugccaagguuauuuauuuucagccauggcuuccuuuagugggugagaaagaaagucuugguuuuccccuccaugugaaauuuggccauuuucuucuguugguggcaagggaguguuuuagucacuacacaugucugaacuacuuguguguggguagcuaggacaucccuaggguuaaaaguuaacuauuggagaaaacacauuaauuugggguauuugaagaaaagcucaagagauuuccggauugucugugucuugcugcgguuccucaauuggcugugagcugguauguucacagcuuuuucucuaaguucauuuuuuaaaaaaauguuggaagagggaaauaaaaguccuuauucuuauuuuaacccucagaagagggggcccuuaaaaagauucagcuccaaagcuugcuccugaaugcuguaauaucucucucagaauauuaaccacaugccccugacuccagaauguccuuccuaguggucacuggaguuaauuugcuaaauuguuaaauuguuguccuauauucauugaaaagcuuauuggagauacuuaggacucugcacugagggaggucccaggcuagcaggccagaucccauuccagguuguuaauugacaggagcaaucaaccugucugaucuuuaauauucuaaugcugcugacuaaugcccagacagacauuugguaagacggaagaaaaacaacacauacuuggugccauguuucaucuuuauccucaucuucuagagucugugcuggcuaugcauucuuauggccaaguucauacaaaaaacagucaguacuucaaguccaucgugggagauacugagaguaaaugcuugagacgauuuuccauuuuucauuuauucaacaguuguuuagugaccacuaccuauguauuuggagacaugaggagucuagacugggaacagugacugaagcaaauuucuuguuucuguaaaauucacauuuaucuuaaauggagguggcuggaaacuuuuguuaggaaagaaaaaggacccugaagaugaaguccucuauacauucuguuuugguaacuugcugagaguaauuagccuuauucucucuucuucuccaacuccccuccccuccagccccccccccccccccccccaguaaauaccauuugaacuuacacacuguggagggcggugaaagagaagacaguucaguauuuacuguguguggcauucuagaagccagggugguaguuggccucggggaguucuuauaaaaaaguuaacagacaagaauuaaaagcacuucacuggaauucuacuaauucuggauuuuggauuugcugggaggcucgucuagacugaagcuuaucuucaaagauaaugcaaauucaaaggacuugcagggugggggaauagcugaaguauauaaguaaacaaaugauaagaaaugccauaauuccucaaagcagguucugugagaauacaccaggguuuguauuuugaauuagcauuccacauuuuaaacauuucauauuugcauuauuagcauaacauuuuagucaaaauuacugacuuucacuacaugggccuaacuucaaagaaguggaaguggguugaauaggaggagaucagcuguguuugggguaaacagaugcacaggcauaauauucuugacaguagcucaauuugaucuuuccauacuuuccauaagaaucuggaaaaaaaauguuugcuuagcacagauucuuagaaagaagagcauuucaacuagguaauuuggagauuuuacauauuuuauuuuuaaucuuuuuuuuuuuuuuugguuauuucauacuguguguuuuuaaccuuucccccaacuccuuccagauucuaccugcccaacuucauauccucucuuuuuuucucucugucauugcauugcucaaccuggacuagagaggcuccaucuuucaguggcaaauucacaauuggucaucuuggcaaagaauaagggacaucaaaaugcucaccuuaagugggagguguacaucgcaucucuucuccagaaguucuuuuaaaaggaaaacguuuacaucacuaccuuauauaugguauugauugagguauucaccguaccaagcaugauuggggauuucuccuucuagguuuagcugugacaucugagguccugugcaaacaucccugagaguuguagaaacacgagaguucaaauaacaccagaucagucagccagcuuauaugguaucaccuucagguuuaccuggauguaguuuucaaaaagaucuaucauuaagguauaugagcgauauaagauauaauugcugcaaauauaucuuuccucaccagaauacagcucaguuucacuuugugugccagcucuugaaauaagucgaugcaaguugcauguuucuaauuggaaauugacuugaaaaaaaauuauguaaaaaugucuuacagugaacucauaggaggagacucauaaugucaaguuacacccuaauaguccuuuugguacaugcagauuucugucagcuaguuguacuuaauuucauuaugcauuuuaauugcaaagcauauucaaaucagugauuaauguuaaagguagccauuuaucccaaggccuguguaguuggauuuucaucucauucccuugaauuccauaugcucugucuucagacucugcuucaacaacaguaagccuguuagauaacagagccuugaaauuuggccuaagguagagucuccuuaauuguuccucacuguccuccuuccagaucaaaaacccuaagagguauugucccuccucuggucccuugaugcugauagagucaccagaauaggaguguagccuggaccaucucaagcacugcugugaaauuccuccccuuuauuugggaagcaaaggcuuccuugaaacccuucccuguaccaacauucacaaagccugcccuaggcuucucuuagcagucucaagucaaguaucucauuuuauugcuucaauaucuuuguuggcuccgaaucuggguuguucuuaucucuugcccaagauggcugccuuaggcaguugacucaggaauuacacuguaauuaaagaaauguagggguuccccuaccugccucaccuuguuuccccagcuaugugcguggugaagaguccuuuacacccagauucaggcggcgccaaggaauugauuuucuaggaauuuguuguucguuuaccuguguuucauuucaguugagcacuugugauagcaguuggagaaugagaguuugguguagggacugaaagcugcaggaguuggucaugaucagaccuuucccuaaguugugaagaaaugaaguggaugauagaaaaugcguggggagcaugcaucucgguuucauucauuucacaugaaaggaguacauuuuacucaauuugaaccuaaacauuuaacuuacugagugcuaacuuuuauauuagcuuacaaccaaauugugcuuaacccugaagcuuugagauggucucccagagaaagagaguaucagcuuguguucccaggguggaauagggacaugcuucuggucuagauuugccauagauuccuagacuccuccuuugcuauagauuccuagacucuaccacuaccuuucaugcccgacucagugcaguuuccauuaucuguauuaggaagaaccagcaggucauuauuauaaaccugggcuuuggaacucaaccagacuggguccauucaguucuuuccccuauucucucugaccucuguuguccuuaacugugagauguggagaugaaauaaaauaguggaaggugcugaccuguguuugcuuaagaaaggaggcugguaucggagggaaggacgauggugaugauagcugugccugcgguagcauuuccucugccuagguuuuuguuuguagaaaggugagcauaggagggagagugaggcuggggaagaaggcgugggucaguagggaccuuugcaccaggcauggaacucucugucuucuacagaaauugccaccugucccuuaccagcacuuccugaugacugcaacucugaaaagaagguagcccccuuccuugccauuucccccuucccauucauaagugaccaguuuccagcugccaggaaagcuaauuggaggagacggugaauauuagcccucuucauaguucaaaugugaagcuguuguucagugguucacauccuccuuguuggucacauaucaaauaucuugcacaucagguauuuacauuaugauucauaacaguaguaaaacuagaguuaugaaauagcaaugaauugacuuucugguugcaggggggucaucacaacacuaggaacuguauuaaauguuacagcuuugagaagguugugaaccacuguuccaguaguugugccucagcuaagauagaacuagacuaccuaggaaaauagaggguaguagcuggaagucagugagauaaauccacacuguugcuuguucuuugggguuucuguaaggagaccugcuuguggaggcaaauaagaaugccauuuagcagacauagugaguaaaagacuugucaaggaacacaguguacuugggcagaagaggaauugaucuuaaagugaauaauuuaagcccguaaauuauauugucuugguuaggacagcugagcaaaguucccaguuuccuuuggaaggacugcaaagaauauuuguggguacagaggaaaugcucaauaaauauuuauugguuuuuuuuuugcuuaauuuuuacuauuuauuuauuuauuuauuuagucuuucaagacaggguuucucuguauagcccugacuauccuggaauucacucuguagaccaagcuaaccuugaacucagagauccaccugccucugucucacgaguguugggaauaaaggcccgggccaccacucccagcggaacaaauauuuguuaacuaaauaccaugaaauuuguguuucucuaauacggcauuugaggaaucugauucucuguuauugcuaccuuaauuugaagagcaaguuagcaacagagauauaauauaaugcuguuggaauagaaggccagaccaccuuaacuccaacuugagaaagucguuuugaugacuuaguuucugcuugagcuuauguguaaccagcuucagugcccguuguuuccaaagcuuuggugguguacaaggacgcggugacuccuguauucaagugugaacugaggcucgguuucgggucuuuugcuaguccaguuacuuuuaggaggcuuagggucauguguagaacugcgauaauguagcucagcauaucuuuuuuauguucauaucaaugaugcuucacucuuugccaacucccauguccauguguaauuucaacuucuggauauuauuuaugaaaugaaaacacugcgcacaaaggacuuuguaccugagggaaguucugaaacuuucccucuuuagacuccauuuaaccuaguccccaagucuucaaauauaaauacgugugccuauaagcaaaaagccuuaacaggaaccugagccagguuucaguuugucuaaccaguuagugacucucuuccuccucccuuuccaggcuaacguuagguagaguuccagcuugaguggucuuaggaaugccaucuucagugugagcugacuguguaguugcucgugauaagguccugucagugucgacuggcaucgugauaucacuuuaucugacagucccgugugugucuagggaaaaccgcuaacagaaauaagaguucaguauaucuugaacccuccacaugugcuuuugacauaaacuggaaaugaacauuuuuaucuucuuagagaacugggcaaagagggaagcaaaagaauggacuguuuucaguuccuuuuacccagauccaccguuaauuuugaaaaaauacaaacauucucacauuccuggaaagccuuuauggaccacuaaaaugucuccaacgaggccauauaaacagaguagaguuuuauuauuucaaaaacaugcuggggaacccuaagaaggccacguguugauaaaucgucccccugugcacaaaugugugcacgcuuucccaaguacccgucuucuugguucccagucuuuuucaaagaaaagcaggcgucuauuuuuauuuucuguucuagcagcuacugugguagaucccugugaaguaggaucugccccugaggaaggacgggcccuugaguucugagcaccgcagacccaucgccauucuaguuacuuggcugcguguuccagacccuggcuucuguggagaugaucagauucagcagccaugcuuuauuuauugacuaguuugcaacuuugucaaaaguauugccucuaaccgcuuuccuugcuuuuggccccaugguuuaagcuagcccuuuguggaaacggcaauuaugaggugaugucgaaugucuuaaaauacacaggcaggauuuucugcuucuaauauuucugugguuuuucugccuuucaaggcucuuccccuuggugcccguauaacuccuggugacuguuaacacaguguggucguugagacacaaagaccgagaauguaccaugagccacucgugucucuaaaacagucagaugguuuaaguuaagaaggcaauccaugaguuucuaaagccugggaaaauguagaacaguguguuuuagacuggccuguucauuuaacagaggagacagugcccagacacagccaaggucugaggccccggcacacguccuccuaaccagaugggcaccuuucuuauggaggaaaagcaucgugugcccaugauggcuguuuccaucccgagccuuuucuuccuccccuugaaauacauucuuauuggcagugaugcacugugacccacauuuaaauuuuaagaugacaaaacaaagaggacuuuuuuuuucuccuuccuguuuuaaaauacuuccuugggaucuuuucuuccucuuuauaggaucauaguugccaccuugcaaagguagugaggaaaugccacaaacacuuucuauuucacucugccugccaaugucauaaugaucacuuuggggugcuugcguucuucuguuuguuguaucauugucauuuauuaacauuagaaauagaugggcuucauguuuugauuuauuauugauugauuguggugcuaaggaagugcucugaccccgaguccuugcuuuaucuauuaaauucucuucuuugguuaguguauuaagaccuguugcucuggguaguuuuacugauucaugggagcuagucuuuucaggggcauaccauagucauaucauugccauugggacguggaggauucuguauuucuggcagaugugacaccaugagaauuuauauacuccaguuugguccccagcuccugagacagcugccgaugguuuugugaugggaugaguggcagagaugcuuggagcaacuuuugggcuuugauggaaguuucugacacacagcuagccaaacccuuugguucccuaaguaaugggcugauaagagcauccugcuuagcucugaaaucucuuagaacuucugaguuuacagaaccuucuuuguccuaaggauaggauuccuggacagcuugauugagauuaggagccaguaacuagaaagacaagcuaagauuaggagcccugaaauuuccaccccaucucccauccugguuggaagagggaagucuuagaaauugaaugcaccauaaugaugaagcauagucuugaaauguuucuagcuuuaaagagagcuuucagguauuuucuggucuagcaaauacguccaggagagaaccgggcagauaaaaggaaaggcaugcgcuuccuccuagcucuggaguggugguaguagcuaaccccaucucuguaggggcacgugcuuuuauccuuggacccuucuguaccucaaaccauguuucccucacuuggcuucucauaucugucuuuccuaguacagcaauacaaaugauacuguuuuucucaguucuuuaccuagcccuaccaaauugcugaaucaaugcagagggguguggaaagcucugauugacaacuaauuguaucaaaagcucaaaaguguacagguucaacagcaggacugguguuuggugucagugauugaaacugagcccccacaccugugaucccacacuaauugaauguauagcaucagacacaaauugagccauuuagcaacucauuaauauccagcaaguuggggaauuguaguguggaaaaaguccguuuggugucugagugcuugugaauauagaagcagccauuuccccuuauagguugauaugucaugcuguugguagggcauugguuuuagauaauucaccauugcagagaauguguagaauaguaauagaguuuugaauuauaaccccacugagcaccauugggguuaaaaauaaggcuccagauauaguuuuagcgcuaaccucggcuuuauuuauugcauguuuuaucagggacauguauucauccacagagcaaggaacagauucauaggggagccucagcugguuuauuuuguggcuuagucauauccaagggguuccagacacuuuaugaucucuacucgccaccucagcacuccaguuuuggugacaaauguauuuuucucuugggaacaagauggccuggcuguagcuauugcaucaaggcauagcucguccagagaggcuuccaugauggguccugugguaugaauauauauaugugcagguaguuggcugggaagaccgccugugaguugaacugguuaagguucaaaauaagaaaagaaucuauaaaucuugaggcgcucuaaagaauaugaaagggaccuuccuggaacccaaauccucuugacaaaguugcucauuggagagaacagugccaugaauggcuggaccaucagaacauucugugagugggagcuggugggagccagacauuauaccaccagcagucuccuaauggagaacagauuguucuagauuguucuagaaaggaggaagaaaaccagcaauggauacugaaggaaccaucaagguacucagccacaccuguuucuucccuaguacacgagaauacuaacauugcuuaaugugauuaucaugaaaaucuagugacugaaugguauaaagacagggccaggccccagaauaagcauucaguaaauggcagguccugcugugagauugaaagucuuauauuccaucaguuuuauauauaaaaaaauuaaauugaacagcugcaagaaugauucauaauucacuguaaucaaaccuggggcaaagguggcuggcauucacugcugauaaguugggccuggucaucuggcacccugaaccauaugcacuugaaacuuucggaugacccagucaccaggaguguggucagggagauaagagauagguaggguggaggaagcagaguaauuaagagcucacauagggcucuguuaagacuguaguccgugagguuuagaguccagcagaagaacacucacaguugugcauccuggcaacuuuccucugccacccgggggucagcguuugguggggggggugguuguugucuguucuuacugcaggaaagcaauguaccacaacucuggcuacaaggaaagaggcugaaguugugucugaagugugugucuaugugcauacauuaauggcuaagcauccaacuaggugagagucuaacaaagaugauagucugcacauccccggaagcccugagaaaccaaacauagauuauuauuugggacacaguguagaaagugggugaagaguagaaaggugaaguaauuaagauaauuagcacauauagccuugccaguagugaaacauaguaaguauuugguuuucuuuucuuucuuuucucuucuuuuuccuucuuuuuuuuuuuuuuuugauuguauuguucagauuuugcuaaauauggcuugcacuaugucagccaaugaguaacuuuauaaaauggaugacgcgcuucaguacaaaugucuguuuucuguuuuuauaucacuuaagauaaugaagagcugaggagaacaggagcauagaggcuugauuaagaguuggagaggugggguggucagguguggcugaggauggaagccaggggcucagacauacugaacaacuacucuccugugagcuaaauuuucaucccuuuugauuuuaucauuuauauauuaucuucuuuuggaggucagagucuccgguguccaaggcaaauacuaaacucauuaugagaugacagugaaccucuggaaugcuggauuauaggugcacacuaccaugucugguuuuauguaaugcuggagcgcaaacucuggcauuggugcauacgagucaugcauucugcuaacugagccaugucccugguaucuuuguucauugguuuguuuuuauuuugacauaggaucuuacccaguugcccagcaugcuuugaacaagagcaucauggcucacugccuagaauuuuagauaccuauguccaggccuggccuuuagcauccuccucuuuuuugucucuuuaauguggaccguccuaaagguauuauuaaaacacugccucuguucccacuuucugauuuuccugagggaugugacuccaaauaauauuggguuuuccaucuaagagccuggccuuuguguuuuguuacuauuauucucauauucauagaguguacuccuaccuaaauuaggccuaguaugccuuucccuaaauacagacuguuagauuguuuuaaauuggauggaaacacacauuuuggggguuggugauauagcuuaaugacagagcuuuuuuuguuuguuuguuuuguuuuguuuuucuuaauaaugcacaagccacugggauccagacaacaugaccaaaauuccacauacuuccuuuuaauaaauuuucuuuuuguggauacauauaaauguuguauggugggcuguuuuccucccagccccaagcaaccugauuagugacuaagacugaaaauuuacuuauaaauacuuaggccauauagcuaggcucauucacugacuagcuaauaauuuaacauaaucuacuuacauuaaucuacauucugccauguuacuggucaccucugcgccggcaccacgugucuguccucauguuuucccuggcuacucuucccauguccaacucuauccuagaauucuuucugcauaccugauguccuaccuucuaguuuaaauuuuccuauaagcuauagauuuuuuuuuuaauugacaggugaugcacccauucaauacacaagauacucuuucuacauauaaaaagcagcaaacauccuuguccuaagcuuauagagaaaggaccaggccuagccaaaugauaguaccuggagcaauccagguagcugaccugcagcagugugcacaagucauggucccacugcagcaacauucuagcacaccagggcuuagacucuuuccagacccaaauuucauuucagcccagcucuuccccaguguguucccacccgacucuuagguuaagcuguuguaaagccucaaaaggacaauucagggcccaucaagagcugggcccaagacagguuucuuccuguccuuccuccuuaccuucaguuuuguccucauauuuugacacagcagagacucauuguugcaggcgcuuaaauaaauaggaguuggacucagcccguuuccaggaaaaaugagaacagcagguguuaucugauguaauuaaaguguguugaacccugaacaaaguacucaguguaaaucucuguuagucccuuacaaugagccagcuuagaauccguucuaugaauuaccugcuggucggaaggucuguggccuuugggaggacguguuguaaauuuuauagcaagccuacuaggaagcuccuugucaauaaguuuagaaggauacuucaaggcucuuuaaucuccguugucagcccaguuaucuugucuacacaugggcauaacuuccuucuccacuugaauuaauguuggacuuuuauaaagagacauuuuaaacucugagugcaguuucucagaugagcugaucuacaaaaugagcgguucuucugccucuucuuuucccaauguccauuuagaaaguuaugguaaaugaaaaaucccuugagcucggguguuuccugucauagucucgcuuaggcaugaaaaaugcuuuauucuuacuucauuuuguauuuuucacaaaugauucauaaucacaccuaaaugaguaaguuugcaauguuuacuuauuuuuccugccuaaauugcacauauagacacauugcugauagagaauuacucagauauuauaaauaaugucagcuaauucuuuaguccacugugauuuuucucacguuuccagacguuucaaaagccuuuauuguguaggcuuaugauggacuuauugauugacugcaaacagacauuggguauucaaccuaaaugcuauuuugccagcuucaacugcccuuugcagcgcguucuucuuucucuaaaggugaucucaaagcaaguugcuacugcucuuaagauaauaaagacuaggagcggggggaauguguggaaucgggugguucuacagaugccaaggagacuuuaagauguuugucucucaaggacaaguuaaccucacucuuucuuuuaaagaacaaaaucguuuucuuuuugugaagcagaguauuuucuaauuugugagcuuuggaaaaaggaagagggaggaagcagagagagcgagagagagagagagagagagagagagacagagacugacagacagacagacagacagagacagagagagucagagacagagacauuggaagaagucacagggcaacuuuucgccuuuacauggguucuugggacugaaagcaaauugucaggcuugugcagcaagccccuuuaccaacugagccaucucauuggccccugauuaaccuacuucuuaaauuuucauucagcaaaaaaaauaacaugagaucacuagauaacauuuaaauucuaggccuaucugcccugcucgguuccaaguuggaguggaguugucuuccacuggggaauaauuugucuccauuaauugaggacaaaugugcaugcguguuuuaauuacacaguaaauuaggagaauuuaagaugcaagaauucaaaaccaacaccucaaaaaauagaaguagaaaagcaggagaacuaucucagcagaagaaucaagcaggugucuccagauaaagaaagggggaaaacaacaaggcaaagacaaaugacuagauuuugcuaaacauccuuucaaguagaaugacucugauguauggcugaaauccuuguaggcuguaugugacaauggggauggcuguaugccacacucagggcauuacucuugugugcuuggcugcagccaguagcuaacuaagacguuaguggccaauauagaguaaggauuuccuguguggacccaaacuucacaaacuuccauagcauggguccccuuuggcucuaugcacuuuaucaucugugcaaaguuuguauguuguaaaguuuuugugagggaaggcuccagaauguuccuuaugcuuuaaagcauccauucuccuaaguguagcacuuuaaggcugcuauuugaguaacaacaaggacauugguugacuuuguucuuugucauguagauguaaccagagauacccuuccccaaauggcuauugcucuuuccuuauaagacaagaacauucagacuuaauuguguuuucuccuacuucacugaggauggcauaauaauaaagucuuuauucagauauggagucuucugggcugguaagaugcucugaggauaaaggcaaaugucuguaagccuggggaccuggauuugaucucugagacucacaugguggaaggagagaaccagugcccaccaauugccccuuuaucuucacaagugcaaugugcuuuggugagcacauaaauuuauaucacaaacacacguucauaccacacacaagaacauaccauauccacauccacaccguacacauacauacauauauacacaucccacaauaaaaagauacauaaagaaaugcaauaaaaagacagugcuuucuggcauguucaaccuuuuccuaagccagucuauccuucucuagccauauacauauuuagguuucucuuaaaaauugcccuggaucuaugagugcuuaaguaagcuacuuuaaaucucuuuuggaagaaauuuaguuauaaauaaauugcauaccucuccacauuguaaaaccuggaagacugguuacaggggaagggugcuggauauucacucaacuaugauugggggcaggaauggagcccuggauuuugcuuuugcugauggaaagaaggccugggagcugggucauagggccucuggccgaucuccaaggggaagcuaagauaaucucuaccuuucaaguacuacgugaagcuaauuucucagguacaauuacuuauagucugccaugggguugcuuaucuuguauaccccauuagacuuugagccccugaggacggaaagccaucacuacccuguauguuuaucauuugguuugaauguuuucccuagaguaggcagaaaugagaaucaagcuaaugauugagacacaaguugggugacuuuuggcucucacguggaucaccauaaggucauucucaguauuaagacugucuuaaguguuguggaacuguuuggggugaaaggaccauuagcuuugagaaagcuccaaaacuuagugacgacugguauuuuuccagugcagauuugcuguccuagcucuuaagagauugaacgauucaucuuaaauagaagugaucuaguugauuccuaaaauuuauaggauguaguuuauguuuuuucauauaaauauuauaucaacagagauuaauuuuuuuuuaaaagcaaggugacucuggaugaaggucaaguguauaagcccugagcagacuuuaggccgugauuggaacuagaggcuacccuuccauuguaacuggggugcaagcauccauccccaugguccuggcuucuucacggauauagauucuacauuucugucacgacugcuccuuuccuuuucuucagucuuagguagaacugauagcacgcuauggccccauuuaacaagacaaaacaggucugggucucaggcuccugaggaauuuuguaaugauuccuagcuaagguggcucagacccaucucagaaagccaccccaucagugacuuugaccagccugaaagucauccauguuuuuccucuaugaaaugcugaugaagcaagcggggaacaaggaaguacgggcuuucagagccaggagucaguucuguuucacucuccaauauaaguuuuuauuucccccaaagaggauggugggaaaucccgcagcacggugccagguggcagucagcauugaugcugaagacugcacaggagaaguuaauaauuaagaaggugguggcccucccacuccugaggcaaugucuguccuuugcuaaaacaguccuccagccagcuccugauuucaaugccaagaguuggcucuauuuguugcugacucuuuuguggcuuucucgcugucuuuaagcuacaugcugacuccuguagauugcucaucugcagguugagucucugcaggcccaggccugccugugccuuccuuuucugccacaggcuuccggaacaggcacaaagggaaaugggauuaagcaucucaagguaucaagcgggacuuuaccaugccuaaguauuuuccugccuuguauagcaucuccuagaacaguagcauaaaauaaaaagaaaagggaagaaaacgagaaaucaucacuuggauuuuaaugccaaauggggaaccgagucauacagucagcuauuucacuggugcgucuagauuuaaaagauacuuucuagaccccaacauauuuuuguagguuauuuccucauuguuaauguagaaauuuugcacauugacaacuuucaaauauucugcauauguagauuuguaguccagcauauaaguuagauacagaacuuuuugauuaguaauaggaagaacccgcuuagcuggguaagugguggcucagguuuuugcuuccagcacuugggaggcagagacaggcagauguuuaugaguucaaggccacucuggacuucuuacuggucuacauuguguaauaacuuccaggacauccagaguuguguagguagguagauagguaggaaggaggaggcgaaggaagggcagauggacggacagacggacagcccuucugacucauuaaacuugagcucuucugccauaugguuauccagagagcacaugaaguccauguaagcagaaugagcuggggaaguuacuggggucuccuuuggaaugccaagauugaggagccagacuguguggugugauaaucugauggaggaaaugcagaacacagggguaagaguucugauaccagugccuggccuugcaacuugcuuaguucucagccucggucagacucaguuucccuguuaugugaggauaaugaaugagaucgucucuuugauagcaacucggcccacauugguuuccagaaaguuaugacaagguuauggugauguucauuguugguauaaagagucaaugguaauuuuugcacuuugaauuuagagaauaagcuuacaaauagaaguggugccagucauaaaaacugccuguucuuuuuaaugugugcauucuuccuuaguaagcauuucagccauggucggaguguuuccaauuuaaaagccaugcaaugauuuuuuuuuuuuuugccuuaaaauacacaguguaugucauuucucagcagucuuauuuacacaguguguugguagugggcaaagcuguuauuuagugauuuuuuuccccccucauuuuuucuuguucaaguaagaauacaauaccaaaucaacacugcuugggaauagaagaaaaacauugaguucuacaaugguguccucccugccccuggggugauagauauuuugccccuacuuuuuaaagucaaggguagauauggggcccaaacacagacaaagcucuacacccuuucaguguccugucuguucauuaagaagugauguggagaguuucucagaauggaaaugacucuuguauaggcaauggaguaauugccaaggggcagacaaucgaagugaaggcauauuucacagugagauuuuaggcguaccugcuggggccauggcacaagauaccuugcuaguaggcaugugagaccuagguaaccagcucauggccagagaagagagggugaucuaccccacucagugacaacaacaauaccaacacacacacacacacacaugauacagguagcaauuaucagugugacaccaccugugucacauguggguacacaugaaacuaugcaugcuuguacuugcuuuuacagaauucucaggacuucccaacaugcuccauucaugcaguaguuuacugucagaaguuuucuguucuaggaagcccacuuacaugaaugcauguugauuugugaaugugcauuauaauuuaugguuauuuauugggagcuauuuaguuuugcuuauaauaugcauuauuacagauauuguugagguuauuauacuguuauuaauuuccacacuuuuacaaguaguuugauagguuagauugucagauuucucuccagaaaagaucuuccaauucauuugcuuugucugcuuguuauuuguuuuuggagauagggccuuacuauguaucucuggcuguccuggaacucacuauguacaacagacugaacucaaacucacagagauccuccugccuuugccuccugguaggauuaaaggcaugugccacuugcgauucacuuucuuaaccugcagcauauaaaugagcccccagugguaaaaguuaggcaguagagauguaaguaaaaccaucuuuugaaguugccuaaguaaauauuucugagaaaacaauuuguaagcaggagaguggucaggcuuucugcuuggacugcauggggcuucuacacaaaugauguuguugauaaauauuuaaaagaguugcuagaaaauuggacauggacuagucuauuacaguguaaauguauacacugauuagauucuuugcaucaauauuuucaaauuccaaauacagaauuggaaauguuuuuugagaacugccaugcuacuacuauaaguggaaaauuucaccuuaaaccucaugugacaacuugcagucaaaaugcagguacaccugcauaaaauucccuucagccuauauguacaaguauguguaugaaaucauaugugaaucauguguuuaaacuuugguuucauccccaauaccaucauaauguguacucagauguuccagaaucucggggaaaaacacaaugcaaaauugucugguuggaaguaugcuggauauggcauauuuuaucauuauuggacauuuuuuuaaagagucaagcccaggaguggccuaaugcuucaggaauccauguggucagaggagcucaggggucacuauaucucagggcuucaaguggagacuuaccauuggacauuuuaucaagucugauuuuuauuauaugagaauguuuuacggugcuuaguggauuaaagcuaagcauuuucuuaucagcuauucauuccagccacuaugaaaggcucuaaggauauaaaagacacaggguuauucugccuucgaccugcugucuuagcuauacccagccuugggacaaaaccugaaaggguuguggguaauacaugccuucuacaggugacaugauuauaaucugggcaccucguguagaggaugcagagaaagugugauagugugauucuuucaggcacacacuuaauaagagggaagucugagcuagguuuuaaagaugugagaaucauucauucacacacacacacacacacacacacacacacaccccuguacguucuccagacaaauaggguuaagcauuaaugagguuaagaagguauccugagguuggggaauuaucauggucuuccagcuguuccuucucugguuugcugucuuagagcuucagcuguuaugcgcaaauagaaugauaaugcauacuaaccuauaguaccagaacuugagcacagugcuugguaguuaagagggagaacagaaguagugcacagccaaauggaggcacaagugggguggacugacagaguuggcaaacucaacugcuaucacuuuucucauaugcauaaauaauaaguugaugcugugaggcuaggguuucuaccuuguguuuucacuuuuuuuuuaaaagaaggcccugaacauagcacuguguucuguguguaaaguuuauggaaagauccauuuuggaauaacgauguuguuaugaugaagguguaaaauguaucugaacaggccgcuucaaugccaggccgguuaggaagucugcaggggauugaggcugagaaaggcuuaugcauaaucaagcuuuucuaugccauguuugaugcaggcuuugguugguuacuucuuagucauuggcuguaagcugacccuggauagaggcaaaaagaauuacccaggcauuucccuguaaguagcacuagaggccuuuguuauaaggagagucaguauucaggagaccuugucaacccgcagucagucacagcagcuugggucuauugcauugcccagcaaaagggaucugggcaguguauacuuucauuaugcccacugauuaaacucccacugagccuuuaaggcccaaacaggcccuacccuggagacuuuauccccagacaagaaagcuucuuuuugaauuagugaugcuaucaaucucuacuucuuggugucucauuauaggguugaucaagaccuacuuuccaucaccacagauuggcuuaaugucugauucccugcuauacuaaugaguuucuugaaggcauagcaaguuuuaauucaccuuuaaacagcuacuccccagaccccagggcuguuccgguguagcuguuuaggaaagguucuuugacuugaaaugagcuacaacauccuucuaggcuccuaaugcuuugcucuuagagauuacugcccaagccuuuucuuucugggguaucuguucuagcauccugcucagccugcuucucuuuccucgacagaauuuuuuuuacaauggacucccuagaugcucucugucuauaacuuacauccacccacucuguagaauggggcuacccuacuguagcuccccagugagucucggcagauagaugcccuguugugccaccucuauggucugcaccuuagggaaaaugagcaaacaucauuuucuccauaauagucuggcuccucucaggaucuggaaaguuccggcuauaucagcgaaugccuugauuuaucacgauuauaaaaauuguuuugaggaaagcuugaacauggucaguagacucaagaaucauuucugggccugaaaaggaugagcgcuuccuaguguggacugaauguuguaguuacaacccacuagucaaauagaaauaguuauuuauguauuuauguacuaaaugcaauuuuguuucuucugguuggggcaacaugaauaagauuuggcuuucuuuguauuuaaggaauuuauaaucaagggaagaaaauggacuugacugauauauaccuaacuuauacucaucaaaggaguaaugugauguauaccagaaggaaaguguguaccagcuuagaauugaauucuacacaacaacaaucaccagacaccugaagcuagagagcccugugccaaauugcagcuauaucauuuaucaguugugaaacuuugagcaauaauuuuuuauucaguuuuaauauuuugaucuguuagauggaaauaguccauaccuaacaguguugugaaccuucuguaagaggaucuucauaaaacacaacuugauggauguuaacaguugugaugaaugugacuggcuguaagcagaccaguucuugcacagguaaaaagguccuggugcagguggcauuugaguggagcuuugaauuuucacauuuagugcauagaaacagauggggaaaaaaaaggggauaaaaccuugcaugcuuucuaaaggagauagaauauaguaugugcucccuggaauguauugaucagagcuugauaaauguucaguuccuacagacauaugguggaguuggguuuggagagaugucucagcagucaagagugcucgcuucucuugcagaugucucuucauucccagcauccauugcaggcagcucacaacagccucuaacuucagcuccaggagauccagugcccucuucuggccuuucugggcacuugaauacacauagcauauguucauguaggcacacauaugcauccauaaauaaaguaaaauauuuagaaacagaaacauauggcaaggugagugcuaaaaauauugagugcuaaaaaagguuuccugaaauuuuuugauccauagaauuuguguguguauucccauucaucugugugcuaauacuuguucaucuuaaggaaugucagaggacacuggggucaagcauaccuugaauuaaaauaguuacaaguauagugaguuuaacuuagagaucacccuaaagaaaaguugcuucucuagccuguuuuuuaaagcuauauuauauuuuuaaauuauguguuguauguguauguucgcucucucucucucucucuguguguguguguguguguguguguguguauuugccugugaguacagguaucuguggaggccuggagaggaaguuggaucccuuggaguugguuuugagcuacccagcauggauguugggaaccaaacuugucuacucuaagugguauaugaucuuuaucucugagccauuucucagaccuugugauuuugauaguuccacaugaagaugguauuauguucuauguuguagauuuggaaacuaucugugauccugggaacauucucuaagcuaaaaagacauaauuguuuuaaauuuaaguaguucaggucucucaggguuaccauaaugcauaggauagcaaucaagaaucaacuugaggucuccacagaggaguguauggaaguaaaacguugaauucagauccuuacuagaggcaggaggugguuuuuguuuguuuuuuguuuuuguuuuuguuuuguuuuggcuucugguugguuccaaaauguagaccuauaaaacuauauguucauuuugcucaauauuguuuuaguggguguucagaacaacuaagucaaaaacaacaaacaaacaaaaaacaaacaaacaaaaaaccuguguccuaguggagugcucugcaaauuguuagauugagguugagguuggagucuauacugcuguacuggcaauuuuuugucaaccugacacuauuuagagagucaucaaagaagagggacaucaaauggggaaaaugccucuauaagauuggcuauaggcaagccuuuaggauguuaucuuaguuagugauugaugggggaggauccagcccauuguggguggugccaucccuagguaggugguccuggguucuauaagagagcaggcugagccagguacaagcaaagagccagugagcagcaccccucuguguccucugcuucaguuccugccuucagguuccuacucugcuugaguuccugucuaucuuucauugugaugaauaguguggaagcacaagccauuuccuccucaacuugccuuuuuuuuuuuuuuuuuuuuuuuuuuuggucaugguguuucauaacaccaauaauaacccuaagagcaagccacaggaaacauuuguaaguaccaggcccuuuuaauaaaccggaaaccccaagccaguugugugugcaugcuuccuugcucuuucuuugaaucuugggcucucugcauaguguacaacagucuucuugcuagccucauauuuuaagcacuaaagaaaugcccugaagugcauugaauacagaaagaaaccuagccuuuacuaugucuggugggcuaaugacaagagcccucuuugugucuuguuuccuggcuuucagccagcacuuuugcuuugugggauggcugucuucaagcaugcagagaugagcauccaucaaggaggggacagcauaaagaaacacagacuucaucaagccguccgcuucagcaauauuccauuugaauugaaucagggccaagggcaggcacgcaguggaguaucuguguggaagcugacauuuuaaugauuugauuaguuuaggaagaauguuuuuauggguugugucaucaauuauuugaaguccuaagugaaguuguuauauuaugaugaacuucuuuuaccuaccucuccuggggacuugugcugagauuucagcccaggacccuauggguaaucucaugcaauccucuuaaagaaacaguguuuaaugacuaaagcuguuaaucauauuaaauacaugcagccacccuggggaaaaacgccaaacaagcauaaaucuacaaaagguuuuugagugagcuaagcaggguacuuccucagggugggaugcuagacgccaggauuguguuggagggagggagggagggagggagggagggagggagggagggagggagggagggaugaagagaaaggagggaaggagggaguaguugaaauaguagucaccugacuacgaggaugaccuaguacuuagaguguggcugcuccaagcuauucguagaauauguccaucauagaagaugucugacacacaguagcuuaaacuguagcugaaacaagggggguaggcugguuuacauaguagguacuaugugacauuuuguugauagucagccauuuguugguauuagaauaucaagguuugauucuuuugguuuuucucuaguuuguuuguuuguuuguuuagugaugcuugauuuauaagaauaacaggugcagccaaacuuugcaaccagugaguguuuuuugugccuugugagaugccauacaagggagagaugggaucuggagguuuuagagccauacauugucugagauucuaagaauagacacagagaccguccuuacaauccagaaauagggaggggacuucuggugcacgggacuuccuccuacccgugaccugcuuuuuuuccuuuaaacaauuuucaguggaguauguugacaagucauacuuugugaguguagacuggacauuuuacaaaggugcaagacucaucccuugucaucagucuggagaaucugaaguagacaagagcuuggcagauucaaccaacaacagacaggccagccugcagggaggagguaaguaaaugaaaggauauuaaaaagguuaggauugcauucuaauuggguaucuuugagcacauaacucugcuucucugggucuuaaacgccagcucauggcuucacauuagaucuugguugucuauggaaguaaauccaaucauucuucaauuuuuaucuuggcgaugauuuuaccaacagucacaaaguggguuuuggguuaucuugaugcugcaaagccugagcaaagcuguggaugucuuaacuuuguauauggcauuauaauuagucccuguccaaacccagcucagggagucaggaagaucaucgcaguugauaggaaaauggaacaggaggagaaucaucuguaccacacucaggaacccaaggcagaugcucaguaccauagugaugcuaggaguaggcucccagggcuaccuaccagcuuggacucaagagcuugacacauuugcugaagguaauuuuagccuugauaggcugcaggcuugucugcauuuacccucagccuuaguaaguagaguggacuauucagucgggauucagugcauuaaaacuagccuuaucuucaggcaaacaaaauaccuucugauuuuuaccaaauacaucauugaaaucuuccaaaaggcauugcucccuggccagugguugguugaguggaggucucauuaucaugagccuacaaacaaggcuuugaaaucauuaauaacuucccuguccaacuuaauuauagagacaagcacacuccaauauaugaguauuaaugcaccaaaauuccuucuguauaggacuuuguccaaagacuccauuuuaugcucugaaaugcaauauggaucauuuuaguauagugcaucaucccaagucacaguaacuccaaucccuuuuuaaaagagaacguuuccaugagugcauaaugcauggugauaugauaagaaaaaaguguguuuguguguuuauuauucauccaugagggcaguuucuucuuuacacguggucuauaguuauuuaaguuugagagacucagcuucauugacaaaguuaagucuuucaaaugaucaagaauguaggucccagagaguggggaugcaaagaagcuuuggaauucugcccuuagcuguagugggaacucgaggggugaaucuggugacauccacugcaaggauuggcccugaaggguaggcugggugauaauacagagagagaaagcauaagauguuguaguuuacaucuaugucacauggcuauagcugcacaggguacaccaggcaucucgugaagcaaaguguauugugggauauagguguuccaucugcuuuauuuaucaagacugauaaccuugauagaacaagcauaucauuaucaaguuaaugaucaucucucugcccuuuguccuguaccuguccauucuuauucuguacaugugcuugugcgggcucucucucucucucucucucucucucucucucucuauauauauauauauauauauauauauauauauaucacauacauaaauuuaucaagauagcuuauaauuuauaaagauuuaugaaucccugauagcucagccuaccuugugucuauuacaggaaauguauccaauuaucaguagucucucugccuguggaagaggacucugucaacuugucauguugcauauauaaauauagaacuguauauuuaaaacuugauagacacucugccaucacauucucucuuccucucccacaucucugcaggcccuaucuguuuuuagaaaugguuuugaggguugaccguauagaaauauuuagagauaaguuuagagaaugaagaagacucuaugauccuugacauauugauuguauguguaaauguccuuuuuuuaaaaaauauaaggaugaaauaauuaauuugcuuucaguugccuggauuuuuauagccuagggaagaaaggaugacugccaaucauucuccccaacacuacuaccauuucccuccaugccuccuccuuucucuucagagugagcaucucaagauguuaacuggcucuacuucugggagugacagugaaugacagauagucuugcacuucuugaucaaugacaagcuacuccacuuagccuacucucccacucagauaucaacacacucauagaagucuggauugagagauaaacacccauauguagacggauauccccauuuuagacaaagcaugucauuauggcuguguaauccccaguugauaauuccugggaagaucuucauuuucggcauacugcuuuuuuucucauccccuaugacccaaggugggaacagaaauguguaauuuggcacgaugacuuacuagaaagaacugcucauaguacuuugagcuuuugcaagguggcauuauuuaucaucagcucacucauucacaaacuguugaacucauacuccaugucugauaaguaucuuucagcuggucuuugaggaagacaagaguugaaugaucuuuguugcugcuuauggugugguaucucuuuaccuaucacauuauagagucuaguuuuuauguuggagccugugcaaggaaugacugggauuugaagaaauuagaaaaucacaaccagacggauaugagaaugcaugagguuaaguaaacaaaaacugagaaaguuuuaugauuucuguugagcgugaagugauuuauuguuuuauuagccauuuauuucaacuugaucauuaacaacauggcagacgguguguuaaauucuagcuuaccaaaaaugagcugacagauaagcccugccuugcuuucucagguuuaucaaacagaacugaaaguccugcagaguucacuggccuuggcuuuagacucuuugcuaagaacuaccuguucauucagcgaugagucacccaaguguccagguucuucaccuucaaaaugaguccauuggccuagauuuuuuuuccccuaagggcuccaaagaucuaagauauucugauaagggaugaaccuggcauucagagauuagcacagcauucacaauaggccuauucugcugggcggaagcugccucucaccuccagucuauucuggauggguaacuuucacucugaaaguugacccacagucuauaacaugaaagggaaccuuucacaagcuagagaaacucaagagucacgggccuuagccuaauuguaggacuuacggcauaauuuacuggcucuaccacagaaugcaauacagaacugcuuuccuccguucaaaauugguaagcaucucaagaaauaguacaauaguaaaugaagcauaggauacuucuaagagucuacagagucaccugccgugugauuaaaucugauguaaaauggaaagagcuuucaguuuuguaaguagauccaauaccaaguagcucucuaagaguguguuagugguuagugguauugcuauuacaguauccaucugcccauuucucucuaugagaguaaacagccccgagacacaguuauguaguccuaccgguguguauuuuccgagaacaguggcuaugccacacauuuggcagcaggagaauucuaguucuguuucccacagaaauuaguucuccccccacaaacacaugccccagggaaaaaggauucuuuaaaauccaucuuaaugaagccaaaguaacauuuaauaagauguucagggaaaccaggaugggcuaacugguagaggugucucuaaauagaacugggccuugcagccuaagaaggaagcucuuaagaaaaccaguucuuagaaaccacuuuuguaugauacaaccaucgcugucaguaguuggaaguucgggaacgacaaccagaggaggccuaagcgggucaaugagcagagauacggguguuuguuacucugcauuuauucugagugauauuugaaauaaaugguugucucauauagggccagguuauuacugugcacaucccacauggcaaagaaucugaagagggcacauggaaggaguuauaaauugcacacgugauggcuggacuuuugagcauuaggcgagccuccaaggaaagauugaugaaauguguucugacauuugagucuucaguugcuagauuucuucuagaaauguuggcagcuccuuuaacccagagacagcaguggugcaguuauuuucaauaacauggacucuccaggaaauuuuugaaauccauuuaaguagaagguaaauaaagauguuuauaggcaaagccuuuucuauggcuguguuguuguguauaugucuuccaaauccggaguugaaucaucuucucccuugccuuaccuaacacuuuuguucuuaggguauuuuuuguuuaucagcccuuccuauuguuaauuuuucuagaagcagauuauuguuuuuauuacuagaaguauguauauucuuugcauuuuucugaguaauuuugguacuuaauuuuuuuuguuggggguuguauaaauauguauauaugucugugugugugucugucuguauuuauguauuuaguucuuggguaccgucaccacauuucugcacccaacugagacuccauucuuccuuccuuucuuccuuucuuccuuucauauaaguacacuguagcugucuucaaacacuccagaagaaggcaucagaucucauuacggaugguugugagccaucaugugguugcugggguuugaacucaggaccuucggaagagcagucagugcucuuaaccucugagccaucucuccagccccgagacuccauucuuaaugaugcagccuaaaugaugaaggaguuuugaauggaaguagggaaaaugugucugcaugagaagcagacaguuggauggucccuggggagccuggcccgccuaguguuuuaccaagcaugucuucauagguaaucaccugagaccaugucuuaaaaggaagccaucugaggucugauuccuagcucacaggguauagagcaguggucaauuucaaucuacuuugggugaaaguaaaacuuucuaaacuauuugggauacagaggaaggaaagaaaaggagaggaagagaaaggaagagaaaguaguuaagucccacuucucagugauguagacaauaaguuaaaguuaccauggucauuguguuuggucauuuacuccaguaaggacacaauggucuugcaagggcuguuuccuugggcuuaguucagacucuggguauuucuugauuugaauaaauagcucaauggaaaacauguaaaauagcccuugcaagacgauaaaugaaaaauauuucuuguuguuuagucacagcuccuucaaacguaugcucauagccaugggaccguaugugcggauuccagaacuagaagagagguuagggcaccauuuuccugcaggcccugucagugcaagagaauauucuucacauacuucuacuucaucacuggugccaacucucccucuaaccacugauguauuuuguugguauugugcaccccauuuguuauccauuagggcuuucaacaauuguaugcugaggacuagacuaaguguuggaaucaggaaccgacuuuguagaucaccuuggaacccagugaugacggugaugucacccauaggcaacaggaacccuugcauuuguugccauggcaaucacuauacauucccagcauccauuuggcucaauucccaccuuuaccugugagugguugucacagccuaaauaaaaggcagacccucuugagccuugcucucucuuccucucucuuucccccguucgucuccauugcccccuuuuugcccgcacccacaauaaaucucucucacauagaacuucauuggccugguguggucuguccagacacaagccacgauuccaacacaacauuggugcuauuugggacaaaguacuguggaaauauugauguauaugucagacacuucuccuguucuugcccacccaccaagccagcugucgugugagaaaagucacagaacauaaguguggaugaaggggcaggacgcugucuucaugaaagggcuucaacagcauuccugugccaagcuuagacaugcuuaggguggcacugggauaaucuuaacgauagucuuaaccuaguguuuucuacuuaggagacuacaucucucuauugauggauucuuuuuucucugaccauggaaaucaugucaacacguugauaauuaaaaccuuuuagaguuaaaaugaaccaaauaaguacuuaagagauuuagugugucaagaaaaugagcugagaguuugagguagucuucacuugaaauacacuguuuugacucacauauagcacaaaauggauuuugaaaugguagaccacuauguagaacaaagagguucuuauuuuaccaaugcuuaauaaaacuuggguuguuuuauuucuuuccaaaugauacuuuucccuacaggugacugugguguagaaaauauauauugucuuccaugcucuucuccuuuaccuauuuuggcuacuagucauaguauuuuucucugaaguuaugauguaaccaaggaggacuucaggaggucaguaguguccucaaggcauaguaauuacuggcagcugcugauugccuuugugcuuuaggaaagauguagcauaaagguguaaauagauaauuuccuucuagguucuguucugcuaagcaauccaaagggauucccacucauuuagcauuguuccuguuggcuuuuauagcagccaaacauaaaaccccagagagcaccacucuggagggaagcugaugacaugugaaguaaaucucuuaauugcaucugaacucaauaucugaucggucaguuccuugugaauucuaauagugcuagaccagcccccacccccaaaaacagagugagcauuuaauaaauaguuaacuacaaaaacagaaauaguucacagaaucagagaaaggaauuuuuauucucaagucaggaaagacucaguuaauguuguauaaaucaaaucacaaauucuguucugcucaggucuagucuuuccccuccccuccccuccccuccccuccccuccccuccccuccccuccccuccccuccccucuccuccccucuccuuuucugcccuuccccuuucuucuccccucuccucucuuuuucugcccuuccccuuuccucuccccucuccuccccuucuucaaaagaaguuccaugucccuggcuguccuuagaugcaguaaguagccaggaauggccucaguuaccuuccugggucuguccuucuaccucccgagggccgagggccgccacacugguuuaugcagugcuggggauuuaaccugcauuacauccccagaugcacuuagcuauuuucuagaacuacugauugugauucgguggauagaaagucucacuggaacuucuguucucaacauguuccaagaugauguaguuccuccuggacaggcaagguuggagccagaauccaccucuccucauucuuaguguuguaguucuuuuuaguacaaauagaugauacauauaugccacccgauuuuccugaaagugacacuuauugauggaugaacucaggucccugagccaggauagagcauuugggugauucuaaaugccuuguuucaugcaguuucuauggacugaguugagcuuuauucuagaucauacccagagcuuggggugggagaaaucuuccuuauaauuccuguugcuuacaucacugagggcccugaggagguagcucaguguuuaaaccacuugcugugcaaauguaaggaucugaguucuaguguccagaacccacuuccagacagacacagcuaaaugucuaauaaccucagaggugcacauacaugcacuguuaaaccugagaaucccaagagaaaggccagugccacaauuuuugagccaauuuuaaagcaagcuuuaauuaaauacuggccaggaugauggacucuggccaggacuauucuuggguucccaggaaaggucaaggagucaaaguuugcagaggcuucaaaaggcaaacaaggccuacguauuugccaucuaauccaaucaggggcaagcauaggccaccauauuauagcaucauaggacaaaugagaauuuauucucaacugucuuaacugcaaacugaacuuguaaccuacaagguauuuuuuuuuuccuguuuuggucucccaauaaauuacaaguuguauuguucuuguuccacuuuuagucucacagcacaucauagacacagacacagacacagacacacacacacacacacacacagagucagacagagagacaccuuuuaaagucaaucucucuuugucuugggaaucaaucaggugcuucuuucucucaccauuuucuuucugcuccuugccgagcccccgagucccucuguucucuuuuucuuacaggucuugagucagaaucuugccagguagaagaggguugguucauugucuuucauuccccccucucuugcagcaucucugagauaaacugccucuugaggcuuauugagaccucuuuugugugauaaauccagugaggacacugcaaaaaaaguagacucuggcuaaauugaccagacaccuuugaagaacuccauagucuauaguauggacaagacaaugaagaccaggcuggaccugcuaccaaaaucuuucuuaagaaccuccagagccaggcagugguggagaacaccuuuaaucccagcacuugggaggcagggucagggggaggggcagaggggcagaggggcagaggcaggaggcaggaggcaggaggaggcaggaggcagagaccgguggauuucugaguucgaagccagcaugguuuacagagugcguuccaggauagccaaggcuauacagagaaacccugucucgaaaaaccaaaaccaaacccaaaccaaaccaaaccaaaccaaaacaaaacaaaaaaccccaaaacaaccuccagauacaguggaugcuagcuugucuauuauccuuggaaaugccauaccaucuugguaaaaguacuauuucucaucuauugcuaacugagcaagaggaagagaaaugguuuacucacaucuuacagagagauagagaccauuccauucuuagagacucuuucuguacugaauucugcugcaguagggaauuugaauggugcuaggcaucucagucaaugacagacaucccuccaccguaaugcuuguagucauuucucuagaaacagcaugauuuuccucuggauuccuuguaguucuaacuucugauuacuucuuacugcggaguuaacugcuugagaacagauauuuuguagauuaaguugcccagcgugucuuuugaccuggggagauagaaguaauugucaccuucuaguggauggauuggucccuccuuggucuuugggaagaggacuucugggacuucagggaguugcaagcaggagaacuaggaaauguuugguucaaguacccuaugaacaauacuagucuuucuuaaaugcaucuaaugcaaaaaggacugugucaucuuguggcaagucucauuggcauguaaauauuuucacuccuuacaggcauuuaagugaaaccuucaaaauuacaauauuuugaaccugaaguaaagaagagggaaggaggaauggggggugggauagagagagaaugagaaugaauauaauauaaagcuaaacaagccauccuuugcacaguuuggauccuucuguuaugaauggucuuuagacaaaugagaaacacuuucuccuauuuggagauaugcaaauguuaaagccaaggguaaucguugugucuguaugcuccccuuucucuuucucuguuuuccucuucgccugcacccuauaggaaugugaucacagcauagaaguauauucagcauuuguguaaauaauacccaagcugcuuggagcaaaggcuucuugcauugcguccaggguuuggcaauggcauuuucugccugaagucuacauuugguuuagauaaagauuaaauauagcccuuuauuccuguggacaucagaguuugcucagcacccuuacagcuguuccuucaucugaucuucacucuaagcccaugaaguuggcagaauagauguuauuauucucauuuggccauugcuuacaagaaagcauccagauuagagguuucuggguaaugcucauaaugauguccuccaguaaaauugcugcugcucugucaaguaugugaacugguugcuguuuucucccuuuuggucaacaacaggguuccccuuuaugugucucuucaggucugucuucagagaguccccauaagacuuaauaaggagcucuguaaggugcacuacgcugcucugauaaaaggagcgccugcugguguuuauuaccuguguccuuguuguuaaugaagccgggcagaggagcugcaggugcggcuuugccugaagccucuauuagucaucacucagaggaaaugcgugcccaccaggcuguuccuuuccuagcaguaauugcauuuuuaaagcggagaaaagacagcaagcauuaccuuuucgaauggaaaugcuggaggauggccugagauggugugcuuuaccgaagcccagucuuguuuuaaaguuucucuagagcuuguugugggcuugggauugucaguguugaggagcggguggauaugcucaguuagugcaagcgcaagcuggcaggacccaggcucgccccgaaggagccccgcuuuauuuggaaaaugcuguuuucauaggaaugcguguguuuuccucucaacuuuggucaccccugagaugguaugcauaccacuucccaaggcguuuggaaagagaaaccaccaagaggccaugcaacauauugauugcaugaaggcuugcuguaaaacacuuagcagcagcaaguaauaaauagcaauaacuuugguccaggccuucuuucuuccaggugacuuugcauaacaauuaucugugguacuuucuauauuaaaagacaauuuugccuacucuuaguacauaagacaggggaagaacacuggagaccagaaacgagggguguguuauuaacuagugagugguucugcugcuguaauuucaugagugaugcugauaaaaaccaaaaaugugauuucccaucaucucugcuucuuuuuuauuggagcuuuccuuuucacccucauguuaucaacuguuaagauuauaggugaucugugucuuauuaauuuaaagcaaucagagccaggggugugguuuucagcacucaggaggccacucagugaguucuagggcuaugcgugcuauaauugugagaugccgucaacaaacauugccugcggaaaaacucagugauaaagauaguagcugugcaagccagacagccugaacagcccuacaagacaacgguggaaagagaagaccaaguuugggagggcuaaguuuaaucucuagaauccacuugacaggagaaaggagcgaccucuacaaaguuguccucugaccuccacgugccggauguaggaugccugucccuccccaaucaugagugaggacaccccccauuguuauaaauuuaauuuaacaaaaaaaaauuaaaaaauagaaagaugagaaacuauguucauaugagugcugucuuaauaagcuuaacaaggagcuauauuacucaaccuacuaguaacugcuccgcuuaauauuauuugaaacuugaauuggggagagguauuaaauaauuagcucuaaaauagucaggugucuuaauuuucaccaaaaggaaaaacguuaguauuuuaugaaguaauuaguauuuuauaaagaauguaaauucuugguucuccacaguggaauuaagaaaugcacacccccaccccaaccccgaggaauuuuagauaguucuuuuagggaaaaggucuguggacauuguuuucaugcucugcucugaccacaugccuaccccaucauguugcugauuguucccguaugacuuaaaucaggcaucugcacuuucugaggaugcugucuguuaccuguggucccccaacuccagacccugugaaucugguuccuguggugacggcuuguagcuggcaacucaacugggugucuuggcugguucccauguagcauccacuccaguggagaauguggcuucuuuacaacauggcugcuaggucagauuccuaaggagugaaagcagacauaccaagccucuuaaaggcuccauuccacacagacagggugcuuccugccugucagagcuaguccugccacuggcugagggggagaaaagcuagacuucacuucggaaagaagcaacacagcauguacucugggaaggaaacucucgcuggagaccaucuugaagaucaguauauccauuucaccuauuuagugugggcauucugugacauuggucuguauugacaaguggcuauagucccuggagcucccuuaggaaaggacccaugguacuccuggcacccuuuggguuuaggcugaaagcuuauuucuguugaaagaaccugcugugaaauuuuaugaaguuaaguccuacaaaguagcaucacugagaaguauaaaaugccaauuucacagccccugcaguggcgccuuuguuacagcaccuuaugcuguccguacuguccuacgaggcuuuggaguucugaaagaagcuaguuagcagauaggaugcugacucagggucuuagcuagcuagcauagugcucaauacauugccauuuuaugggcccugccuguuacuaacuccuaacccccaacauuccuggcggagcuguggccauggguuuauuucuggaaccuaguacaugaaacuccugagauggucaguaaguguugucaucuaaugacagagagggauggaugagugaaugacagaggcggaaauguaguuucugugcaggcuacuccauuuuguguuccuaaggcagcaugccauagccuaugcaucuauccgaaauaaaacuuuauuuggcucaugguuuuagaagcccaaucuccaagggcaacagccgccuuuuuuugucagugccauuuaugggagaaggcaucuaucuuauggcaagauggagacaaguuggaacucaagagucuccaguucucuuguaaucaguguaaauccauuuaugaagcuggggccuaauaagcuaaauaugaggcucggacucuucacacuguuguaccaggcauuaaguuuguggcacacaugauuuuguuuuuccuuuuuuggugggaucacagucaaaccauagcaaaugugugugggguagaaugucuuacugcuuguccagguucuuccuucauccccaggucucguuagaguccauccaaccaaggagggaagauguugaaauuaaauuauuugauaaaagcuggcuuugcacuuuuaugguuuauauucccaaaugaaauacacacacacacacacacacacacacacacacacacacacacacacccuuuacauuuugauaugccuuaaacaguuggaccacuuccuaaccuccuccugaguuauuacuuacuaaauucucuauccuaccuuggcugcccuggacccaguugggcagcccucuggccggagcucuccugacuccuucacuugguggcugugccucugugcccugcacucuucugagccauggagucucucuugcccuccauacucucuugccaguggucaggcuucuccucuccuuuccucuccugguccccaacucaggaaaccuccugccucugucugugcuucccaacuauuggcuauuggcaacuucauuuaccaaucagaaccaacuggggacagguuuccagaagcuaagggcagacucuccugcaaacauuuuuuuggggguggggguggagggugggcagggauguaauuagcauuagaauccaagcagcuacaggaagaggcaccaguauuaacuuccacaccagacauugcaagcaugcuaauuauccugucucaucacgugucaaagcuaccccauuaucucagucagaugagaaccagaccagaaauuuuuggugagaauuuuuugaaauuauaauacccaaaacucacuuguaagaccaaccuggccaaggagcaggugacuuccuggaaugcuaaguguuguaguucuuggaaaauaacacagccuuauaggaaaauaggguggcuugugacuuuuuguccauaaaagaccugcaacauguccauuggaauaaccaaagcccaucucuugguuaguauuuacuaguuaauauacuuugcuucaaauuuggccuaaagugaugcaguugguuuauccuccugcaaaucuuaggauuaacaaaauuaucugaacaauagaaauauucaagaagcagcagcaaguuuuagauucucugaguauuggaauaaggaugaaaaaggcugaagaaagaaagcuaauaaguaaaagagccuugugugugguagcgcaugaaacuguauuuuuuuucuuucuuauugguaugauuaugaauauugcuguuuugguuaugcucagagagagggaauagauuuugauaggccucuugaauuauuuguguuccuucuuauccauuauauuuucaaguagcuuuucuuuaguagugguauuaaauuuuaaacagaauaugaggacuuugguaaagugcucaucuccagcuugaguuccccgucauuuuaaacuucuuuccaccucaugcugauauuuuuuaugcauauauugucacuuccaaaacucaauggcagagcaaggacaagucuccauacugaagaguauacaucucuugaagauggagaggccucuauaggcuccuugaguaaugaguacaacucucucucucucucucuguguguguguguguguguguguguguguguguguguguguguguguguucguuccauggacacucguguccaguagacugauguuagaauuacacugaccuaaaagcguacucuggauuuuaaugcucccccaacaaggggaggggaaacauuugcagcauggaauuaacagucuccucagcacccaggugccagugaaaagaauauucucacguacccgaucacacucaaucacacagaaggauaauagccuuguuaacaugggcaaccuuacugcccuuuugugucuaaauaacguguguauauggagauacggcaucauucaguuccuacagaauaacagcuucucaaugaggaaaaaaugaauugcccaaaccuaacauuuucuaucaaagaaauccucaaaauacaaugguuuccugcuccuaaaacucuaggaaucuggauuuaacacaacagcagcaucuuuguuuuacaguuugaacacucagccuaaaccaaaugcuuuagacuuucucucuuacagugcuucauauauuauuucuuuaauugauugcacaaauguauuugauacugcuauauuuuauaagaauuaaaaggaaaauagucuaaauuuuuaucacuggggaauugaaaacacguuagugcaucugaaggguaaaauacuagguacauguuggaaagaguggggauauauuuaaaugccugccugaauguuuaggcuguacaaaaguauucaucauauggggugaguaggcacucaaacauuaucuguagaaugauucaauucaaauaucagccaaaaaaggagaacuaaacuccuuuccaaacuuuggccuuuggaguacuagggaucaaacugcugguauugcaugugccaagcaggaacuuuuuaacugaggaaccccccucuccuaagcugaagggugaugaugaagaacggcuaguaauaaagcaguguaaggaaaccguguugaaguagucugaauuccucagcagaagacuccuuuauguguccauuaacuucgaaaaagaaucauauauaguucaagauaaagcaaucauuuacacauacucugcagaccccacuucugaaagauaaauaucgguuuguguguccuuacguagcaaguccagcccaacucugauguuguguugauauggaaacacaccagcauuauagcuugcuggccaagguucaagucaugacuuaggcaaauugcuucaucuuuccugucauugguuuuguuuaaccccggagcccuaaauuucucacugggaaaaaaugaagugaguuauacauucuuccaauauuguuguaaugagcaaaugagauaauggccguggaauuauugugugaacuguaauguacucagccuccauuauuauggaauguuguuggagccacuccaagaaguuaccguucccacugagugguucccucccagagcuaaggaagagcagugggccaccagauucugucuuuacugaagguaacaugaauggcaugaaucauggauuaauuagccagggaagaggccagaagcaccuugacagucucuggaaaagguguugagugaaagaagucuucgauuuugauuuuauauuugacaaguagccacaacaaaagaauccuccauagcauguagaaggagaguuugucuuauugucucuaaaauaauaaaagacuauaaaggagggaccugggaaggcagagagagauaaauagcuggggugguuguagauaaaggucaagaagacagaaugaaauaaaucccuaacuucccaucaugcaucaggcccccaggauuagagguaagcccaagcugcaguuucuagaacauucucugcauucugugaggcuugauguuaacuuccgguaauggcucaggcaagcaagguaggaauucuaggauccuuagacagguuggaguucuuuugggcugccuuggugccuuuuagcaagugcuuaguguuaugucaacaauuuuuccaaccccccaguuggucuuaguucugugauguccuguaauuauccaggauccaucuuguaacuuuuacuuggugcccaguauuggagagauaggugcugauuuuccuggcauuuccaaaauucugggcgugcauuuuucuuccaguuggucuugacuugacuugacuaaauuuccaagccuucugguguucauguugcauaaucguguaugacucaucugaggguucgaagccagucuagcaaagcaaaccccauccucccuggcugcuccccacaagcaucugcagccaggcagcccuagaguguugcguaaaccagaaggcaggacagcuuggcccuaacguacaaggcgugcauccuagccccgagugguucucccuuagccaucagcuggugcucugugaagcagaccccugaaguuacucucuccagaucccuuucagcuaugaagacauuguuuuaaauuaaaugagaacuuguaauacuuaagucagggaaggaaggaauaaagucaaaagggaguguuuaugugucccucccauagguccuugaacuuagagcuuugaagaagaaauuucaggaauaaaaacuugaugggaccauacuuagugguuacagaauauggcccccuuaagguuuuugaguagcauaauaguuuacuaggcugagcuguagagccacgcauuuguagacaggggaugucaguuuugaacagucucccucccucccucccucccucccucccucccucccucccucccucccucccuccauagcagcaugguuccacuguuggccauuaagugcaccucuucccacaccuugucuuaaauagccuuuguuucuucuugaauugauagucaacccaccccugguuuguuuguuuguuuguuuguuuguuuguuuuauucuuucuuuaacuugucuuucuacuccuuuuuuucuuauuuuucauuucucccaagguaucuuaauccgaaaaaugacaccauagcugacuuaauccauucaaaccuuaucuuuuguuacaagccuugcuuuagcaauuguuuacagccaagcucuuguuugugauagaguuaaaaacuccaaagcuccaagcaguuuaucuaggcagucucacuauguagcuuagcugaucuggaacucauauguagaccaguuggcuuggaacuugugccacuuucccugccucagccuccagaguggauuacagacacaagucacagaccugucuugucucuugguucuugguuugcuguauguuagacagggcagcucuguagucucaauagcuuugauggcugggguagacuuuugucccuucuuguacuuugcaauagcuaagcuuaauuacuccucgaugcagacucuguaccgaccguuuagacugacggaugcuccugcuuagguuuccuuggcuggagccaucacuguuuagucuguagucuucagaugaucaguggagcgagcucguucucuagcuguccagaggauacgagaggcaucuuacuauggggaaggcugauuuguggcccucuuaucugagaucuuuugugucauuaguuuaauuauacagaugggggaauuuaauaccgaaauuacuuaauaauaauuucaaagaauugcugugagccaugcccuggccuaagaagcaugugcuuccaguaugaccaguuccccagucacacacauuuagagcaaagguugucaaacuuuuguagacuguggugauguccagugacccucagccagagaggagccuggcaccagccaccagucuuggguggcuugucucugguucaucuggcaucugcaaucacugugggcuggcauccuuuagauuucggccuuagaggcuucuguguucuaugccauguccuagcaguacccaacggcagagucauuucucagacacucaaacaauacuaguuggcuauauugauuuuuuucuaguccagguucucauggacacugccaugauuaucuagaaagaauccucaagguagugccaaaacccuugcccauuuucacuuuuuaagccuuugugaauuuaucugaauaauggggccauugacucguaggccagguuauuguagcauuuaaacuguauagccuaggaaacagaggcaggcccacacauaacugguucucagguugauuucccuuuccccauugacaccucuucccgcucuacaucagaucacccggaugucaccuuugcucucacaguccuuccgugcugaccuuucccagggcuaggaaagcggacaggaugugcuucccauacuccuaggguuucauggggcauuuucuggugugaacgugcagugacugcauccuauaucaaccugacuaucuuaccuagagcucugcacaggaaguagaguccugccaguagacaaaugugucaccuuaucuaugaguaggcugacugggggacagugcucuugcucugauuuaccuuucuucuaguucagacucugucuuccuuagcagaccaccuuggccuucccugccuucacguaugugaucuaucuggagcugugaaccgaugacuccuaucgaauaucuguugaaacauuuugucuuauauuaaggcacaggcagcccuuauaagaaacagaaauguucaguguaugcuaggcucauaucauggccaucuuuacagauuaauuuguaaaauucucuccuccagaauuacuaaagagguuuuugaacacugaaucaugaccgauagauagcaaauacauauugcauccuacuaaggaguuguucuuuuugaacuguuguuguuguuguuguuguuguuguuuucaagacagaauuucucuguguagcccuggcucuccuggaaaucgcuuuguagaccaggguggucaggaacucagagaucagccugacuccugaguacugggauuaagaacaaugugccagcacugccuggcucuuuucaaauuauuaaaaaguaagacuuggaaagaagguuuuuguuuuguuuuauguacaagucacaagagcaguuguaugacugugaacaacuaacguuccauugauuuagcuuuagcaaauaauuuucuguuugcaauaugacugggacacuuuggagaacucuauccaccacccagcuuccccuaaagucaacuuacugaacaagagauguucccagauaaaccacugacuuuggguucugcccucccccaaccguuaccuccuuacccacccccaaauuccucaacccuccacccccuaaauccuuccguuaauuuacucauacuacuaauaauuacuugaugcucuguucuguccuuauaguacaaccuucauaucauggcuagguguuguuugcuuguuuguuuguuuacuuuccauuucauuaaaugaaaaauucaggacaugcuguacuaaauggcuagagguucucuaucacaaauucaagaggagucagauaguguguuaaaacucuuaaaaccuucaaaauuuuuccaucacacuugaacugaaccccauucaucuucaaaaacccccuagagacuggucucagucuccucagcucacaccuuauccccuaccccuuuucuguucauuuguuuuuccuggccacacuggccuuucuucugcuugcaguccaggcacaugccuaacuccugcgucgggguuauugcucuuaccuuucuuucuacuguuaaacccaaggucacuggagaaaaaccaaucccacaauuuugagccaaauguaaaacaaacuuuauugaauacuaaauacugaccaagagauggacuuuggucaggaccauuuccgggaguuucccuuuuuaaaaaaauucugguuaacuugaacaguguaaggaacagauagcaggaaaaaagguaaaugcuucaaagguauuuaagugaaugucaucucugucaucagcccuuugguaugucuguuucauugagaaaucuguccucuuccccuuaaggauauuccggcaggacaccuuuuccccaaacaguuggaguugaauuagauuucuuaaaggauaauaaaaugucacaguuuaaacaguucuuuuacuuuugacagcucuaucauuaguccauugucauaggaguggcaauugaggggcuguugaaagggccuuaacuagcagaucaaaagcccggaagugcuaaaagacacugaaggacauggaugcccuggcuggagccagcacagggccuucuuuccuuaggauuuucaggcccuggagacacugcauuguuagagcuggauggcccuguuuuauguaagaguuggguuggcuuucuuuuuuauggaguuuacuuagccuacccauuuagcaugauuuacagaggcugauguagauaaaccgguagacuuaccuaggaaaggacaaguggccuaaauugcaggaagucauugagaaauucgacuagucaggccauuccgacuacaguggaauuaggaaacuagcuguuucauuuacagcuaauuaaagaucagucaagauuacuucuggccuggcuaucuguguaaucccguuaguccauuuuacagaugagagcucaacacuggaauugggagaccucggguuuguguccccggguggucugccagggucuuagccucauuugacuuagugacuccuaggacagacaaguaaauuguauaaagacuuguuuggguuuuucugguuucauuuuguuuuaucuuuguuaaaaaggucagaacacucagacuacuucagagucccuuguuggaaggacugguauagguuacgaagacuguucaucaucuucaacacccuagcuguuuagagccugggagacagaaaacgauuuccgaauucuuguguacaaguaacucuaagaugccauugccugauccugcuaacuuguaagagacuaauuuguaguagauaugaaauagucuuaauuuucacuuauuuuuuuguaaauucaguuuuggaaaauagcucuguggaguucucccuaacucuacauucuuguuagcauuucuuuauugaaaaacgccccucccccaagcaggcaguuaggcuccuauguuccuaugacaaagagcuguugcccagguuaaucagaaacuugaauguuugacuuaaauaguggagaaauuaauucuuuaaaguuuagaugguauuugagguaauacauugcccuucaguguuauaaauaaggaaguguaaguacuuaaccuucuuccaaagccaugcuuagagccgcccuuauuaaguaaauugaaaaguuaaaguguaaaagaaaagcgaaaacaaacgaacaaacaaacaaacagggggcagguguguuuuauacacauauaaaaccugaacuuuuuaacaagcugaucaccaaacuuuuuaugaguugcuuuaaaaaaugagcuccuccugaugucagauaaauucuucuaaggugauuuguuuuuaaaauguggcuuuaauaaggaagaccuagaauggguuuccccaauuucuaaguguuuugugacagugaacuucccagcauagcucauggguuaguacacaguauagcaucacuugugguuacuaaaaauggcagacggagagcuuauuuuucauucagaacaucucauuuuuccaguguuaauaauuaauugagcuuuucaguuuucaagugucacagcuguaagugccgguaugcucagcucugagcauaggagugcagaauguucaacuaaugauguuuccacccacugucaaugcaaaaacacagcucuuaccucagaggaagaaaaagacgguuuauucuggagccaggcuugagugacccuagccaaggaacacagacucaguauacccuaaaucccauguucagugugguagcagcuuccuagagguuuuacagugaccaaagaaagccaggaaucaagacuccuuuaaaguaccucuauggagaccacagguaggaagguuagaccaaagcugggaagucucagguguaggcgcccaugcuaucugacaacauucuuaggcuuuuguuugggggaaaauaggguucugcuaguguacucccacauauuuuaccugauaguuacagaaguguuaggucagacacagaggcgaggacggacuggcuuuuaaugggacuaaagauagugcaagguacauuuuuguuaggcuauggacguuuaauauuccaaacucacagucauuaaaguucuaauuaguuacuuugccuugcaacagguuuagugucugguguaguucuuaccaggggcuuuccuuuguauuaccaauaucaaaagcccucauauaagaacaagaaacccauacugcaguagguccuccuccugacacaguuugugucccucggccauguguacagggcucuggugcugggugucuaaagcaacccuggugcaguggucaaaagaucaggaaaacuaggagcgagaguagaaaaguaaagaaugaugagggcaaauugcuguacucauggaugcacaacaugcauuauuuaguaaaauguugacaacuaacucacuugccuguugggcaauagcuugguuauaguaauauuuacuuugcuggggcagccuugcugccaggucugagauuggcuugggauaaggaaagaaggaaaggggaauuucuugggugauagagucucuucagcagagaacuagaucuauuugcagauugacauauacaaucaggcacaucuaggcuguuuuuguaucugguggugaaagagaugcguaaacacaagcuaccuccuuuucuuuauuuuuuuauuugcuucugugcucagaaauguuuugugacucuccauguuuuggauuaguaaagcuguguaagauggggcuugggagugaguaaaaucuuuaugacacacugguccucgucugcugucucagguggcgugccaccacuguucuccuuaaaauuagauguaagccagaugcucuucuuuccuaaugagacaaguauuuuucuuguaagaucuuuuucacccauuaauuuuucagaugcguagggccuaugucaguauuugguuuugauacauaccaguugugugugaaguuagacacacaaaauaugaauauuucaugcuccaaggaauuuuuuuaccucagauauuagcagaguuaacacaugcucugggguuaugaggucuucccgagaugucauauuggaggguaacacauuccuggaaugauugauagauuuaaacuagugacaacucagauugauugguuauggcuucuugguuuuccauauuagaaggcuuuugaguguuccugacuucaacagcuaugagaucuauugcuaaugucugccauggauaucacucuugacuuuucuuauuucauuaugacuccuuguauacacacucuauccacgugaaacuaguugagcacagagagugcauacaccugucauuacacaacuucugaaacgguguuccaagaauuauaucaagaagcaaauuaauagccaggcaugucacucaugaucauugcacuggggaagugguuguugaaaauguaggaguucaaggucagucuaggcuagagacagaggggacaaaguaaacauuuuaaaaucacuuguuaaauuccuacugugugcuucagccucugggaggaacaacuaugccaugguacguggaauuguuuggaaagacacacuaaacggugccauauugggauugguuuuauguagcaaauggagcuucuauaaacuacguuuagucuuuauuuauuuauuuacuuauucacuuuacaucccucucacugcccccauccuggucagcccauguccucauaacuacgcuuuuuuucuaaagagugggaggacauggccuauuggaagcgguuggcuguaauuagaagauaaacgacaaaaagguaauaagggcguggggaugaugagcccacuggcccaccauggcucucuucuucuugcuacaguguucuagaugaaagcuccuuuaggaggucagaaacuggcuaucaaucaccuucuuuuuauucagcaguuuacugagcugcuugccggguguugggcaccauaucaagauggcagggcuuggcuguugagucugaccagauguucuguaaguuccuuucuuauucuauuccgaaaauguuuguuuagacuucuugauugacuugaucccaaggacauccaaaagucacuuugugggaggagcggggcacccccuuuugggaaucacuggagcuacagagagcaaauguggaggugauuuauuuagcucugcuucaagcucuggcucguagcaugcacucauccgaucucuguaacaguuuagaaauggugccuauuuuaguuuccgucuauacucauuccacacacaaaggaacugaagucaaacaggcuuaagugacuuucuuaccuucauccauuuccccuuaaaauauaacguagccaccugcuuuuaccaccauuccuugcugcauguuugccggcuuaaaaauaaauugaacaaggagagcguaggcaccagguuuguugcuuuuucuucucuuuuccuuuuuagaagggcucugauuccagauaauugcaguccuggaaauagaacagaaucuaguacuugagaaggcucggguuccccuuccaagcuguuccuugcagggcccuuaauuccaguacguuagcaagagcagggaaucuugccugcuuaaaaauaaagcaaaucugaagaagagauagacaccagcguugcugcucgguuugcucuuucuccguguguguguguguguguguguguguguguguguguuuucuguucuuuguuuugugucuauuugguuucuuuggauuuuauuuauuuaugcuuuuuuuuuuaaaaaugcucugucuacauguauaccugcauaccaaaagaaggcagcagaucacaucauagaugcuugugagccaccauguaguuucuggaacugaacucaagaccucuagaagaaaagccagugcuuuuaaccacugagccaucucucuagcuccguuuguuuuguuuuuuuuuuuaacagggaauuucuguguagccuuggcuguccuaaaacucauuguguagaccaggcuagccuuaaaccaccugucucugccucccaagugcuaggauuaaaggugugggcuaucacacccagcucucauuuucauuuuaggagaacucuggauuccagauaauugaauuccuggaaguaggacagaauccaguacauaaaaugucuccggcuuaguccccuuaauuauuccaacguguuagugagaacaggagauccugaagagacaccaagcgauaacucagcuucccuguguucuaguucaugaacagauuuuuaaggcuacugguccccgugacuaacagauguuauuuuccauacuauuggaauugggacauacgaaugaacucaaagagaacuauaucugagaaugugacucuuccuaacauccaucauuagaauagcaguuguagugugauguuuugggauuuggaccugcccuguuauuuccaguuucuucucacacccuggacaacccaggaaacucugacacacugggucccagccuguucauagauuccugauuagaauuugauauuuugauaaagcuugucugucaacuugcuguaagacuuaauuuuuccagacaaucaagagucugacuaaaaauggaggaaccgggguucagcuauaggucacuggaaauggaaacggauuuuuucauacugucugacugcuuucaggaaugcuauuuuugauucauguuuaguugaaucaaugauaaaucaucaaauuuuuaugagucaguccuaacucaguagugaucuuacacauuggaaacauaaaaugcucuaacauauuaauauaauaagcacaguuucaaaacagagcauuuucuauucucuagucacuuguucacugggcaguugugguacagcagggaaagauacauugaaaauguccuuacaauccaugcacggagcuaacuugcuguuaaaaugcagucugcuagucaggguggcacaugucuuuaaucccagcacuugagaggcagagacaagcuucugcguuucagaccagucugggauacagagugagacccuaucucagagcaacaaacagagagucaaaucauauugucuucuuuuuuucuugccuuagcaucuugaauaguguuugggcuuuccguugacaguuucuuauucugccucuccuugguuugagcacucaaacauugcagaacauaaauaaauagaaauaaauaaauacauaaauaaauacucucaaguaggugaguucccaaaggacagcuuuacauggucucuuugccucuuuugugcugcugggcacagauuuagacaaacucauugcugccugcauauuaagagcuuaauaaauacagaugggaggaaugcaugauuuaugacaguguugccuguuuagcuuggugauaaugcucacagauccuaggacuauguuucuuguggaguaaaaauaaauaaacuccucuuuguaaguuagagaguugaugggaaaaaccaaggaacgccuacagacuuuuuuuuaaaaaaggaauuuccugugcucagauaguugaguucauuugcaaugucucuuguccugacugacaaugcugaaggauaaguguaugauaucaaaagccugagcagcuccaggguugcuacagagaggagaggggaauggguugaaagaaaauccgcaccguccugcuucagugucaucucuccucuuuguacaggguggcugaaggcuaccuuaggucucuauacuguuugccugguagguuuguuacuguuuuccuggccugaccuggugaugcuggugagcagccaaguguucuggaaguccacacucugguuuugcgaaggagguccuugguaaauaaauggggcucucacccuguagagugcauuucuugccgaccagaauugaagcuuugccugugcuuuugaccagugcuggcugcuuucuauaagggcagggucugugcacagagucacacaaaugcacuucucaguaggaauuguagaauucggcuuguagaggaaaggacugucgaguuggcuagaccuacgcuugaccccgcucccuacaugggcugauaacuaaaagaaaagaaugucaaaugcuuaagaaacagugggcaccgacagaaagguugccagggcuuugucgauaaccagcucuccuuuucuucuucugcccuuuuccuccucgggcucagcuagccacuaaaugaguaaauugcuagcgggaaugauccucaccaggcuugugaaaccaggggccuagguaggcagcagauugccagauggagugugggucucuccugccccaggacaugaguugccucagcuuaguagcuguguguuggccaaaugugcugguuuuucuccaugugucaguguugggagggauugcaaggcagaguagaucccaaccccagaauugaacuugaggucaccaacauccucuaacagaggauguaaaugguaauuuuagguccuguaucucuguccauucuuaguuaugaauuggaaugaguuuauugagccaccuagcccagguggucuccuccagacaguaauccuacuacuaaaguguuugaacuugcuuuuauacaacagugugaagagcuuccuuguuccagcuguccaugugaaaagugcauagccuguauaaauaucauagaccuucacggagaggcauuccugucucccucagccuagggaccuuugcuuaggccacaugucaugucuguccaucucucugucuccugccaggucuuuccuccucuucuuccuccuguuccuccuuguccccauggaacacaaugcacacacgaacacuuaggcuuacccuacuaggauccaugauccuggaagccauccccuaauauccagugaguaccuuccaauggccucgcugcuuccauuuugcacuggcugaacugaaccucauugacugcucauugaacucuacguuggcuagagaucagcaccucugaaauaaacaaaaguaugucuggacauggaauucuccaucuucaaauugccacguggaaagugauaguuuuuuccuuaaauguauacuuuccugacuccucaguuccaaagguggcaucaucaaaacaaacaaaccaaccaaccaaccaaccaaccaaccacaacccucugacagcagauaaacuuugauuucccuugaauuucauucaucucucugcuucuugcaaacacaggccugguguaccuuggagguaugaucugcagccuccucuguucguuguguaggauucguugacuuauggagcauuugaacacaagcucccuguguugcccaguaggaacccacuugauccuuuccaaagccacucuuguggagcuugugauguucaaugaacacguuaacaagcugucacugugacuuugucaccaggcaaaucucagagcaucuccaggcucauuuugccuaauuauuuauacauacagauuucagucccucuuacugggcuuagucagaccugugcagguuaucaaguauggcaagauaugucaugaaugcuuugccauuaaaacuggucacuucugucuuggggucccgcuaaucuuaaagugaauagcagaaaauuuuauuuauuuauuuuuuaagcuuuggaaguuacaaaauuuguuccuugaaacaacuuaccuuugaauguuugccagugugaaccuaacaccuagcccugucaguuuaaaaugugugugccuguauuugaacagagaauguaaauuuaauccuaguaggugccuauucugaaaaccaucuucucuccaguguaaaugugcacuuaucagaacagaacaaauguauucaaaaacaggagaguaaauggccuuuuugauucagauugccucuacacucucccccuccccucccccaucauagugaaagcuuuauuaucaaucccuucauuuucuuccagcuuuagauuuggagggcagaacaggaaaacauuugggggccaguuguuuugaaucaaaacaaaucaagaacuggcaaaaaacagucguuuccuggcucucugcugaucugauuggugucauuuccccagcucaggagagcuguguuugcucaucuuucguuugcuucugcagauugguguuagugggugauguaaaaacccucuaacguauuaaauggcagugagguaacacagaacuggagccccugacugccuggccuuguuuuagggauuuccccuucacauacaucucugcuugacaaggacagacaggguguuuuucgguggcuuccuaggcuggcauaggaagugucugguggcccacuuccugugucacauuguucacacauuugacaaaacccagaaaaaaaaggcagcggcaagggaaguuaggcuucacuuugccaugaaggcauaauuacauaagaguggcaucuaaaagugccagacauggucuuggagcaaccacaauucugaucagugggcugaauuucugagaauaccacuacccguggcuuugaagucccuaacucugucuaaccacucaguuugcaagauuggaacaagaaaaguggugaguuugcaaaccuuagucacaggacaauauuugggacagugugccugggaucucucagaggcacaggcacauuccuucauuccccaccccaacauggagccguuuuauggagcuacaucuugccucagcuucucucagcuucugaguggguacaguuccagaugugugcccccaugcccugcucugugucuucugacaugaaggucaucagacagagucucugguuggggcauaaaggccugggugcauacugcuaacuugaagccuugcuucuuaaagaguccuggacauucugcauguguccuuuuucucuguaagauaggagaguagggcacagcagcugcuaccuaaagaccauguguggaaccaaauaacucaguacacaccuguaaggucuguacugaugaguuugaagcucaaaggucuuuacaguucaagaucauguaucuaagaggauacaaaacaaacuucagggcuaggaaaauagcucagugggaggauguuugucuagcaugccugagacccuggguucaauccccaguacuagaaaauuaacuaacuaauaaaauaaaaaauuuuuaaaaauccacaaaaguaaagaacacaaacucaacccaaugaauacaaaaaccaaacacaugaacacacaugaagucacauuauggaaucccuuccucacuuuguuuuuuuagaugacauuuacuguuauuuauaaauuugauauaaaaauaauaauaacauuccuuuacaauaaaucaugguuaguaguaucucauaaaaagccuucugugcuauguucaugcacacagagcaagcacaauugaggcuugaaaaggcucgugacccucuuggaaagguggaucugggauugaaacaugucugcuguugggcuguagcuccuuagccagugagacuuacagagaugguuaacaguuguuggcugagaucauacgagggguggguaccuagcacagguuuagggcacaggcaagcagcacagcagacagcuuauggaugaaacaguccaguggagugggccuuuagguuucucccuuuucaguaagauugucacacccuauguuaggugaccaccagccaugguugaaaucacuuccccugggcagggcaguauguaugcucugugcacugcuggguguuaguauucuuguuuagacccugagcauuuacacaggcuguagauuaccgaugaaaugcuucuguuuagcuaggacagccagaugaagucuguugcaguuguucgguucuuaacugucugcugauuuuuggccuaauggaaacauggccgaagucaagcauucuuuccaguugacagauacaguguauuugcccagcagggaaauuggggcacauuugaagcaaggaagaugcugagcaaaugggagugacaggaaacaaggugagaagucuggugugggcaggaccuugcagguugccacccaaggaggcaaggaggcaaguauagaacagcgucuuucuccuguggggaugcaaccugugagugugagcccuucacugaaggccguggguuuagagggcaguuauucucuuugugccugcucuuucucuggauguaauuaaggagacuuuagagaaggaaucuugugcuaaagcccagauaagagccugaacuuaucuaccuccccaaaucccuaaagccaaguuggauuuuaauauuuuucuuuuggauuugacuuugcugcugugcgaaggggcagcagguggggaggagagagaggagaguuccuggggaagaagaaaccuuuauggagacccauuuuuaaucuccaugauggcucaguaauguaagcccugagaguuggcaauggaaggaaaacugcaggauuaauggccuugugccugcuucucugauacccuuuaaaaggccagcuaaccagcuggcucccuccugcuccaaaugcucucccucucaaauccugaguuguguuguuucuuuuuggcugauuuuaauuuucuucuucguuucugaauuucagcaccaaggggguagggagacuuuuccuuccuuccuuccuuccuuccuuccuuccuuccuuccuuccuuccuuccuuccuuccucccucccucccucccucccucccucccucccuuccuuccuuccuucccuccuucuuccuucuucuucccuccacaccccaugugugugguggggugggagguuauagcacuacagaugaacaggaagauuuuauaggaaagagauuuaguucaucguaauuuagggauuuauuuuggugacuauuuuccuuaaauugaaacccugugugugugcuuguauuuguacacauuuaaccuucugcaauccugcaacauaguacauauauuuuuggaagcagagauacaauccaacauguacucaauucuuaagauguuccagauacaauaucaguacauagcccccuuuacauuuuacagcauuauugcuuuucccacaugucuauuuauggcucugaggacgccaugucauguguuucacaguggaucaauguagaagucuacagcuguuuuguugggaugaacauaugaauugcucaggucuaaaugaucacuaaggaaaguuguuuuggguguaagaccagaugcuagacaggaggcaaaagggcuugcuucuuucacugcuagaaagaagcacaugguaauuguuuccaguaggaaaccuuugacguaggucagcagucaaggaaggagcgacagagagccaucauggaagaauaagagcucugccuguuaccuauguuauucugguagacuuuaaaaugccagucccugauaguuuucuggguaaacauucucauuauuuucugucauuggcauugucauuggcagguaauuaacaacaguaccauuuuuauauaacacucagaccuggaugggucucagugaugucccuuuauuuuuguaugacgcuguugacuguuugauuuucuuuuuccaauacgaagcucuuuggugugcuuauuacauguagaggcuauugggccugcuguggggagauuggacuggcccccuggaguggagggucuuuucaaacugacucuugccaauaagauucuugcuaaagugagguagugcaggcaugacauggauggacaaccagggcuuuggggagccuggaugaaguugacaaggauggaauuuuggccacuuucugagccagaaucgcagccgcugugccaaguagugcccugucacgaacaauggccuguuucaggcugggcugagagauggagcauaguaccagggauuaggggugagcucacaugcugggcucuacugggugcuuagcagccugcuggaguacaagcauuucagaugacuacugcuauaucucacagaggucagcuuagguuucucaccuuaaaacacaaauuccguuuucacacaucaguccucagaggauuccagggaucuucauuuuccaugccuuucucccuacaaacuuccaauauggccuuggcauagagaaguaagucucucuaguucuaauaucauuguuuccuuuguucuugaagaccuuugcuucuguccaaauggcuuauccgugcuuuaucugucgauagauuggaaaauuguaauguuuuucuuuuauacuucauuguaucaaugugcagguagguguucucuuuuucaguagacaauucacuuagaaaucaacaugaugauacaucucugguucugaaagaaaaacuaaagaaggguaugcaauuuacccauccuucagcccacucuuaauuucaauacacuucaauacucauauagaaauacaguuuuguauguauguauaccuguguaugugucuucauauguggguguauauuauagauuuuacgcaaauaugccuacaaagugucuggaauguuaggaaaugaaacgggagaaacacuuucagauggagaaaauugugaugguauuuuucaauaacauauccaaacccaaguuguucguuccuuucucucauuugaucccaccuccauccccgcuccaugaccugcagacacccaaaauguucuuuucagcagccuucucaucucagggcaaaauauucuuugucuuagaaagguuucuuagaaaccuugaugucuuaggcucuuuuuucauuguccacauccacuucaugugcauaccuggaugcuauagcucuuguauauugguaccucacccaccacagcuguggucaccuccagucugaccagggcaauaaacuccuugucuucucuguuuccacaucccacaaauucgguacuacucagcugccccagaggaauuccugugggagguaaaccauuucuucucuucccuguucuuggcauugucagugaugcuccuccaucucucauugagagccacauucuuuacuaugaccucaggguccuauagguuuauggcauccucuacuacuccuuuuccuuuccauucucucagcugacaaguguucucugagucauaucuccugaccugaaauacucggaagcacaagggccuuagaauauuuguauagauuuugccaguugaguaucccuucaccccaauaucugacauugaaguauuuuagacuugagggcucgagaagccugagcugaagcagaaguugcucucuucugcuaauuaaagugguuuacuugguaaugauucuccaaucaaagguguccuaugagauacuuaacuuuucauguucugccugguguauguauuucauaccuucuugacagagcaaugccuagugguggccgcuauaguuaggagcagguauaaucuuccucuggguguccugcacaaccacauguugucaagauggagccaauuguagugucuuaccuggauuguccagugcaggccauauuguauauaucgaaaaucuauuauguccccuuucuagauccuguggucagagaaggggcuucaggagugugggcaugauugauugagagauacacagggaauagcuaaaggggagagaugcugucauuggucaucuuggcuuuggguaaggcugguacaaagauuuucuuucucagacucacuuaggauucuuccucagucuaaauaaaugcaguucaguagaagaagcucuucugaaaugaaaaugaccuaugucagaaaagucuagucaagccaauccaguggcguuuaguaccaucucuacuuacaaugcuggggaguuuuuuuuuuuuuuuuuuuuuuuuuugaguucaucugaaaagcauauuuaaaucuguugcaccaaaacaaugauuuugaucacaccuucuccguugucuugacuuuucuccucaagcgcucuucuaacaaaggagcauagcuuccagauuuguaaacugccaccuuauuaucccauuagucaauuacagcugcugaagagcaggguaagugacaguauggcagauucgagccauuuaucugcuguucgcauagccuuguugagcacaucaucaagcuguuuaaauucauugauaggacuuauacauguauuucagagcacuuaacgugccaucagaauguuuaggauagacucuggugaccugaaauugggacugccuuccucagcagugcauauacagcuggguuguaguccugauuagcaaaacugauucaaauuaggagaggcaaccugcuuucaagaggauauggggcuaguccacauauagcagugcaagucaaauuggggacaauuacacacacgcacacacgcacacgcacacgaagcaggauaauggagauacaucuaucaaacuaguagaucaggaaaucuuuuguaaaugcaucauaguguaaguucuaaguaaacugcaacccauuggaguuugcuuuacuuccggugaaccuuguagacaaagagguuucacguaaaugcuacaccauugcaagcucacagagaaacuugacauuuggacucugugggugaagagggagcugcaggggguugugucagcaucacaaggaggcaucauggugaaggagcccuguggguauuggaaaauagcuguucuguucgucuugcucuuccugcuaaggacaagaguuauacuaugguaguguuuguauugcgaggaaaagacaggcugcaaaaagacaaagaguuggccuggagguggugguacgcaccuuuaaucccagcauucaggaggcagaggcaggcggauuucugugaguucaagguuagccagagcuacccagccaaacccugucuccaaaaagaaaggaaaggaguugaguggucaaauagaugcuaguuccuuuucuuuuuuuuccuuucgagacaggguuucucuguauagcccuggcugucuuggaacucacucuguagaccaggcugggcuugaauucagaaaucugcuugccucuaccucccaauugcuggauuaaaggcgugugccaccaccgcccagcuauggaugcugguucuuaggagaugaggcgagguauuggaggaccugucaacuucaguuuuuuuccuacuuucaguuguauugagaaacucuugguuccaccuaaauaacuacagaucugaaaugauaaugcccuguuaauuaugagcagcacuaacccuuguagacuuggugguucacuuuuacugugcucccagaguacuguaucgacuacauaguaaaaggcccugcuuccucugacuuuaagcucaaagugugauacuagccaaugccaaaucagauucucucaaucuuguucauauauuaggucugaaaauugccuguguauuacaagaauuuuagcagcaucucucuggaaccuaccuuaccccaacgauggcaaccuuaacacucucucuguguguguguguguguguguguguguguguguguguguguguguuucuuguuguuuuuucacuucuccaaguuacuuaaaaugaccuucuaagggaaauaauuguuuuguucauguaaaaacugaguccagcuguagauuucucugagaaagcuggguaauuaacuuacauaaccauugugagccaugaggcagaacagugagaccgcugccuuuuccucuggagcuacaacucugaugaugacaucauaccuuuggcauauugcuguccuuccauaaaacaccaccauugagagcggaguuauuuuuggaugcuguuuucugaagauggaaggaagguagacccauauauuuccucagcaauauccaaaaacaguacacuacauggaccacuucguauaugcucaugguguuggggauuaauagugauuuccaacuucagaugccuccaucucacugugagguuaaaauacuuaugcuguuauguccaucaaagucuuacuggauucccgagagcggagcucuaggcaaauccuuggagauguaaaaucaccggagaaaacaacuccagcucuccaaggaaauuauggucuauuggcuaucaguuucaauuaaaauguuuccaacacaacuuguagugcaaggagacucuuaaacgaaauguguuggccacauguuuuuaaauaauucaugacgcgcauuuaaacacuugccauggcucagugggguagaaguacuugucccaaaaccuuaaugaccaggguuugaucucuagaacuaucagcggaaggacuugauucuuguuugucucuaaccucuacauguuugcccccacccauucauaacacacacacacaaacaccacuaauuaaaaauugugaauuacuuacauuauuaaugaaggugaugagcagaaaugucagaaaucuccaagaaacugugggucuaguaaaauaggauuucauuuuucuguuugcagaauguucguagcuuaagguugaggaguaggcuucaugaaccccaggaauguagcuccugcuguuuuaugaucucacuguauuaaagguugcuccaguuccagcuaucacaacugcauugccuaccguagaaagagaauagagaaggacccuuccuuuguagacaguucuuggaacgguuaccuuuaaccauuccucagguggcuagagagacuucuguaagcauccacuguggcuagacauguguguuugcuucaaccaucugaaaaucaaaauauguaacuuagauaaacagagaaguaaagaacucaaguauggaugacaguacaaagaaaugcuggcuucuggcuuccuuuggggccaagguucaaggguuauaagcuaagagcugagaacagcauacagugaaaaugacuuuaagaguaucuaugcaaacucuaauugcuugccaugcaugauacuauagauuuguuagcuuuuugcuuuuaauguguucuuauaaacaacuauucagaauaaugccacugucauuaaauagagucaccuuaugcuguuauaauaaucugucuuguggguauuugaucagaaggaaacaucagcuaagcaaaguaggagauuauugaaugggaagacagaaaggugauuggagguguuccuagaacuacgugacgcuuccuauuaaguccuaagcuauuuuuuugguagauugaauacaguaugcucuuucuuuguggaggcaggauaaagagacaucauaguuauauaaauauucugaaugaacagauaggccuaccuacagaauuaacagcggauauuuuagaaaaccgauaacuacagcaaugaggugcuaugugcccucaggcauaaaaccagugguauuguuacauguuauaaagaaagacaaaggugaugccuuuacaugagaagaaaggguucuugguaaaguuaggaugcaaggcugcauuuccaaugccuccuuuuccugugccuuguguucuuacuuuaugggugcaagcuugaggcauggacagacuagcuaacuguccagcgucacaaagacacugaguccaacgucacaaagacacugaguccaaaguugauguucaaacucuggccaccugauacaagguucuaagcuuuucuuuucuuucuuguucugguuaaaagcuguuaaccucuaucuuguauuacauagauaguuuuuucugccaggaagauugaagcuuuugaauauuuuuguccauucugcaccaucacuuggcauugaggauggcuaccuucugaaguugauaacaaauugauaaaaauugauaauuaaaugacuugguuagauuacccuaaguggcagggaacaagcuuucccacaaggcuuugcccaucaguggguggcaacuggcucagugucuugucucucucaaguugaaauugccuuuagaauuuaauuguuuuuguucccggccacuuugaaauggaauuagacacacuuguguagugucacuggcucaguacuuacuauaugcugagaccuagcuacauuuuccuugaugagagaauggccgcacucacuuuuaugugggucuuaguagccaccaauauuuguggaguagaauuaagggccaggucaauuguggagugcgucuacuagagcccccauaggggcagagaaacaaccaaccacuagagccccggugaacaguauucuccauggaaguuuaacuucugcaaugcucaaauaauuucaugccaggccagcucucucuaaacuagaacuuuggauauaauauagugucuguuuuguuuuguucucuaaaucaugugacagguauuuaacaaaugugcugucucacuccugguuuaucacaaugucauaacaaauauaugaucagauccaccaagugagcccaaaaaucucaaggauccugggaaauaucguucaguugagcuuguuuuaacugguuuugaaaauggacccacuggacucagacuuuuaagcacuugcugcuuuuccuuuacaccuccuaucagcccuugauuaaugaucaaaggaucauugucuggugcagaagaccgcaggaguucuggcuuuccugggaaagcaggaauugggaaaccucccaaguaugucaaaaggcaaagggggaaaauuaauacguuguugucagggagccucuaaagaagaguucagauagcgcucauuugggaauagcuaucagaagaaacagaagcagagcaggagagaaaugcuaaggggccuaagaugcaguuugggcaaacauuccuccaucauuccuagaagcaggcuguacauguucccuuuuccugaaaagcuagcacauggacuuggaggaggcugagggccucuucacugugucucaaaacugacaauucuugaucuuauuucuuucccugauacuuuucauuucaagggaaauaaaaaucuguuuucggguuccuuucuccucccuugccacugcuaaugucaauaucgccagaacaacuucagacuuuagacauuaagaaacguugaguuaauauaacaauuugacguugcuuuaaaauuuacccauggaucucuaggcaagcuccaucuuuaaauauuuacuuaaaauauuugcuuuugcauguauaccuggccauuuguaggaauguauugaaaaugaguugauuuauuugcuucauucuuggguggauaauguugacucuacugaaguguauuagaagagagucauucuauuagcuauuccuucuuuuaaagaguccaugguggcuggacucugccguauuaauuauuccgugggcuucagcaaucucuaacuggguguuuucuaaauaacaacuauauguagauaaguuucuuuagauaagucucuaauguagcacucagggggggaaaaaucagcagaccugaauuaaccgagaaaccacuuuuguguugcguuuugauccauuuaagcuaaacugauuagcacuuuuugaaaagcaaaucuaaauccuugugcuaaucaagggaaauugagccaugcuguuauuccauguuguuaccgagccagugagaagcagcaagcucccuuuuuauuuuauuuuuuauuaaucacucagcauauagcuggguucagugcccaccuccucccucagcaaaccacucuccucagcgcuuguuuaauaaaacugcacagcgggggaauauuggaguguuagugggauucuaggaaguucauuccggugcaguugacgaucgggugagugcuuuugcuuggggguggggggaggggcggggauggucuguuugaagcaggcuguuaagaaaagcaugaagccuguugcacacacgugacucaacugaaacacaaguagaaagcaggcuugccugguuuccaguacucaguggcucuccaucagggguggauggacccugaggcccaccucaugucuucaccgcugauaacuucauucaacaaaaggcucacuacuuacucauauccaccccaaguagaugccgacgguagcgacucggcaggcuuacuguguauggaauucuauucuuuacuaagaauugaucaucacagaggccugugcaauucauuaucccuguaaaccccacccucuacaguuccauucuuuauuggcagugauuaggcaggagacauucguuuugguuuucaggcugucugguauggagcagcagauaccagagaaugaggugggggauggaaagggagggauaauaauauuuagccuuauuccuuucaugccuaaccagaguugaggaauuuucagagcagaaauuuguuguuucagggauauguccaguuuucagcuggaguuacuuauuaaccucuacuugcauaagcagacacccaugagacucuaaggauacauggagaaagaagucucaccuugcucucacccucucugagucuucaaaugccucucucaucagugagcugagagggugagaagcuuccacccucucagaggcaaaggcaaagcaguuugcaccuuucugcuucugcugugaaaccuuugaaauugucuuacagaugacaacuucauacgagucagauuuuccaauguacaugcaaggcuacagcucacccgcagaugcuaguagagauccagcuagucugagaucucugcaaaggcccugcguaccccagcugccugcauggcucccuagcuguuuaaagccuucccagguggcuggcgcuagcagguacacauggcaagaacuacccauggcaaggaccauuugcugguugugauaguugggacgggucuccaaagccagaaaugaguaucaauagacauuaucuuuagcacagagccugugugggcccaggguuuaauccuagcuggugugccuggcugaugaauguucuguagcugugaucaucuccuugggcuuuuauugcuguuugcucuggcugugccuuuaggagaaggccgagcacugucugcugaagagugauuucagaaaucacuuggaaaugguuguaaucuuaagaguguccacacaaaggucauagaaagcagaaauuggccuggauacagugcagaucauauacaaccuucgaugucaaugucccuguccugaucucuacuccccuuuaaaugccacaaaccuguaccuauuuuaaaagguuccaggacuuagaaaaccuuaugucacuuuuucuagaccuuugcuuauuggugacagaggacaaaacuucugggcagguuaaccagauuagguuacuucugugaacaguuaguauugacuuaguguuuuuguugcuguaaucaaacaccgugaccauaaacaacuuggggagaaagagguuuauuucagcucacacuccauugaugagggaaaucaaggcaggagcucaaacagggcaggaaccuggagguagaagcuggugcagaggccauggagggaugcugcuuucuccuugugacuucccauugcuugcucaccccacuuucuuacaccauccaggacaauguauagggccuggggguugcaccaccuccagugagguagaccuucuuuucuucauuaaucaucaguccagaaaaaugcaccacaggcuugcacagaggccaauaugguagagguauuuucucgacugacaguacuuccuuccagaugauccagucugggucaaugugacaugaaacuagcuagucccaauauccuauaguacuauguuuuaagucugcuuuuuuuuuuuuuuuggauccuuggcauuguaugggccuggaccuuccuuuguucuuagacaacaaacugugcaaaguguaguauaucaguucuguuagacauagagaaccuaaauuccugacugccacuacuaaggaacugaucgaguagccugucugaagaggaaauuaauugaccucuugggcuccucucagguucaaugucaggcuuggucccuguucucccuagcauccaaucaacguaccuaccuguuugccacuaaagcuaaauaacaaauuuagcuugcuugaauugcccugguuaccauguucuuacuaagcuggcacacugaacaugcuguaucaugguagaaauuuuuugcaaggcuuaucucuacauggcuuuuaguagaguuucucaucagaauaagauuugggcaaacauauucaccucaguuguucuuugauuucuggaaggaaaacaugcauauguugcuaugccacuugggaugggaggugaguguggguuuuuaaaaauuuuucauuuauuuauuuauuuauuuauuuauuuuaauuuauuuuucaagacaggguuucucuuauaacccuggcuguccuggaacucacucuguauacaaggcuggcuucaaacucagaaauccgccugcuucugccucccaagugcugggauuaaaggcgugcaugcgacaccacgccuggccuaggugugggguuuuuuuuuuuuuguuguuguuguuuccauucaguuuuccagaguuaucuucaaccacaaagucacugccagccuuugggagguggaagacacacuguccaauugacauuuucuguuucuguuucaagauaaacagugaccugggcuuguagagacuggcuggcuuggauguguuugcaguuccccagucgagucuucauagcaguaugaguugcuuugugauggauaaccaaucauugccuuacaacuggcuucaguucugaaaccgcauguauuuggaacucugagacucaaguagccugacuuauaugucacuaugacagagucaacacgcaugaccuuuucugugaggcugugaugcaauagcuuuuaaaugggugguaagugcuggccggcccuacuuucaaaaccgagagucauucaugaauucauucauuccccuacuacauagggagccacgguauaaacuaggcagugcuccagagugggagauggagcaaugaacugcauccugagucacaagcuuuauuucuuugaagugccagauaacauuuuacacccuguaggcuuuaguguaccuaauguagcuauugcacucagcugggguuugcacaaaagcagauagaacaacaauaaagggaagguugcugaauuccaauggaaguugauuuauaaaagcagguagcccauggagcacagguuaccaccccugcaucagagcacggccugcucuggcugagugaacauugucaucaucuacacggaauugucaccagguauuuauguuucuuaugagaauaugugcuccuaaacaacaccucauucaaaauaagaaucagucagugcaguugaaagcuuagguucuucaaagggaagaaucauaagugggggcugggacgauagcccacuggguaaagugcuugccuugcaagcguaagcaucugaguuugauccccagaacccacaaaacauaaaacuuacuguaguggcgugcacucuugcaaaaccagagccaaagaagagacaggggguugucuggggcuggcugcccaucaagccgggcccacuuggugagcuccaggccagugagauacuuaacuucacaaacaaggggaagggccuacugagucauaacugccaacgcugaccucuggccuccaaaugcacgcacacacacaaacacagacauucuacuacgucuauacagaaacauacaugcacggcaguaaagucaacaaaaaguugacaucaauauaucaugaacgcguauucugauauauuuuaaaacuugugccugggucauuguuuacuaauugugggcuguauuuucuaggucuuaaacauucacaggaaagcuccuauagcucuagcuuuugaugaauugaccauaccuuucgagccaugaaggcaauaugaaaagcugucacuaacuagaacacucugucccuucaucuacaagcuccaucaauaauuuaaaggaacaacuuauucaugaauuccgucaggucagcauauuagucauggaucugccuuuggcgagccagcgagguggccauucauugcucugauggcuuuggcauguugauuuggggcaaaugaagcugaugugguaugcacuagucuagguacagguugucacuuaaaagccucguuaggugaauggcuggaugccuccggagaggcguucuuacuaguacaguauugcuaguuguuugcauuauaguaguuaucaaaaguuccuggccagugaggggauucauuucugauucuguuuaaaauaccucaggaaccaauucugugcuuacaaaguuccccuaacauuuuguuuguaaacuaaugugaguuuccaaauauguagaagucuggaaagaauuaucugauggacaucgguagggcuuagggauuuugaauccuaagcagguggguagcuguuucaaaguaauaagagaauaucaccucuggccuuuuuaggaguaugagucuuuaggaguggccagaaacuaaaccagaucaguuaucuauugggucuccuucccucuaugcaccccuccacuuacuucucuugucuuccauuuccuuugagauguaaucucaguauauuacccaggcugauacaacugucuucugcuccuaagcucaguuugccuccguuuccugaguauuuaggauuauaaguguguaucaccacagcagacucuuauuuuuugggaaaaccccauaaauauugcaccacgcuguugcccuuguucuuccuuacuuccaggaaguagagaaagagaaagagaaagagaagcagugaggagaagggaaggaacucuuucaggggucuguaggaucacuuagcgagucaugauuccugcucucaagcccaggaagcugaguucuaucuguagcauccacaucuguagcauccacaucuguaacauccacaucuguagcauccacaugguggaaggagagaaguaacugguucagguuguccucugcccucuaacacacacacuguaguacacacacgcacucccaccuacauacacacauaguaauaaaugaaauauaauuuaaaaaaaacugucucaaaaggcugaaguugaccccaaacauccuguguagcugggacuggccuucaauuccugauucuucuuuugucuccagccccuuagugcuaaguaagauuaagggaaugggccaccaugucuggcuuucaacuuuuuuuuuuuuuuuuaagagucacucugcugucgacuaguuuuccuuacuguugcaggcucacccuggccucccuuuacaggaagcaaaaucaucaccaguaauugcugcaagaggguuuagacaggacugguguuucccacauguugcuaagaaacagagcccucagaugcccuuuagaacugcggaggucugucuuucuaguggucuaauucugcuuacuuacuucguagcaaagcuuccagugucuuuuguucucuccgacuacuuccucccacuagccaaccccaaguaccauacggaugucaggaagccugugcuggccagagcaggagacaggcccuuccuuccacgaugcaggcucucuagcugcugaacuucuggaaagaaugauugaggguuggaagaaaccguuugacauccaaccgcaaagggaaaaauuaguccugugacccucucugguucuguuucauucugcauccugcguacuuuaugaggaacaacagccaugggaacgggaguuauauuucucuuuagaagauucggucacaauuuaauggugaucacaagucuggaggaaagacaggguuggaaguccuaacuguacuuucuuuuagcugcugucuaaguucugaaaaaugcuacagccauucauccgccguguuuaauuucccaucccccaacucaggacagaacauauucuuacacuguugacuucugcuguuuuccugcucuagccuaugcucggugagaugaagccaacugccccacuuuguaagaaagucuugaagaagcauuacgcuccauucuccuugcuguucccucugccaugaaagcaauuauauucuagaggcaaggaagguauuguguugccugggucccauggaaagcaugcagacuauagcacucaauauaacucuaugacugugagauaguggcucauuuguuacugcagcuuacguuaacccaaacggacuagcauaccaugugcaucacacugccaugcuaauauuucucagguuuagcacuagaaucauuaaaugguguaaaacaccauucccugccgaguuuguccgcagauugguauuuagaaaacaguuuuccaaaaggaggguugauuguguucuaguacuauccugaaggugaagacuuacuagacgccuguaucuuaauaaaugcaucgaauccugcaggaaaccaacauuguuguauucugugaccugaaccucgccuuuggcguaacccaccaagcccucccacucauuggcucaguuccucuguauugucauaguuaggccgguuuuaagaagcaguacuaaagaacuucccacugagacauuucaacacagagaggcuuucugaucucuuuaaaauaaaaugguuaaaaaaggucccgugggaagaguuuuccuccuuaagcagacuccuguggaaguguuuacauuuggauugggggucuaauuauuguuuuucccaccacagaucuaccauaguugcaucauagugcaagggucaguuuugugggucacacccaccagugcucacugggcucaugaccgucacucacuucccuucccaucgcuggggcuuuuccuggguagugcucuaacuucuuagccgucccuacaucuguuucaucauucauggugugaccuuccuuugggaggccaacaaaaucuuagcaaguccagcaacccuggccucggguuacugaagucauguaggacagaggugagcccacaaagggaaagucuugagcaaaugcaacaacaaaagcuauaauuaaaaucuaaggucuccgagacacuuagucauuagagcuggaaugcccaaguauuguaacauguuccagcaucaugguuaguucuguguccaaaccagugacuacuuuuagaaacauccgcuccagaugaccauauaguuuuucuguuuuucuguuguccucuuucccaaagacagggagauccaaugucuaugaaugcuuguggcgucuguauguaaauuugguuguuaacuucuuuuuuugucaugauuuuagcaccuuagaaggauaccuaugacauugcucagcaaguuuuugugcaaugaagaauggauggcaaacagaaaaaaaaaaguuacuguuuaauuuugcaucagccuuuaauacuuuacuguuagcguugugucuuauuaggaaaaggacgaagagaaagcccaaguuaugaucuuuuacaaugagaugcacuacaucgcuuauauuuuuacugcuauuuacauauuuuguuuugagguauauuguucauccaggcuucucuguauagcucgggcuggccuugaauuuaguguguagguaagguugaucuuggacuccugauccccucacuuccuuaaugccaggauuauagaacaaaagcccauggcuacugugccuagcuuccuauauauuuacuucuguuaucggggaggaaagucuuuuuaagaaauagcgggggcuggugagauggcucaauggguaagagcacccgacuguucuuccgaagguccagaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaaagaaauagcaauuuggggcugggagggugcuccauauguaggagcaucugaaccauuguugcauugccagcaucuguacaccgccgcucacagccaacaguaagcucugaugccagugcucucuucuggucucacacuuagcacuuggcccuuacauggugccgaguuauauacauacacucagacaugauauucuuacacguaaaaucaaaauaaauuauuucuuaaaaaaaaaaaaaagacagaaaacaccacaauaccaaacccuacuuaucaacaaagaccaaaaggguggcauauuuuuuaagcacuuuccuaagauucugucauaaaucuuuggucuggagugaaaucuauuuuaaaauaacguuucugcaauaacccguucugugcuccuuccugguucggaucugaguucucgauuccccugugcucuuuugcaaucucuccguccccgucugugcacgggccccuccuucccugccucuaaauccuaucguucuuuaaaauucauuucaagugucauuuccucuggauacaccccucaugaguuagaugcuucucuaucuuagcgcacccugaugcucucugaguauacuuccagcacauccuauuuaucacucuuuauugugccuguuugaucaaugguuagaugauuaaacucuuagcgccuccaggccaaggcuugaauauuacucaucucugcauggugggcaacucauggagugucuuggcaccaauaggugcuuagaguauuuucugcuuguauucacuucgguucuuuauguucaagaaaacagcuuguuacccaguagcaucauccuuccugcagccacuugccuggaaagcuggaaggggguuucuuccuccaguuucagcagccaccauggccccugucuacuacuggcccacgaagaaaggccaggcggacaguuguuccucguccugguggcacaucccucuagaccuagucaccgcucagagauuccaccacacauugucucuaggguuaggauucucaugcaugggaaauuugugaggacacagucaugccauguaguugacucuaucacucugaauugcugaguuugaaggugcaccccaacacuuaggaggcagaggcaggagaauuaucaucuugaaaaacaaucugggauauagagcaaacccaucuuagaaaaccaaggcuugaaaguauggcuagcuauauagcacuugacuaggguguuuaagacucuuaugaccaccugacuuguaauuccuugcugagccuugaauaaaaccuaguguaguauacagaaucccaucugguuuuccgaacccugaacuagauauauauuuccuggcaguuguuuucuuggccucagaauuuuaucuguguauguuugccaaucuuagauguuaguuguaauagaagaaauauauauuuuaaaaguacaauaacaguauaauauuaccaugucuuuucuuucauuuuacaaauaauacaacuaaguuuuuuaaauuuuuuaauaaauuagaaucaccaaaaauccaauauuucuuuaauauuaucacaauuagcagcucucuagaaugacauagagauauuaagaugggugcuccguuaaguuaggugucacagagugcaugggauucuacuuucauuuuguaaacuagacaaucccuuagcacaguguuagucucguucuuuaccuauagcugugcaaucacugagcuggguaaaauguugugauguaccaauuaagaacauccuauguuguuuuuuauuuuuuuauuuuuuuuauccacaaguucaguaaauuacaacuugauugucugaguaaacauugcuaccugcugugacugccuuguugucgaacagagcucugcaugcaaauuaacagcaguuuguaauucccaguauggcacacuguacuuuucccauaacuuaaauuucucuucucucaccaccggaaaacagauugggacaaagcgcguccuuucuuguaucuuuugcugcaguucuuugcuuccaggcagugcugccuauugcugcccuagaggaggugcgauggaaacaccuggacaggaccugucaccccuguguucucacaaagauauuagcaguaugcaaccuaaugaagauggagaaaaugccaacucauuuucucuuugcuauucaaaauuauaugugggccggaauauaauaagccauccuuaugcccgaguaaccugugacccuucagugagguccugcucuuguguacuguguaugguucacugucagguaauuuuaacguccaauaaaaucugccuugaauaaauuagaauauauuugcaaauuaguugguuaauuagauuuuagacaucucuggggggcugagcugaaacagaugugugcaaaaagccccuugccgggcgagggaugugcgcuucugacugaauuuucugaaggaagagccugucauucgauccuguuguuagugucagaguguuccaguaaauacauuccuguagagcccagcagaccuggccucugcucuagagcccauugucagagggaaagggcucacaguugccucugucacuaagcaguugcacugugaaguaagcagugggcucuuagaguuccuuugagggauaaauuauauuucauuguucuaacauuggcuuccuguguguguuaagaaaaauuagccaugguggaaauagucauggcuggucuggucaucuucgaguuuucuaaaucugacugucguugagcaaagaacaaaguuuaaaaguacagaaauggcguuugagauuggggaugcucaagucgggcucuuugugcugaacagacacuggccccacauuaccucuggcuuuauuguucgcuuuaaaauacagcuguucuucuuuuccuaaauuuuaaaaaguaguucauuauuugaaggacaguuguguuugauguagcuuucaccuaccuuccaauaguaccaaugaauacccaaagccuacuuucaggaugggggaaggugauagauagaugauuaacagauagaugauuaauagauagauacauagauagauagaugauguagagagauacauagaugauagaaugauagaugauagauaagugauaaauaugugagauagauagaugauggauagacaggugaagauagaugauagaugauauauagaugguugauagaugauagaugauauauaaaugauugauugauagaugauagauugauagaugauagauaaaugauuguuuaauugauagauaauaggugauagaugauggauugauagaugauagauaguugauagauugacugauaggugauagauugauagauuauagaugacugauacaaucaaaugagauuaugucuaaaucaggaauuccuguacuagugauuuuuauguuugacauuaagaucuggauacuguaaaauguagaacuagauugaaauugagcuucuuuccugcuacagcauucuucauugagagcuagugcagccagaagaaagggaugcuugccauguuuguuuuauuugaauuuccagucaugauuuaugaugagaagacggauuuuugagggguguuuugaaaguuucugguaguugacuguguuaagcauuugagcccaguacauugccaaacaucuuguucucauagacuugaacuuccccaaauccuguagcugacucaacucacaucugggccugcagguugaguuucuacuccuaugggcucaagaaacaaacugcuauuuaugacaaaaccaagugucauugcccguuggaguguuuguuccagggguuagcaaacugauauccuuucauuaaauccucugugucaggggcauggaaacucuucauuugggcaggugacuccaggucuacagaacaaacugaaagggaaggucugggucuagaaggaaguuuugcccacuacagugacucagguacgugaugugggcccaaggaugcuggcucaaaguccaucucuccaggcagaacacacugagcagggagcacagauuugggauugaaaaacagggcuguuggcucuggugagguccuaaagaucccaggccagguuagcaagaaauguccagagguagccuuugcaggcgucugggagacuuauggucugacagaggguaauaagcagggauuaggacugaacuucaaaauguauucggaaauguguauucaugcaauauccaucauaauagugaggauauguggaaauggguuuauuuucuuccuaguacuaaugcagagaaguaacacugaaaaacagaacuuugccagaugagcaaccguauugguucaaagaauuccuagauccacacaugaagugucauggauggccuggagaauggugcccaguggcauaaacacucuggucagauaccgauggaggugaucagucucaccuaagccuaaagggcaaugcauuugagggaagaaaacagcaguuaucuauauugaccuacaagauacgauagaugguugcugguaaggucugccuggacucugucuugaagaugaucauucuggagcaagcaugcucuuggcuagugcugauugcugagugccagggccuacgccuaggaugggaggguuuggugccugggauugccacagaguccacuuaaaaauugagucauagaugcuaaugaugucagccauguguuggagacccugaguauauucuuuuuuaaagauuggccaguucuggauguguguguugaagguaaccugaaaaucaaauuugucuugucucuccccugggggcuuugaagauuucaaguaucagaaccaguaagcuaugguguugcuaauaaaaauugcuuaugaguuguucgcuugggguaguaaguaggcuuauuuauagaacagcccugagccuccccaugggcaagaaggcuuuuuacuaaagcaagaucaugagguagagaaagggcaauguugagggacaggguauaucuuaaggagucuuagacuuacugauggcuacuaggaggcugucaaacuuuuaccccugaggcuuccauccggcuccguugcugguggcugcaaaucucuuucauauggccauuugcaauucgguggaguguuuggaacgagcuaguuaaucccaguccaauucauaaugggcagguagccaauucacacaaaccaccuugacaauccacacuaauugcuuugucuccacggagcagcuagaaauugaauugccugcagagaugaacauuuccuacuuucuaccccuuucuuccagcucccccucucuguccauucccacccuuggguacccccagcugaaacccuacacuuggcugcuugcugugauugugauuuuuuuuuuuuuuuugguauuaaauagcacacauccuucuaggcuauaaauuuccagaaguuuucuuuuugaagaaaugaguagauucaagguaaggaaaggaaacucaauauugucauuauggucauuuauauuugggcaguugguuucauugccacggguagaaacugucuuugaacaaagcaaaacauacuccuuuuuuauuugaaagucuagggagacaaauuccuagacaaacacucaugcagccugguauuagauucagaaagagcuacugacccagaaaaacacccagucuagcagccuccagaaucgucucuaagaauggauaauugugcgccccaaacagaugagagucuggguuacuguaacugacugagagcugcuuuuuaaaggaguaugcuuuaccuacacagguacuucuggaguaguccuacuauguccaaauuccagcgaugcucugggugauccucaggggcaagugggaugcuagaugauugcuuccauuaguuagcuggacaaggaugcaaguuguacccaagggaccugacuagguucuggcucuuuuccucacucagcuacuuuagacuuaaauucauccucucugaaccuauuuauaucaguuagcucugaaguuaaaggucuguuucauuaaaaauuauauuucauaguuauaaaaauauuuuaaugcugcuuacauuuuagagggcugauugauuuucauauauuuagaaauuuacuuaaggaaaggaaagcucccucuaaggauaaaagacaaugaccaguuccuucauggaugcuauguugacuccccuucuccuaacaaccuugugaagauuaaagcaguauaccuccgugcaagcauugucaacuugaacacauuucuaggcauucagugugcauagacacuugguuauuuacagugauuuauaguauuugccccacuaucuucagauagaaugucucucugagcaggcuagccuugcagugaguuaugaugguuggaaaccucuuaccauaacuauccugccugaaaacaaagcaaauggugggcgugaaguccucuugccauccaggguccaagagauagagaaaauuuuucauaaugugaaagacaagagggaguagccucuaaggaaucucgugggcguuguucuuccucaaguuggaaauccuugggaauuuugccuagaagauaauucuagagguucccuuuuuaacacugguuaugguaaaggggguuugauugagccucugugaccuccguggaaaaauccaacaaauagaaagugaaauuuacaagggauuccaacaaaaaucaacaacuguuugcauagcuuggcaggcucaucucaaauauucauucuggcccugagagcuuugggucucugucaagauaauucaucuuuuauuaagaacaaaugcugaaaguaugagcuccauaaagaaaaccacugcuucuacuuuuuaaauauuuugauugcauuggauuugauguguguuuaugugcauuucuguacauauguguacauacgcucgugggcaugacucaacaugcauguggaggucagcagacagcuaagagguugagggugggaauugauucucuucuuuuuccauguggguccucgugguugaagggcaaucaucaggcuuggcagcaacgugcauggccacugagccagcagcguccuaguccugaagcugugguuucuuaauauuuaaggaaagaggcaggagccuagaaaagaggaacaccacguuagggcgagcgaccaugugcuucugagacuuccauggaagcggaagucacuggagaaggccaaggauacuuggugcuuagguggagagaaaagugcgaacugguuccuuggccuagaaaauuucugauucuugugguuuugcagcuguuguuuguuuuuugaggcagugccucaugcaguccuggcuggccuugaacuggcuguguagcccaugauggucugaucaaaugccuguuccucugccucuaauucccaagugcuguaacuggaaagguacauccauccaucgcucucgguaugagguucugaggcaaggacucuaggcauuuuuggcaagcacuccuaccaacugagcuauguccucagcccaagacguguuguuuuaacaucuugcugaaacacauuucucccuguggcucuucuuagacacagaagaguggguauugcaaauaugucaguuugguaaaauuccaugcaacuuacugcauaugaagagucuguauugcaucaugucaggcagcaagugacaggugacaggugaccuggcagcaggaauaauaauguagaauaacuuuaucuucugagcgaugugaagcagcugggaaaggcggcagugguuggcucugaccaagcucaggguuccugggugccuguguguaacaccucugaacucucuggcuuccuacaagaccacagcagagcuacuucucgccuccucagccuaucuugaucaaggugugcagagguggcagggggaaggagcuaggcuauggagcaggggagagucccaacaggggcugugucuguuugaaauuucccuagaaaguccaucgucuugauugacugucuuucugguguccauguguagaaccaaaacuccuaaggaagauggcaucuggcaggaagaucauguauuggccuguuuauucuuacacucagugccaagucauagauugucuuuuuagaacauauugauccucacugccacuagagcuauauucaccccucccccaaagccuagacuuuaacucccuucauaaagcacaucuggauguuaugagaaugacuuuguaaacacacuacugagaggugcccuucuggacuguaccagguaggaucuucuugcauccagggcaaaccacugaagcuuucucugcaguuuuguuuccucaccugcaaaaaaaaaggaaauugauauaauggugcuugcuuuuaugcuuacuuugcaaaguaaaagaaguuuccauauacaagaaaaaaguaaaaagcaacugcagaauuaagcacuuauuagccguguguguguguguguguguguguguguguguguguguguguguguuucauugauuugccuauguugccccaagguuguguguuaauggaugggaaucagagacacucacugcccucccucccagacaguuguguuuggcccuaccacuuacauuccuuucuccaccaguaccuccaccccccacccccacagagacugacuuuguuuccauuguucuugcauguguggagaaugcugcaacuugccacccagcauuccugcguuccacuuuuuggauugcucuucccuugccccuggagcuguguucucccgcaguccuuagaccuugucuucugcagagagggcuucccugguaucuguccucauuaggauacuaccccccagcaucucuagucacauggguggcucuuuugcucucaucccaauguguaguuguaccuuccauuugcacauugucaguguguacagucccuguagaugggauguucugcaggacauauucuguuuccuuuugggaccugugggauauccagcagcuauuuccagggguuagugggcucagagcgaauagccuccguacauguaggcucagaggauguguaaguugacuaaaugagauguagccauuccaaguaguaggagugauaccuuucuccuuucugacugguggaucaugaucauccuagcuacauuuauuccugcccccuauuuuucucaaccuucuaacaggaacgaaaaggaagccaacaaaauuaccagacaccccuuuuagagaaggggugucucucugcauuccuacuugguaucuuuuuugaugguucggaggaggaagcagggucuuacagccuuucucaccagaccaguucaaugaggacacuugccauauggacgugccccaucugcuggcugcaucuggugccuacauucacaguggauugggaagcccuguguaguagcaaaugcuggcugcaucaucuuuaagaguggccaacgcuauacaaggcguuggaaccaaauuggugguccugcugauguccagaaugaccaugaaucaagaguuugcuuuuggaacacacauuuucauaaucacagcagcagacugaguucauucaguaagcauuaccaagguucacacuaggacacaagggauaaaaugcagagugaaaugccaucauucacuguuuuguuguucucuguauguauuauguggaccaagguuacagcauguagcaaauaccuucugugugagacagaugacagacagagagauguggcacucucaugccccacccccccacgccccccccacccccgcuuucgaggugugaggggacuuccuuugugaaccguaaguuuuaagauaacaauuucagacaucucauggaauuuucuggcuuucuuuucacagcccccaaauaaggacuuaaauuuccuauaaggcucaauaaauagauagaauguguugcuuugcauaaauaaauauaacuauauuaaaguggcaggcuguuuccuuugucaauaaauguuuuaugucguagccuccaugccggaguaucucguguaaauuauggauuagacuuggaguagcccagcaugggcugcccguugaguggcagcaggccgcucugugacauucacagaugguucuccacugcagacugggcuauagaugcccauggucuuauauucagggcaggaaaggaguuugaguggguagagggagggaaagaagcccuugggaaagaaacccaauguguuugucucuaguauggcuaauuuuacagaccacaugaaauguuuuccuaccaaaacaaguacuugguuguuguuggaggaggcaucucuucccaacaucccgucuccuaugaguccuuucugacgucuagccacuucaccuggauacaaggcauuacuaucacaguaguuacuauugugauucaguaguaacuauugugauauauaucacaaggguaucuauugugauaguauacuaucacaauagcacagugauacaguaucacaauagcaccuggcuccuggggacagguaagggacaucacaaaggaagcaaagauagcucagcacuugccaauucucucugagaaagugcagcccagaguuccuggaacuucucauuugucauaagaagucuaagaucucaauuuugauaggaauucugcuaaugugaaaauguuaucggggccuaucuggagugaaccaaauguaucagugagcagugcuguacucuaucuaaucgguggcccaaguuagagccccuguuaaaaauucaucucugcuguguauauacacaucucguguuuacaaaggacacuacugagucacugcuguguggucggaaauauguuacaauacauacucaauaaaaucaagacagcucaauaggaaagaaauguacaguagugucccacaagaguaaagucacugagcacccuucguugggagauguuucccuuccugaguuugcuuaugcuaggguugaaauagcccagaaguaauaugugcacauaaacucuuguccugaauucaguuggguauuuuuuuugucuuuaauuucuauuauucuauagagauucaucuaucauccauuuggaauuaaucucuccaguaucauauccuucagauuucuacaucuggauaaguaagaaugauguuugaaaucuuaaucugauaaauaauucugagguuuguuuuuucuuguuuuauuuuguugcguugucccuguuugaggucagagcuagcucuguaacccaucuggccuugaauuugugaucaucuuucccagcuuugguacugugauuacaggcgugugcuacuaugaguagccuucucaacccuucuauuauuuccguuaaauuuguuuugugaauaaguagccacugacuuaaucuuccucaucauuaacacauagucucuaguaagaagacucccaggggaguaggggaguaauccugaugucuggggcuuggggccuaugugaucccugggaggauuucacaagagugggugaacuaaaugaacauaccugccauguuuaaugguugcuugcucggaauaguuuacacagaugaccauauugggggagaaggagggaaagggggucagaauaugaauguaccuggaaaucagcacguaugaguucuauguuuuaagauuucaugguacuuuauuuguauuacccaugagcaccauaaucuuuugugugaaugaugcuuugaaagagauuauuucuacuuauuucugcaugacaucgaagcugacagugggagaccccacugacauuaacagaagcucagguugugaguuuggggguggggguggggcaucuucauguuguuugcgauccucucaucagcuauagaacuccagaccugccagccucagucuuccauggcaaaauggguuuacugcaugaauuugugugccccccccccagccccccaauccugacaacagacugugguaacaugugugaagcugagcacauauguguguggucaaucaguggucauagcuguuuuauugccuucauuaccacauuaagguaucuuuuuaugaguguguuucaugagguuucuuuucccucuucuguggacuuaccuagccccuucauuacucuacauuggacuuuauuguaaaauacagaaacagaaucuguguugugugaucugucuuuuuauuuuucugcccuuccaguuuguuucuaggggaucagcagcugaugauuuggcccgcucugaccccacacuacuaucucuguugcagcaugggacauucuuggguaguugcucuaauuucuaaauuagucuaagaagaagauggauggaaacugacuugguuagacagagcccaguugugaaguuucuuuuguuuuggcucuaguccaagcuaauuccuuauaacuagaguuccccugcccaccucucuccccuuagggauuagaaucagcaggauagccuagucacuguagcagaaaauaucuucaauugcuucucccagcucaagccuuacagccaucacuacaugcagauagucauuacuuauagaagggcagaagcgagacuccugggcuuuuccuaccaacaguuuuguucucugggaagagggcauccuggcugucuuuccuguuuucccagaccacuaccacagccgacucguacugcaauuaagucauuuccaugauuucauaucauguuuuuuuucccacacccuagagauauacaauguuaaggcaagauacaagcauucaugcuguguaugcauuuagggaguuggggaauuuggcuuuuaauuacugugaaaauaugauuauuuagggacaaggcaccaucucugcagagccuguagaauuuugcagcaccaggaauaggggcucaugaauaaggacuagaauaaguguguuggcagugccugcaugaagggcaaggggugugaaccguagcaguucucugcauccuucauuuaccccagucaguuuguuauggcgcauucuugccucacuuugcuuuccugucugugacauggguucaugccagcugccccucagcuauggcucagcaggcaucuucaaugguauaacaaaaccaacuuguuaaggggaagugcuuaccugcuuagaccuccaguccuuaaucacucucauuucccaggcaggaagaagccuccggcuuuguuuugcauaaagucccacagauuuaacuccagcucacagcaggacaccuuugguuucuugagaugaauagcuguggcuugugccuuuugcuuuuaaaguuuuuaauggccucuguaacuugcaacugcugucaguauuguaucuccagcucuagugcuccuggacacuuguccuguagaucccuagcauccaagagggucaaccuucccuaguagaauuccaguaagaauuaauuccaguaagaauuauugauagguugguggauagacaaauguaugaagagaaguguccuuuuuguuuguuuguuuguuuuuuguuuuuucgagacaggguuucucuguguaguccuggcuguccugaacucacuuuguagaccaggcuggccuagaacucagaagcccgccugccucugccucccaaguacugggauuaaaggcgugcgccaccaccgcccggcugaagagaaguguccuuaugcccuacauuugauuugaugucucuucucuagccaguccucaugacccagaggauccucauucacaaagggacacacuauggggggaagcccuaugggggaacuaaaggcagauuguaggucuuggccucaaaaccucuugacaagucagaaaaguaaaaaucauauaaagucuuaggaagcaucguuaaaguuugugucuuccagagguagaacugagugugcuuuugguuggcccagcuuguguuuucuggaacugggaagaaugccuuauacaaaggucagccucagaaagggucuugugucugacucagcaccacaaagauagcuaugaccaauguuaggcaugucucugguuagaaaaacacaacaggauggaaagauuccauuguagucccugugggguccuucaagcuacagcucacauagcuggcccaggacagccuauagaucaguuguugucaaccugugggucgcgaccccuugggagaguugaaugacccuuucauagggguuacugaaugccaucagaaaacacacagucuacauuaugauuccuaacaguagcaaaauuacaacugugaaguagcaacaaaacaauuuuauaguuuggggggagggggcguggugcggucaccaaaacacgaggaaccguauuuaaggguuguagcauuaggaagguugagaaccucugcucuagauggagcaggaccaggaagccccagaagcaaacugccucaguuuauaccuucuguucuuaaagugaauuuagacaaacuuguuguaugccuucauuucuacuuccauauacugggggaaauguagcgcuuucuaagccugcaaucccaacacucaagagacagaggcaggaagaugaugaguccaagugcaggcuggcauccauccugugauacauguauacuuuccugugucaaggaagggugguauggaauagggcaugcacuacugcucaucuugcagugguuugauagacuaguuggcuaaauggacaugucauauauugucaacagauacguguugucauuaguagcacuauguugacuaguugcaggaguuucuauggaaauuucacgcaagcccuauggcuucuuuccuuucaggcuaucgugucugacuacaugcuuuuggccccaacucuuucuaaaaggacccaaaccuaguacccagagaauaacacugaucguccugccucuuaccuuuuaacaucuuaacaaggaguacugagguaaccuuaaaagugucugguaguccucauuguguagugggcaugcuguguacacaggcaugagauaaauuaaauggugcugacagugugugugugcgugugcccagccagacacccagauuucuuagaucauuuaagcacauuucguguaauggaacguguuaugacuucagcagcuuccgaauaagaguuagaggaggggggaaaaauaaaaucugaacaguugcaccagccaggcucccccagggaguuauuuaaggcagcuugggcacuccuguggaguuagggcuuccucaaagaacagccacuguucuuaugaaagaacuccagccccucccgaccccucucuagggggagaagaguuccuucuuuuauuuuuaggucuuaggugagaaugugagcccagaucuauuuucaugcugucuuccuuucucugcucacuuggagcuagccuucuuagcuuaguucuggucugauggugucuugggcaggugaucugaccacuucacauuuggauucccugauuuucaucuggcauguuuagacuaaaagacuuuuuguggcgccuuccagcuccaaauuuuuucaugguuucccuucuuuauuguuacaggaugcacaaaugccguaacuuuuuuuuuuuuuuuuuuuuuuuuuuuuuaaagauuuauuuauuuauuacauguaaguacacuguagcuauccucagauacuccagaagagggagucagaucucauuacggaugguuguaagccaccaugugguugcugggauuugaacuucggacuuucggaagagcagucgggugcucuuacccacugagccaucucaccagcccccacaaaugccguaacuuaagcauaagauaggggagucuucauugcucauauugaaaacguccacuuuccaugcccgccuuucuuagucugaacuugguuacagcuguuuccagacgcguacacucccuuucucauccucuuucccuuccuaccuccuucuuuuccuuuuccucuuccucuuccucuuccucuuucucuuucucuuuuucuuuucuuuucuuuucuuuucuucuuuucuuuucuuuuucuucucuccuuucucccucucuuuuuuuugggggggggaguggggguaagaguaauuuagcuuuuauuucuacauuucuauaggccuugcuggaugcauggucauuugaucucagugcaaacuacccauaccuggauauacacugacauucuugcuguuggcagguuuuggaagccugcagccaggguccuaaggccaucugagucacuguuaaugaaccaaacugccugaaaggcucuagcaguugccuuuuggcacuuggcaggcaaaucuuuuucauguuagcuucaagguugucagauaucauuauccccaaguauuaaaauuuucaaagaaaggaggcaguguguuugauuuauagaauaauuaucuagcuucagcucuaacuucgcuuuggcgaugguuuugcaagcacucgaaaauuaaauccauuuuuuauggcacuacaagguauuaucucacagcaaaugauaauuaaacaccugugaaaucaauuagcccuuuaagcagggggaaaaaguuuuccaauuauguuuucacaccuccaaaacuuuuauaacuccaaacucaauacuuguggguaggaguaugguugauuggcuguugcuaggugaacuucccauaaagaucaucccuaaauuuugcucagacuucauccugagacaguuugugauagggacauauaucagcucugcauaccuauguguguguaugacacagcugaaccaucugcuucuccccaaagccagcuccucacauccgcuucuccccaaagccagcuccucacuuucuguuuugaugccaagguuuacuuggagguuuaucuaaaagccaagaagucuuaauggaaauggagcacuaggauguuccacaugaccgcucuugaagggucccauagccauaaccaucuucaguucagauucacacucagauaacagaccaauuggcgaauagcugaaacuuaagacaguggaaaaccagggaucauagccagcaguuuucacuuacaguauccugugcaucaucaccacugacuggccuugguaagaaauucauuuuucuaaacgccuuuagaaaaugaucuauacuucugaagcacuggauagauuagggcauguacaccaauguaauguggaccucaaaacaaacaaacaaacaaaaacgaaacaaaaugagcccaaagagaagcaugauauauuugacauccucuacuugugauucaggucagaagcuguuccaagaagguuuagccucaucuguucugauacuuagagguacgucaguuugcucaguguuuucuggcucccugccuugcuagauccucaguacaccuuguuaggaaggcaagaccagaucaacaacucucuguuuuauaaaugagaauauauuccauagucaauacgacuuccuuaugauaaaucaggaaccaaguuaagagcagaaacuucacugugaauguuaguuucugcaugcuuuaccauaucuuuguacauaaacauguuaaaggaugauucuacaauuuuuuuagauuguuccugaagacauuuuuaauaugcacuugcuugucaagcagaugacauuuagagaaguugacaaaucuuaacauuagcuggagaaauauggcuagcauuucaggaaacaagaugaagggacuuuguaagaucgguuuggccaaguacguggcuuucuugugaacugcuguuagcagcugaacgcuuuauaaccucauaagcauuauagacccugaagaaugagaugaggguagaaugcucugauauuuguucaacaaagacaucaaaaaagaucacucuaggucagacauguccucagcaauaguagugaacaacaguaacaacaacaacaacaaaggggcaugugugugcuuguuuguauaauauauauguuauguuugggcgggaaagaacaaugaaccugccaaaaaaauaggggcuugaauuuaagucuucaaugccaggagagagcugaaccaaggcagugggaaggucggcucagaggccaaucuaggagccccugucugaggagugugcacacugaugggcaucuugggagaagucuggaagaagcauuggcuuagggcacagcaaguaaauaaugaaaacagguguggugcucugagaaacugagaacacugugcguauagauggucaucaagaaagggggauguugaagcaauggguagaggauaguauucauggguccccauaucuaccggauaggaauauuguucuuaguagcuggaggggccauugggauaauuuugcccagaguaugacauuuuagaggcuucuuuagucauuugauagagaucagauuuuaaaggggauuacagugaacuuggucuguuuuaaagccaauagaauaggaauuugaagugcuucuuuucucugcuuauggugauggaaagcaggaagaacacugcagaagcaccagaggaaaggaugggagcacacucuuauuucugcauaaugacaaauucuauuaguaggcaguccuacaccacucugcauggcuucccugggacacagaauacuaccuggcguacaggaaccgcucaguauuccuuuguuggguacuuuuucaucgcugcagcaaaaauacccaagaagauaauuucaaagaaggacuuuugcaaagaauauauuccaguuaaauauucauuacauguauaugugugcauaucuggcuauauguauaggaaccauauguguacagggauauguagaggucuaaauagugcugaagaggucugaucucugagaacaggcaguuauaagccaccauguggauguacucaaccacucaaucucuguagcccagagaauuacuuguuauaguuuagcuuaauuccgauauauuuagcaguaucagagauuugaguuuacagaucuggguuuguggugaagcaggaacauuuggaagacaugaaucugcucacaucaugguaaacagaaagcaaugagagauaggaggaggucagaguaagcuguaacccucagaaauaugccccaauuauccacuucuucugauaaggcucccacuuucuaaguuuccacuguuuuacacaaguaccacuacuaucugggaaccuguuuuuuguuuuuuuguuuuuuaaacacaugaggcuguucaaaucuuaauauccaaagaugccagagcacaaaggcauccucagaaucaucuggucaaccuucccccacucccccacccccaucagcugcaucaguuuucccuguucuauagcacuguuucagaaugagacuucucuuuagcagcuucuccagaggacuguagaaaauauagccagccggaggaaggagaggucacucagcucuguagacuugucucccccagugugaauguguuuugccaaaggaaauggcagaauccagacuuuugaaccuucccaguccuuaugaacucagcuauccuacaauaguggucuguaacaucaucauuauguaacaaucugauuuuuuuguuuguuuguuuguuuguuuguuuuuugagacaggguuucucuguguagcccuggcuguccuggaacucaccuuguagacuaggcuggccucgaacucagaaauccaccuaccucugccucccaagugcuggaauuaaaggcaugcgccaccaugguauuuuucuuaagcaguagcacaaauguuuucugucauaggaucccauuugccuuugcacauguauacacccccuaccuuuccucuugacaucuucuuuuaugaaauuuacaucuuacaucucagugcccuacauuucucaagcacuugucauauuaauauaugccaacccaaggucuuguuugcagucaaugucuaaggcccgggacuaaguuauuccuaagucaaaaauugaaacucagugauggugaaaguaggagaggagaugggaagguuaucaaagccaggggcauucugcaagguauuuuauaaucacuuaaguguggggaucagacagaagguuuaagcauugacauagagcacaguaugucagacagucucugucuccauccccgccuucccuggcuaugagaaaagcccaucagaaauuccaaccauuugccuuaucagagggcagaugggguggccaggaaggaaaagaggucuuugcuuugauggaaagagaagaacuuagaauauuaggauugguccguuucuucugggaguggagugauuuugucuuuggaccacaucaguguuuguuauugaagaagccaucaggggggcccacaauuguucuucucagcucaggcauggagggagcgcaggagaguguucacugagagcaccacucugcaugcauuuaacaugacuuucaaauaaugcuauuuaucaggccuggugaagcacaaauuuccaauucccaucacuguucaaggagaauguaacuuuuuaacaaguugccagaccuuuagaaauaaagacaaaaugugcauggguauugccugugugcauauacaugugcaucacaugcauaccccgugacauggauccccuggaacuggaguuacagacaguuaguuggaagaugccauguggguguugcaaauugaacccaggucuucuagaggaacauccagugcuucuaaccacugagccauuucuccagcccugagaaaauguacaaaaggaaaccaggaagaauaaaagauugauuuuuguuuugcuuugguuccauucuuaaaguaaacccgagucccacucaacuuguagcuucaccucagcuaggcaggcuugguaugaucaagaguugauauaugcuuacuggcugaagcugaccuugccauaauacagaguuacgucauuccauguccccauuccuucuguaguccaugugccaugaaguaagcugauacauaccagccauggguaaguaggugcugggccaagagaugguagagucuaagcccugacucuugaagugauaaaaaugugcaacuuagucgagugagaaagagagucaagaugggguccaggacuugaguggccauaggagcuuacucuuggaagcaggaauugagguuccacagaaagggaggggagccugcaguguucacauuugggucucagucauccucacuccuaucaacagggcacaagcuguccuaagaauaucuacuccauacugucuauacuagccauaucuucuuagccuuuauuuaguccacauuuucuugccccguuccacuuggccaucuccuguggcauggcaccaagggaaagccuaaugauaaaauaaugaccuugggcuuccccuugcuaaguagccugcuauauaucuuuucuggaccauuuuuccacccaaggccauuguugcagcugguucuuuuauugucagugucuccucuuuucccucugugcccagguaacccuuuauuuagcacugucagaaaugcuucguuucuaaccagagaauuuagacucaugugucuuggaacugcauuccucucagaauagguucuaaaaucuggcacugaaaguauaagagcggacgcagccagaccugugucauccugaaagcuucccaagauuaaugucacagggugcaauguguuacaaaucucugucuucaccuuugcuaccucuguguuacuuuuuccuucuagcaaaaacucugaggcccugugcuccacacugcaagcucugcucuccuuacccaggcuccacaaagccuugcagcuccgcuccauugucuaugaaauggggcagaagcuguaccugcuucucauggugguuuuaacaguaauauacaaugcagaguauggauuauggggcacuguacccugucuacaggaaaggcuuaaucaguaaaauuauuaguaguauaguuauuaacagucaucguguuuauucaugucuuuguguauuagccaauaagcugcuauuuaaugagcaguagcaaggaugguauuuuugagacaaggucucuuuauguaguccuuacuauucuggaacccacaauguagauccaucugcuucugccucccaagugcugggauuaaaggcauguuccaccaugaugguuuucuaccucuuugagauauauauaaacauaauacaauauauacucaguacaugcuauaucuauuaauauaugugaguacugauuaccacauuacaguucugaacugccagugaucauucaagauaaagaugcaaugggaaagauuagagucaacaggggcuaugacccaauguguuuaagagcauauuugauggcagucaucucuuuccccugugguggaagucaggugucaauauauguuauguagugauguaucaaaccuaugcccauggugauacacaugagaauuaaguaccucucacugggaccuucacccacagcaugccaccucccuccuccuguuccuguagugaaagauuuuaaguuggcauagaaugaaaauugucuucuguuugaagccaggaaguaugaaagaaugcauguaaguugucugcccuugguuuuguacaaacauccugucugcaauggagagccuagaauuggcaacaucacaccgagaucacaaaggaagugauaccuuugauauagcuugugacugguggguugguugccuguugaauauucagggcaaggaauugcaccaccuuuaaguagcaaccuuuacugcaggggaguugcuggcuuucccuaagacugucgccacucugaucgaucacauucagagugcaguuccacguauuugaagaacugauugacguguaugaagcagcucagcuuugugcacacuuguggguguguaucagccagcaauucccacaaguccaacagauccuccaugaccccugggacccauacuucucugugccauguugucaaaagaacccagacaguacaguggccagcuggaaccauuuuccaacucccaauucacguuucucaguucagucagugccacggaucaauuuugugcgaucccauguccugaccuuuaagauuucuuuucucaaaaguaauugaaauuuuaaacauuuuaucuggacuuaggaaaggguaucggaaacaggcuuagaaaacaacagaggaugccccccccccccacacacacacacaagucaccuggagggaaguuuugaggagagaguccuacaaagggcaguugcacguugaagaggucagagaugaacugcucacuaauuuucuuaaugagaauuguaugucuucagacauaugacgccaugugggcugaccagaagcagcauuguuuaaagaaaagaguuggggccuucuuacauuuucagcauuucaccucugcccaugaaguugagcuguaugguuggugggauacuucugggauccugucauucuuucgcuugaguucuucagugacucagauucacucucauggaauaaugucugagcuccaggagguagcaagcuuaucaucuccuuaacccccucccccugcccugagcucuuuaaccauuccugacccacuccaaauuggguguuuucccuccccauggacccuuugauccugauggacuaccauuagccuagaaaugcccaucuuccaguguuuguagcucuugcuccgucaucagugcuuagcaaagaguccuggaaaucuucgagauacacaucccuguucucaucuuccucaccaaugccuucuguagccacccaugccuuaucuucccugcccccccccccccgcuuccauaugaacaucugacaacuucacaguguuuucacuggaccacgaucuucuuaagacggaccuaacauguggauggcacacacgcacucacacacucauccaagaacagagaugcacuagucuguauuuccuuuuccucaucacagggcacucuggaacuucagccaccccaaguauuagcuuucugauuuuuuuucauaagagaugugacucaaaucuggguauaaacagagaagaaucauuacuuagaagggacggggcuggcagaaaaagagcagcugugauguucacccaguucauaaguaaauacucgagacaaacuaucaccucaggcagccuggaauugugugagucugaagauuagaggcucauugcuggcuucuugccuguccacuguggcuagcgaaaaagcaggaucauuuggccaacgugcuugugagagaggaucugugggaacccugggaagacagcaagccacagcagcggcuuccuuccuuguacagcuucugaugaggagaaagcuuuuaaacuacacacugcugcuguguggggagcugcggcuucugcuuucauuuucuuuuaacgggucugcuccucguuugucucuuggcugucuuugcaaaacuguuuuuuuguuuuuuucauuguugguaguuuuuaaaaaauguuuauuccauuccuucugauauaauuugccauaauaaccugcaauugcauacuacuuuccugauuauacugcauguacauaauuucauuugagcuucacagcuuugagacugacagaagcuaagagaugugcaugggggucucgcaggagagccacacuccagauucuucagcccaggucuccucauugacagcugccuguguuucugauaaucugcuggcucccuucagcugaagugauuacagcuaucuuuugcagaaaugcucauaaggugcuguacuuuaauuaaaauguaucguuuggaagccgggcgugguggugcacaccuuuaaucccaguacucgggagacagaggcaggcggauuucugaguucaaggccagccuggucuacaaagugaguuccaggacagccagggcuacacagagaaacccugucuagggagaaaagaaauuaaaaagaaaaagaaaagaauguaucauuuggucaggucaguagaaggaucaaccccuuuggaugaaccaggaaacuaagcccagacaaauuaguauuucccaagauugcccaguuuguggaugguaagcauagacugugaacccagguuuggcugcuugaccacugagcucuuguuuacuaaguuuuuagcuaccaguucccugcugcacaaaauguacugggcauuacaauggacucacauagaauccaaggcucuuucccaagaguucuggauucagcaggccugggugauccugagaucugugcaguucccugguaccacaggugauacaaguggcagggacaacacuugguggaaugguaugaaccacucugucucccuugccuagucacacugacucacuauuagugagucaucuuauguggugagggaagacuucaaauaacauuccauagcauaucugaaaugggguuauauucuguaccuuauucaguacaacucuaggaagaaaacuauuauaccuauugcaugguacuggcuuccagguuaaagucagggucaugucguuuuuauugcacauuuucuguggagccacuuagaaaggcucuucuaucuccugcaucauuaccucuggaguguggacuguaaugccacaaaggggagacaacugguuuaccagcugaagcugcaaauucucugaaagcaguugauaccucuccugucucacuguguguguguguguguguguguguguguguguguuuuaaguuguaugugauuauagcaugucuuacaucuccugacuuaauaagaugaacuggucuacuuuagaagauugucuccccacuugaccuauaaagucugucucccccaccucuaaccaaugguagcgacuacuccguucuccggccccgucguuauaugcugucacaaguguuaugaaaauggagcaauguaguguguacccuuuagaggguggcuuuggacucggcauuagcauccucgagguccuuguguacuuaaguaguuugauccguguucuuuuacuucauuauguuuuauucaucugagaagugaucuaggcuauguguauaccacaaucuugccucauucauacuuggaaggguauccaguguauacauuuguggacaguucuccuauguaaaaaugccuucauuucucugggauaaaugccuaaguacagugcugggucauaugaaaaguccauuuuuaguuugagaaggaacugccagauuguccccaaaacagccuuaccauuuuccucucauuguagcccccaaggaagagcucuuguuuuucuuguuuuccauguuucuaucugugcuuguucucauguguccucuuagaucauacacuguccugcagggagcaaguggcaccuccuuguguuuuggguugauuuccguuccuucaaugacuaacgauacucaguaucuuccuguguucuucuuggugcuuuauucauuuucuuugggaaaaauaucaguucaaauuguuagcccauguuuacauuggauucucuuauuguuguaucagaaguguuuuuuccauagucuagaccaguguuucucaaccugugggccucaaacccuucggaggucacauauaauauacuugcauuauaauuuacaacaguagcaaaauuacaguuaugaaguagcaaugaaauaacuuuauguuuagggucaccacaacauaaggaacuauauuaaagggucacagacuucggaaaguagagggccaugguuuuagacaaaguuucuuaggagauggaugauuugaaaguauuucugcuucaggagauugucuuuuucccuuccaggaaggagcuucuagaguugaguucucauaggcagagauagaaaccuguauaaugagacaagccaugacauagaugccagucaccgaaggcuggggagauuuucucagaccuuguacgcgcgcacacacacacacacacacacacacacacacacaccaucccucugucuuaugcauuuggcacuacucaagaaaguuuaaaucaaacuguuggguuuuuuuuuuuuuuucauuaauaaaguguugguuuggggagagaauuccacagggucuggcuaugucacacuggagugaugauucuaguuuucucuggugauggggaugacuuuaagagauuuuacagccuuuuuuguuuguuuguuuguuuguuuguuuguuuguuucuucaagaaaggguuucucuguuucguuuugguuguccuggaacuaguucuauagaccagcuggcuuugaacucauggagaucagccugccucugccucacugcugggauuaaaggcauaugccuucacugucccgcuugagauuuuaaaucuuaucaauuagguucaaucuugggcagauaaagcaacugccuuuggauagugucugucugaaugugacaguaucaucagaaguguuuuuuuuuuaaggacacaugaauauaugcucagguucagugaagcaagagagcaucacaggagaccgaguuaaagaauuccaaagcaggaaaugccccaagugaagccaguaacuggcccaacuaaggucaucaucauccguucucuugaaacaacucaguauuucaugaauuccucaaccauagaaucuaaaagagaaaaagguucaugggcugagcgugcuuaaaaguugcaauggaaaauauuucuuucaguuaccuuucuaugaauagacaccauaaggacuugccuacaguuuuauagggcgaacucaugaccaucauggcauugaauauggcagcaggcagacaaagauugcacaguagcugagagcuugcaucugauccacaaggagcaauuaggggaugguggaaugaaacugggccuguugugagacauuugacauucaagccuaccccuugugacauacauccugcaacaagaccacaccuccuaaaucuccccaaaucaguucuaccaacuaagggccacacauucauauauaugagccuauggaggagcauucucguuuaaaccacacaauauuguuguaaguuauguguguauauauauauauauucuguacagcugucuuuaucuuugugacuauauuuggcagacauuggagcaauugugaauguauacaugcaugcuccuccuagaaagauugugaaaaucuugguggaauggucucaaaagacauuuuuuuuuaaaccuaaaaccaacagcacaaagaauagcgggaacguagaagcugacaggagacauguaaucugaguggcucuuuauuucaggugaggaaacagaugcccugaaaagcacccguguuaagcucauggccuccgagcaggaccuaacagguucagggugcuucccucaucucauuauaugaaugacuucaagcuucaauccugugcuacaucagcaacuaaugcuucuguacaggcacuuaaagucgacacccccuguguaacugucacuugacuuucucccgggagcuuuucugcccuucuucucccuccacacacucuagaaaguaaauucugcaaguggaaacuuugaaacuuguuacaauccaagacacuaauaagauuuuacauuuuuagcagcuuaaugaugaggauguaggacucuucuggucccuccgggguuucuauucucaguaucuuaaaccuugcaggagucugaaguauauucgaccuuucuauauuaaaaaaaaaaucaguuuaacuuucgcucaucaauuugugucgguauauuccccccucuuuucuaccuauuagguaaaauucagacauuaucaacauuugaacuugaacauauuugucaauuauuuuucuguguuugguaaaaaagagagagagagagagaaagcgagagaagucauuacagucguaauuuaauauuuuuauuuagcugaauuugauccuucuuaaaaauccuuuccacuuugaagucuauuuugcagcuuaauuaaugcagcaagggcuuuuuauuuugcucucaauggagauaaucuuaaucuauucacagugaccuuuucuugugcaaauuaguuguacaugcuuguuuaagcaaaugguccuuugcaugaugucucuucuuaaugacggguuuauaauugaaaauuggcuuacucccauaugccuaguuuauaugagaauauaaaaauagauguggacuuuaaaaauaugaauguauguaucaauaucccaaaaaaaguagagggaagaauccagugccuccaggcuaugguuaaauuagacuauuagaguuagaaaaugccggugacauaugcuacugucagagucacaccugucugcgcuacauuggaagugcuugagaaaugagagcgauuucaucuuggcugugcaacucagagccuuuacaggacaugaggcaucucuagcuucccgaguucucuuagacucuuaguuaagucgaaagugcgugcuuaggaauguauuugguauuaauaacuuuuacagggggagccucaaauaauuaaaugcuuuuuuugguccugagucucacugacaauaagagacaggugauagucauguuauaauuuuucuggaguccccccuccccccaaaacaguguaauaccauuaaauggcauuugaguaaaaagaauaaucaccaugcucuaucccaguuugcaguucccccugguaauuuuuuucuuuguucugccucugccucauucuucacaaaggcuuucuucugcuccccauccuuggccucccaugcccuauuccuccuggcccccagccccgagucuuuccccaaaagucaaagcagccauacuuauacacagcacuauuuuucuggaaucacuaaauguucuugguuaaauguagaaacuccaguucgaagagaaaacaaauguuggcuugcgcuuaagguggagguuuccgaaguaucuuuuaauagcaugguguggggaacagagaacaagaagaacauuucguguugcugagugguguggcauuaagggagaagcagauguaucaggaaugcuucuuagucuauggcagcaaacuguuucgucaagcgggggggaggagggaaucuggcuagugcaugcaugccugcaaccagcuacagaucaacagaggcagaagugaguggaucucuguaaguuugaguccauccugcucugcauaccaaguucuaggccagccaaggguguguaaugagacuuucugugcaccccucccccaccugauuuaggaagcagagacuaggcaagacaaaugguuaugagaaccauuagaccugucccuuuguuuuuguuuuguuuuggguuuuuuuguuuugucuuguuuugggguuuuuuuuuuuuuuuuuuuuugguuuuucgggacaggguuucucuguauagcccuggcuguccuggagcucacuuuguagaccaggcuggccucgaacucagaaauccgccugccucugccucccgagugcugggauuaaaggcgugcgccaccacacccggcuagaccugucccuuuguaaacuguuugcaaaagagauccuuauugcuucauacagcaugauuguuccuguuugucuuucccaugcaacaagcucuugccccacuaaaugggaaggugagaguagcccuuccucaaggcuuaguuauuugggguaaauuguuaagguaaauugaugcucugcucugaaccuccaucauccguuuuuccuccuggauuugcacuugcugaucagaccucuuauuguucuagauaugauuaucgggaaaugcugcacaaugccacuuucugucugguuccucguggucgcaggcuuggguccuucagauuccuggaggcuuugcagguaagagacuaugaaaauuuaccgcagcagguugaagauuggagccaaacugguuucaagcuuuucauacuugucuagagucaaaaaaaaaaaaaaaaaaaauaagcccagcuuuugcuaaggaacuaaaaacacuucccaagaaaaucugaaaugguuuugaagagccagaauugggagcaagauugacucccugauuuuggacaugagagcaguuaguaagcggucucaccaccgggaagacuggauucaucaggaacauguuugcagacagagggcagaugggcagaucccauugcuaacauuggcucuugaguuuggagaugggggucucuccuuuuuuccugucagccaaugucaggagcacacccagcuuugggauuuuuugguuugcagccugucuucuugaauggcaagagaaauaugcccucuaccuaccuaccuaccuuccuuccuucuuuccuuccuuccuuucuucuuuccuuccugcaauaauuuacaauuugucugaaucuguguauuugagggguguuucauagcgccuucauccugucauuugaaccguaaguccuacccuuuccucaggcugaagagcuccugucucuggcagagcacuuccggugcuuugugcgcucugaaaagcguaccuucacuacucacuagcauucuggaagcuucaugggugccauagggagcaaauugcucucuggguugaauaaagacuuccuuggcgacuacauuucgucuucagccuguugacauccuagugcagacgggaaacuaguacaacugcaguuugcacuacacacuggagggaacaagguuuugaguuagaugcuuauagaaaaaggagagcuagauguuacaacaguuaaguccacaaagcucuaccuagacagauggaccccauccuguuccccacuggcucaugacauuggggggaaccaugaugagauguaucugaggcacuuccauugacaaaaugguguauacucaagguuuuuaugcucagauuuuuguuguuguuguuguugugaaagcuuucugcagcaaggccauucauccccauggaaguaaggucagccaaaccuauguacuagaauagaaaugggguauuagcauucuaaggcgagacuugaaaaucuucaagucagguagggaugcuugcagucccaugugaccugguaauucugagucacuuacuugcuuucuagccugagcaguguggggcccgugugacauaagcaaugccagugauugaauuuguacuuacucuucuccugauuggaaugguaucccugcugucgguauccucacacucaugaaauccuuccuuugcucaggcugccugugucccuguaaugcucagcaacggaugggaguugccauucuccgaagugauuaauuggaaccaagcugccgucauaggcgaugagagauugcuauuacagguaaggaaggggcuguggccuucggcagaagagcagauuauugcugcccccauccaaacuuucaaagaagaugaauccaaaaggucagcuccauaaaagaaauuuuaucaggagaaaauugccugugucauggugaauaugaagccguuuaauaugauauuguucacuuuccaaccccaaaaucuguccaaauccgcagaauauauugugggaaacagccauugcugauaaaguguaugagcuuuguugaguggggagagguggauccccaccagcuucagcaccagcguuuucagacacgacacucucucuggucccucggcucuauauucauucacucugguugacucugggacauaagcucuaggcuuguugcugugcgcaguguuaccacuaccgcaguacucaacccugaggacccgcaggagggcugucacuuggauagguauuuaaaagaaaggccccuaauaaaaguuucagucgugcaaggaaagggaacucagccugcccagagaauugaaugagcaagaaggggccaugaagauuuccaaagccccgcccccauccccuuacccccccuaccccacccccaguuguguuugagguucucuguaaacugccacauacucuuauaucacaguuaauauuucuuuucauggcauuaaauacuuuaucguuaaaccuccacaagguuguguagaaagauccucuccaauguuuguguuuuuaaaacaaaauuaauugauauccaagacaaggaguuucuagaugagcuucugcucuucuuccugugcuccuggcuggucugcuaauggacugcggaagggaugcagucaucuccugaaacucccagagaaugugcccgugauggagagcacuguggaccaauccagccgaggccacaacagccucccugucauucaguucucagcugugugaucuugggaccucugggaccacagcacaaaccuguggggauggguacucuggaaauagugaaccuguucuuuggacuuagcccauuccacucccuuuuaaaaaauuguuuauuuuuuauuuuauguacauugguguuuugacuccauaugucugauaaaggugucagaucuccuggaacaggaguuacagguaguuuuaaguugccaugugggugcuaggaauugaaccccugguagaaaggguauccaguacucuuaacugcugagccaucucuccaucccuagccuauucuguucuaaacaaaacauaauuccauagguguucacugagaaagguuuggggauuucgaaagguuaguguucauagcacugauucccugguauaauucaauagggacagccuccaagacauacuaagaaagagcucuccauguagacagaguagacgccugagucauacacucagugugguauguggugcuuguccacacugccuuugucuuucuuuccuuuuauguugcuuuaauaauacauagucauaaaggaaauuuuggauaugaaaaccaucagucauuguguucucaauuuuuuuuuuaaccaaugcauucuugaacuugcuaugaacaaguuggagucugucuuagaguagagaacauuccaugacacuuaaguaugguuauccugggcuacuaaaguuuggcuuuuucacucuuugaagccacauuuugacuugacucuaaagauuguauucuucacaccccugugcccacacuugcuaguauuuuuccuccucaucugcaaucuguuuuuacacagcugcuuccauauugaacagugacuguacgguuguuaacaaugguuuuaaagagcuggcacggagcccaaaugugugcucugggaaauguuuuuuguuauguuacaauuuuucauuuccuguuuucgaacagcucugguguuuuuauuugcauauguucuugucagccugucaccgaggagcguacuguggcuuuccuauaucuauuuugguagauccuauuaccacacauaaccuuuuauuaggacuuccaaaucauccuguccaaaucguaauuaauucaucacuuucgcauaccugucucugaggaaaggcagauuaauaaccaauagccaaaugccauuggaacuuagaacuccauccugccaaucaauugaagucauccuccacacaaacugguagaacucuagaagugggagaacaggaugucgccauggaagacacggggugguaucauuggcugagucuaugcaccucccuccucccuuuagaagcaccauggaccuggcuuucuggagaccauauagccaugguagcuuuuggcauuuucucguggccaugauaaaaacagccaugccaaucuguaugacuuagagaaugccauugucauugaaagggacaugcuuauaaaaauuggggaugaggguuuucccccccuaguuuuucuucggcaaucuaggucauuuucucauugagcaaauaaaaauaaauuuucuugacuuaucauggaucugugucaugaaugguucagcucaucuaagaauauuuuauuuccauugaccuugauccugccaguguuucaacuuuaccuucagcaucuguauuuuuuucaguauuaugaucuuuucaaagcauagacuuaguaucuacauugagauauuggcagagcaagucagguuuuccuucuguucuuuucacugcuuuucuuaagggccaauuugaaucuuagcaaugugcuaucaucuccuuucccucugaugagaacgcaacuauagugcagucccauauuuugaguaacuuuccuauuaaugugguuggcagagcauuucuuauguagcccaggcucccaugucugugugauucaucaugcauuagggaggcaagcaugcagaaaggugcgcacagcagggcaguugacaaucacaggaaucuaguguagauuacauaaauagaacagcccuugagcuguacguacagucagggagcaagccuggaaaacuuagccagaaauccaaggaaggcaucuuagaacuagggcuaagacaaauuuauagguagacuguaaacaacuggcccagcucuacuuaaaauaaauugguccaacuuggacuagcaucucccugugucaacaaugguaauagcaguaauaaugaaccaucauaauuaagauuucuauauguagacacuguacuaagcacccaaccauaucauguuaugaaugaacaauccaaaagagcaccuaauucauccaaggaagcauaucuaguaaauaguagaaccagaaucccacauugaugcccuuaacgccuuuaccuuacuaucaagcuaugcuacuauuaaaaauaacaauauccugaugagagcuucuauuggccaugcucaauuaggcucauuucuugaauagcuagcauaaaaacuauucucuuagccacaaaauauauagcaguaugaacaggaagaaaggccuuccuucaaaauuauuuaacuugguauagaacagccuaugaugaaauguuugagagauccagagaaaucagaguaagggcuggaguugagaggagagcucucagguguacaaaagguucaaaggagacuagaagaaggaugugcauguggacauggcuaaaucgguuuggguugagugguuaggcucaugaacagucuuuaaauagacacauuuauagauacuucauggucccuagaguggcacuucuuagaaaaggguuuguugguugguugguugguugguugguugguuuuguuuuugguuuuuauuguuguuguuguucuguuuguuuacugucuccaagaccucucauguccauaucaggaccaaagauuuuguggacuugaggaggaagaggagaaggaagaggaggaagagggaacgggacuuaggacuguaggaguccccuauacaacuaaccugcuaccacagaaucuuagagcugagcuaggccagugcacagucuccaugcauuugaaugcuguugagguugcuuuccuagaccuguuguuuguucugauguuucuuggggacauuuuuacuuagcaguuggugacuuugguggugagccuagccuuuacuggcuuagccaucauuucagccugggugaugauuuuuuaauagaccuguuuucuagaaaaugaaugcuaugaagaacaaaagugcaacccacugaguuguuuugaucaagcucaucucucuguuuugcaguuauaauuacuauguguuccccuuauguuacagauuccuucuacaaucaggucuauucaucaggauaaaauccuagcacuuagacagcagacacaguucuugugggaggcuuauuuuucuucaguugagaagauuguauuaacuacacuagagguaagugagaccauuccacucaugaucuuugaauaauaguucuuuuauugcaaccucuuuuuuuacuguuggguuguguacuuagucaaguaggacaaaaccaaauuuccuguccuugcauaguuuagugacagcucauccugcaaccccacaucuguuuuaccagucuuaagcaaaugcccucauuccugacaaauucucauaguagaagugacauggagagaaguuguacccuggacaaagugauuugucuggcauaauuucagagguaauguggguaaugacuaucuuccugucacucaaacucagugguauccuuugaagacauauuucuggaguaaauugagaaaaaaagauacugaucaaguaaggaaacuauccuccaccauucuuaaacuaugaacaguucaggggccaccauagggcacagcacuuuaagagacagcagaauugcuucugaagacacaaacaacugaaccagccaaccccauguuguaagguugugguaagaagaaaacuucugucaugguuguauccuacugguguugaaaauguuaaucuuuauaaaaguagaaacucuggcucaugaguggauaaacaucuucaaguugcuuuauucugucuguguguguguguguguguguguguguguguguguuggggggcaggggaguuguauugagaaagcacuccacauacacugagccaugucucauucuuuuaaauugccugguuuaaggcaauagcaaaauagaaaaucaugaaaaugauuaaaaccacaggaaguagagcagauagcaauggccucgggcuaugcagagcuuugcaaagagcuaagaaagcucacagaaaacugcacacucaugaguuuccugccuaugagcaggggagugaucagauugucuccugaggugacccuggaacuuggagaauggggcaggacaaucuacuacacacuuggagaguauuuccuucggaaguuaacaaucacucugaaagcuaauauaaucuugaauaaauacaaaacaaccaaguaauaccguggaaacugaagucaccugcuccauugacaugaucaugcuguguucuuguugaggggagggagggucagcaugaguguuagacaaagcacaguggaaauuuuuccacaccagccuaacuucagcuccaggucuuagcucuaggcaaccagucaccaggauuuuuaugcccgguguacauccugcggcuagguaaacaggucuaucuaaguuauuuuccauuccuuuuugcuuuuguuucugagugagauaggagauuuuuuuuuucuuuaaaaauaauaaaucauuuucuagccuuuuacuucuuagaauguuagcaaaacuaacuggauuuuaucugucucuugcucaggaagcccacagauaaacaaaagaaacugccacaacauuuuugacacuugcaguuuuuagaauauuugaaauauuaguuuuuuguccuaagcauucccccucagcuguucacacucauuuugcucuguuuguguuauacccgucucagugucuguggcuucucugcuggcuacauuuagacagagccuuggccuucuaauguauaguuuaucuguacacauacagacacauacacauauuuuacugcaaucauuuuuuuuaauauaucauaccgucuaacugcuuagacuauuggcuuuuaaucauguucuguauuaaaaagguagccuuuuuuucuucauuuauuuucuuucuuguaaguuauuuucuaguuuucccguggcuuuaguuacucuuucgggcuacguaguaugucuucgggcguguccuuagccuuuuuauccuguccugcucuguucaccgauacacccagaccacguuuuaaucugucuucacccuaauaccaucgugugguaagccucugcuuauccacccaucuggugcaggucaccguaaauacuaucugugauuacugcuaucugcauagaugacugggaaugcauacagugccuuagucaguguuuugcuugcauuuugagcuuuguuucugccuacacuucuagguugguauuuaugaagugaaauuagugaaccaaagaguccaggcauuacaaaguucauaauauauuuuguuaaauuacuauguuuuuucuuaaacuugaaaaaaacauauuguuuuauuuuuguuugaugaaaauggcacaugaaauugaaugacauaaaauaaaacuugaguaaugggggagucuacuguaaagauagcaauuuuccucgaucuacacaucaaagucuuaaaagaaguuagacaaauuacuuuuaguuuaaagauuaauuauauuuaguuugaagaauaaaugcccuaccauagccuaggauuauugaaaagcaguaaagaucauuuauuuccauaguuuaauuagcacacauuauaaagcuaccauaauuaugagagcuuugauccaacuucucaaaugagagaagauaugaguuguguuacuugauaccaaauaacguauuguuaguacaauagugggcauauaguauaaaaguauuagcaacacucgcaugaggacuugguuggacucccaguauccauguaaaagccagccauggugacaugggccugugacuacaaugcagugcagacaguggcaggcauauuccagaagcuugauacguagccaggcuagcccaaacugcaagguccagguccaagugcagaccuguccaccucugaucuccacacaggugagcacuccacacucacacaggcacacaaagauaauacaguugauguaauaagauagagguggguauagccauaucauuugaaguuaaagaagcugcucugcacaugaucucaggcauaaaacacacuaagcaugacgaugaaaaucauuaaaacuuuugucaggcagauacaccauaaagaaaugcaaaacugagagcagagguucacagucaauaugaagcuaaaaaauguuaauauuuuugacauguaaacucugauaaagaaauuagaaaaauauccaaguucccaaguaggcuggaauacagugagaccuugucaaaaacacacaaaaguacuuauauuuucagauuagaacaauugaaguacgucuuuucccaaaacccguuaaaguacaucuuucuacaaacauucugaauuaggauaugaaaugaaaaggaaaaacuccuaauauuucaguaauguauguauacauaaauuauacauauguauguauacaauggcagaugcguauagauaaucaguacauacagcaguuugaguuaaugguuuucuuaaaguauauuaugauggugcagaaaauaacaugcauucauuaaauccauauuuugaguacuuauuuuguaccuuuucccaggcuaucaguaugugugauagaauauuguguugugaaucugggcaguggccaugagccauaucucccagucagccacacuuguaucucugugugcuguguugcuaagguuaguuaguaugcuggaugaacugaguauaguaaacacauuuucaacuuacuuuauuuuuagucuauaaugaguuuaucaggaugugacacccucauaaucuaaagaaguaucuacagaauccuuguguggauggauauaauaaagacaagagaugcaaaaguguggaguggcuuaauugcuaauuaaauugaauuguacuuguuccuaagcguauauagucaagucauguaugcaucaggugcugugaaagggauauuuaccuuaacuugaggaaguuaaaauuaaauaaaauacuacuucccaccuauagcaucaguagaugucccauggaaucaugguaguggugucaccaagggugcagaagagagacuuuaagauuagauggaggaugacuaccccucuuaagccuuucugcagaggcuagcaccuuuagaagaaagcauaauuuucacccuguacuucucgagaagauaaugaccuaaugaagaaaguucuaaguagcauaggcuaugguguuuauguuuguuauaacauugcacauccucagucagauagugagaaacagauuggccaauuguaauguaucuacauugaagacuauuauacagacaccaaaugugguaaggauauacauuuauugguauaagcaaauguucauacuguucuuuuaaaaacagguuacaauauauucaaacccaucuuuuauuuuggucaacauaauacagacuuauacacauuuagggaaaaccauuccuaagucaugauauaaaauacuagcuguaucccccuuuaaagucuuauguauuuuacuuuuuguguguaugaauguuuuacccguauguauauauguggaucacauggacauagugcccucagaggccaguaauagguguuagauccccuggaacuggaguucagaugauuguaagcuguuuuccuguuccucugugagcuccacugagucaccuucucauccccucucuguccucuauuuaagcagggauuuaugugaagcugauuuuuuuuuuauuuucucuuuugucuucccuaauuugcugcaaaggaccuaucaugagugacuaguucauucucuugauauuucaaaauaaagcaguccauguaagaaagaaaacugccuuaaaugacacaucucauugccuacaguaggaggaacaguauugcauccacuuagacucuuuaaaugguugccuccacuuagacucucccaggcugucucugagagacccuccucugcugcauucuugugagccuucaugauuguaauuaaaacauaacacacagacaacauugcuaauuugccaggcaaaagaucauaucucauuaauuauauuucuuuugcagcagguuauuguguggauccaguuucuugucuauuaaguuaacagagcucccuccauucuccugcaauaacagcuggauguguuacauucaucacaauagaaucuuacguugagcuguuuucaucuuugagccuagaaaagcuuucuuccccuuggaucuaagccacacaauucuuuagcaacacauuuuuuuuuaacacuaaaaccauauacuucauucaaauuuauagcagcugucaaaucucucuauaucaucccaagauuggauuguaaccaucugaccucucaggcaaauugcaagagagagaacacuugcuuucccaucuuaauucagagcuugcauuacccuaaauucaacaaacagaaaaacagaagugguaaaggaaaugccauccuuauacacaaagcaacaaagcauacguguuccugagaugagcucaaggaccacacgucagcugggcccacuuggccuagcacuuagacacaauaagucguccaauggguuauggcccugcuaaggaagaaaauggacguuaacucuaggcagcauagacuuaaggcucuuuugcuuaauuuaucuacgcauagacucuggaucugugguacuucuuccuuguugaucauaaucuagacccugagagugggaugacaagucuuuggagaauccccacuguaacuucucucaucacuaugaacagaugccuuacaagagccgcuuaggagaaggaaagcuuauucaauucaggcuuacagguuaagguagggacaguaugggaaccggaguaugagaacgcuggucauggccuuuggucuguagauuggaaauagaaaguggacaggaaguaggaccuggcuaucaaaucucaaggcccucccucacuuccuuccuccaggagugcuuuacuucuuaaagguucuacagccuucuaaagagcaucaucagguggacccgaguauucagacacccaagccugggguggacgacauuucacauucaaaccacaacacuagcucuaacguuauagguaguacuuagacacagucgaagauggggucccucauucuccccaaagccaaggaugagcagggagugcauuccuuccgcauggcuacucuuucagacuugggauccuguuagcucucaagacugacugcugcauuuuggaauuagucuccucggagcuggauuuuucuguuuucuacuuacuugcaggcaaauugaaacaauggcaguggacugaguagcaagcugcuaggaagauaguguuucuucaugggucagcccauagucacucagguucaaggcaagcaaagagaaagcaugcaugagaugauagcaaucgcuggcauaaccuaacagccuauggaaguggaggagacgcuguuuuagaaguggggguuguggagcuuucccaguuugcuucuuaguuaucugaccaagcacauuuaaacuacagcacgguugugcuaugcugaugauuuuccuguaaagccagugagcuaaugucaaucaaagauggcuuuggcuuuaaacacaugucaucugauggcacuuggugugccaggcaguaaguaucauuugaucaaggaacaaaugaagaugacuacagccugcaacgcacuacccaugauuuuguaaaagagaauggcauagaacaauaaggagccugucauucuacccuguaaauuuacucaaguaugauccuacugagggccucaacaaacuccucccucucccuuucccucucccucucccucucccucucccucucccucucccucucccucucccucucagucucucucucucuguguguguguguguguguguguguguguguguguguguguguguguguguguguguaaauacccaaggaaguguccaaccucuaaauguuaugucuucuuucacagcaauaaaguguaaacacugagugccauuuaagaauccugagagcugucuggugaagugacagggagagcuagacauuaggagauugaaaaaugaccuuucuguuuguuggaaugagauccaaacuccuucaaacuuuugacaauccaaguugauauauaagcuuuuuagaagcauaucugucagccaggcaguucuggugcgugccuugaaucccagcauuugggaagcagaagcaggugggucucuuaaauucaagaccagccuagucuauagaguaaguucuaggacagccagggcuacaaagacaaauccuaucucaggaaggaaggaagggagggagggagggagggagggagggagggagggagggagggagggagggaggagagacagacaaaccaaagucuuaaagaaucuuuaaugaauguggaagcuuuuuauucagaaguauucucaauucuuugccuagacaaaugacuauuuuggucaguucagagaaauaagcugugaguacuauggggaaacacauaaaaagaccaauauuggcuguaucuagaaaaugaaaugagauuugguuugaaagacaaaaaucaaaucuuagauacaagaauuuagcagauuaguugacauucugagaggcugucaguaaaucaguuuauugccagugagaggaugaaccguggaggccacaccucucuuggccaagauuaaguuccaugugcuauaugcagucacacuuguaucugcuugucaagauccauuuaaauagaguaugaaacgcuuauuagaauuucaagaguguuccauaacugauggucguauuuggaaaauuugaaagaagccagacuuuaaagcgaauggaguccgugaccaugugaggcgugccucccugggacccgagcaaaugaugagcuacuuguaacaucucugaguuccgugucauuuguuuguagcuucaauuucucaugcugccucuugccaauuuauccugugucuugauagccgaggucauugauaugaccccaugcuaaaaggcacauaaauuuagaacgaaaacaaaagggagaucuaaauagaccacuauggaaagggaauaauagccugcauuggggaaguaugcaagaugaaaaaauguaauaaaugguauacagacauuugcaugccguguaaaacucuuuccagcucucacauguugcucacaauagaugucuacaggauggcacugcaaaccaugccucuguaccauuggcaggaaauaucaacauuauaauuggauuccugaaaucuucgucaacucagaaaguuaccuaaccauauaaaauuagcaauuuugaucugagggaaaaauaaaaaugcagauauuacugaacugagauuauuuguuccucucaauuucuacccuacuucucucaguaggaaaguacaggugaugugguuuaaaagacccauaaggcucauuugaguguuguacccaucacugagugggaugacauggugagcauauuaauaacuuagcaaauccuagaaguccaugcuuagauucauguuuccuuaaauguuauaucaggguugauuggcagauucagugauuuauuauugggagucaaacagcgcuuuauaaaugguaauagauaccacccaacuaagccccugagguggcuuuuucuuuguugguuucuuuguuuuuuuugaguuuuaaacuuuuuuccugguaugauauucuguaucaaguuaauuauuuucuacaucauaucuuaaugagucaaugguuuuauuacaagaguuuuaaagucagagagaaagcccuaaaguagacuaaucacauucaacugacaaaugauucagguugggagaagguuugucucuaaauguaaaauuuaaugaucugcaaggucccaaaguccaaugaaacuaaugaacuagccugacaauuacuagucuucauaugccaugguucuugucccauuccguaggauguuuugagcaguuguuaaaucacaacuuuuugaagucaaaauacagaaauccuugagcuggcuaguauucaacgcccugcaacugacuuugaaaauggaaugaacgauggugacaggcaauuuaaaacucccuccugaauuaaagggauggaauggggagugagccuaccuucucuugucuuuguuucugucuccagauggccaacacugacagugcugugcacauagaacggaucuugcugauaagaucugaaucuauauagagaugccccaccaccaggggcuggugaacucuucuguacacuguacuugaggugcuuugucagccaguccuucucuugcucucacuguccugccgagccugucacugcuuugucucgcacacguuccuaucaguggggacuuggaggaggagcaguuagaaugugcgaugucuuuucaacaucaucauucccuaucuugggugagccaagacccuuucugaguaucaucucgacucaaccucaccaccugcugcuuugcuuucuagauuauucaggacagaauauucaagcacauaucacguaacaguuuaauauggaacaaacauccuggaggauuguucguccuaccgcaguauucaucuuaccugggagauuucccuuacuacuaugcuaauuuagguaagugaauccuuuugauuaccccccccaaagugguuauucuucccaauagccagggugggagauuguugucugagcccccuuuaaagaauuguaaauacaacagaguauuagaaaacaaaaaagacaggaagccuucuuucucaucugagcagcuauccuguacauuugguagacuucauugagaaauguucuuaaauuauagaucauuuugaacaugagaagcgauuaaguauaaacuuaauauauaugugugucuguguauguauauagguaugcccguguguguauaucuccaugauuuuuuucauaaucucacuucucuuuauguacauuuagaaaaaccugaauuaagaaggagaaauaagaaauaacuaagaugaugugucaaggaagaauugaugcauucuuccaggguuuaguauggcccucuccuacacagagcuaauggcaggcuagauguuugaagguuugguagaaucuguacucacaagcagcuuugacuugaucucaguggggugaaggaugggagcacagagauacagcuccacagaggcugauguuccuaccgcaggcauugccauaguuggagccccagacgcucucaugucaguggcaucagcgacacguuagcucagaguuacagcguuuagaaaauguggggcaguaagguaucuuucagacugcuaugauaaagacucagggugguccuauucuauaugaaugugcuccaaaacaccuucacccuucuuaaauuguacauacuuaguuugaaacccacgaagugagacugaaguuucgggccuaaaguauucaucagcagugaauaaccauuuaauguaaaccggacuuguugggaggaccauguggaauucaguggaugguugacugagccagugagaacucauugugugucaaaugcaguagauaagaauccuaacauuucucguaaagcucugugaucuucauucagaguuagcccuuuagaaguaugucaaugaugccucuuaaacgcuugcuggaaaaccuaaaagcaaugagugguuuccaucguuaagaaguguuuccucaguccuggguaucuuuccugaguauacaucaagagaagaagaaacucacuuucuuucugaaguucaauuaaaaugcuaauuggaaggcacaauuuuccauguaaaacauuugcauaaucauuucacauauacacucugauuuuaacuuacauccccaccuauaucaaagucuaauggggauguucccacaaugccugguucauaccuaagcuacuaaugugccaaauuaguaggccuaaauuaaugaaguucugaaaggcucuuaaccuguuuguaauuuccgaggucuugaagaagggcucccgaggggauaccuucuuguuucucuguggugguaaugguugauuugcauauucauuguccuugcccauaaagagcucccauugggcagaagucaguuucacauacuuuuucucucagugguguuccuguuacacaaagcagccauucuugaaaaauggaggcucccuuagugugaugcugcugaugcuggagccaguguugaggaugcugauggugauaacacagagcacuucuuauuugcuaauaaguccugugcuaagugcucaguguguaucagggugcucaacucuggggauaaaugcaugucccagccuaagaaacccagaggauccacccauauuucucaaugccacuaacacugauggaagaucugggagucaggccuaaauggaugaugcuagguguuguccuuugaacuuuuccuacauucuaauucuuuuaugaaauguuagucacacaauccccuuuaguuaauaugcaggcacuuguaaauccaccaauggaaaaggcuugcuuauguauagacauaacagguaaguuaugcaccagaacagagugcauagauacauauuggguaacauuuaaaaaaaaaaaaaaaaaaaaaaagauggcaggcaucacuaagggaagaaaauguccacagaaucuggagauggauggacacuggagaggucucuaggcugauuggcuguuacaugucaacuugcccuuuucuccccuucuguccauaaauaagacaugaaggacagcuguacuugagggacagcaacuccaggguaaaccacugggacauggagucuuuuugcugagucuucuauuuuucagugcuuccuuaggccccuccuaugauugccuuucagguuuaaagccccccuccaaauucacugcagucauccaugcugugacuccccuggucucucagucccagccaguguugaagcuucuuguggcugcagccaaaucccaguacugugcgcaggugaguagccuuguucucugcagccucauugcauaccucucccacacuuggcuuuccaggauguugcucaucaaguaacauacccaguuccucuagugauuggcuaggcuuugauacucuccuuuuuaucaacuuggagacucaaaagugaaaccuggcacaagucagauuucagaaugaccuuugccuugguguaaaauguacccgcucccccaacacacacauauagagauguucuguuuaaaaaaaaauguaugaaacaaacuacuuccuuuuuuucuuuuguguguggauauguacgcauguuuugagagggugagcaauauguuuguguauaggcacauauguucacauauguguuuagggcagaggugaaccgaggauauuguuccuuagguacugucuaccaacuuuuugagacacugccccacccuggaacucauugauaaggccaggcugccuggccagcaagcuccaggggucugccuguuucugaugccccacccagccuugggauuacaagcacacacucccauaccuggccuuuccccacggaugcuggggauugcccuuguguuggcagggcagacauuuuacucacugagccaccucccuagccucuuauuucauucauaaacaucaaaaugauaauguaaaccaaaauggccacauggcgggacacagaacacuacguuccaguaacaguaacagacuuggcagugucgggaagugucgacuuuuccuucacagcggccaggagagaggagagaaugauaucugcgguagcaguguuucccaaaucaguagcacuccgagagucuuaacacuguuuaguuuuuuuaacuugugccggguguagauaaaaugguuuacaaaugagaaaaggcucaaaucauagugaaguguucaguuuucaauucauugccuuuaauggaaauuauaaagucacauaaagccagcaacuguucaggggaauccaaagcaggaacucauugugcuucugucucaaauucuuuuaugucgcccacuugccugguguggugugaguucauagcagauguucggauguuugguauacauuuuuauuuaacuugaucacaguugcuauuacacucuuaucauaagauaucagaaguuagaaaacacuugauuaaguuccggcaaacuugaaguuacugcuuuuuauuugugagugaguguguguguguauguauguauguauguauguauguauguauguauguauguguguguguuuaucuauguguuugcauauaugugaggguuuauguauaugugcaggcacauaugcacaaaugugcguauacauauagaguccauaggaugacguugggauuuaucucauuuguccucuuucauauauguuaagguagaguuucuuccacacagaguuuguguauuggcuuagcuggucuaguaagcaagcuuaccacaaggauucucuaccuccuagggacuaggauuuuugguagacauacccaccuggcauuuuuauggguccuggggaucaaacuuaagcucuuuacuugcugagccaucucuucagcccuuagaguuacuacuuucuccuagucucugaaaguaaucauuuagauuucuaccguuccucucugguuguugaagaucgaaaguucuaaaguugguacggguauggacucacuuugaaauuuuguuuugccagcucacuucuaucccucuuuuagaagggggccuauagaaguacucaagacagccgucuaaugaucccugugccuuucagaucauaguucuguggaauugugacaagccucuaccagccaaacaucgcuggccugccacugccgugccugucaucgucauugaaggagaaagcaagguaggaggggcuaaugugaggggacuguggaaaccuaccucuucacagaccaccaugggugcugcuggcucuagaagaucccuuaagagcccuugggucaggguuaugucuaacgcuguacuuguucccgaaugucuagcuuugccagccauggacuuugcaaucagugaaacuugcagaguuucacugcaaacaaucugguagcuagcuuucuaaguuuacauucuuggaugcuauuuccucauucauaaaaggacacuuauaccacacacuuccuaggguaacugugagggugaaaugagcucaaggcucagcgguguuuccauaaaugacaagaaugaaagguggcaguggcagcugcugcugcugauguugcaugugcacaguuuguuuagcuaaugcauuguguccuucaggaaaaaguucuuccuuacccuucucuuuaaaaagucguuucuccuuauuuugccuugaagccuccuuucauccaaagaccagcucagccucgcuggcccauuacuuucauuauccaguccacucugcuuagaacucaauaaccuucugaucgucuucuggccuuucagggacuauauuuauugauggcuuaacuagcaucugaagucauguguccugcccaagauggcccuccagucucuuuuucucuccuuucuucuguagcugcugguuauaaugauucgaaaggccauuuggcuuuggucuuggccugcucucucaacucuccaccucugucagcacccccaccugucuuucaacccccuucauucugccguggucuuaaaagugggugcacuauuaacagucagaacccagcucacuccccuagcugcuacaugguacuuucuuucccaguuguaauuagucacuacucaguaaaagugauauuggagaagcaguguccucugagagacuucuuuugccaguuccacagagacuacuuuacccuagguauaguaccuaagccagaauagcaaaauaauuagguuguugggucaaaccauuugaagcuaucuuggaucuuugaaaaguagcaaauccauauguuccacauaauguggugagaauugcaauggccccauggagaaaagacaaacagagcaugucauuauauacucauuuuccacuuagaacacuguguguugguucuguguuauagacuuacaacacacuggagacaucuggaagccuggacaguaugcagauguauacuagcaacucugaacuuuggaauucuuugguguuuuggccccaugaaugaccacaucuccuguaucucuuugggcugugugugucaagauauguggacaggacucaaugugccugacuggggccauucugaugucuucagauugcacgacaguuucgugcucuaauucacaaauuguauaccuuugcucccagugagaagugcugaagaugcuaaugccuuuccugggaucguaccuugaggaggugccacacucucccaucaauuucuauaacuaugccccuggaaacuaguuuaguuuucaccuuuacuuuggccacucaucccagugggcuguguggcucaugugccuugucgugacucucagugucucggguggcacauucucuagaaguguuagcauuucagccuugcugcggacucaguggauuauaacuuagccccacuucgaugauucagugaaauauuguguaucaaggacuuagccuugugccuacuuaacacacacaaacauuggcuugguuuuuauaugaucugaggggcaugucuuaaucucugugccgucacacaccuuccaauaagcagaaguaaucaugauacccaguuuaugguggcugaaagaaucaaaugauaccauguaugccaggaauugucgacaagauaucauagacucccccaaacuuuggugcaggguguguguaauuauuuccauaguuuuuuuuuuuuccucuguacuagauuugucuuggccaguuucauugucauguuuauaaguuguaaaagacuuggcuacucacaugguuaaccagugaacaaacaggacaaaacccaguuauacaauauugaccucauggguauaugccuuccccuuguguuaguucacucaagaagguaauugggucaaggacuugaaagaaaaucucuuuuucuauacuaaugggcucauaaacuauaguucagaaaaaggaagagagggagaaagagagagguaggagaaggaacgaacgaacaaaagaagacagacagacagacugacugacuuacugacuucccugugaagccagugacugagcccaggguggggaacagccuucuccaucccacaaucuucauaucuagcugggacuucagagcugaugugugcuguuucagcugcaaaguucuguuuugaauuuauagggcuugucuucgcaguuuuccccuguaggcugaacacgggaaaggucagggcauugcuaagcugccagcuaaugguuucugugguccucuguggacauguaaacagcucaggagaaucgcugcaggcggagauuucugagcgcuguagauaugggguugccgaccacuuuguguuuuauuuuauuuugaaagacugagaaagauuuaaacacacacacacacacacacacacacacaaacaccgaacccugacccacuugacagaugugcgggaguagucucugcagccauguauacuacagcucuguugccugagcucucagauagguuaucguaguguuucccagcuuacaggcaugcaccuuggaucugagaugagacaaacuuggcuuccccauguaagcaaagcaugggagucuuugugguuauuaaaugugcuacuccccccgacccccggggccuguuagguggcuccuucuccgucuugccaggguucagccucugcuuugcuacccaucauuugagcauucgaagugaauugaggcggagcaugccucucgggucucuaugugugaaucucaagccugacuuuuccaggacaauggggaugggcuugucacauuuggccaugcaugugcuuuuagguucuuucucgacagccacacuaucugggaacaaacccaaguucaugaccuuucugucuccccaccccccaucacuccccagcccuaagauggguuuguuauaaagauacaauaagacgagggccaugaagggaaggccaggaacauucccugacauacuagcuaguccaggacaauugguuauuguauagcacaguucucacaggcagaagcugugccucucacggguaagcuuccauaccuccaucuaucccaucaaacuucuuagccccaugcccacugguguagaauggccccagugcaccuuuccaauguagcaccuucccagcuucccuaacugugcaccacacaugcucauucuuacccaguuaaaucauuguagucuucauuccuuuuuuuuuuuuuuaagaguagagaaacuaaggcuucucuugucaaucacuagcugucaacaauuuucuauuuauuuauuuauuuauuuauuuauuuauuagauauuuucuuuauauacauuucaaaugcuaucccaaaaguucccuauucccucccuccucccugcuccccuacccacccacucccacuucuuggcccuggcauuccccuguauuggggcauauaaguuugcaauaccaaggggcuucucuucccagugauggccaacuaggccauuuucugcuacauaugcagcuagagacacgagcucuggggguacugguuaguucauauuguuguuccacccauaggguugcagaccccuucagcuccuuaggugcuuucucuagcuucuccauugggggcccuguguuccaucuuauagaugacugugagcauccacuucuguauuugccaggcacuggcauggccucauacgagacaacuauaacagggucccuucagcaaaaucuuucuggcauugugcaauagugucuggguuuggugacugauuauggaauggauccccaagugggguagucucuggaugguccaaccuuucgucuuaacuccaaacauugucucuauaacuccuuucauggguauuuuguucccuauucuaaggaggaaugaaguauucacccauuggucuucccuuuucuugauuuucuuguguuuugcaaauuguaucuuggguguucuauguuucugggcuaauauccacuuaucagugagugcaguaguccucauucuuaauuccuuccacuggcauagcaacaauaugcguguacgagcacuaucuaugauuuuugcuagaauagaaauaaagucaguauuguaaauguuugggcaucuccaguggucuggucucccaggauguguaccaggauggaauaugucaucuucccuguucuuuccugcucucgggauacugguuaucucugggagucccuugugcuugcugaacccuugucucuguggccccauuuccgucucugccuggucauucccaccuagucggagggccugccuaauuuaugaugcccaugaagccuuccugugcucuucugguagcugacucugcugcccuccagucuggcacuuuucauucugagugaaagccagucauguagcucuccaucucuacugacucuggguuccuaaaggcaggccauaaaucacguuugguuucauccuuacugugguuggagugguaccuguaggugcucaguaauugcugccuggguuaauuuuugcugguggucgauggaagacguuugcuguggcagaugucagguaauggaacagucuucgugaugaugugacuggcagaauuuuccugacaguagacucuaacguggcuucuccaugcaccuaaccucacuucucuuacuccccagguuaugagcagccgguuucugcccuaugacaacaucaucacugaugcugugcucagccuggaugaggacacugugcuuucaacuacggaaguaagaauggugccucgggagcagggcggggcucucuggcaggugccuucaggccugagaggugcugggaucgcucuugcccuugccuugcuagaaguugaaaacguuucccaagucuuccugaagugguuuuaauuaacccaguuccugcuagcgccuugccacccccuggcacccugagaaaggcacuuucccccuuuguuuucucuucuaauuaagaccugauuuguguggcuguucuucuccccucccccucucaucuuucaucuccuuuuauuuuuuaaguaguacagcuguaggcagguguguggaaacccagggauggaauaccuauguccugaaacucucuggucaagcaucccacccuucugcaguuacagcgcucucugugcccaggaugcacauuuguggcuucuaaaaggcuauuuuuuugucucaucuaaagugcuuccugcucccacaugcacacacucauucauucucacucucucucucucucucucucucucucucauacacacacacacacacacacacacaaucacacacacacauacugcauucacacacacacacacacugcauucacacacaagcaaacaguuucaucugaaggcugagauggagaccuucuauuuugaauguucaaguauuugugccaaaaaauaagauuacacagggaagucuguguggagaaagagaaagaagagggaagagauaggugauggaaaauuuuguagcuggauugaguauugauugcugaggcuucaggccauagaugagaucaaagauaucucuaugaaaauauagaaucacauuauuaaugugaucacauuauuaaugguagcucuuaaaggcacagagacuucgcuaauuagcuuuuccuuuucuuuuuuuucuuuuuuuuuuuuuuagccuggaaucguuuuuucuuuuguuuuagaaauuggcacuugccagcacgcacucuuucggacccggaguguaggucuaguagacacacuuacgguugauauaggcuggcuaacuacccuuccuccuuaagaucccaucguuguaacuauguuuuagucuuuaccaauuguauuaagcagguccuaaauaaccccggcucaccugguucagugccucuuugcaacccgaguucuauaaagacuuguuagugacuggguccugggaauggacacugugccaaugcaagacugaccacacagccucugugucacaugucucguggcaagaugacaugcuacugggcugaagaugugaugaccaggcaaagagaaggccugaacagugagccuugagacacuccagcugguauuucucugcagcuugcugcaaaggaaagcuggcauccugagagcacauucauucaacaaguguuugcugagcgauuccuuuguucuggucucugugccagguacuuggguuacagagucccugcuuguaucuaucaaaguccuggcaguaaacagaauucaagucagauugcucaaaugagagaauuuucaauggcuuaaggagguguggguagggaugcugaacccuaucaaggauguuaaaacaccugguaagagcugaaagcuuuccuaccgcaucccugaacgaggaaaaggagaggcagcugaaaaggcccuccucccagagcuguguucauggagauguggcuguugucagaacuuuggcaccacauaguucugaaaggacaggaacagcgaagagaccuucuucuugaucccauguuucuguuuuuguuuuaaucuugcugguggcuaccauugaccugaccuagccaugcucuagaacgguaugccaagcagagcagguagagcccucccugggugugcugugaugaaguccugggaccauacaauuuagaggacgggagauugguuuagcucaggguugaagagcucucacuucaucauggcaggaaggauguggcugcucagagaucauguggcagccaugaaucggagagggauaaaggccaucugaguagauggcucccccuucuucucccuuugcuuccuccuaaaucccagaauauugagccucacauuccacacucauauuuacccucacccuccucuaguuaauccuuucuggaaacacucucaguggcacgucuagcagcaugcuuuacuaauuuccuggguaccucuugaguccagucaagucaauagucaaggcuagcuguuacauuaguaugccagcaucccagaauggaugaugccguuccaagggcaaacucagggacaagcaguacauccccaugguggaacauccacagcauauaccuagggcaucuucuuauggccuggaguaugguucaucucaccgcauccccagggcacaaggcaauugcucacacaccaggcuuugguuuuccaugccccauggugaaauagcuucccaccacugugauguaucuuuguacuggauuauuuccugugagaagauaguaguuccaaccacucagugcaugcugggaggaacauguguugcaugugaaguaauuagaagucaacguggguugaaaaugauauguaaauuuaagagguuggcagucuggcuugcuuucgccugcugaucacugaagugauuguauggccuaaaaugcucaugggcagaauuucucuauucuauuuuuuuuuuaggugaguagguguugguuucauuggauuuacacaccacacacacacacaaacacacacacauacacacuguucaagggaucuuagauuguauaagcaucucacugaagcaucaggaauagauuuuuuuaagaggcauucuuuaaagggcauuagauagaggugguuuaugcuuauuuacauuuauacgaguugccacaaacccucaaaagaaaacagauguugauuuuuaagagaggggggcuuauguugaccuuugcugucuuugauguguuaaugaugugaaugaaagcaguguuaucagaagaaucacaguuuuaucugaauuuacuuuugaguuccuuugaaaugacuugaaaaggcccugagauagugagacauucaugcaaugaaagcacccuauugcguucuauacuaguuguuucuuuaucaaagaauaaucccaaagagugcugacaguuggguggauucuuuaacaagaggcuacauaauauacugucccaucaauuggcacuauugguuuugaguaugggggaugucauagguuagcccaaucuggucucaggugucuggucagacucuauccccugcugucuuaacucuccccaguaaguuuuccuaaugcguggucuaccacucuccuucccucccaguuccgggcagguauaguuugugugaacgagucauuuuaagccccuuuucucuugugauggcaauguuuucagagaaagaaaaccaguaagaguuuguuaugaggaauuacuugaugaggucaugggagucucagggccugcaaagucuacacuuuccauauguaagcuggugucucagaaaagauaguauugugguccuuauagaaaaugauagccugagagugcaaauagccaauguuaagucccaguccaaaggcaggaggaguucagugcaagcauaaugguaggggaaaagggcacacacagagcaggugggauggcugcgugggucagagcucuugcauggaacccacauuaccaagccagauguggugguacacaucuggacuuucaggacuccuacagcacaauggcaggcagagacagggagaugaacaugaaguucguagaccagcuaaccugguccuacuguggccgaaacaagagugccugccuugcuaagguagaagggaaguccugaaaacuguucucugagcucugcacaugugaccuggcacaaacaccccaucaaccccaagaccaauucuuuuaaaauaguuaagaaacaucagagacaccuucuuccuccauauucgcucucugugaacucaguggauugaaagguggccacccacagaagaggggccucacauguuagccucauguggaaauaguuucacuggcccacacagagcuaaucucccaucugccuuccugaccuuuguugcggucaaguuggcacacauguuaaccauuguccuuuuuauuagaaagucucugacuagauaguaagugugcaaucuuuggcacagcucagaauggcaggcaucaaauugguguuucauauaaaugugaauauauggcuguuuacaaugagaguggcuucuagcuaagacugaaaaauuuggaaacaaaaauuuauuuuaaaaauuucaugaggcaaguagaacagcucaguggguaaaucuacuuucuacaccagugcucaaaaugucauucaugaaggagucucuguguaucccuggcuguccugaaacucacucuguagaugaagcuggccucaaacucagagaucugccuuccucugcuuccccacugcugggaugaaaggcgugugcugcgaccaccacuaggcuucacaaccucauuuaaauccuggguccugcgugauguauugagagaauuggcugugaaaguuauccucugacauccgcagaagcagcaucucacgccccaaaccccaacccaaaccacuaaaguacacugacguauguguguauggacacggacacauguguguaucuuugcacucaacucaaauaaauaaacuuaauaagaaaaaaauuaauguucugggccaaugauuccaaaaagauacuuuauguaguauauucguuuuaacaauuaucuuauugcuuuaauguuucuuugaaaauagcauagucaucaaugaaaccuaggauuucccugauguuuuuaccuaggaugaaacuaauuaaaaaaaaaauagaguagucaguuuaaagagaaauguuacuuaaugaguuuaaugggugauaugagacuugggcaaaaagcuuggggaauaucaagcuaagcuuacucacuucauuuuuaaaauuauuuuacuaaaaugaauaccaauuuacauauuauaagaucaaucaguuuaaacuuugcaguucagugauuuaguucauucaugaucuauacaguuaaugucauuuaucucuucucccaaaacguuauuaucauucacaaaggaaucuuugcauauguuuuacacugugccuccccuucuuugacaaccuucaucuuuaauuugccaaucacugauuugcccaacuaggauaucuuuauguuuguggaaauguguccuacauggcccuguuagccuucuuucucuuauuuagugcacuauguggcauuugaguuucagccauguuguauuaguguuaccaggaccucucuggcucccuuucuauuccuaguccuuuaucuccaugaaaagaauuuagacaagacacagaacauagcauaaggagaaacauauaauuaaaacacaugaggcauucucauggcugagagugggaaucgcccaaguauaccacaguaaaacacuuucauagugagaaugcacagcaaccaagugggaccccauacugaccuucauggcgacauaggcuaucuccucuuuaagguuucugaaagugacaacuuccugggugaugacuuccuauccaggugauugucagauccauuuggauuaauucuguagaaggggcaaugguuuguccaucuucucuuacaggaaagucucagaauagaugguguuuuaguuagguuucuaagacggaauaaaacuucaugaccaaaagcaaguuggggaggaaacaguuuauuuagcuuacacuuccacauugcuggucaucacugaaggaaauaaggacaggaaccuggaggcuggagcugaugcagaggccauggagggaugcuacuuacuggcuugcuccuauggcuugcuuggccugcuuucuuauagaacccaggaccaccagcccagggauggcuccaccuacuaugggcugggcccucccccauugaucacuaauugagaaaauaccuuacagguaaaucucauggaggcauuuuaucaacugaggcuucuuucuccuuaaugacucuagcuuauaucaaguugagucaguacacacuugcuaaucucuggugcaguucagaaccuaagagagauguguaucagaaccauacacacuggauauguuggcccugccacuuacuagugcacauaaauuacuugguccucuacuuagcuuucccuuuucuuagcugauaaauauaaaaauaucuaucuaccucaaagaguuauuauaagguuauuacaacauguacaguccucuaaaccuucauaugguaaucauuauaugaucauaaauguaucauuuauuuuuauauuuuuuguuuauuuuuauuuauuguucaucagaugaucuaaauggaguguacagauuaaaaagagauaacuugcuagcuccauguccuggcuuagaguagguucagaaguacccacuuuggcuuccuauaaaccuuuucuuuaaaauaaucaugucuugacuuguuuuaacuugggccuuuguccccacuuguucucagugacuucaugagugacugccuuucuagcuguaccuagcuagcauccugugucuuuagaccugacauaccugguguauuuucuuugugacgucuucucuauguuccuguuaaaaguugugcucuuuucaaaaacuuucccuaaagaaaaugcuuuaauuuuagucacuugggcuuugauauaugcuaguuacgaugccugccguauuucagucccuggaugcacacaggaaaucuguucucguuuacaaaacagaugcuccuaugcuuccugugaaucaguggucacagugccuuugggguuggggagaaggaagcaacugcuuuucuguuuuuuuagcuugaacagacugggauuucuaaagggcaagucaggaucgaucucucucucccuucccuuccccccuuucucucuucuauauuaaucuuaaguuucuuuccuacaaaauauuuaagaugugcauaauugcagggcaaaaugucaagcagucaguuuaauuugcugaugaauaugggaauuaauguuucgaaacaguugugggacuccacguuaugaauuagcagggggaggugauguuuuguugacauuuguucaaagucuugauugcuuguuuggcuuguacuuugccuuguagguggauuuugccuucaccguauggcagagcuucccagagaggauugugggauauccugcucgcagucauuucugggauaacucaaaggagcgguggggauauacauccaaguggacgaaugacuacuccaugguguugacaggagcugcuaucuaccacaagugaggagcugagauuucuuuuuuuuuuuuuuuuuuuuuuuuuuuuuauuuauuuauuauauguaaauacacuguagcugucuucagacacuccagaagagggagucagaucuuguuacagaugguugugagccaccacgugguugcugggauuugaacucuggaccuucggaagagcagucgggugcucuuacacacugagccaucucaccagcccggagcugagauuucuaacaacugcauuaauaggagcuuuaggccaaauccaguuuacaacaugaacgaaaauuagucaguauucccguuugauuuuuguugggguagcaaauaugagcuauaaaucuucuuggcuuauuguauuuuuagauauuaaggcaaaguaguguuuugaguuaagccaaaagauaccgauaacacucauaacuagguuggguagcugaauauuaagaggagauaccuaaauaucccagucacuguucuaggugguuuggguucaccuuugaguaaaacagaaaacaucucugacaaugcagggcucauaugcuagugaacagagacauauaaaugcuacagggaaaucagggacagcaagaagacacugacaaaagagucaaguagcgugagaugcagaaaugaggaagguuggagaguggucaggauggucuguuauacagaugggaagugagcagaaacuucaaagcaagagaaagguagccaaggauguuauagauagcauugggaauagcaagaagaaacacccagaguaaaacaauggacgaagauggaaaagaagauugggauuagugacuauggugcaguggaugagaagguccaagaggccugggagccucuaauggaugggucagugcauggccugaacagagcagacuucaggguuguguucccaguauccacucuggaugucgugaugagaacagucaaugagaaagaugacaaaggcaggaagaacuguuagaaaggagugagccaaauggagauggacauuagacuggggccagggagugaacgauggugugaguaguggccaccuugcagcaauacuuggaagcugauucagaauggugaccuaaucagaauuuaauggcuaccaaguuuucugacugacuugagguccagaaggauagagugcuaucaacagagggaauucuacaaaugaguaacuauuucuacaugcaaauuuugcccugggcauguuauggccccuaagaggcuuuucugagaaaaaucauagguagagauaugaaaugggcaaucuugaaaaacagcagacagagguaaaauuaucagauaaguaaauguagaguguucacauuuccacagucccacaagaucacuaaugaaaaucccuaguacuuuauccuaaugaagaaaauguaaccaaccuuaccuuagacuuuuaacauagagaaucgagagucucaucaucucaggacuaagucugaaagugcccaaauguaaacauuuggcugaggaaaucuuaaucucaaaacuuccccuccuccugcuuccuccacacaaaugaauuugauucauucaaauaauuugucuaauuuguaaguagauucucuugccauccguauuggucacauuucucauuacugugacaaaauaccagacaaaagcaacuuaacaaggaaguuugucuuggcucacagucugaagauacaguccaucaugguggggaaggcacagcagcaggaacaugagaggaagccgcucacagugcaucuuuaguuaggaagcagagcaagaugaaugcuggugcucaauccacuuuccucuuuguacucagucuugaccccagcccacagugcuguccacauucagggcaggucuuccuugcuguguucaaccuuucuggaaauauccucauagaaacacagucagcaguguguuuccauggugauucaaaauugcaucaucacaacaucuuaggguucaguuucucuuucuaacugaccagccugcuaccaaauugugaugggcaagcaauaucugcaucccugggaauuucugugccucacuugguucuuccucuguaaaauaaggauaauaauauaauaacaucugccucauagauuucuuagguggguuagaugaggcauuucuuguuaaagacuugagaauaugauuuggucuauagugaguacaauaaaaagcaauaguugucauuauuaaugcauuugguggcaugcucagggauccagagaaugccuguguuuaaagucuacuugucauuauguaauguugcccugcuaagagaauuuccuuugauauuuucagauauuaucacuaccuguauucccauuaccugccagccagccugaagaacaugguagaccaacuggccaacugugaggacauucucaugaauuuccuggugucugcugugacaaaauugccuccaaucaaagugacccagaagaaacaguauaaggagacaaugaugggacagguaagaauaaagaacuuucuucccaaggcuacacgaauacauuuuccucagcuuuaucuggcaguguuauagggagacagaaaaauaagccacaucugaaagcccugaaggaaggaaugauuggcacauggauaauuaagaauauaaagcuuuuagauaacccauaauaugacaugacagugacacauucuuagaguuucccuuauacccuuugggcuaguauaauagaacaacauagacuuagggcuuaaguuacaaacauuuauuucuccuacuucugaaaccuggggauucucaagucaaggugucagcaguuguaauacccaacgaggaaucacuucuuaacuuauguaauuugccauguggcuucaugaugcaaagcugucuggugcaccccauuccuaaggauucuaccuccaugggcuaaucauuuccagaugccccacuuacagaucagcaugucccagucagacaucaguauuuccagggaagguguaacuauucaguccacuacagaaugaaaguucuacagugaauuuaagucaguuuccuguagaugccuacaaguugcgaggaauccuuucuuaacagaguguucuugcucuuguuucucuuuugagaaaauagcauagugaaauacuagaggucauacuaucaauuuucaguucucgaaccagcauuuauaagcugugggcaggccagucaauuucugagauucucuuggcucauuuuuaaaaugaagugguaaaacuuuuuuucaugaaauugauauaauuauuaaaguaaagccaaauauccucuuggguuauaaauuuucaugauaaauauacugucauagaaauauccaacuuccuguguuuauaggcaggaaaacuggaucuagaaauguuaacuuacugcuacaaguaccccccguaaguuagaagcguaaggaaguugaguuuaauccccaacaguguauccuggauaagguaggacgugcuuagaauuccagcacuugggaguggggacaagaagcucagaagucauucuugacaaguacggggugugacgcuaaucugggccaccaaguaagaccuugccucaaaauaaacagacaaacaaacaaguaaauggaugaaugaaaggaggcagagaugcaguaaaaugacucagcagauauauauaauccuaccaaggcugaagaccugaguucugucucuagccauucaugauagaaggcgaaaagcaagucccacaagguaucuucugacuuccauaugcaugcuguggcaagcacaugcucucgugcuccauuccccauggcgugcaugcguguguguacacacgcacauacauacacacacacaaacacauacaaacacgaaugaaugaaugaauggauggaugaaugaaugaaugaaaauacaugaaaaagcuuaaauacaacuacuaguucucccuagguuaaaucauggagugccucgcaugauuaaaaucaacucuuagcauuaccguagcugggcauggugacuagguaacuacuccgaggcugagauagaugaucuaggccaugggggcucuaggccagccccagcuacagagcccaggguaguauaucuuugaaaaacaaaacaaacaguaccacuaacaaaaccuagagagaccaugguuguaucuguuuggguguucgaacuuugugcugagugcuagcuguaaaucuaaguuuuguaaagggaacuuuagcaagcucuuauagcaaccucguugacuggguuuuucuaauucaauaaauguagcacgagaaaaacaaugcuauaagagaauuaugagucaugugguauccuucacagccuacugagcccacacagguucagaguucugguuauggagaaagaacuguguacugggaaaguucugcccuccuuuaacuauugaaguaacaggcagaagcauucgcaggaauuuuccaaucauuaagaccaaacuacuucagaucuaagcaguguauauugccgacugugugcccauauguuuggucgagugcaagcucacagaaucacauucuguuacuaguguuugcuagggagagucuucagacgccccugaggaugcgcagucauccagggaggacugcuagugaccuuuucauauaugugccugcuucuacuacuaugugagcaucuccaguaauucacauacucuagagacaacucuaaacugaauguuagauuugucucccugugcccagguaguauaguguacuugaauccuucuuccuaucauacucaugauuucaguaaaucuuuguguccauagaaugaaugggauuauguuuaagcuuaugcuuuuauuagauugaaaaagaugguggugguauuuguugguuggguuggaaucaaucaagaaugagcugauagcuuuucuauuuccauacaugcacauuuuccugggcuugaguuuggcccuuuggagugagugggccaaugaaaaaaugccugucaaccacaaagcaguggcucuccaccuuccuaaggcuucaauccuuuaauacaguaccucauguugucgugaaccuaaaaauuauucuuguagccauuucauaacugacauuuugcuacuguuaugauauuuaugauaucauaaaucacagauauuuaucuaugcuugccaauguucuuaggugaccccugugaaaggcucguucaaccacagaggggucgccauccaccgccuucaaggcugucuucucugauaggaacucagccaguuauguuaagucuuugccuugcuguuacuugccaaggugcuuucucgcaguacagaugcuagagaacagagccuuccuucugccucuuucuggccuucagagaauccuguaacuuccuugacccugcugugacuugggagcuccuccaccuggcugcugccaggcuccagugugcuucaagaaaacacuucacaaguaguguuuuguuauucugcugcucagugcuaacuugacauuuguauuuaucacguuauuuucaagcguguugauacuugugacuuuaaagugacucugcgugagucucacucuaaaaugcacuuuucaugaaaguauguuucuagaccacacaaacacauacacauaguaaacagcugcuuauuuacccguguuuauaauccuugcauguugagugugagcaccccacacccugcacuugugaucucccuucccagcaaaccagcaacaagagaaacaaacaaacacaaguccaguuacugucaucuauauauccacucaaacucucaguggccugucccuuaaagaaaacuuaaguuuguuccuuccccaacccuaccuggaagucaucaagucaauuuccaucauuuauguugucuaaauaauauuugacagcuuuagaggcaauauaacuaaaaagaugguagccuuuuuuucuuuuuuaacuuugauaaccugagaccaucuauuacuuaaaacaacuguuggcauuuaguggcauugaaaagacaauuguuagguuaaugagcagaauuuuaauauuuacuguagaaucagucuuguagacauaggcacugugucacuggaucugagucacuuuugucucucagucaucucaguagaguagagaaagucuauaagggaguguggguuuaugugcucuguagcucuagccaugagugaaguguaaggguuucguuuguucuugcguuaugcaugcaucuuuuuaaacaagccauucggugggaacuugauaaagguggaaaguuagaugcuuaaaguccaaguccacagcccaugucuccacacaucaaccguguuaacaccugggauuuagaaggcuggagagaugucucagcaguuaagaaugcuugcuucucuggaagaggacuagaggucaggucccgguguacaugucagaugacuuagagcuuucugugauuccagcuccgaggcauuucaugccuucauguagccuccaaagacacccaugcacacauauacaacguguggagucucacacacauaauuaaaauuaaaucuaugcuuaaagaaauuucacauaaguauuuagaaaacuaccuuugaagcaaagacuucauugugagucauagcuuugauuucagauauaaaagagaauguucuguuuagugacuguaguaguugagagcccguugguagagggccgagggccguggcucgaucaucugagcuucagaaagcuucgaaagauuaggugcguuuggucauuggucaagaugccacaucucgacuucagccaaagguaagugggcaugccuaagccuugccuuccccagcuuuguagauggacaggcuuggcaacgaggccacacguucugccagguucugccgcuggucuuuagcagauccagcuacagugcuuccucccccugccuucucucucucacugucuuccuuauuugucuccuucuccccagacuucccgagcaucccgcugggccgacccugaccacuuugcccagcgacagagcugcaugaauacauuugccagcugguuuggcuacaugccgcugauccauucucagaugaggcuggacccgguccucuuuaaagaccaagucucaauucugaggaagaaauacagagacauugaacgacuuugaggaagcccaccgagugggggaggggaagcaagacgggcguccagcugcucucuccuccuucccaaugcagauccgcucacgcccagcaguggagccagacugugccaaguaucaaaaaaucaaaaaaaaucaaaaaacaaaaaaaacaaaaaagacaaaaaaagaaaaaggaaaaaauaaacagcuuagaugaacacagugacaaaacucggcuggaauccuggcuccuggggcugcgccagacugcuccauucaccucacuggcuucugugucccacaacuagguuguguacaguuuaauuauggaacauuaaauaauuauuuuugaaaugauugcuaugcagguuuaaacuuuuuuaaugaucaaaacuauuaaaaaccagaguucuuucuuuaaucaaaauuguguugguuguguauauuuccaagcugcugccccccucccuacagacaugauugccaugggucacccaggauuuccugcagugacagcaacagacaucacgggaaacacaaucaguuauuugacauagugucagcaaggaacuuggcacacacuaagacaauuucacauuccaguuuagauguucggauccccuuggucucuaaacuguugcugcaugaaaguguugacuccagauaagcagaucuaacucagaacuuuaauagaaauuugguaaucuuuuuacauggggauggguggggggaguuagaccaagcaaacacugguagauuuaagaaauguugagcagagaaccaaacaacucccagcauguuagugauggacgucccacaacugaaacccuauacuuccuagugguuggcccauagauucaaccacugacccauauauuuaauggggaaauccuauguguuagaggccaaaaggaaaaaaaaaaugaguccagauuauuuauaagacaagcgguuuaauguuugugaaagacucaaauggcaaaggcuucucuguuaagaaagaagcaguuauguguaaauccacaccauuuaaccaaagggugcuugugaaguaccuaacugagggcaugccuugccacagaacucauuccaauuuggguuaaacacuguuuuauacaagaaaaaaaaaagacaaucaaauuaaucagaaacaugugaagacuucuuucaguuuugaaauaaguagaaaaauuuaguucuauuucuuguuaaaaacaaugcuuccauccaugcaaauacugucuuaaguuuaugaugguuuugaaacauuaagaauuuacauauacaaguccaugaagcauaucucuaagcuccauuaugaaauauggaggcuucugauauuaaaugucugcuucuacuugaaggaaccacaaaaagggugaguuauagaaagauuauuauacugaguuauauacugaguuacagaaagauuauuagguacuauagaguaauuuacaaggacuuuaguuucuuuuucuuccaagaacucuugugcauuucauaugccuaucuauauagacaccggaagagaaaggaaugugccuaauguccuag

SEQ ID NO: 7752 - RNA, 1694 nt, Mus musculus
aaggggaagggagaagguuguuuuacaggauaccacaagggucauuuuuuucuuaagcugauuaccuggagaaaguccagcauuuaaauucuaacuccuggguccagaauccaugucuuaguccauccauuuuaccugcuuucagguauuuuuaaaucaaaauguguuuucuccuguuauuuccauaaacgucaaugaccuaaacacauauguuguagguuucaucacuaaagaggauucuuguaaacagugauuuuuuucuacuaaauuuauaauauuaucuuuucugauguauuugaauucaaagaagauauggugccuaguagaugaucugaguaaccgucgauucaguuuagaucuuaauaauaguauaaggcuuucugaacaauauauaaugggguguaggauaaaacugaagcuucauaacuaccauucuugugcauuugaugaaaguuugaugaaagugggcaugccaauaauacauucauccccaaauaugaauucugggggcaagcacauucugcuuauacuugagguaaggaaaugauuuuaaggagaacaaucuagaaaaggcaugugggaaaugauuuuauggaguccaggccuggugggcuuaggaagccucuguguaugggaagccacuuguaugggaagagugcaguaguuaggcucuugauuccagcauacaaucugcugacugauccaagagaccuucccauauguuccuuucugcugacugacucuuuuuaaaguuagaauggaggaguaaccccaagggcuaguaugcagcugucucuucucacuccuaccagcucccucugcucucugccugcuucuacccaacagugcacuaauaguguggaauugggccugcaagcuugcuauugcagaacuggccucuugggaagagucaacugucaaacaaggauucagccgugggucugguuguguuacguagaagauugcuucuuguccuucauugugacaccugaacuucagcucuuggagaggcaucagugggcuuaagauucccugaaaaagcaagaagagagaaaccaugucgaaauauaauucugccaacacauuugaaauucagguagcaucuuaacgccaugcuaggcuuauuuguucauagaugaguaaugaacagagaguuguauuagaaauugcaaagugaggggaauuuagugccuggauauacuuaaacaaagacagaccacugaauagucauggagaaaaaguaauaauguauuuaguuucauaagcacauuguauguuuaaaccgaaguaaaauuuguaugcauaguuuuuuuuaagucuaauuuaguaaauccuuguacaaagcagaauaguauuagaaaugcacgaauaauuuugaaaaaguaugcagcacagcaauauuacccuauuuuaaauuaacacuuuaaaacaauugucauugugggccuauuuuauaucuccuuuggaaagaaaaagggaaaaagaauuauccauggguuuaccuucaaaagacagccacuacgaggacuuggcauauuuuauucuaaccuuuucucugggugguuuuugguuuugcauagcagucguaagauauuuugauggcuuuuuuuuaguggaaaucuuucaucuuugguuggaguugacugugguuguauucugauaacgcaagucugugaugugugcuuuucuuguca

SEQ ID NO: 7753 - RNA, 11697 nt, Mus musculus
cagaaacgcaggcuuuauuucuuaacguaucuauuuguccauccauuuacucauuugguucuuugaucaccggguuaccuauuaaauaucuagacaaagaguuuacaaaguaacucaauacaaccccugcucucaagggcagacaauaagaggcuacacuaagacuccagaaaaggagcuccgcucuaaaaagcacgcccugguuuuuaaaccuaaccuaagccaaugcaagaggguaggggaagcuggguuugaagcguccagaccuggaugcguaaguuaccaugaugaaaagagggaagaaguuccagcagaaggaagcaagucaggaggucucaagggagacaggacuucugugaugcuaacauggcggguuucugaugcugacuuuaagacgagccagggauaucauuagcuauaaaguucagcaagagggaauaaaugcucauuuuggguggcucuagcacucacagggucuuaaacaaaaaagugcaugguuuccggagcuucugcuugggcccuggcagagcugauccgccaucagcucuugucugugugcagccaucuugagcaggucacugcuaaucucuucugagaaacugaggccuugucuucaggacaaugagaaauccugcagggcaggaagcaguaaauuagguggaggaucaggauucuagggagaucuuucugaccccuggaagaaagggaggguugucauaggcucacacuagauuugaggagagcgauuaggagacauggucaaugguucacaugagagaggagaguaaggccaagaaaacguggugagggacauuuaucagaguuaguaacacaauggaugauuaagggaaaguauuagcagcuuuuaaggagcaaaggaagaguuacagucuagcugaaagccugcuuuccuaaaggcugcccaaagcaacaauguguucaguggguugugauuuuggcucagugaggaaauagcugcuuucuauuccuaacaguuucacugagguaggaccaucacacagagcuccacauucuuacugugcaguuuguugucuuuggagauacacaaacaccugugacacuaucaccacagugaagaugccaaacgccugcaucaccucaggaagggaaaccagacuuuuaagaaccuaaguuucacaaaggacacaaagaaacauuggggcaugucuguacugcaccugguagaggugaguguccccugcuucauuuucuugugcaagccucaccugagcccgaugaggacauucauguuugugacagcuuguuccacucuuccucccacuggggacaucuucaugaggugauagaagaaucucauucauuagccugagcagcaauucaaacuuucaacguugugcaacccuauugaguuaaacuuuuacaaguccuuugucagcccagcgugggcgagacaugaaccagccgggcuggggugagagaggugcggagggugagacguguggugcuagucacuuugcaaauguggauggcugugaacgucuucgaccgcuaacuugugggugcuuuaugguuguuguuaaaaaucuguaaucauuuagauucucucuggcuuuauagucaaguuuaaauuauuguggauggcuuuuauuugguagguuuuguuuguuuuugagacagggucucacuguuguagaccaggcuacagagaucacagaacucacagagaucucccuaccagucucggcuucucuaugguugggaauaaaggaguguaccaccacauccagcuaaacccaggguauuuuuaacagaaagaaggauccuugacauaguggaacaagaucugucaccaggguguuccuuacccaggcacuggaacucucugugugauguuucuuuccccacgucucuuuucauucucucaaaauuccuuucagaguuuaauccuccauuucugugaaauguuuguauuuaacaggguuggcacacacacuagcaucucaauaaauaucugucaaacagacuaaugagcauuuugagccugacuccaggguaagaagauaaauguggcaggcuuaucuucuguagcugcuugugauguagcaucagugacagggagcugcugacuaaagcccaugcuuagggcuccuaccuggagcugcugaggagacagcgcaagaaguggggcuggggaagagcugaaucugagcaguguccaauacucaggaaagacaaugcagaggaagcuggaaggggacccauaguuucauguccccuucuauaggcuggcauguaagaggccagcuacccucugacuccaacuuucuggauaauuggcugauuugcuggugacaacaucaaccuaagucuuuggccacucacaguugugugugaugcagagagaugguuuuauccuaauguugccuuugucuguccggagagugauaaucacacaaagauugauuuuugacauauuuuuagcagauauucuggggaaggcuaagcagauggugucauacacgggucugguuccuagggaugguaacaggagagcaagggcacuauacaagaggacugugggggaacagguaugaugcaaaguccaguaagccauuuuacucuuucugcuucggggacugaggaauauggagaaacucugcuccuuccaucacauuuaaacucuggacauggagcuaaaacauuuugacuuuccauuaaguuugcuugcuuauuuuguuuuguuuuguuuuugagacaaggucucaccauauagcccuggcucguguagaacuggucucaaaugcauagagaucugucugugucuuuccccugaguguuggaauuaaagauaugcaucaccucacccaguuaguaaguuauuuuuagguuucagaugaaucagcucaagauuuauaaugucuauuaaaauacagcgugaaaauuucacagugauaauaguugauaacguucauaacugcgucacuguccccuuuccacguugcaucaugcauaggacaauauguaaagagcuguggccaaucaacaagaagcaaaagcacguaccaaguauuuacaauguuccaagucuguacuacgcaccucacacagccucuuacuucacuguaaugacuuuucaguucucugaugagguggccagagggcaggaauuauuuuuauaaucuuuguguagauggagaagugacacaugaagaucagcaacugcugucugguuaaguuagaguuugaccgaggaacuuugauuuagagugcguccugguggccuaagagauccugcacaaguagccgugcugaaacagggcuggugagugagguaguuucccucaauuggauuccauuucuuucuucuguucugaggugauagauacagcuaacccucuuagcugcuucauccucacugucauccuagggcucaggaauuuggacaauuucccaggcugcaguggauucugucuaagaaguacugccuucauuuaccuuccaauaucucuacaaggguccaaauucuuucacauaccucccacauaaaauggaaguuuaaagacaaaugcauguucaaaggugucagcagaugccgaucacagacaacgagucauugggugguucuagucauaggauauggcuagaucauacaaaccugcagacacagaacagucucuaccugugguugcccagaaccaggagucugggugacaugaagaaugacagauaaggaauaugguauuuguuuuuggugugaugaaauguucuguaaucaauccugauguggguugugcaccuauuuaaacauucccaagucauugacaugcacaguuuaaaucagugaauugcauaucaagaguacaccccaauaaaguuuuaaaaaucaaauaaaaacuaaaaacuaaagcagaccaucucucuaaaaagaucauuuagaacauugcuuuauuaauuuauuaauucaauuuucuggcugggcggucaguuggccaugagauacaauggaggaauugcucagucaggaaccaucaggacucaggaggagaaaaaagccagugggguaugcugugugcaagcagagaaugggcugggccccagccuagcagaggaggcuguuuugagcccaaacucaugggaguugaguggggaaaggcccuagaccagugauucucaacuugugggucccaaaucccaaagaccauuggaaaacacagauauuuauauuuggauucauagcaguaaauuagaguuaugaaguagcaaaauggagauagguuuauggaugagggucacuacaauauggggagcuguauuaaaugguugcagcauuggggagauugggaaccauccaugagguaguugagccagauaugaguguuggggauggggauaagagccggugaaaacuuagagaaaugagaaaacaggucuucaucugcaugcugggaagguccaucauguguggcaggaccaagaagaaaacgauugagaauuaaguagacacuggggauauuacuuauuucucuuuggggcugagcucugugucaugaagagaugaggugaaucauuuucaagcauagcuuuuagaaccacccggaauuuaacccauagauaacuguccuugguguuuuugguaucaggauuuguuuauuuggguuuuuuuuuccauuuuuagaauaaccaaugccuaugguuauuuuagaaacugaucuaucuauuuagcaagcauuuuccucccacucaggcaucacaguaucuucuuaggugcugucauuugguauaugcuuagcugccugcuuagccuuuuuugacucauuggcagccauguaagcuuggucucacgguacuuuucuaauguacaauuuuugauuccuuuuggcuguacucucagccagagaugcuucaguggagagaugcuucagugguccauugaaauuuaaacauguuggguucuuuucuuuuggauuucuuccaucuguccuguguguguguguguguguguguguguguguguguguguguguguguguguguuuucucuucucuagagaugaguccaggaaucuguugaagauuccucuuggaaaggaagauagacuuacauuuuccauuaagaaacaaauuuuaaagagcaaaaaugguucucaacuuuaaggguauauaaucaacaaugcuuucuaaacuugcauggcaccacacaccuguaaucccagcagccaggagguagagguaggagaacaagaaguucaagaacauccuuggcaacauuuuuaguuugaggucagcccgggccacaagugacucugacucuaaaaaccuacaaggaaaaucaugggaacugaggauaugauauaguacugaacaggacaagggucucagauuccauuagguucagauuagaggaaacaacagaaagugagcaaggcccaagaacagagagacucucaucauggcaugggaacaggugaucugaaaacaacaauaaaggugaaccaauauccagucacaaagcucccuagaugggcuguguaggcaaagucucuuugaggaggugacaacaagcucugaagccugaggaagaacuggccuuggaauucucuucguguguguguguguguguguguguguguguguguguguguguguuguguguuuguggaccccuuucuuccugugugugugagagaggugugugcauguuccuagcagcauguguucacacucauacaugcaugcauuguuguuguuucaaggacgagauagugggaacaauagaagauaaguaagaagcuccucaaugacaugggguucaaguggaaguuucaggagaugucaugugaugcagacucaccugguguuuugcugaggcaagccugaugggaggacacgugauguuuggagagaguauauggauacucaauggauagugauggggcgcuugcauaucuagccuugcaacacuuuguuggucuugagucuuugaugaucuucacuuccuugagacaggcaaguugagagaccuuuuccugguguccugguuguucccaccgaauuguggcgacucagcagaggccuggugguuucugcuggaucgugccaccgauacugauucauguuugcuauccugacacuacugaaguggacuacuggugucuugacaaacggagauuggaaucacuccaaagaauaacuucuaaacagaucugcuucucccuguccuguuuaucauccuuucuccccuaccuuuggauggugggcuauaagaggggguugaagcauugaaaacccuuguuaaaacuacgguuuuaaaaagucuagggcuggacagauggcuuagcgguuaagggcauugacugcucuuccagagguccugaguucaauucccagcaaccacauucuggcucacaaucaucuguaaugugaucugaugccuucuucuggugugucugaagagagcaaugguguacucauauacaauaaauaaauaaauaaauaagucuuuuuuaaaaaauuggacauaguacuaccugaggacacagcuaugccacuccugggcauauacccaaaagacguuccaacugguaauaagaacacaugauccacuauguucauagcagccuuauuuauaauagccagaagcuggaaagaacccagauguuccucaccagaagaauggauacagaaaaugugguacauuuacacaauggaguacuauucagcuauuaaaaacaaugaauugggcccgguagugguggugcaugccuuuaaucccagcacuugggaggcagaggcagguggauuucugaguuugaggccagccugaucuacagagugaguuccaggacagccagggcuacagagagaaacccagucucaaaaaacucaaaaaacaaaacaaacaaaacaacaacaacaacaacaaaaacacacaaaaaacccaacaacacaaaacccaaaaaaacaaaacaaaccaaaaaaacaaaccaaaaaccaaaagccaaaaaaaaaaaaaaaacaaaugaauuuaugaaauucucagacaaauggauggaucuagaggauaucauccuaagugagguaacccaaucacaaaagaacucacaugauauguacucacugauaagugaguauuugcccagaaacuuagaauacccaagauagaauuugcaaaacucaugaaacucaagaagaaggaagaccaaaguguggauacuucaauccuucuuagaaaggggaacaaaauacccauggaaggauuuagagaggcaagguuugaaggugagaccgaaggaaggaccauccagagacugccccccccccacccccggaauccaucccauaaacaaccaccaaacccagacauuauugcauguaucaacaagauuuugcugacaggacccugauauagcugucuucugugaggcuaugccagugccuggcaaauacagagguggaugcucacagucaucuauuggauggaacacaggguccccaaugaaggagcuagagaaaguacccaaggagcugaaggggucugcagcccuguaggaggaacaacaauaugaacuaaccaauacccccagagcucgugucacuagcugcauauguagcggaagauggccuaguuggucaucaaugggaggagagucccuugguuuugcgaagauucuaugccccaguauaggggaaugucagggccaggaagugggaguggguggguuggggagcagguggaggggggaggguauaggggacuucuagagaggaaacuaggaaaggggauagcauuugaaauguaaaugaagaaaacaucuaauaaaaacaauuaauuaaaaaaauuggacauaguacuaccugaggacccagcuauaccacuucuggguauauaauccagaagauguuucaacauguauaagaacacaugcucuacuauguucacuuauuuauaauagccagaagcuggaaaggacccagaugucccucaacagaggaauggauacagaaaaugugguacauuuacacaauggaauacuacucagcuauuaaaaacaaugacuucaugaaauucguuagcaaauggauggaacuugaaaauaucauccugagagagguaacucagucacaaaagaacacucaugguaugcauucauugauaaguggauauuagcccaaaaguucagaauacccaagauacaauucacagaccauaugaagcccaagaagaagaaagaccaaaguguagaugcuucagugcuucuuagaaggggaacaaaauacucacaggaggaaauauggaggcaaaauguguagcagagacugacagaaaggccauccagagacugccccaccugggaauccaucccauauacaguugccaagccugaaugcuauguggaugcugggaagugcuugcugauggaagccugucuccugagaggcucugccagagccugacaaauacagagguggaugcucgaagccaccauuggacugagcccgaaguccccgaggaggaguuggagaaggcacugaagggucuuugcagccccaugcagggagcaacagugucaacaggcuaggccuucuggaacuccuggggacuggaccaccaaccaaagaguacauggagggacccauggcucuggccacauauguggcagaggauggccuuguuggacaucagugggagaaguggcccuugagccugaggguuuuugaugccccaguauagcggaaugccagggcaggaagacaggaguagguggcuaggggagcacgagauagggaguuucugaagaagagcccuggaaaggggaaaacauuugaaauguaaauaaagaaaauauccaauuuuuuuggaaaagaaaacaaacaaaagacaaaaaaauucugaagaugaacugucagguuuagaaacacauaucuaauuuuauaauaagacuauauuaaugaaaucugacuugaaaauaaaaaaagugacaacaaaaaauauauugacuuguuugcucaauauuauagaaaaacucgagucagaauuccuacaccuacgucacugagaaagacacuuuauuuaguagaguaugugauuugucugugugcuuucugucugcagugagcauagguugaguaaguauuugguuucaauuaguuuuccccacuuuuuucuacucaaugucuuuacauuauuuauuauauugcuagauucaaauuuuuacuuuguauuauauuuagauuuuuauuucauuacaacauagucaauuuaauuuuauuuauaacuuugcauauaaaauacuaguauguuucuuucuuuuuaaaaauaauccaggccuacauggggcaaaugauaugaaaaggacaacaaauuaugaaaaaagaguccaguacauguacagugcuugaaugugcuucuuucuguggagugauaguguauugauuccuguauguucagcaucaagaauacugaguugcauuuaauggucguguuaucaauguaaucaauagaggagaaauugaaagggagggguugccgaauguuucugagaaaaugagcaaugaguucacaaauacaagagaggcaccucugagccacagagaaggugagaacagagcagguacaagaagaacaucuccuucaaauagcucuggacuuugcuggagaaguggaggcuuuuucacgaaagauggcuagaugcaaauggcuccaacuugcaaggccugcaguagguuugcacacccagacaagguuggauaccauguaaccauggcaguggcaacagcccuggcugugggauaguauagaugucuagcaguuagcaucccagguggguggcucacaggggccugggguggguggguagcuugaggaaagggacaaacugacaaggaagucaagagggggcucaaugauaaggagagaagggagagaggccacaaauauccaaugagcccagagcuagaagacgggggagaaaggguggggagauuuccuaguuccucuguagucaugcacuaugcaaaccagaaagcuuuacaaugcaacaguagccacuugccauuuuguagacucucccugaagaaaggcuaaggguuuuacuuacaccauuucauuuuacccucauggcauacuccaugaucccuucuuauuggugggggggggggggggggcgggggacacacuugaggcuugcugaaguuaaacacauugcuuacauuuuucugacuagaaaaaaaaagaggaagaagaagaagaagaagaagaagaagaagaagaagaagaagaagaagaagaagaagaagaagaagaagaagaagaaagcaacugcauguagccagucaagcuuaagccucacacugauauaaauauuauucugguuguauaacaacauuugacuccugcauccuuuucuugugggcugauaacccggggcuaguucugucaacucauuggccuugcgggaugaaguccaaguuuccuaccgugacucacgaggcgggucagaguccaaacccacacucucuucuguggacacaggcucccacaccaagcgcuccugcuggguucaacuguuuucaguucucugagugcagcagggcagcuuuuguguucagggcugucugggggguggggguggcaugucuuuccuccuuuucucuuccugccuaacuccuucaaguccuucaaagcugagggucacuaucacuugaguccuucuccaagccgaugaaaacgagaacaugggggcaucucgucuuugcagaucuuuauggcacuucugauggcacugaaccguguggagcugcugaaugcuugaccagggcuccuuccacaaguccauaguuccugcccgucuggguucauguuucuuguuuguuuuugagacaaggucucacucuguaacccagacuggccucaaacuaguggcaaucuuccaugccuggcuaaaugaggaauuggaccuuuuauuucuuccguuacuuggaacuacuugcaauugagccuucccauguucccaugugugaugcaagcccucugucgucgaucucucucuccggaccuuaucaucuugaaggaccuagggaaaaaaagaaagacaaugguucugauaguguuggugauagcuagaccuugguuucacccuuauaccucugaagccagaucuuauucuuagagcauguuuucagucucugguaaagagcaacacacacacacgaaguucuaaauguaguccauaaauucaagauauuuguggcuaucaaugacccauuugccuaucuauuaaaaaaaguucuaauauuuuuauaacuaccaaauugaagcaauuacacaguugcuuuauauuaguuguaauaucauucaguuuagacuaguuauucagagcagagaccaagauuuugcccucugguuagaagauugaacacaugucucuugcuucuauuucuuaguagguaaaauagcagcaagaagcagagacccauacgucccgggggggcugggggugggguaugauugucaaaaucccuuuaaacauugugacauauucaagggguggaaauaugguggucauaucccccagggugcugcagaaacuuucuagaaugcacaccgugcuagguucaccugcaaaugcuagucuagagaucccccgacaucacaacaggaaaguccugccgcaggcucuucaggaaacaggaacgaauccuagagaaagaagggga

SEQ ID NO: 7754 - RNA, 57034 nt, Mus musculus
caccggucagaggugaccggcaagauguccgcaggcggcggcggccgcuuagagcuccuguagcgcggcucaucugugugacaggggccgggcggaggcggcugagaguggucggggaggggacaggaggcggaggacggguggcuaggcgcuccgggugcacgggccgcuaccgggaaugcgcugcagcgccccgugcagccugaaaggcgagccccgcaggagcucuucaugccgcccaccggcuuagaguccuccaggaugaacaggaagaaaggagacaagggcuucgaaagcccacggccguacaaauuauaaguaccuuuccccuacuccguuucucgcccugcucugauuuuguuuucauugauucugugagugacuugaugaguccgggaaacuagugggaaauuagagcccacuccaggggacaugauguuuguagggugaaacgguuuugaauaauuguucagcauacuccuuccccgcccacgggcucauaaaccuuucuuaaaguaccgcuauauuuuuuugucaagacaaaccuuuucauggcuguugcucgauuuaaaauaagcagguuacucauuuuguagaauucgaagacaaacuacugugugguuuuugagcggcucaguauauagucccuauucguacuuagauuuaugcuuucauauaauaauagucguuucuuucuuuuuuuuuauauauacaacccaucaggucgucuguaucaacaacauaaacuuccagcgaaaaucaguugugguaagaucacucccggucaucauaagucagccuuucacaguucuugggggggauucuauagucuuccagauuauauggugccccagaauaagacauaagaauucaagucuaguuugcuauacaugcuguucucuguucuccccaccuuuucccauuuccugauuaaaauguucaaauaugcuaaguauauugugcaauaggaagucuuuauagucaaacaccuucacauugugcauuagacaggacagccuguagucauagcagucuuagauucagcuguucauuuauggagugucauuuggaauauuugucacacauugcuauuuggggauagaacgugaaaacauuagggaguauuuguaauuuaaguuuuuacuucagcaguauaggaaacucaugauaccucucagugaagcuuagcauuauuagagucaacgugauugauagaauuauacuguguuaguugaauugcucuugucuauaagacauuccuuuuuuguuguuguuguuguuuuguuuuuuguuuuucaagacaggguuucucuguauagcccuggcuguccuagaacucacucuguagaccaggcuggccuugaacucagaaauccgccugucucugccucccaagugcugggauuaaagcaugcacuaccacugcccggcuauaagacauuccuuaagggauauguauauuaacccauugauucuucacuguaaucucuugacacagauaagauuuaagucccagcucuucccccccccccauccugcuugcucuggccauauuuauuucauauauguggguacacugucacugucuucagacacagcagaagacagcaucggaugcccauugcagaugguugugagcuaccaugugaauugaacucuggaccucuggaagagcagugggugcucuuaacuguugagccaucucuccagcccccucaguccaaauuuuaugaaugagggagcugaguguauacagguaaagggaaaauggguaaauaacguauugguagaagaacaaagcuacugccuacauguagcccagcaaaagagccucugguggacauuguucacauguuugugcuguuacuuucuguaauccacaagagaauaugcuugcuugcauuuaguauccuggaauagagaaaugaacaguccaccuuuuccaccauaauagcccuuacuucacuggguagggacccauuauuauaacuuauagggcuaaacaaguaagcauuaguccuauucuaauagacuugaucuauaauaucauuuaguuacgugaccucuaaauacuuccugcuugacuacuggacuguagggauguuugagaguucagauguucaauucagaagaaccaagauuugauaauaucagcaagguuuggugaggcuuuuuguuuuguuuuuguucucagaacagauaguguccuggcauacuguugcagauccuucuggcuauucugagaaaauagauucaggaggccgugugguagagagugguuuuccacuuaacacagaagccucuauucuagggcugugaacuggcuuaggacuagaaauuauaaaucaucucuacugcuguagcacugugaggcauuuuuccccccccagaagaccuagaauuuuuucuguuuacugggcaaccccaucaaaaacuaucuguuuauaucuuucuucagcaccugauaaugagugaacuaugaaguuaguucugugggucagaauacuauguuuaagaugguacagugguacaaucccaguuaggagguugaggugggaagauuaauugagccuaggaaauguagaccagccugggcaaagaggagaaaucaccucuuuauaaaccaacugaacauggugguacacaccuguaacccccauucuggagguugaggcaggaagauuggagguuugauaugauccuggacugcauagggugaucuguuucaaaaacaaucaugcagucucccucuguggcuuauuuugaugacuaugcccauucaugaguaaauuuuaaacauauuuuuaaguaaauuuugaacauccuucugggcgcagagcggaauguuauaaucagagaagaggguaaugggcagaggaggauuucuuagcugguguagcucugcccugcagaggauccucugaaggaucauuuauaggagggagagaaagacggaaauguagcugugagacaagagaguuugguggcuguuaagagagugaguuagggucagguuuugggaugagcagagaagagagucccagaaauugcaggagcaaaggaagagcccaguuucugauugaaggaaagggccaugaaaggagaagcacuggacauucagacucagcggugucagcaguguggcggugucucagauggugacuuugaucgccaugcuggaauggaggaacucuagugacuugggggguaaaggaaguugaagucauuguuaucagaagggucucuggccucugcugccugacugcagggauuauaggcaugcaugcguuccaugcccaccaggaucguauaguuucuaagugaugaauccgggauucagguauuuacaaggguccuuuuccauauuaucaggagauacacauuuaauuacaaaugacugcuggccuggcuuuuguaguguuuacugcauucaauaugcuaaauggccaagaaauagcagcgagacugccuaguucccuuuaaguuaucauaaauaagagaguagguagccucccucagacacugaggagcuguuucaucuaaguguaguuaauaguuuucaaaaagauuagaacacaugggacagcuagcugugacaugguggagaaaguccuagaacggaaggauaaugcugagguguuugauaguuugaggauuugaauuacgucaguggggaagaaugcuugagcggaagcuugugacaauuaauagaucugauuguggcauguagguuagggcccugugacaucagggaacuguuuucuugacauauauucccuucacuuuguauuaucaguguuaguuuagaaaaccaaaugcuguucuuauauucuuaacagguaacuaugguuuaauagcuuuccauaacuuuuuguuuguuuguuuguuuguuuuuugagacaggguuucucuguguggcccuggcuguccugaaacucacuguguagaccagguuggccucggaacucagaaauccaccugccucugccucccaagugcugggauuaaaggcgugcaccaccaugccucgcuuuuccauaacuuucuaauucacuuuucuuuuuaaauucuuuuuuuuaaagauuuauuuacuuauaauauguaaguacacuguagcuaucuucagacacaucagaagggggcaucagaucucauuacagauuguuaugagccaucaugugguugcuggaacuugaacucaggaccuccggaagagcagucggugcucuuaaccgcugagccaucucuccagcccuucuuuuuagauucuugauacaggagcucacuauauaauucaugcugacaucaaacuggcuauccuuuugccuuagccuucuaaguguugaaguuauaaauauaucagaauuccguuuuucuucuccuuccacagccccccucuucucgcccccagacaucuucacugugcagcucuugcugucucagaacuuacuauguagaucaggcuggccuugaacucacacccagcaccaaguucauuugguuuuauuugcugcuuuucuacuuacucugagcucuuucuguaggguggucauugggugauugacagaguagucuuugagacaaguuggggcuuggcauggugucacucaccuuuaaucccagcucagagacagaggcagaccuuugaguucgaggccaacuggaucuccauggagacuucuagccuagcuaagacucuagagggagggagggaucuauguauggacuuucugcuacacugguuugcaguuugcaacuuuucucuguccagcagaggauuuugcuguguaggcaaggcuagcuucaaauuuguggccaucuccugccuucacuucugaaguccuagugguacaagcaugugucaccaccaguuuaauuugcacaauuucuaaauacaaagcuuuucuggccuucgcucuuucugauguaauaagcuguugauccaugcuaacaguuugauuuaagacucugugucucuuauuuuagaacugggagcauaguggcuguagaauugcauguguuuugauggguugguauaaagauuauacagaaaauauucaugaacuuuauauaaagcccuuaugcccagaggauuauaagcuaguagaaacagauagggcuaucuaacuagcauuuuguuaacuuuauuaauuuauguauaaaagcuaaucuugaaauacuuuucaacaguacuuauaucuucuagggcauuuggguaaaauguuucaaguagcacucuucuccucagauuugguaucgggauuagagagugccuaagaagguagaaugguaccugacaagugacaggagcaucucugucuagcccucucugcugacugcgugccuccuguggggcucugagacccucauacucaccacauagcaucugcagcauuugaugccuucccaggguucaggugucaguguacuaguuuucagucaagcuuauguaaaucacugggccuacgucccauaguucaccugucuuucccauucgaguuaacgcagcaggguggugguaagaguauuuagcgucaguuguaguggauaguuucuuucaauggacggauggcacagcccucagguaacaugggagaguguguaugacaugggacugccugguaggcagucacucaguacuugcaagugcugcugcucccaccugcuuuguucucucggcagcacuugcugcucuguucccucauuuaacuccugugagaagaucauacuuguuagcuucaguauuguaguuuuuaaagcccaaguucuucguaccaucagauucuuggacuucaaccuccugaucgugacuuucuucucuaccacuuucugguccuguagccuaguuagguugcagucuaccuagaaauucuugucuuugagacuaguaaauguuuucacuuuuccagucaacaguggcuuacuuaccacaaauugcacagauaaaggaaggcucguaaagacuagauaaauguacucagccagucacugguacaguuaacguuuagaauuaagauucucggggaacacucacguguacauugggacuuuccuuucagagguagcauauauaaguaguaauuaaggaaacaugcucaauaacauucuggcauuugcaauguuguucuugguuuuuacagggauuuguggagcugacuauauuucccacaguugccaacuugaauagaauuaaguugaacaguaaacaguguagaauauaccgaguccggaucaaugacuuggaggccgcuuuuauuuauaaugauccaaccuuagaaguuugucacagugaaucgaaacaguaaguugggcacguuaagaagcugcuguuuguacgucauccugucacuguuuucagagauuguuuuucaacaaacuuucccauucuuauuguaauaaagcuauguguuguauaauuucuguugcuuuuacugcccugcaaauuucgcucaaggguuuccucaccuuuguccuacauaguaaguuacuaaauuucccuucuuacagcuuuaaagaaguauuaucuggggauuuucaguacacuuauuuuuguuaaauuaucuuaaucauguuucuguuuuaaucuuauccauguuuacuugauaaauaccaagaaauuauuucagugaguuggauggucaccaucaucuucagaacagggacacuguaaaauacucuacuaaaugguuucacuauuuuaagguaucuuaugaaauacaauauccacugucaacuauauuggagggcauuuuuuaaaagccuugauagcucuagaucauauuguuucugagauucucaguguuuuguagugggaugccaggugcagauauaaacucuucaaugaggauaguauuucacuagccuaggacguaucauugcuuuaaagaguuaucccagucaagcaauaucaguauuaccuaggaacuauuuaguucugcacaucucaaguauuagcccaaauguacuaaaucagacaggauagggucuacaggauagcaagccuucuagaggauucucauagggccugaagcuaauuuacacugauacuagacaaguagugaucuuggcauuucagagcuaaugaaggacgugaacuuaauuaucaguuuaacaguucuuuugagcuauuggcucccucccucccucccucgcucccucccuuccucccuucccucccuuccuguuuugagcccaggcuguccuugaacucagagagauccuccugcuucugccucuagaguacugggauuaaaggcaugcaccaccauguccgucacauaauacuucuuaacauggugaauaguaucaggauuggauaacuuggcuaaaaaaguauucuuaugaauuguguaagaagacauaauacuuagaaauaauugaugccguugauauuuagggagaucugguaaaauguguggcuugcuguuauuacaaguuggcuuuuaucuccccaggagaaaccucaauuauuuuuccaaugcguaugcagcugcagucagugcuguggacccugaugcggggaauggagaacucugcauuaagguucccucagagcucuggaaacaugucgaugguaaagcaccaggaauguauuacuaccgugaaauaagccuugcuaaauggguccuggauuaauaugaauauguuagccaugggcuguuacaaauugccugguuucagugcaagaaaaccacuuuguaaggaauguucucuaucaaaggagcuaugccaccagcucccccccccuuuuuuuuuauuuuuauuuuuuugcuuuuuuuucuggcuguccuagaccacucucuguggaccaggcuggccucgaacugagagacccaucugccucagucuccuauguccuuggccugugcuaccacacccagcuguuuugcuucccccuccccccccccccagacaggguuucucuguauagcccugacuguccuggaacucacuuuguagaccaggcuggccuugaacucagaaauccgccugccucugccucccgagugcugggauuaaaggcgugcgccaccacgcccggcuuguuuugccuuuuuaaugaaagguacuuuucaggugacuagauccauuugguauaguagcaauaucgccacauuaacaguccuguuuuuccagaauagcuucucaaguugcaccauaagcucacugagcugccuuguggucagggugaugcuagaacaugggcuuaugccacuuuauccuuucuaaaucuucaugauccguucuuuaaagauuuaaccaguacaguuauuguuugaaaacuucuuucugccuuuauuuagucuuauaaaagucaaagaagagagaaagcuguuuucaguguguuugggagcagaugagaaauggugguguuacgcaguguagggcacagguagaagcuuaucguggggcaugcacuugcaauaucugggggaaaugaaaauagcuccuuucauaacacaagguggguuuuauauacagaccuagaauauaauugaagaacauaauagacggugcaguuuuuuuaauaacccuccccacucuacuucccuucuuuuacuugccaaagucaaguagaacugacaguugggagaaaaugcaaaaggagaaagaacucaaaauguagaauugcaauuggauuugacagaccuuaaagcauccguauuaggggguuugaaauuuuucugaaaacauugcauguugucagaaauguugagaauaugcucugguuagugguguguuuugugagagauuacaagcagcagcuagagagacuggggaaagcuaucaacuagaguaggugagcacuguaagugccugugcgguggcaagugagcgugugguggcuuuguuuuaugaacugccuuagauuccaggccucuagcaucuagaacuccaucccaggcagcucugggguuucucaauauauaugaugcuccggcugugggucucaugugcuauauucauuauauagguuacuguugcuuauuuacgugucagugaauguauauauuuauuuauuacagaguugaagguccugaagauacauauuaauuuuucuuuggaucaaccaaaaggaggucuucauuuugugguacccaguguagaggggaguauggcagagagaggugcucaugucuucucuugcggguaucaaaauucuacaagguagauuauaaauucauaucuuucaauuaauguaauuucucuaguugcauuuuuaaguauugacugugcaguguauuuucuggaauggccaguguaagcuuggucccuccaacccuaagcugcuucugagucgugucuguugaguguuccuucucacagggaaguguuuggaaaugaccuaucagcuccagucuuuaacuuuauagugagcuuuagcacgcaugcagaaaacugcagcauuuaaauguaaagagauaguaacgguucacaggugaacaaccuguggcgcucccagucagaccagcacaguuagcaccaucacugggcagagucuccucugcuuccagucagcauuguggccuggccuucugucugcucugcuccugaaacaccauugacugggcuugguucuggacuucagguaaaugggcucauucacgcuugugcucuuucuagccagcuuuuugcugcugcuugacaucaguggguuuauguaagggcccaccucuuuauucucacgcucgguaguucacuacguguuccugaaguuguuccuaaugcgaguguucccucacauuauuaauccuccuaaggcugcgcuuuaggguuguugauauguuggugcuauguacugauucuguuauacagggagacuugaccugagauuugaagucugaagcauacuuuguacugugaaucugcuuguagauuuugguucccgugugucgauucauacucugagcuguguaccuggaaguuagaauuuacaguagaugcugcaaugguagccguguccaauggagauuugguggagaccguguauacccaugacaugaggaagaagaccuuccauuauaugcuuacuauuccuacugcagcauccaauaucuccuuggccauuggaccauuugaaauacucguggauccauacaugcaugagguacgugugugcgcacuucacgcgucuuucucuucucuguacuuuuacuccuuaggaaagaaaggcacaagugaauaaacaagauuuuucaguguuuaacugcuuuaaacacuugaacacaaucacuaaaaagaaaacauuucccaucacauuuauuuggaaugagaaucacuuugaugaguuuguugccaggguucuucaucagucccucgguagcugaagcgagagcacaucuuguuauuuacuuuuccuuuaaaacugcggucucucugucagcccuugaagucaggugucccauggugucccaugcgcuugugcuuugauuccaacuuguaguuucccaaacuaguaguaacgguugguuuuagaaaccaacuuacacucuagccaaggcguccuuucuuaaugcuaagcauguauuagaaaaaaaaucacaaaguuuuaaaauaguuuacuuauauacauuucucuaaucauaacauauauccuuuuagccuugaccccaugugugguguccacuuuuuuuaauccugaccuuuuaaacuguuuuagguuuauuuuccuucgucuuguuuuuguuuuucuucagcaggcuugcuguguggcccaggcuuuccucaaacucauguaaagcguccugccucagcuuccuggccccugaggcaugcacuacuguaucuggcuuuuauuuaaacuuuugucuaacaugaagugauugcucacaaugucaucuucuggaugacacguaacugcauuauuguuugucuuaaggcagucucacuauggagcucugucuggguuugaacuggugacccucugcucgauguccuagaggcaguggggacugggagaauggagcugcugaaggggaacuuuauucagagcaucggacaguuauacucugaggguuagagucacaugaguaaacuaugugcaauuacagaggcaagccacauguggaagcccaccacuggggcuccacguggcagaaaccaaguuuuuccauggaggucuauaaacagcaauaggcaguuauagugaauaaucugaaguaaacuuaauuuuaacuucugugugcuacaccugggaggaucgcaaaacauauuccaaaaacaguugcaauguuuuugaagaagcugaccaaggucacaagauucucguauugguuucugcacaagcacucugaauucuccucacaggacuccauucuuggaacaugaagcacugggauuacagauguggccacugucccuggcuucuucauucauuuggcauagaaguguuucauaagauagucuaugauacuuguuuugaauuuagcuuaauacgaaaacugugacuguuacuuauugugaaucuaccucuuuacugccacuguggcucgccuguauucagcacaccaguauuuggucuguagcugaagcuucagaggauaacuggagugauuguuccugucugcugauaguacugaucagcauuaacuaguuuaugcugaggucacuguguagcccagacuggcuucagcaucucaaggguuagaauuacuguucugagccaucauuugcauggcaacauaaacuguuaauuucuagauucagcuuagugguccuuaccguugggcaugugaaagccauugaguuuaaucuucaacauuguacacacacacacacaaauuacuaaaguauuacuauaagaugcucaauguuagcuagguguagacacauaagagauuaugcuaagccuuaaaauuuaauucucauugaugcauaggagagaaaauuuaauuuggaacaguuuuauuuucauuguguguaagcuuauaacauaauccauuuuaaauuucauuuuuuacuacaaugaacauuuuguaaaccugaucugaaaagccuacuaauuuuacaacagcuauuuuucaacauuaugaaauuuauugcaaacuaaacaugccuguucuuuuuuuuucagguuacccauuuuuguuugccucaacuucuuccguuacuuaaacauacuacgucauacauucacgaaguuuuugaauuuuaugaagaaauuuugacuugucgcuauccguacuccuguuuuaagacggucuucauugaugaggcauauguugaaguggccgcuuacgcuucuaugagcauuuucagguuggugucccuucaaguagaggaugcccaaguuagaguacuacaaggaaaggcucuuggcucaucaguugugagacuggcuuugagcaucauguaugauugaguucauagguagucugguguuuguaaaaauguuacaguguagccucuuacauaagcaaguaaugggucauagugccuucuuccacaauuaccauucacauuucuggcuuaguuguuaauguuuggcuuaugcauuguauaggugauuggugugccuucuugguagcacuacaaaacuguacugguaucaccaauuuguuaucaaaauaccguuuucccuuuguuuuagcccuccuuuucuauacauuuuuuugggaaaaguuccuauuuguaaguuuucuuuuuuuuuuuuucuuuuuuuaccccaccccuauuuguaaguuuucuaugucugggccgugcccuuuuccugucucugaaggcucuaguguguaaugugggacacuaguccagggcauucuucagaacacaguuggaaaacuugaauggagcaauguauuuagaaguaaauaacggagugccaagauguacuagaugccaggaagaggggcuuauuuuuguuacaguuuccugguuucuggagacugugucucccuagcacacgugccucaggcugucugugccccagacugaaugcugguuuccuggagugugccucugcaucgaaccugggagaagaguugugaaauuaaguaauaacccuauuguauuaggauccauuucugauuaacacuaguuucuuccuccuuaaaauagugauuuauauuuuuguuaaaaucaguauaaaauucagauagauuuugaaaagauuaggaaacuuuuggggugacuauucuuuuuuucuuccguauugaacgugaaccuaaaguugcauugcuuuagagugcaguuccuguauuuggacugacugugcaucucuugguccuaaguggcuucuuuggcuuucagcacaaaccuucugcacagcgccaugauuauagacgagacgccgcugaccagacggugcuuggcacaggcuuuagcacagcaguucuucggauguuucauauccaggaugucuuggugaguaacuucagagcuacagacugagccagaggaucagggaagcuggcuuccccuccccuccccuccccucuuguauaauuagcagggcacagagacacaugccuuuaacuucaggacucagccgguagauguuggugagcuuaaggccauucugaucucuguagcuaggugagaugacguccccacagcauggugacaccuguuucaaaaccaaaacaaaacagaacaguagaguuacguauauuauuuaucguaaaaauaauuuauuuaaaaauaaauuuaucguauuuauuuaucauaaaaauaagaauucugaaaaaugucuuaguaguauagaaugcagauuuggacgugcagaacacuaauuagaauuccaaugucacuguucaaauauagaaaaccguuugaggugauuuuaaaagcagaaucauuaucuucaacaauagugcuaguaguggaggaauuugccuuuuacuuuagauuuuucccaguuuucuagaaagcagagaaagggaagcagguuuggagcugggaugcagucagaggugcaaugcucuccuguaggugcuaggcccuuagucggagccccaacacuaaaaacaaagugacggucuuuccuuccuuuaacuugagaugacuuuguauuauuguuuguccguguuuugagaaggagucguacacugucacucugccuggcuuuggacuuacaguguacuauuagguuggcgucaaccucacagacaucuaccuguuugccuacugcaugcuaggauugcaguggaaggcacacacaagcuugugguuaauuuaaagcucuguacaaaacuuccuugaaauuguauuaucuuuuauauuuaauaauguaagauucugcuuauuuuuugcaaauguaacccuauuugugugugugcgugcgugcgugcgugcgugcgugcgugcgugcgugugugugugugugugagagagagagagagagagggagagagagagagagagagagauguaugucaguaaaugagugguggugccgauugccuuuucccuagagaaaguacaaccaucaaacaguacaggauaccauaaaacccaggguaugaaaguucugccuauggcucacaauaaagaacaugggguuggaguugccaguaacuccgagccuuguacaugcuagccaagcacucugucacugguaaacacucccaguccaugaacguggagguaacaucuuaccuggccuaagaugaucuugaccucaccuaugacaacgaggguaaccuugaauucuuuuuuucccuuauuuuauuuauuuuuuauuagauauuuucuuuauauacauuucaaaugcuauucugaaaguucccuauacccucccuccucccuccucccugcuccccuacccacccacuuccgcuucuuggcccuggcauuccccuguacuggggccucucuucccagugauggccgacuaggucauccucugcuacauaugcagcuagagacacgagcucuggggguacugguuaguucauauuguuguuccacuauaggguugcagaccccuucagcuccuugggugcuuucucuagcuucuccauugggggcucuguguuuuauccuauagaugacugugagcauccacuucuguuuuugccaggcacuggcauagccucauacgagacagcuauaacagggucccuucagcaaaaucuuucugacauaugcaauagugucuggguuugguggcugauuaugggauggauccccggguagucucuggauaguccauccuuucgucuuagcuccaaacuuugucucuguaacuccuuucauggguauuuuguucccuauucuaaggaggaaugaaauaucuacccauuggucuuccaucuucuugauuuucuuguguuuugcaaauuguaucuuggguguucuauguuucuaggcuaauauccacuuaucauugagugcauaucuaaugacuucuuuugugauuggguuaccucacuaaggaugauauccuccagauacauccauuuguccaagaauuucauaaauccauuguuuuuaauagcugaguaguacuccauuguguaaauguaccacauuuucuguauccauuccucuguugagaggcauuuggguucuuuccagcuucuggcuauuauaaacaaggcugcuaugaacauaguggagcauguguucuuauuaccaguuggaauuucuucuggguauaugcccaggagagguauugcuggaucuuccgguaguacuauguccaauuuucugaggaaccuccugacugacuuccagaguguaaccuugaauucuugacuagucugccucugccuccaagugcggagaaugugccugaauaccuagcagaugugaacuuuugagcuaagcagcccugacugugggcaaguacuucuuuaguggcagacaguccaagcaguggugugaagagaggcgccacagucagagcgacugcacugcugaauucuaaagcacugugagcuuugcuuugcuuuuauacuaaugaucaaacccagggcugcaagcacggugggaaaucgcucucacugagcuacacucucccagccaaacaguuccuguuaggggauucauauacuuagugcuucauuucagaggaagacaacugacuacuuacugugugucaggccuugccauaugcauuuuauuuuugacagucuuaauauuaaagauucacccagaugugacgaaggcuagaugggcaggcagcucagccuagaagaugugaggaacuugauaauuuguuaauaaucugcaguugccuaaaaacagcaguggucuauaucacacuguggcuguuagucucuuugacucugcuuggccaggcuuucaugauuaaaaguuuugacuuuccuuaggucugaugaaugggugcugaagggaauuucaggcuauauuuauggacuguggaugaaaaaaacauucggagucaaugaguaccaccauuggauuaaagagguaaacgaaagagauuuguuucccacuuguaagucagucauauaugguaauguuuuugauuuccaugucuucugucuuuuauuccauuuuuacuuuguuuguuggguuggggcagugcacaugcuagggugcgugugugcucagaagacaauuucccggaguugccccucugaguuccuuacacugaguuccuuacgucaagcucaggagcucgggcuuuuggcaaacucuucugcccacugagccaucuucuagcccccuuguccucuguguuacuuauuguaaugcacuuuuaaaauaucauuugaaaaauagcuaacucuuuucaaauaaaaugaaaauuacaucacugaaaaaaaagauuauaacugagcuuccuacuuuuguuuccaagucuuccguggggaaggaugguguagugauagugugugcuccaccggggagaguggcgcguugcuccugcagugugaaugguguuuugcacacaguagcuacuuaugucagguagucuucuauuccuaccguauguccucugucauauuuuccuucuauuuaaagaugaaggcaaagaauaaaagcaguauuuuguuuaucuauuucucaccaugcacauagauacuuuaaugcuauuauuggauuguauuagauccuuaaauucauuguuuuuagguagaaaaauucccaccuuaaucucauuauuaaauuagcucucucuccaaaaauuugcuagaggguucauacacuuagcauuagucuucauuucagaagggaauaaccacuuacagaguguaauauaauaauacugugauuaaagaaguauugacuguuuuaauucucuuacuaccccacuuuccauguaaggaaacuaagguacauagagguuaaauuaguuaguaaaguguguggcuaaucagcuguauugucaggauccaguuagcuuuuaacaucucauggugcugccugccacuuuucucugcugucuaauauuauuuaaacuucagaguguucaguauaguuaugaugucuuuuucagcuuuucuuucuuccuuuuuuucuguuaacuuuaauaaguauuauauguuagagaugaacagggucauuuuaaguugauguuauuaauaucauucaauuaauuuccuguugguugcguuaguccucagaugcaaaauacugagaaggaauaaaucaauuuauagaacaaaucagagaggcugagaagagcuguaaggaaaaguuucugagcugcuggcaagcucugaagucacaaaauacagggagguuuuugaaucuuagcauucacucaucuguguagcuuggucuguuuguaaaagcccgagcuguucuccagauagcguuugccuaucucacauuuacaucugauuccaggaaagagaauuuguggccuaguacuaaagauuguuguaugaagaaguuuucccugacucuugcuuuugugucuuuuuuuaggagcuagauaaaauaguggcguaugaacugaaaacugggggaguuuugcuucaucccauauuuggugguggaaaagaaaaggauaaguaugugagauuauaaaccucguuuuaugggcugccucauacauacaggaccauguguguucuugaggcccgcuaaggccagaaacguaaugauaguguggcgccgcagccugcacuugucagauccccucucugcaguucuguugcaucagugagaugacuguagcugaauuuaagccuaggagugugaggcucuucuguuugacaugcuaaguuuucuguaguucaucuuccucauacuagccuugauuacuuauaaaucuauggaaguaguuauuuuguuaaccugaauugucaacugauucaacugagaagugccccggggauuaggaaagcacacuugcaagucugugugaagagguugcaggaggauugagcagacagaaagcuccugaaaugugggugcagucugcuguagcuuuuggagguacagggcuagaugaaaugaaagagagacgggacccugcaguuccccgcugcugccuccucccaugagacaggagcugugcucggccauguucuucccaucagggagggcuaagcggagccacaguaaauccuuccacuucccagucauuuugcucagguuuuuauuacauacaauaaguuuaacacaguaaauuuguaccagagauagagcuguuacugucucuaaucguaaccaugucucuuaagccuuuggaacugaauuuugaaaggaauuuggaacaguuuggagauguaggcgucaguaucucuagacugcuguaaguuuaguggacaguucuauuaggagcucagaagaucugaugccaagagaaauaugggcaguaaagaccaacucaggaaguuuaugauaugacugagaacucuacuuggaauugggcgagaggccaugugugccacauuauugcaaaaaacaggucuacauuugucuauccugagauucaagguagcccaguuaguaagcuuugguauggauuuugcugguagcuuuuagacagauuuacugagaaaauuaugagcaaaaaaccuuguuugcccagaaaagaaacacauaaaggggagagguagccaaagagauuaagaccauuaaaagaagaaagggcuuugcuccuggacaguggaaaaggcccuugaagugccuguaucccaccugccauaagggccugggaaugaagccaugggcagagucaagacuccaggaagcugcaagcagccagacugcccagggcagaaagcucauuugcuaucaaaggaugagaggcagccagugccaugcuguuuaagaacuuaaggcccauacccgacuccuacaguacguccuaggugcuggacauggaacgauaaugugugcguguucugcuaugcuuugguucguuuugcuccugguguucugguguucugugccucuguuuaggaauacaaguauuuacucagccaucguuucuugaggguauuggcacaaaaacacaucugaccucaaaauggaauauaagagauaauucauuucagaaccagguaacagugaucauggccuaggaacacagauacagguuuccccaaauaccauauuccaguauggcagcuguuugaugaaguuuuaugccaacaaaacagucauaaaucaacauacuuuucagauaagauguuaguucucuguauccaacccagggauuccugcauacauuauccguugaguugcaccugggcuugggcuuuucuuuuuuuaaacuuauuuuauguguaugggugaaacugaaguuggagggaacaccacacagauauugauugugaguauaauuugauacacuugauacccuauuuuauguauagaaucauaaacugcuuuuugguauuuguugugcaaaaguacuuguguaaaauuuaacguagcaauuuggaauuauggaaaauuaugaacaucuuaauuguuuauguuaaauguaaagucuccuuucgacuuauuuuucuuuacuagucagcuuuguucuuuguuucagccccgcaucucaccuccacuuuuccauaaagcauccacauacacuguccugggaguacuacacuauguuccaguguaaagcucaccucgugaugagacugauugaaaacagaaucagcauggaauuuaugcugcaaguaagugcuaacauuaagaacuuaacaacauuaaaggacuggagucuugugaaaccucaaagccuauuccuagugacgcuccuccuccagcaaggacacaccuccuaauccccaaacaguugaccaagucuucagaugccucacacugauggcggacauuucauuuacaucaccacauccuccucccugucucccauagucuuguggccauaacaucauguuaaauacaugcaguccaaccucagaagucugucaugggcaaauucaauguccagaaucucuucacucacgguaaucgcuuaauuauaccccucuauaaaaucaaaagcaaauugcauguuucugacagacaauggcauauaauacacauugccauucuaaaagggagaaauugaggcauggugaggaaaugcuggaccaaagcaagagcaaaacccagcaggacaaacuugcaaucccuuagcuccacucccaguguuaaagguuuacucaguuggcucugcguuccggcuuugcagccuucagcacacuucugucucuugagcucguuccacuccaugggugcagcucaccguggcggcugucuguagcuccggcaccuccagcauccuggagucuccaacacaacucagguuucauacugacauccucacaaaacggcuucugaaggccuccguacagggagggacuccuuugccacacaccuggccucaggugcucuacauaacaccagaggaaggugcugcagcucauugcuuuauugccauuguuaaauuuugcucuauuuuaaaguaaguuuuagucuaaguaguuacaguauagaaaaugaaauaguagaaucaagauagauggauuacucauguaaacauauauccuuuugcuuuuuggcccauucuuucuccuuccccauucuguccuuucuuuuccuuuccuuuccuuuccuuuccuuuccuuuccuuuccuuuccuuuccuuuccuuuccuuuccuuuccuuuccuguccuguccuguccuguccuguccuguccuguccuguccuguccuguccuguccuguccuucccuucccuucccuuuuuuccuuauguuuugagaugcugagggucuaauauaugaccuuguaugcguuaggcaaaugcuuuaucacugagguacacuccugucuuaggguuuuacugacaccaugacaaggcaacacauaucggaaacauuugguuggggcuggcuuacagguccagagguucaguucauuaucaaagcacgagcauggcagcguccagacagguguggcucuggaggacuggagaguuccaccucuuguuccaaaagcagcuagcagaagacuggcauccagacagcuaggacaagggucuuaaagcccaugcccacagugacacacguacuccagcaaugccacaccuaccucaacaaggcuauaccuccuaauagugccauacccugagccaagcauaugcaaaccauuacaauucucaaacuuuuaaaauaucagcuagccuccugucucuguugauaacuuuuuuuuuuuuugguuuuucgagacaggguuucucuguguagcucuggcuguccuggaacucacuuuguagaccaggcuguccucgaacucagaaauccaccugccucugccucccgagugcugggauuaaaggcgugugccacuauacccggcgauaacauuuuuuuuaaaauugauugauuuauuauguauacagaguucugccugcauguacacuuucauaccagaagagaacaucagaucacauuauagaugguugugagaauuugaacucaggaccuugggaagaacagucagugcucuuaaccacugagccaucucuccagccuuccuugauaacauucuuaaagacaggcuuaaaacaaaaacuugaacaaaaaaaaaaaaaaacaauuuugcugaggauguaguaaauuggaguacuggcuuaauguggauggggcccuguguuuaaucccugauauaaagauggaagcauaaguguucucugaagcuugaagaacagaaauauaaaagagaaaagugugcacgagagggcauuuguccuuuuuaggaugguguagguguuaacuagugucggcauuuaugaguuuccuuuuuaaugcuggugagccaugguacucucacaugcgcuaggugaaugccaucgugcugagucccagcucuacuccucucccaucucccccuuuaaaguagaauacaugagauuuaagacaggucugacaugggagcacccugcgcuccuaaugaguauccuuaguuuugaauuccuguguuuuacauauugugcuucuuaauaaacgauauuauguuaccauucaguaauguuucucugaacaaugcucuuauauucuguuuaaauauuuguguauuuuucuuccugauaguuuuuaaccugaaaaugaauguuacguaacuguuaccuucuguaaaugaucgaaugaugcgccagugcagacugggucagugugcaguuggaaauguuauauguuauaugcucuucuguguuauacgcucuucugucuuugcagguuuucaauaaacuacuaagucuggccagcacugcuucgucucagaaguuccagucacauauguggagccagaugcugguuuccacuuacggguuuuugaaguccauuuccaaugucucuggcaaagacauccagccccuaauaaagcaguggguguauccuuuucaguagcaguucagcaccauggggacaggaauaagcuguguggaagacagggaagagggcggugacccauuguuacuuccuuacaaagcagaaguaacuaagcugugacuuauaucuucugacgcgccuuccaaaggaauugaauuauguauucauguguagacguugaugucucuauuuauaaauguuggcguaguuuguacuuuuuaauaugagcagaagguagguuccaugguggaugagguaaauacucuagcagacuggccgacgacguuacuuacaagaugaaauggucuggugacuuugaaauaugcucgcgcuuggcacaacuugaauggugucguagaacuuggcaguucuuacacuuuucacuucaagguacaaugaagaauccaguagaguggcauuacuuucaaaauacaagcuucucaauguuucagaaauuuucuuuaaccugggaaacauuuuucaaaagaauuuugaauauuuugccacaugagauauaaugaaguuuacuuugagacuuugaucuauugggaauacauuugaaaauuauuaauauaauaguuuuuggggguuucuuguaucuuuuuuuuugcacacuuucauuucaauauguaaaauuuccuuuacaauauuuuagagaccagaguggagugguaaaguuuuacggaaguuuugcguuuaauagaaaacgaaauguuuuagaacuagaaauaaagcaagauuacacaucuccuggcacccagaaguacgugguaagugccuuucuagaagagcaugcugauuuguugucuccaguuccuguagaggaggggcucucaaacugggguuacuggcuacucugcaguggguuuguacuuggggaagagucugcggacagacuucagagcgcgcaugcccucgcuuccccugucccugacaccagcugcgguuguacuucugguacaaucuaccuuuuauauaguacaauuuuguaucuuaucugucuuuaaagguagggcuaugucuuggccauugguauguuauugcuguuguuguuuuuaaagggaccucuuaaagugacagugcaagaguuagauggauccuucaaccauaccuugcaaauugaagaaaacagccuuaaacaugacauacccugccacuccaagagcagaagguaggcagugaguccuaagugugcacuggagaagcaacugcaaaucccacauguaaaaacgccuaagggaaaguucaguuauguagccugaggaagaacaucuuaccugcuagcuuuugcuccugugcuacaucagaguagcggugccaugcauacuuugucugcagucugguuuuguuguuucugagaccguaucucacguagcucuaccagccuuggucuuacuucugccucccaaaugucagaaucacaggcaugcgcuccgacacacucagcucuugcuuucugucguuggaccuuugucuuuggacuuaaggauguuuuauauuuauuuaacuuauuuguaggacagagucucacacuauugucuaggcugaccaagaacuguguaccccgccucugucucccaaguccugagguuacaugcuugugauaccaugccuggcuauaauuuuuggggggggagggggggucuuauauauugcaggcuguuuugcuuuccauuaaccuuuaacaauaacaauaauaauaauaguaaugauaauaauaauaaaauucaacaucuguuuucucuagcuacgagguagauuugguuguuuucacacuccaugucaguguucacuccacuuugccuuaccuuuuaguguuucaugaaaccauuuauuugaacuuuggcugccugauaucuccauuccgauuuggaaaucacacaguuuucaauuuuacuuuucuucaaauauaggaauaagaagaaaaaaaucccacugaugaauggggaagaaguugauauggaucuuucugcaauggaguaaguuacuuaaaaguauguaauuacuuuugaaauguauguucuuaaaaucauuuagagucaagagaaacuuaggaagaaaucuaaauaaaaucauaacucauuaaauauauaaaauuauguuuagacuggaugagacaugaagaggaaaugcaguauuggaggcgugggcacagucccaaccuuugcccucucacuuccucgcgaguauuacucacauugauaugcaugcgacuuagggcaaucuuaaaauucuguuguuucugcuuccuuacguuauuugugggccugaaguuuauacuucacgugaaucccagauacuauugauuguguuugggacagugcuccagaguguguugaggcugucucuguguuugcaaauggacuauguagaacuacucuucuacauuguauauuuagucuugguuaauauauuuuguaacccagguaguuuuccuaagccuggccuuuuuuuuuuuuuuuuaaauuuucaauugauuuuucugugcaugaguguguuuuguuugcauguaugucuguguaugacaugcaugccuggcgucuguggaggucaauagagagcaccagcuuuccuggaacuggaguuacagacugucaugaacuacccagugggugcugaaaauugaaccugggcccucuguaagaacaagaguucuuagccacugagcugucucucuagccuuuggacuucaauuauugauccuccugcucccauccucuuccccgcccuccaccuguuaggauuauagcugauugugauaguuacugauugauauuucuuacauguucaauauuuuuauaccaaguacuucacaagcucccaguauuaaacugaauuaguauuacaagugguauuauuuugaucaaaauauugguauagacuugaguuuuacuuugcauguuacuuaaauacaugagaauaaaccaguggaccuucauauuauaauuucagagcuuucuugagaaaaguacucacgugccaagcauuuaaauaucaacuauaguuauuccaguagaguaaaugcuuuucuuuuauauuuccuuuuaaauuuccaguaagggauaacauuuauacuauaggcauuuuuuuagguuauggaaaguuaaucaaagacaguuuauauuauuuguguuuugauauuucauaauugcagguaaaaaugucuagaaaaauauuugcaguggaaaauuuggaauuugguauccuauguaacaacucuuuauauccugaaagaucucuuuaguaagauugugcgaaaguuagcauaacauagugaaaguguguugagauuuuaaaauauggcuauaaucaaacucaacaacgugaaacacuguuuagagcagagucugaguagagucugcuuguuucuguuucccagagguaaguuuuaauuguguuuucucuuagugcugauuccccuuuguuguggauaaggauagacccagauauguccguccugaggaagguggaguuugagcaggcugauuuuauguggcaguaugagcuccgcuaugagagagauguuguugcucagcaggaauccaucuuggccuuggaaaaauuccccacuccggcaucgcgccuugcgcucacugauauacuagagcaagagcaguguuucuaccgagucaggaugucagcgugcuucugucuugcaaaggugagguuccaaggagaacagaagauugccaaaagauugcuugcacuuugcacaaaggcuccaagaaugaauucaaacucaccagucuuuuaaguuuuucuugguaacaguucuuuugaaaucuuguaccacacugauuugaaagaaacauguuugacauaaaaauagauauguacaaaaaugucauuauugucaaacugaaaauggaggagaauucuuccauuuuuaaauugccaacuguauuuuaaugcuaagaaaauuuuggcuagaaauucugugauugggggcuggagagguggcucagggguuaggagugcuggcuacucuucugauggccuugaguugaguuuguaguaagcacauggugucucauagccaucuacaaugagaucuagugcccucuucuggcaugcagacauagacauacaugccaacaacagagcacucauaaguaaguaaaucuucaaacagugaaaagaaauugugauuguaaugauuuauguuuuuacaugagaauacauaaaauuaaccaaucuuaauugugguaguuauuuuacuuuguuuucagaauuaaaauuagugauaauuuacaauaauugacuauauuuuuaucaauaaacagucucuuuuucuuuuuucuuuuuuggcuuuuaggacagguuuggugugcaugugugugugugugugugugugugugugugugugugcgugugugcguguguguguguguguguguauguguguguguguccaucuuuggcuguucuagaacucgcuguauagaucaggcuggccuggaacucacagagaugcuccugucucucccucccaagugcugggauugaaggccuucuucacugccgcugaggaauaaacagucuguagauuaaagagcagucuggagccagaggaaugcagacagaaaguugagcagaaacucugucuaccgaguguuucgcaacaucuggauaacagggcuauucccauuucaguggaugcuagcacuuuauauuuguuuugacuuuagugauagcaugcuuucugagcucucagauauuagagagagaaaaacgagauuauuugcuagggauauauuucacugguacuccaaauagucuuaggauuuuuguuaaaaucauagcagaaccauaaaaacuguaggauaaaguauuugcucauaauuuccuuuaccucagauacuuuuuauaugcccuuaaauuucaauauuauggagauuuuuuuccuaaagcauuuuuuucuucacuauuuaaauaauuuuuauuaaagcaagaaauuuuacaaucauuauuacaugucuugggucagcugucaauucuguuggcuaaaacaggauuaacaucuaacuuuucacaguaaagaauuagacagguaagggaaggaaugcugugaaguuuuauacuuugaugaaggucuuuuuuccccagagucucuaauacauuaauuuuacauuuuauaauuuuugucaauucguuguuuugcaucaaguaaucuagggcuagcuuugcuuacuuaaacauaacauuugcuugguauauauaggucaguguuuguuuuccuuucuuuuuaucuuuuguaccuuuuuuauugcauuuaaauuugagguauuuccauauucaucugugaagcauggguuucuuuccacguguccagaucagguauaaacagcuaggaccgcuguaggauugcucucugggcagcugcuguaacuugauggacaccuguagcugucagccuuggagugaggcacacuggagacgucagccuaugagcuaguuccaugguggcagucucuagcagaggaccagugauuuuacuggcaagaguagcaucuguggcuugaagaagagaaagcagucauucacucagcacuggcuuuugcucuugaguagugagcagauaccaacauggaagcacuuacaggcaacugaccuugaacaugacuuggagugcggcuagaggcucuuaucugcccuacacugacggggaacuuccguucaccauggcuuagccuugccucagcauucuucucuaaauaaacaguaccucauacuggccugcuuuccacuuaaguggucugaggaaugguucaaacucaugauaauuauuaacuuuaaugagcuuaaaauaucaacauucucucuaccugagugaauagggacaaacccagucugugaagccuuugaaagaaccuuaaacacaagaggaugcuggcauuuggaaauuaacuugugcaaaacgacuguaaaugcacauaguggggcuuuugguucaucuuggauugggugggugggaggaugguuuguuuuuuuuuggugggugacuuuguauauuuucuuggaaguggaugauaacagaccagcuugugcuaauuuccaagaacuguaguguuggcuuuuagaaagcuauuuggucuucaguguauuuguaacagugacggaacguuccuccucucugacuguuuacagauugccaacucaauggugagcacguggacagggccgccagccaugaagucucucuuuacuagaauguucugcuguaaaaccugccccaacauugugaagacaaacaacuucaugaguuuccaaagcuacuuucugcagaagguacugacugcucuguguucuucugaugcuuuuauguuaacauaacuuuauugguguuugccuucugugaugucuuuauaugccauaaacucucaugugucuguuuaacuuggaaacugcauaugauagguguuuguuucuuauaagccggacucugcucuaaagcuucucuagaauuucccuugaucacugauuuuauacaaaucaucuacaucacuuauaacaugcagagaaaugaguggccuuugauugguugcguggggaacggacuuccgugcagagcagaccuuucucccagccaguauauucugagucagagguugcucagcuugcaccgccagcuuuacuugcuugcuugaaggcaagucacauugccuuggcugccagcaaggugcugcacguggaggcagugcucgucucaguucugcugcgacugggcuacgucucuauuuucagaaugaggacauuagaccagggcauugaguguguuuaauguuacacuugcaggaggcuuucuguuaaaugguaaguuagagggagagcggaaguguggguacacuggaguaugggaagaaguugagugguuugcaaaucauuugcaugguuuguuaggcaaagcuagauuaacuagaucaaccaguaaugaguguggcauuaaaggaagagagaaggaaggaaagugacgccccugucuuagcugaggaagcugcugugagggcaagcaggggugggaaagaaucauugugcuuuguuuggugucauguggaggacacccagaggagaaaguucauauaaaagacaggucaggcuuugagcaggagaagggaggacauaggaauuaaauggagaaaaguaagaacauggugauugguuuucuucaguccaaaggauuuuuuuuuuuuuaagugagacuccugcuauggcuccgaagauuuuggaguagggccuugaaucgguauuagagcccaaagaacauugugagacaucuucuuuagggcaggguguggcuguugcauuuugacaucucagcagcagagauuauuagcacaaguccuacucgggauuguaccuucacccucugucauggagggagaaggauuuagaaggcccuaccucacuccuccuugguguggcaacugguaaggugccuagauucucauaagcaauucguguuaaacucagugggucaaccaaagcuaaaacagucgaggaaggcaugacaguggaggagaggaagaguucucucagggcuggguaguaggcucagguuaucggguaaaaagagacaauauggaggauagagguuuuguuuugcuuuuuuuuuuuuccuaaugaaagaagauagacugggcagaaggcgagcauauguguauuauaaagauaaauauauggcucuuuugauuuuacugucguguuguuuauauguauugcuuccaaauuuauuugccuguguauuagcuuguaguguaaaguuuauuucuuacuauggguugaaguaaacaacuuggaaugaugauacuucuaguccaaaugacuuacauggcaggagagaaaguuugacuaaaucaaacauuuacauuugccuugcauaagugcaaagcaggcagagagaaggaaaggagcuuucccucuagguuuucuuaucucacacugccugccucaggcccuguccucauugccuggacaaaggcagugggagggagggagggagggaggaagggagggagggagggagggagggagggagggagggagggagggagggagggaggggggccuuguuuucccucccaacuggagaggaucuaguccaccauggcaagaccgacaugacgccaaccaugaggcgugcagucgggagacagagcaauacaaacacugcuccucucucuccuccuccuuuguguuuguucuggaaccccacuccaugggcgugugccagcaccuaugggguggaucuuccuaccuuucagcaaaaccucuggaaauaccuccgagacaugcccccaaguguaucucuuauucugucuaaggcuuaauuagcuguauuucaguagcagaauuuacuguugugugucuguuauguugagacuaacagaaaauugcuuaugaaauuuuagaaagaagaaagguacucugaauuugagacugcugucuguccuuagucugaggguuggugagcuguacuauugguuucgugccuaucaccagcagaucuuugagcccuaaagaugauuguguggaggcaaggcaguaagcaacacgcagauauccagaguagacagugaaggucuggguuaaaggcgaaccagugcugaaacuguguacucucuccacuacaucacuuagaaaugaauugauaaaguuuacaugauauauacucuccuccggcaagugacagcacaggcacauagccuguagacuauguccacuaauggaaauauucccuggauuccuuacccauuucaguacuagugcuuuuagauguauccguagugggagcacaugggagauggaguacuucucuccaucuacguaucuguguuaauagcacuggaauucccuuuagaguacaaauuaccauaguaaccaauaaguuggguuaugugccuaaaacgcuuuuccuuuuuuguagacuaugccgguugcaauggcuuuguuaagagauguacauaaccuuuguccuaaagaaguuuuaacauuuauuuuagacuuaaucaaguacaaugacaacagaaaaaauaagguaaggugcuuuucucuaugaauauuguaaaguaccuagugauacuugauuuuaggguaagauaugggagccucaguccccaggacugcaaucaaagaaaggaaaaaauacuuguguuuguauucauaagcccauagugccuuuguggaguuagaggcacacagcaugguuuauugggauaaucaguaguugaaaaccaagauuaauugguucuuaaauauugaaacucuuauaguauagagagacugauacaucaauuuggggcgggagguggggggcagcugaaauuugauuuuaugaagucuaacagcaccguuuuauuuuuuuauaugugugugugcuaugugcauguuugcgcauguguaugugcaugggcuucaaccaugccugcgagccucuggguaggggcagggucagagagcuucugaagggaguuagaauaccgagggaacugccgucugacagugggaaaggaaggggaggagugucaauuaaacagcagcucuugucaugguucuugcaugcuucuuuuuauaacuaguguuaugcuuuuggaaagaauaugacguuacugauaguuuagauauuuugauccucuccugggauguucuuauucuuugaaauacaucuuuuguccaaguuccuuuucuuuaaguugaguuguuucuuucucuuucugucccucugucccucuguuuucuuacacuccucuuuuuuuuuuuuuuauucuauaugcauacgagggugcagcuucucuguauaugcguccugugcaggagcccacagaggccagaagagagcagcacaccuccugcaccuguauuuagaggugguugugagccucccuccacuuggguucugggaacaaacucaggacuuccucucuaagagcaguuaagugcucuuaaacguugagccaucuuagcucucucuccagcccccugcggucuuuugccuuuuuuuuuuuuuuuuuuuuuaauuuccucaauuauauggugaucuguagauguugaauguuuauacuuuaagguagagugcuaguugauuaauuggaagguuuguauugauaccaggauuacauuacaggacuguaauguuuuucauuuucugugugugucuguggugugcauaugugucuuaggagcaccugccugugggguugcauguauguaccgcugcaugcagagaccuggguuaaucucaggugacuuucuuucuucauuucuuuguuuguuguuuuccgagacaggguuuugcuguguagcuuugcuugguuguucuccuuauggauuggggcacuguccuucacuugaagccacagcuugaaucuagagcuggccagcguuggcuaagcuagugagcuagcaagcuuuggaaacucuguaucugccccugaggguuaggcguaugugugggcucccauccccaucccugccuggguuuuagaugaauacugggcaccaaagcucaggcccucauucuugauggcagucaccugcuccacugacccauccucuagcucuuaguggauguaaucuuugucuuuccuuucucuuuucuuggacuguaaugcuacaugcuuuuacaugcuuuguuuggguaucuguaggaagaucuuagacacagugagugccucacauucuaauaggucacuggcgagugcaguguugucauuguuuuccaaaggauaauucuauacagaggacugguuguauuuacuagaaaucuugcuguuacauacacucuguaugugugugugugugugugugugugugugugugugugagagagagagagagagagagagagagagagagauccuuguguugaacucuucuaaagaugugcucuacuucugagcugaaaugauguaaagauauauguguugugucgugaaaaggcuuaguuaucuuuuaauucuucgucuuaguuuucagauaacuauuaucgugcagaaaugauugaugcccuugcuaacucaguuacaccugcugucagugugaauaaugaagucagaacuuuggauaacuuaaauccugaugugcgacuaauucuugaagaaauaacccgguuucugaauauggaaaagcuucucccaaguuacagacacaccaucacugucaggugccacucauuucuuugcugcugcuuuaagauuauuuauucccauuugauuaaauugaaaaaaauuaaaacaaaaauuaauuuaaauuuucugauacugucaucuccagguaaauuauuaauauauggaaaauaucuacgaaaguuuuccccuuuuuaguggaauuuuuaaauuuauaauacuauauguaguuuuauggucaguuuccaucaugugcgaauuuuugaaaaaaauaacaagauuuuguauuuucgugcacgcaugcccgcacacacagcaugcacgcacacccaggcacaaggugggaaagcaccuaugcugcggucagaggucagaggucagaggacagcuuuggggaguggauccucucuuucuaccuuauguggguggcucaggaugaagcuuguucucccaggguuccauaugucaaguaccuucgccugcugagcaaucucacuguccuagaaagucuucuuaauaauuauuuugauguuaggguccuuuuuugggggggggggguuguuuuguuuuguuuguuuuucgacacacaguuuuucucuguguagcccuggcuguccuagaacucacuuuguagaccaggcuggccucaagaaauccgucugccucugccucccaagugcugggauuaaaggugugcgccaccauacugggcuguuaggguccuuuuuuuuaucagucacucguguaaacaaccuccuuucagguugugagacacacucacauguagguccaucuguguagccuagggucaccuugaacuaaccucugaccuuccaagugcugaagugcccugcuucuuuuagccuuccuaguuuuauuuuuauguuuuaguuuucauuuuauuguauuuuuuuguuuguuuguuuuugagacagggucuuacuaugccuuuugggcugucccgaaacucacucauuagaacagguuggccucaaacucagagaucugccugcucuguuguacccuccacccacccccaucucugcuuccuuagccaagugcugggaauuaaggcuugcuccaccaugcccagcgagucuaccauuuuauugugaaugaguauaggauuucuggagaaaguacacuauuuaaauuauauucuuaugcuaaguacuuacuuuuuuuuuugaaguauguuuuuguugacauguaugugcaucugaguuuccaaacacauuuugaaauuuguuuuuauauuauuuagauacuaauauugaacuuuuaucagaacauuacaaacuuggauguauauucagauuacaagguuuuuaaaauuauuuuuauuugauuuuaugugcuugaguguuuugccugcguguacgccugcacguguccagcuccuggaacuggaguuagaggcaguugugagucagcauguggguacugggaaucaaaucuggguccucuggaagaguagccaguguuccuaacugaugcgccacgucuccugcccugauagaugaggauuuugacugauugacaaaugacucucaguaguaccuaggugacagcuuugguccaugaugggucagaggagguaacuaacuuuuccucacuaguugcuugagagccauccgggugcuucagaagaacgggcacgugccgagugaugcaucucucuucaaauccuacgccgaguauggccacuuuguggacaucaggauagcagcucuggaagccgucguugauuacacuaaagguaacggugucuggguggugcuuguuccaguuuaggaagggaugucgaaaacccccuuugcaucuuuguaguauagguacuacagggauucuaauugguuuuaauuacuuuuuauuuaguauacacaguaguagaucucacagugauauuuucagacauaucaauccuuauuguuaaauucuuggcucacucacuuuuaguugguuugguaacaauaggaaaaaaauaaaauuauagauguuuuuaauuccugggagaagccagcaaauucuacaaauugaauuauauguuuuguuuuguuuuguuuuuuuaaaaaagaagagauuucagaaaaauaccuagggauucaaggaaauauauuacaaguguauaaaaauuuguaacuaugcaaacaaagcaagagacaguaacuuucaucaggaaaauuagcuuaagucucaaguuuaaagaaauaaaaaguauggcacugaauaaaauagagguugggaaaaauaacacaggacacaguagaauacucugaaagguguaaauuccagugacaugaguuagcuucuacugcaauugaaguuuguggauuaacuuccuagcuagaucagaaccauggugguguagacuacaaagauagugugugggucucuguuccuaauuuucuccuguguuaaaauuucuuuauaauuccacuuugcuuuaugauucauucugcacagauaguauagucuccaguuucagauuacaaauacaaaaagacaguaaacaauaacacaguugucugaguuuuagauucucuacauugccagcugucacuuagggaauuaggcacauaugcaccucuucuguaaucuucuuuucccccccaagauuaauuugggccugaaacgguugcaccugcucuagucuuaucacucuggagacagagguuggaggaucucugagagguagagaccagccuggucuauguagcaguuacaggccaacuaggguuauauagugggguccuaucuaaauaaaaagguuuuuggguuuuauguuuguuugcuugccuguuuguuuuugccugcguuacacacauccacaaugcagauucccaccgaggccaagagagguaugagguauucagaugccuuggaguuggaguuaaaggucauucguugggaguagccugguaugggugcugggaacugacguauaguucucuacgagagcacuaagugcgcuuaacugcggagcuaucucuccagccccuucuguaacaacaaacucccaaagaaaauuucagauggaauauaugugaaucaaaauaauaauuaagauaaaugaguguauaaaaugaagaaaccaaucauagcugaucuugccuauaugauagcuuuaagccuaaaugcuugcaaaauuugugccaaaaaucuguguguauuucagaaauaauuguuuaauaguuauauacagguaauauaaauauguaaguauaacauacaucuaaaagucaaauuuguaauggaaauauugggagaugaaugagguuaaaguauauugaacucugauuagguuaaaaggaaacgggagucccacaugcaguuacagguuguauugaacuagcaacguguguaauuaggucuuuguaaguuuuauacauuucaacagaaaugccuacagguagaaagcaaagaguaggcaguuacagguuguauugaacuagcaacguguguaauuaggucuuuguaaguuuuauacauuucaacagaaaugccuacagguagaaagcaaagaguaguuaguaaccacauuguauuuauuuguuuauuuaaaauuuauuuuuauuuauuuauuuauuuauuuauuuauuuggcauuuucugagacagggcuucucuguauagcccuggcuguccuggaacucacuuuguagaccaggcuggccucgagcucagaaaucugccugccucugccucccaggugcugggauuaaaggcgugcaccaccaccgcccggcugguugaauuuuaguaugaacuauaaacugggcauuauuuuuugguacuauuuuuuacugauggcuggcugaauauauucuggguacuguuuuggucaugguuacauaugacauaaugcuugggaaaguuacuacuggucuagugcauacaaaguuuuaaaaugaauuuuaauugcuuaauuggacccuucaacugccugacaauucagcuaagacuucuacuuacuuaauuuccugcuuaucacuuguuauuugaucuguuauguaacccuacaaauacugauguuuauuuucaguggacaggaguuaugaagaacuucaguggcuacuuaauaugauucagacugacccuguucccuaugugagguuaguuuaugucuuuaauaucuugauuauagaucugaaauggguuagaucauggccaaaaauuauacaugggaaagauguacaugggaaacauuuucuaaaauauaggaauggguuaugcauuuuaaagccuuuuuuucuuauuugauuuuagaaaaacauuuugaagagacacauuauuaauaguuucuccuaauuuuaacuauucuguuuugacuuaaagucuuauaauacuugauaauaagugaguagggauaauuacuugugugucccaacuuauaauugauuccacuauuuuuaugucauuugggaacuaauuucagggcaucucuuucuuuugaucgaucauuuaacagguuuuauuaccuuuuuuuuuuuuuuuugucuauguaugcaugcacauguacccagcaugcauguggaggacagaggacgugggcgcauggagccacacugcuggcucccauuuguuuuuuuaauuucauucaaagccuuaaguuuuauuagaguugauauuuuuuaagaucuuuagacgcuaaaggagcugcagccaugccgugccaucugccuuuguauuugugcuuaccucugguaaccacauuuauuccugcugggguuuuuggauguuugguuugguuuugcugaccauuucugucuuucuuugaagucggcauaaucgacacugagguuguauuuaacauucugacuucuuagaucagaauuuuagaguugaagaauaacucauagccauuucagcucuggggaaggacauagaccuagagacguuaaauguucaccuucccacaucacuuggcagaugaugaucuucuaaaugccacagacugccugcccaucuuuagaaugccccgaggugugagcugccugcucaggagcuggggcuuuuuagagcggugacgacuugguuguuguauugguuagaguuuuacugcugugaacaggcacuaugaccaaggcaagucuuauaaaaacaacauuuaauugaggcuggcuuacagguucagagguucaguccauuaucaucaaggugggagcauggcaguauccaggcaggcauggcacaggcagagcugagaguucuaugucuucauccaaaggcugcuaguggaagacugacuuccaggcaacuagggugaggaucuuauacccacacccacagcgacacacccauuccaaccaggucacaccuauuccaacaagaccauaccuucagauggugccacucccugguccaaggauauacaaaccaucacaguuguuaacuguauauuucaguguuuuaaguaaugcuuguuacacauuuuauaugaacuuuuaauauuuuaauguucuugauuugugaucuguauugcaguuugaauaaucuguucuuaugagugauauaaagucacaaugcagaaaaaaaucuaauaacuuuccauuuuaaaguccagagcaaaaaauagagccucauuacuaugucuaaaauggaguaugcacuuaaaagucuuuggaagcauauaagaccagaagcuauaaauacaauauaaguaaaguuuagccauuuguuucaaaucauuuaaugcuuaaaguuuaacaauuuguuuucaaugugcaagaauaagaaaauuaacaucucuauuuuucaaggcuuguuagaguuaaauauuagauauuuaagaucuguuucagagagcacuuugagcagguugucaugguuguuacugaauuacacauugauuauauaacugacauggagguauacauauugauauaugauagcugaaugaaguuauugacauuguaucuguaacgagugcuuuugaaauguaguuuuugagcuauuuugguucauucaaaugccaagagccauauuuacagucugaacugaaaaucuguauagaggugugguuaccccauggcagaagaugagaacuuacuugugccaguugucuucugacuugcacgcaugguguggcacagacacccuaccaccacaucccacacaaaauaaguacaaacuuuucuuuuuaguucacauuuuuaaaaaaaggcauuaugaugaugaauggucacaggauaaaagugucacugcacagugauugcuuucuuauugguauuuauuuauuuuuuucaaauuuuguuuuagacagggucucacuauguagaccagacuggcuucaaacucacagacaucugccugguucugccucccaagugcugcaguuaaaaggugugcgucagccgggcaguggugcccuuuaaucccagcacucgggagacagaggcagguggauuucugagcucgaggccagccuggucuacagagugaguucaaggacagccagggcuacacagagaaacccugucuugaaaauaaacaaaaaggugugcaccaccaugccuggcugugcguuuuaauucguuuagcucauuuauuuugauucuguuuugcucucuuugaggcagucuuaguuuauaguccaggcuggccucugucucucugcuucucugucucugcuugugacucagccucuaguacuuggacuccaggagcauaccaugauguccugcaaagggagcuuuaguuuagauacuccaguaucugucucuguccagcucauuagcauuuuccugcccuguucuaagcauaaacauuguuuuuaaggguuuaaaacucaugguaaaaugaaaauguuuaaagagaaaccuugaaucucccugccccucucccaaagaaaagaaugcgaugguuaauguuauauaguaagaugguagaagaccuuguuggacaguucagauaauugaaaacaaacccauaagacauuuuagugaggaaaaacaugauaaacauuuaggauucagcauaaagcauuuagaaguggaacuaaaaauaaaauuagacauaaugggaaaggagaaagguuuugauauucucggugguauuucuuauuuauaguaccaaucagcaaacaguaaaaauuaauuuauuuaguuuugauucuuacaggcauaagauucuaaacaugcugacuaaaaauccaccauuuacaaagaacauggaaucuccuuuaugcaacgaagcccugguagaucagcucuggaagcugaugaauucugguaagaguguaaugacuuucucuuuuuuaacuuuuuauugauucuuugugaguuucacgucaugcaccccaguaccccagucccccucauauccuugcccccucgcaucugcucuccacuguuguaaucuuccccacaaaagaaaauaaaacacacaaauaaacaaaacaacguagaaggcaucucgucauggaaacuaacagagugagucccacaguacaucccuuuguccacauagcuuuacuugcaggcguucacuuuaacaagucauugcucugguuggagaacaccagugauuuuuuauaauuauuaguuauucucauuuuauaucagacuuucaaggauaugggggggcggguuugcauggagugaaagucugugaccuggagcuuacuaacuggcuagaccggcugcccagagggcacaauggcaucuguuucccacucccuaguguaggaguuccaggugcuugucaccaugccuggcuuuuacacgggcgcugggaucacacccaguuccucguguguaaguuguaugcucuguccugugugcugcacucuggcuccuccgccuuacacacacacacacacacacacacacacacacacacaggcugucagaguuucacguugagguuauuuguuaaggauguguucacuuugucccaucuggaaaugaaacauacucguuuuaagugguuagagggcuuugagcacaguagucuucccaccacuuuucuguggcuuucuugugcccuuguucagagagaacucuuuucuuuuuccaggacagugaguaccuguagaacagcagcuaagcugcaguuguaaaggcugcaugcuguuguugcacaucuccgagggcaugccaucuuaccguagugugaguuuccauccugcagugagaucagggacuggaagcacagaguggaggagcaguagcucuuaagccagugguugggccgaggucaagcccagcucaguguaacuagucuaaacucugccguuuaccaaaugcaaggaguagaaccuguuucugcagcccgagaaugaaacggcuugguauuuguaaagcacugugucugccucauguugaacacuccgugcuaugauuccugugggaagugaauuucuuuccuucuguguugggcaaucacauuuagggucuugaguaguuggcuauacuuucagcagccuuaguagccacuuauuuguuaagucauuuuuauuuaauugguuacuaaaucugugaauuuauaagugucauguacauugaaaguuuuuguuguaucucuuaauuugaaauuguaauacugcuuuuaguugaaaggucuagucaaaagcuagguucaaauuauuuuacuuaaacaguuguugcaaguugacggagaccagugggcguuuacucucauacgucaucuuuauuuucuaauacugaacauuuugagcuacuuuauuuccucccuagaguacugacguagcucaccgugcuagcucauugcuaacucacugagucauuuacuaauagugaacuguuaaagacuacucucauuuauaauaaaagugcagggugggggggaagugcaguagccauaggaaauauauuggaauagcuauuuugaagaaauacaguaaaaugaaaguggguggccucugucuuuauguaagccagucugaacuaagauacuguuaguugguguuggcuagcuuucccuacucacaagugauuacugugcacaguuuuaauauuuuuuucuccuguuaccuugaggcaucauugccucuuuuacuuagaucuaagggacaaacacaaacuucagagacuuacaaagaaugcagcagugaaucuucugcacaacauugccaugucaaauauuaauaagaauaugugccuggccauaauagcucacaaaauugaggaagacauaacaaauuauaaagaauucucuuauuaccuuuuggauagaagaauuaagauugcaagaugguuuuggaaaaaacugaauccgaucaggaagcuggaccucuggauagaaugaaccuuacauaagaaguugcuugauguuuaauuuucaaagacuugucagaaucagaaucauauacguuacaaaauaauguacaguuaucuucugucagcagccugcuaguuuacguuugcccuuuacaaugcacgugagugaaagaaagaaugacuuuugcacgcuguccucuggcuuccacacucaaagcacagcaucugagcacaagcgcaguguucaacacacacaugcacacucacucaauauuuuuuuaauuucugaaguagauuuuguaagaauaguggugugagcacgccuuuaaucccagcacuugggaggcagaggcagguggauuucugaguuugaggccagccuggucuacagagugaguuccaggacagccagggcuauacagagaaacccugucuaaaagaauaguggugugugguaauuaaugauguugguuuugucugccucuuaggcacugcacaugacuggagguuacgguguggugcuguggacuuguacuucacgcuguuuggccucagcagaccgucuugcuuacccuugccagagcucgggcuuguucuuaaccuaaaagagaagaaagcugucuugaauccuaccauuauuccagaagcuggaguaggcaaccaggagucugcgaguaacccaggcugccacgcucagcuagcuggauuccagaacccugugaguguccccagcacaaaagacaaagccucacuuugugcgcaugcagcacuauccaagaagacaaagccuucugcaacucagucacuucucuagccucaggccauggccagucuaaccccaacucacguaaacaaugugcucccgucgacuugugugaugaugucaggcucuuuaggccccuagaauuucuccugugccugguacagagccaguuacacaucaggcugccuggucuguguguauggagaccgugucuuuaaguugcugguaaaugguuuugagugaaaaucaagacuggaggaguaaucugaugaugggaggagaugguccauuccauuccauuuuauacgauuuuuauauuugugggguuugccuucagaaagccuuuucuuccuagcucugcacuguagauucccagacucuguaaaaagaacaugcguaaagcauuucacuauaaaaagaauguuccagaaaugauuuucaugacgcggugucugugccuguguuuugagcaguauccaggcagacuguucuccuggccauugucuacuggucugucuacccuugaaccucagguccccuuuacgauuuaccugaaguuaucugggauauucucacauuugcuguaaaugcagagucuguccuaaggugggaauuggagcuuauaauccuuacccccaucuugguugguuguaguuuucaaaacaaggcuucuccauguagcccuggcugucuuggaacuuguuuuguaaaccagaguagccucaaacucagaaaucacuuacuucugccucccaagugcuaggauuaaaggugugaacuaccgugccuggcucacagaagcacuuuaucugaucagcugccuuuggaggcuggaccaccuaauuuuuguuuuaguaccuuuggaagacaagacacugcuuuucuuuuggcgacuguaaugggucuauucuuuggccucucuuccacuguccuuaaagauaauaucugaacauaaggugaugcugcgucucucuguccuuuugugccugcacuaguuuucaaguucucaggaugaggaggagguugacauggauacuguucaugacagucaagccuucaucucccaucaucugaacaugcucgaaaggccguccacuccagguaagcacacggccuugggggaggugggcaguguucacauauaaucguucuaaggucuguuacuugauuuuuagacgagcaaguguaacauugagaaaccaauauaaacuucuugaaauguaucaguguaauuuauauugacaaaauaauaaauuguagaaaguacuuuuuggaaguuuggccagauggcucaguggguaaaggcauugguugugcaaaccugucgcucugaguucagucccugccacccuguaauggugaaaagaaaaaaccaaccuccgcaaguucccugacuuccaucuguguacuguggcauacuugcauacacacgcacacacacacacuaaugaaauuaacaaguaguacuuauuguguacuauugguucucuacauagugaguucccggccagccagagcuauagagugaggccuugucucacccucccccuaaaaaauuuggauuuguguaagacauuugucauaacaaaauacuuuauuuacucucuuuuuuccccccuuuuguuuuuuugagacaggagacaggguuucuuuguauaguucagcuguccuggaacuagcucuguagaccaggcuagccuggaacucacagagagccaccugccucugccucccuagugcugggaugaaaggcuuaaacuccaccacccagcuuuauuuacucuuaauaauaggacuguaguuacauuuaauauaguuuucuuuuuuuuuuaaaacuagugucaguguuuuccauaaugccaccuuuuuuuuuuuugcucuguuccauauaauuugauaucacagauuuccuuguauuuauuucucaacgaccauauuuuuuguugguuguaccauuuaguaauaacaaaaaaauaauauacuuaaguccauuucauucuguuuugugugugugugcagguguguauguauguguucaugugugggugcacacaaguauauggagaucacaauugugggugucauucuucagccacuguccaucuuuuguugagacagugagcuuccagggauuaauucugccauucuggaggcagagguaaguggaucucugaguuaaaggccagucuggucauuagaaaaaguuccaggacagccaggacuacauagacaaacccugucucaaaaaacaggugcucaugugugugucccucccccaucccuccuccccaaaaauccuaauccuggccuguacuuuuuaaaugaauggucuuuauguucccuucauugauauguuuuacuggcccucuguaucucuuaaugcauuuuggcuggaagucuacauaaucagaugucacaagagcuauaccagucuguuuuaagccuguuugcgugcuagagugauuucuacacucugauucucagucggagugucugcuagugagcuguguuucuuggcucuaaauuuucugguccagucuuccuuaccuuuaauauauauauuucuauucaccccguggccuuuuggcauccccuuuccuuucucucugaaccuuuuguuuccugcuuuguccuccaguggcuagcuaaugacacuccugcucaagcaacuguuaaugcaguuaccacaggaagagauggggccguacagauaccucuaugcaugaugggaagugugcagaugucucuaccugcugcuguucaugguuacaacagcagugauucaggauauucuugaucuuacauucucucugcccucuuuucugugaugucccugcaucucaguggagugaagggauggaaacacucuuguuauaaagcugagccgccuucugucauuuauucuuagcgcuuugggcauaugugagucuacauucauuagagccuuuucacucugcugagagccacaguggucuuagaacaagcauguguguuuagaaggcaguuugacuuguucaucaaugguaguguguucccugcuugggccaaugcccucccagcaauaggcuuugaccagguuugaccagguaucaaguguggauucccucccgugaagccagccaucguaagcagucgcagagacacuuggucaucccacagcuagcugugccacucuugccccaguggauuuaccuagugggucaguauuguagcucccaccaugcugcagcugugagagaagacagaugaguuguagccugcaucgcaccuuuccugcacuguaaagacucucuguaagcagagagggaguuuccaguucaguucugucuucauuucuuuguauucuguaaccgaaguguaugcuguguucaguagaaaggccuuaacaucucauucugggagguaagcuagaccagugacaauaggcuguauuuuuuuuccaaagauuuauuuuuauuauuguuauuagugugugugugugugugugugugggguaagugucuucugaaagucugaagaacauuccuuugaguuugaguuacagaauuugcgagccgcuuagcaugggugcuuggaacugaacacagguccuuuggaagcacagcaaaugcuuuuaagugcugagccauccuucauccucauggccuuuccuuuucaggguguccgcagccucuguagcaaacaaugcaugggaaggugugcugcaccucacacugggguuaagcucaugacuucuaggagagcguugacaacccuugaauuucuucugucuauaguauuccuuuaauuuggacaucaugaguugucuuggguuggcauguuuugaaauaucuguuucucuuauuaauuaaaacaucuuuauugacuuuagcagccuugauuagcaguuauuuauuuucaggacgugaguguaucuuuccaugcuuuucuggcucuuaggguuguagaugagggaccuguuguuauuugguguguuuaucuuucuaaauauguugcuguauuaucccuuacaaaggauuuuuuuuuaaucauuuacuuuugaaugcuacaucuuauguaucacaagcuggccuugaacuugcuguguagcuucuucuccuccuuccuuuaccuccuaaauccuggaauuauaaauguucaguacacaugacuaguuuuguacuggcugggcauuaaaccuaggacuucauccauucuaagcaaacacucugacaacugaccugcauuuccaguuccuuuagagcuuucagggucugcccucugcucuggguuuuuaaaauuuucacuguuacauaucauggagagguucuucuccacucaugucuaguugaacuucuaaaugccucuuguguuuggaugucuguuauuguagauuugagauuucugucuuugucguuuagucucaguucuucuagcuuguggauagauauucuuuuuagguuuuaucucuuaaucauaugccaggguucuuagaaauuuuagucaugccguuuugccuuauugguuauuuuauuuauuaguauuugaauucaguauuguguguguguguguguguguguguguaugcauaccuuaguacacauaugcaaguuguaggacaacuuguagaagucaguucuugagcuggaaagaugacucagugguuaagagcacugacugcucuuccagaaguucugaguucaauucccagcaaccacaugguggcucacaaccaucuauaaugggaucugaugcccucuucuggugcgucugaaaacagcuacaguguccucauaaauaaaucauuuuuuaaaaaaauugaaggaggaggaggaagaagaagaaaagagggaggaagaggaggaggaggaggagaaaacaaguagucauuguccucucccuucaccauguggucucagguuuuuaggcucugcagcaggaccuuuccugcugcucauuccucugcuugguuaaucuguuguuaguuaaaacaucaccguaguuuuuauuuaauucacuuuuugucguuuccaacuuuuuuucucaaaucuuaauuucuuuccuggauuuuuucuacacugcugccuuuuuuuaaauccauauuccuaucuuuuuuuuuuuuuuuuuuuuuuuuuuuuuuuaccaacucucuugucugggcugcugaguuucuccaucuaugugaucauaacgauuuaaggcugcucaucgugauuaugaguuagcguuuuggguauuucacagugucuugaguugaggaguuaggaacuuugggaggacuuauguugccucgcguuccauauuucuuuggaaacguguugcaguguaugccucugcuguucugggcacuucugguuuuauuauugaucagccuacucuugaguguucaaucucugcugccacucagaacaaaaagccaacugcugaaccccuaacaacagauguugaagacaaaaggcacagagcacacauaaagcugcugauaacuggugagcucggagaggaagaugggaaacucucaugcuacuguucccaaguuugugcauaagcuugggacuagaaucugacauggauucgauuauccuguuuuauguuauaccauuaauucuacuucuuguuuuaaauggguuuguaacaucuuuuuaaauauauucaguaaguuuaacaauugaaauguuuuuuaggaaacuuugcaaacuguaugcaaaugccaaauaaauaguaauauagaugaagugacuuguguagcagaguguaggcccuaauuuaaguguucagcaagucuuucaagugugaauuuucucugaggcaacaggucaaaggauuaaauuaauauuguauuccauuuaugauuagacuuuuacuagaguuaaacuauuucugguuuuaaagcuaacaugugaaaccuguuaaacuuuuuucugcuguuaggaaacaaagaacuguauuugcccuuuuugaucuuuuagggcucucuaaguaccggccguccggcuccagauccuccuuaaugccccagcauucauuaggcugugacaucacaccacccacaaaaccccaguggaguauggagcugucccgaaagggagcagguacacuugcuuguguuuguuuguuuugucucaagaaaauuacauuuagaguuaauuuaucaauuaaaaaauacugggaagauggagaacuuaguuuucuugcaauauauugguuuuauauuauguaauuuaaagacuauuucagauuaguguuuaucuguuucagaaguuuguguuucuguuaauaggaaauuuauaaauaacaaaaaauaaugaaaaguauucuuuauuauguuguuguaauuagcuacuguaauaaugaaaucacucgcucuuuccuuauagucggaaguuaaguguaaaccucagauccugucacugcaccuucacgcaauccacaaauaaaucacccagagcccagucaggauugcuguuccauucacgaaaaugcagugcuagaccuguacuuagaguauuucauacaggauugucaagauggcuuucugggaaagauggguucugccaagcccgacagcugaguuugauccucagaucccacaugauggaaggagagaguugaacacacacaaacacacacacacacacacacacacacagaccgagacugaagauggcuuucugggaaagauggguucugccaagcccgacagcugaguuugauggguucugccaagcccgacagcugaguuugauccucagaucccacaugauggaaggagagaguugaacacacacaaacacacacacacacacacacacacacacacacacaccccgagaccacacacacacacacacacacacacacacacacacacacaccccgagcacacacacacacacacacacacacacacacacacacaccccgagcacacacacacacacacacacacacacacacaccccgagcacacacacacacacacacaccccgagcacacgcacacacacaccacacacacacacacaccccgagaccgagaccgagaaaguuuccauugacuaggcuugcuuaaguaguuccgcccagcuguacuuauucaugcauuuuacacggucuccucaguuccuauuguuuuauuccuaagucucaggucuuauuguguuccucaguuacuaaucaagcaaagaugagaauccaaauaaauagcaccugucagaugcuaugagcuaccaggaaaccaagaugacgguuuccaggcguuuaaggaaagaauuacgagagaaagccacauagugaugucacuugugaagacugggguuuccaaagucaucaguaacccuugagcagcuauggcuaugggcuuaugccuccguggcuggaucuugcuuugauacagaagaguaaugcuuauccaugugaggaaggagcucagggaccaacugugauuaauaaguagacuucagccaaaagcaacagcucagaauacuucaguguuaagaacacagaucauugucugccaaaagcuuuuugugagguguguguguaccuuuauuguaguagauucacacaauauguuucagaaggaauccagcugggacuuggccuuguauuuccaugagugaagggcuugggggauuaauucuuuggcuccuucucccauuuucuccuuccucacuucucucaccucucuuuuugcccuuucccuccuuacuccuucgugugugugugugcgugugugcgugugcgcgcacgugugugugcauuuugaauuucaaauauagcuuuucccuaacacauugauacacuggaaaaaagguaacugugugaaacauaagaaaagcucuuugauagacuacaaauaagcaauagaaguaccuuccuuucucauuuggacuuuuauuuauuugcaugaaugugugugcacguaugucacagugcacauggagagggcaguuucagccuuggugguaagcaucaucaacugcugagccauucugcugggcccagggaguaaaguuucacuccuaacuggugugacaguauuccuguaggagcaucacucacaaaucaccuuuugggaucaaguaaguuagagguggccaugugugggagugagauuggucuguggcugaguuaggguccugagagaaagagaagagugguaagggaagcuguggccucccuuccauuugcaaacucgagaggaaggagcacacgugggcuuuggggggacauguccagcugaggucucuuucauucaugcucgcuaaaacguauggaaauguuugcucuaguugacuccaaacggagagauggcauauaaaaucuaguagacuugcagcucuuuucgaagugcuuaagugaaacuccuucagcaggguugcucuacucgugugcuguuuccucggguuccgagcuguugagugugggucccuugcuuccucugcucacaaagugaagcgacaucucauaugucuuaaugacuuagagccaaggacccagaugauauucaagaacagaaauguguuacaaaccucaucuaggagagauagaaacaaacgaugccgcucuaagggagcugaaggagagaggcuuauuuuguuaguagaggacagugaugauguacuuuuaacgccuccuacacacacacacacacaccacacacacacacgugcacauuugaaacacacacagcuccagguacacacacacacacacacacacaccccgaggccugcagcgggcccccccacccccugcauucucccucuucuuguguaugaggguaaaaaagauguguuaaaugcguaugauuuugugcaggugguagggcaggcugugggauaaccaaggagaggugugaaaauggucccuucacccacucccuuucccugccccugucccgaaggaaggaagagaauaggcaggaagggcccagugguucugagagagacagguuugagcaucauagaucucccucccagcacugagcccccuuucuuccacugcaagguugcaggcaucaggacugucuccuggguuuauuuagugauggcaagaaugagaaacagagggcuagggggugaugguggagcagaugaaacucccuagugauuucuggggggaagaggggagucuugcagcugccuugcucaggcugcuggguuauguaaugccuucuugcauaauucagaaaauacaacucuaguucuugaaaucuuacuuugaaauuaaaacaauuuguuuuucaaagcuuguaugcuuucccuagagaucuuuuuuuggaacucaagaugaaaaacagacuuuuuuuuuuuuuaaucuuuagauuacaaugauguauuucaacaucuuauuuuucuauuuaaucuaaagaaccaaagagcagaauucaugucuuuucuaacaaacuauagacuuuguauugaauaugaacguauaccuaauauaaaugaagucaauaaaauuaacagauuguucaguguuucuuacauguucuuauuagauggacuguugagcuugcaaguuaggcuuuuauuaaguacauuuguuuguuucagaucuguuauauugacuacagcuuguuuguuuaacaugauuuuacauugggcagaacaauugggaauaucuuuugcauaacacaaaugaacaucuuacaggauuuugaauuaugugugucucgaucucugaaauagagaagguguuucaaaucacuaaagggguuuugacgagccgagcccauccuccucgguccucugcccaugagaguguauuugugacaucagugcccacaggaagcccacagcaguccuuuugaugguuaccuuuuaaauuuauacucccgucuauagcuucucucccuccccuuugccauauauguucgucacauuuuuaucuguaguuauuaguuguuaacacaauugaguuccuugugacuuuuguguauuacagucccgucuagacacguaauuggaggcaggugugcugguacuguguaucuucauuuggaaguaccaguagccaguugacucuuuuugcaagguuaacuauugugguuagucaggaucuagaugcauuaacucauuguggauuacaaaguaauguuauucuaauuaaucuuuccauuuuuauuuauaggauguauuguuucucuaaagcuaaauucccuuuuacuauuacucauugguaugagccauauaggaaagucuagauaaaugccuaauucucucuguauuuaauaauuuuuaaaaacaaugaguuuauugaccacauauuuuaauggugaucaguucagaguauuuauuauccaggauuaguauuggaauuguuguaucuuugaacaucuuuaaaggcugccuccugagucaguuaggcaagacugaguuccuuguuguuguaucgaaugcuucaggcucauccuauaaauauucugacucaaacuggacucagugcuuugucacaggaaccauugauucugcuacccagguucuuaaagcuacuuaacuuccuguguucucauaaaagucaagcaaaauuuaagauguguaggcaggguauccuauucugagcaauggggccugcagguaaggaugaauucaucuucaaagugguuguagguauucugggaaagagucagccauuuggucuuugccucugcucagaagcacaacuuccaggauaagcauucacuuuucugaaauccuagcaccucggccaguguuuaggacugaugaugagaccugugcagcucaggacugagacucugacaagugcagauagucagcuaguuaguguaggcaguugcuaaacaguggaugcugcaugaccggccaugagcugggagcucaguugcucauuugucuuuagcauuguuucuuuuuccuguuaccuggcuagguuuugugagauaugagucugguuuucuauacuucuagcuugaggaacauauuuaaggcauuuaagauggaaauuaagaucauauaauagcacguucuguuacaguuccuuggucaacagguuauuagaacugaaggaugccuuugggacauugagucaguuuuuagucauaauacaguacauauuagaggcuaaccagacagugugaucgagaacacaggcucccaaguuucaguuucugucuuuucuacugauguuacuguugucuuuaggaacauuugcgcucacagccucugcacuuccugggucuuuacugugugcucugagucuuccagaagaguuuaccucuaccuauuuauuccuagaaaccaucuaaggaacuaaagaaacauuuaauuuucacuaagauaccuuuaucaauaacuaacauaguauauuugugucugaauacuuuucuaagugacccaauaaagacugcccucuucucagggcagagaaguauuugaaggaguucuauuuucauuggccaguauagauuuuaguauauagcacaaaguaagugauuguuaaaucauauuacuuacaaaauauuaacauucaaaggcugguuugcuaauacauuagcacauuacaauuuuuuauaggccagauggaccuaaaauaguugacuucuguccaaugcuggcagugcuguuguuagcugcuguguacccaugagucugucaucagcuuccucugaggaaagcuguccuuccuuaccaucgacagaaacucauuccguguuuuuaucccgaagguaaagagcagccuuuggagaugggugugcauuccaugguggcagccccgcucuccauguuugcuaaggaggcucugucaucgcgacacagcgagcaccaucaccaccaucaccaugagcacaagaagaagaagaagaagcacaagcacaaacacaagcacaagcacaagcacgacagcaaggacaaggacagggagcccuucgccuucuccagcccugccagcggcaggucugugcgcucccccucacucucagacugaagccugguccucuguggagacacaagcagggaguguggagagacugcagaggaugucuauuuguaugccugagguuuauauaggaaugaguguauuggcucuggaugaauguuccccccaccccagucccccccauucuuccugaaaacagaggaugacuuuuauaaaagccuuccuguccacugcaggcccauucagaugcuggucuccuguggacccacaaagucagguaugcuugaaagccuuugauggaugucagaggcagaaggaccuuuucaacagaaacaacugccagaucugugggacccagcgguuccaugaagugcugaauaccgccacuuggaauugcuggagaggcuguuguguaggacucaaucccucgacugcuuuuuguguuagccauugaaacugaacaccgucauuuaugagcaaagagucuuauauuucuuuuuacccuaaaguacaaaaaguuuugaaagaaauuauuuuuuaaaaaauuuaaaguaacuaucuuuugguaguacauuuggugauuaugauguugcaauguagcagaugcaacauuauucuccagucaagauguuuaaauuauguuuuguuuugucuuccauuaagugcaagugaauguguucauauguaaaauaucucuugcugaauguggacaguuuacacacuuaacacauauucuuucuaaaauuacucuguacauaauaagccaggcaugguugugcaugccuguaauuccagcaguugggaagucggaggaucauucaaggccagcccgagauacaugagaaucugugucaaaaaagcaaagugacaaacguuacucugucuaacaaaacaugauacucugaaagggugucuuuauuugcuguuugcgagcuuggauauagauaauuuggcccacacuggaguauaccagcaacaguuuaaaauacaugugccaugcuuugguuucguauuuuaaaaguuuguaugguuuuauguuuugguuuugauuuuagguuuuugguuuucugaauuuaccagguucuguguuaaaaaauauuuucauaucuauucaguuuuauuauuucuuuuguuacuaaauauuugacucauuucuugaucucagaauaaauauuucaaaggggauccaaaaaugcuggacuuuuaaauauacuuuuaguuauauuuaacuuguuuaauaaauaacuuuuuaaguuggacagu

SEQ ID NO: 7755 - RNA, 1695 nt, Mus musculus
acacacauauuuaaucgaguuguugugguccaacuguuccaaccaugacuguuuuaugacagcuaaagaauccaauagauguuugguucaugagacugccugcuucagcugguccucaguauaugccaggaucccuaagaagcgggcucuaagacauguggagggauggauuugccagcaagagugagggcaaccaggcaaacacagauagcuuccuucuuccauguucuuuauguacacugaaaccaguaggcccagacuuaagguggcucuucagucaacaaaaaucccucauaguuguaccugggaguuuagguuuuaguuaauuccagaugcaaucagguucccuucccuuccccuccccuuccuucuuuucuccucuccucgacucaccucgccuuccucccuuaucccuucuucuccccuccccucccugucccucucuucuucucuucauuauuucucaauuccuuacucuccccucauuuuacaguccugaggaucaaaccuuggaguuuguacaugcagccauuuagcuauacucucagcccccgaacagcauucugacucccuacacugauaauagagaacaaaaugauacuaucuuggcccaaaguaucauucaguaaguggcugcugauugucccuguuaccauuaucaucaacaucugcaucaucagaugccucucugggaaugguucuuguaucuuuaaccucacccaguucugaucuuaauaucuuacccuacaugaccuaugcaaacucacaaucacuccucccucucccuccacaccugacaccugacagauaucaagaucuccugggagacagugcccuggacaugccuguggguuauuaucuggggauuaauugagguaggaagacccacccacuauggguagcaccguuccguucguugcuggaauccuggacaguagaagaaaaggaguucagcacgguguucaucucgcucuuucugaccgggugcgauauaaccagcggcuccccgcuccagcugacacgauuucuccaucaccaaggccccuccccuugcacugggagccaaaauaaaccgaacccuuccuuaaguugcuuuuguucaaguaguuuaucacagcaacaaacaaguacccugcucaggcuguuuuuucaaccuggcguuuuuuuguuuguuuguuuguuuguuuuuguuuuuuguuuuuguuuuuuuuuucuguguagcccuggcuguccuggaacucacucuguagaccaagcuggccucgaacucagaaauccgccugccucugccucccaagugcugggauuaaaggccuguggccaccaccuccuggcucuaccugacguuucuuguugcuggaauuggaaauagccggaaagcuuuacaaugaaguguuacauuuugauuucucaccuauuaucuuggcgaaaguuacuuugaauccuuuuuccucuucucauccccaucuucucuuccuuugugccaacuaaacaauuauaaccguauccaaacucagagccuucaaguguuguuuuguucuuguaacaccggcuaauagaauccugugcccuaaaaucaauuuccugcuuucacauccucuuuguagcgucagggcugaggaaguaauuauuuucgcuuaugacucaccguuguguuguuauugcccuuggaaagcuucguauccgaguaccuag

SEQ ID NO: 7756 - RNA, 1695 nt, Mus musculus
cuagguacucggauacgaagcuuuccaagggcaauaacaacacaacggugagucauaagcgaaaauaauuacuuccucagcccugacgcuacaaagaggaugugaaagcaggaaauugauuuuagggcacaggauucuauuagccgguguuacaagaacaaaacaacacuugaaggcucugaguuuggauacgguuauaauuguuuaguuggcacaaaggaagagaagauggggaugagaagaggaaaaaggauucaaaguaacuuucgccaagauaauaggugagaaaucaaaauguaacacuucauuguaaagcuuuccggcuauuuccaauuccagcaacaagaaacgucagguagagccaggaggugguggccacaggccuuuaaucccagcacuugggaggcagaggcaggcggauuucugaguucgaggccagcuuggucuacagagugaguuccaggacagccagggcuacacagaaaaaaaaaacaaaaacaaaaaacaaaaacaaacaaacaaacaaacaaaaaaacgccagguugaaaaaacagccugagcaggguacuuguuuguugcugugauaaacuacuugaacaaaagcaacuuaaggaaggguucgguuuauuuuggcucccagugcaaggggaggggccuuggugauggagaaaucgugucagcuggagcggggagccgcugguuauaucgcacccggucagaaagagcgagaugaacaccgugcugaacuccuuuucuucuacuguccaggauuccagcaacgaacggaacggugcuacccauagugggugggucuuccuaccucaauuaauccccagauaauaacccacaggcauguccagggcacugucucccaggagaucuugauaucugucaggugucagguguggagggagagggaggagugauugugaguuugcauaggucauguaggguaagauauuaagaucagaacugggugagguuaaagauacaagaaccauucccagagaggcaucugaugaugcagauguugaugauaaugguaacagggacaaucagcagccacuuacugaaugauacuuugggccaagauaguaucauuuuguucucuauuaucaguguagggagucagaaugcuguucgggggcugagaguauagcuaaauggcugcauguacaaacuccaagguuugauccucaggacuguaaaaugaggggagaguaaggaauugagaaauaaugaagagaagaagagagggacagggaggggaggggagaagaagggauaagggaggaaggcgaggugagucgaggagaggagaaaagaaggaaggggaggggaagggaagggaaccugauugcaucuggaauuaacuaaaaccuaaacucccagguacaacuaugagggauuuuuguugacugaagagccaccuuaagucugggccuacugguuucaguguacauaaagaacauggaagaaggaagcuaucuguguuugccugguugcccucacucuugcuggcaaauccaucccuccacaugucuuagagcccgcuucuuagggauccuggcauauacugaggaccagcugaagcaggcagucucaugaaccaaacaucuauuggauucuuuagcugucauaaaacagucaugguuggaacaguuggaccacaacaacucgauuaaauaugugugu

SEQ ID NO: 7757 - RNA, 32596 nt, Mus musculus
cgccuuuaaucccagcacuugggaggcagaggcagguggauuucugaguucgaggucuacaaagugaguuccaggacagccagggcuauacagagaaacucugucucagaaaaaaaagaaaaagaaauuugauguuagugauggauguguucugaaugcaaaacaucucccacaggcuccuguguuugaacucuuggucaugaacuaacuauacuguuuggggagguuuugguuaaaauggaaaaaaaucuacuaccuuucauuuuuaagaagaguuguuggaaauagaaucuaggggcuucaguaugcuaagcaugucuucuaucauuaagcuacaucccaucccuaaaguaccucuaaaacuaaaugugcuuuaauccccagauagaauugaucaguacaaagauauucuuuuuuuuuuuuccaagacaggaggaggaggaagacacaagggacagacauccuuucccaaacaugcacaguucccuuucugcacaccagugagugugcaggcuggauuuggccgaggggugcggcuccauuaaucuuuccccccaccccccaccccccacccccgcacuucucugucuuuucaaacagagaagguaagugacuugcuucucuccacaguucugaaaugaagugacucuuagauggacuugucuuaaguaaacuguuuccuuggcaccaagcucuuagaugucuucagagucaccgggcgaggauaaccucagcuccgcaugcuugggagaagccucuagauauuaagacacuucuugcuuacuauuuuagagccagcaauuucuuuuuauggguguuuucuuuuguuugagacaaggucucguaaaguagcucaggcuagauucaaaguaguaacuuccugccucaucuuucugaauguuaguauucuagauagguggcccaauacacagauuaguaaugcuguuuaaaauuaccucccacauuuacacaguguguguguguguguguguguguguguuggggagacacgcacccgcugcagcacauggguagagguacuuacaagaguccauuuuucuccuuauaucauguagauuccugugguuaaaugcaggcagcaugcauggcagccaguccuuuuaaccacugaggcaucuugcaaauucugaugccauauuuaaguuucuaggcuuacacaucauaaacuuugucagauucccuagacuugaacugcuuaagccacagaguuuagaaacgucuucuguuuuaacaccuaucuucagcuguauguucauaguuuaagaauucccaucacugggggcuggagagauggcucagcaguuaagagcaccggcugcucuuccagaagcccugaagucaauuuucagcaaccacaucguggcucacaaccauccauaauggggucugacgcccucugcuggcacacggguguacaugcagauagaacacacauauauuaaguuaauaaaucuuaaaaaaagaaagaauuccaguuauuaaaaugauagagaggccgggcgugauggugcacgccuuuaaucccagcacuugggaggcagagagagaggcagagaggcagaggcagaggcagaggcaggugaauucugaguucgaggccagccuggucuacagagugaguuccaggacagucaggcuacacagagaaacccugucucaaaaaaaaaaaaaaaaaaaaaaaaaaagauagagaggugagcaaucaagacuuuuacaccuuguaguucugacauuuugagucaacucgccguuguggagggcuguucuguaccuugaaggauacguagcagcaucccuagcgguugcuagaagaaaacaauuguaauaacuaaaucuuuucuagacauuauugaagaucucccauuggcaaaaacucacuuccugauagggggaucuuugcuuugaacuuuucaaagucuucuuccuauaaaacaacagaggaaagcacacaggaagauguaaaauccucugaaggaaaggauaggucucccuggugcuacacuucguuguguuaccugcuugguguucaucugacucgccaaagcaaaagcaaaagcuccaugaagcuccccaauccuuucugggugcugugucucagcuacaucaccaagcccacagcacaugucccaucaaagcaaaucacaccaacccacaaaacugugucacugcaucuauaaugagucuucucuucguuccucuguuaauccauuuuggaaacacccucacagauacaucaagagguuugucuccuagguaagucuaaauccugacacgcugacagugaagauuagacauugcagcacuaaauaaauagauuuuuuuccugcagucucugucaaguaguaggcaucuuaguggguuaaauagauagauuagacuggguuuguggucuguaucauccuucccccaucugcgucucuaaaauaaaaaaaaaaaaaaaaauauucucucagggccuguugcuggaaagcaggaaggguuucuucccuguauaagucuucaguggaggucuuaaaggauaacacaggaucacaauuugucaggucagccauggcgaucugagagccucuaugaagaacccauuuuaggucuacuagugggaaaguagaaucuagaguagcuucaaaaugcccugugacagcuaaggaccgguccauagcuggugcugggguguggggaggucggagagcagacagguggaaacacacagcagagccacgugacuccaggccccgccuguugcucaggguugugcagcucuucugacacaaccuggauaaugaugucuugcagucuaggucacucugaccuuguuguuucuccuacguucaaugagcccgaaaaaggacuguaccccuguguuguccauuuccucgacuggcaaccuugcccccauaugcacaacaaccaccauucaguuuccuuuuugucuuuuuuuuuggaugcuagccaggaaacacagccuuuuguauagaugcuggcaauuaggaaaccaucuuaugucuguggagugucauugguugaguagacucuugggaguuuugcuggcguccacccaaagccaucgcuugacuuuucugagugcaguagcuggaccucaucuuuagauuucucuucccucccccaacuuacuuucuucccaaugaguacaugacuuuguugcuauggacaaauaucauuuuuaucuucuuuuuccagcaacuuugauacaagugcaucaaaucuacauaauccccuguauguuuucuuuacccccagcaagucccuuucuuuguccuugaacaacaaggucuuuucccuccuccuaaugagcaguggucucagugagaauucccaacagccaaugcaagaggccaggaauggcugcauaugccaaucacuccagcagaggauugguccagguuuaaagacagccuggcuuauaaagugaacuccaagauggcucuauagcguccaagagacucuguguagaacaaagaagaaaaugacaaacuuuaaagcaugacugguguccauggcuccaggaaaaaggaaauugaaacuauaauauggaaucauuacauauuugcuaaaggggccgauauuuaaaagaggaauaaaaacgagccaucagugauguuuuguaaaaagugauaugaugcagcaggguaaggggacaucacucagugggcccaugcugagcaacgcccugccccagcccaaggcaccagccgcauggcaagucuaguauaaaauaaaguuuauuugggggcaagggaaggcagguugagaaagagguagaggcaaagaaagggggugggggaagagaagaagaaaagaggcuggcugggaacacaugcauagagaggaggggagggagagagagaaagagaacagagagagggagaggggucagagagagaaaacagucagagaacucuagaagcucaacaguccuuuuauagugagccagguuugugccuagcuguugcuagguaacuguugggcggagccuagaagaaccgcuaacauggaacagucuuaucucucauacacuacaaguggcaauacaaaugagcacaaccacuuugcaaagacugccagugcuuuaccuaacagaaccaaaaugcaugcauauucuacuaugcauauucaaaaaugcaugcaagggauacucauggucauccauggacauuuucuagaauauucauuacagugucauucaucacugcuucaaaauggucgcucucagauacuggucaacaacaacaacaacaaaaacaaacauaaaacaacaacugaauugggugcaauggcacauuccuuuaaucuuagcacuugggaggcagaagcaagaagaucucugagaguuugagaccagccugaucuacguagacaauuccaagauaaccaggguuauauagagagccugucucaaacaacaaauugacuuagauucucagaagggcaaacccuaugucagugggaguggguuauaccaaacgaaccucugguaacaguauugcagacaucaccaacagaauguugaagaacaaugugcuaagcgccuuuaaucccagcacuugggaggcagagacagauggauuucuaagguugaggccagccuggucuucggagugaguuccaggacagccagggcuauacagagaaacucugucugaaaacaccacacacacacacacacacacacacacacacacacacacaccaaaagagagaguaagguuauugguccucccuggugauggggaaauaggguuucuugauguagcuguugguccucauguaaguggguucauuuuguaaaaccucauuaaguugugcaacucuaaacaaugcacucccaguguuugugcuuuauggcagcaggggucagguugucuagaagcagacugagauaagcaucuuugcgcauggucauuggggcaggugcucuugagaauacucucuagagagauggaagacuuggguguagaagaggccagaggagcuacacgacaaaggccucagaccauugucccaggagaucuucaggugagaugguucuauaaggucaucuuagagugugcuuuacacauucgcuuuucagcaguaaagucucugauucuuugcuauuccugucaaauuaaucagucauuucuuuuaaguggugcugcuguagggaaggaaaccugaccuugauugugguguuuuucuucagcauaggagaguggacuaaccagaaagaggcucagccuggagccacagguacccccaggagaggggccauagccacugcucuaugcuuuaacaggaaauauaaaaacaaagauucugccaggcagugguagcacacaccuuuaaucccagcauuugggaggcagaggaaggcagauuucugauuuugaggccagccuggucuacagagugaguuccaggacagccagggcuauacagaaaaacaaaacaaaacaaaaaaagaaaagaaaacaaaaaacaaaaaaaaaggaaaacaaaacaaacaaacaaacaaaaaaacaaacaaagauucugauuugaaucaugaaagagagaagaagccuuagaaaggacaaaggaacaagauaggacaugcagugugcacucugccacagacugccaugcaaugaguacaucuacugcugggaccuugucuuguuuuccuaacgcccggcagaagcacacagccacaucucugcguuguguuagcaacuuauugcacaucaaauacaaacaguuagguguuuguucuuagcucuuagaaauguuucugcccuuggcucagccuaaccugauaaacgauaccuauuagaggcccauuauggaauuucuuauaccuauucuggaaccccaaaguaugcuuagugcuuucagcuuuaauauuuccaaagaguggcgccugccaccgaccgcuccuuuguucacugcugugggggggaauaaggcuuaucugcuccaacagggcugagacaguugguuguuuauaagagcuaagucugcuguuuucuggaaggcgcagcuguuggccagaggcucucuuuagcaaacacagcacucgcaguaggagcaagggucuaauugcaaaauauaggugcccaggcuccccucucugccccugggcugaacugccucuccaaggaaggggcgggguuugcccuuacucagcccucacguucacucuuacuccuucccuuuuucuuugaagggaaugcuguacagcgggaaagaaguugcuccaaaggaagaacauugauucagggcgaaaaguagccucuccuuccaucccaggcgccaucauaaaugcucacgaguuccaacagagcggcuggagcaggagccgguggagacggaaccaggagcuuggccaagggaagcucguuucuggcaaaucucccgcccuucgcaaacaauuuucuuuggacgccuuucuuuccuuccuguucccuaaccccuauuuaaaccugaaggugccccaugccuucacagcucuagccguaugugagcaggacuaggcugaguggggcaagaagcacagaaccagaucugucauccuacgucaccaccugcgagcugcuuuguggcuuauggagccggucuugggaugauuguuuccagaagagcauucugucuaggugacgaaaggacccagaagccuggggaaagcagagugguacuuggggugucacuugauggacaaucacauuauguugagacccuguguucaaucuguaguaccuacgucccuguccaaagaaaagagagcugcagaucuacagcagucauugauauguuucguaaaaugagguaugauacagcgggaggggggugccuuagcgagcccaugcugaggcaucccccaccccaaguaccagccauaagacgggucuaguguaaaaugaaguuuauuugggcgcgugagaagggggcgggguaagaaggaaauagaccagagagaggagaaagaagggaaggggcuggaacgggguggggagguagggagggagggggagagagagggggggggccagaaaaggggggcggggaguuucagucuuuuuauaacuagccaggcuccuaccuggccguugcuagguaacuguugggcggggccuagaagaaaagaagaaaugcuaacagucauggucuuaucucuuucccagcgaguccuuccuguaacagucuuuaguuccagcacugccuguggacuuggcugcaggugcucuauuaaaaagccgccucgcccggcaugguggcgcacgccuuuaaucccagcacuugggaggcagaggcaggcgaauuucugaguuugaggccagccuggucuacagagugaguuccaggacagcccggacugcacagagaaacccugucucggaaaaaaaaaaaaagccaucucaguggacaguugugggguggcuucccagaacugccuuucucuuuggcaaaauguuccuugaaauuauuggcauucuuguuucacagugugcaugugccuccacacuggagggauaugugcgugaccuacagugagcuggugguaggaaucucuugucacagagaucuucccaguaaccccaguaacgucguaugguguaagccagacuacuagaaauucacaagcaaggcaugucacaccaaagcuaauggaacagugucuuuccauuaugauggguaagcugaaagaaucugaaccuucugacagaugugguguguguacuuuaacuaaauaaaaucaccucaagauacauaaaagagaaaaaaaagggagaguaaauauauauacucacauauauauacauauauuuggagagagagaagagagagagaauguuaaugugugggagcuggagagagaccccagcccugagggacaccauuccuucagaaaaccuggguucaauucccagcccucacauggaaacucacaaccaucuaaacuucaguugcagggaaucuggucccucugcugaccuuagcagugcccaggcaugcacaugggacucacacacacacacacggaagaaaaaacucauaaaauaaaagacauaagucuaauuuaaaaaaaaaaaaguuuauguguguuucagguguguguagaguacacacaugugaguguggacacaaacacauaauucugaauguagaggccagaggucaacauuagguuuuuccccuggauugcugugcaccuuauuuuuccagauagggucgcccacugaaccuggaguucugugagucagcuagaccagccaacgggaaggaucagucgccccuggcccucccagcucuacaucacagccacacccuagccaacgggaaggaucagucgccccuggcccucccagcucuggaguuauagguacacaucacagccacacccagcuuacgugagugguguggaucugacuucagguccugugugugcauggcaggcauuuuaaggacagagucaccaccucacuccucagccucaguccuuuucuuuuacgaaguauuauagaugacauuuugauauuuauuguuuugcagugcugacaaucaaauccaggauuucaggguuauacuuuagugagugagcuucagccccacugaaaacuuuaauauugugaccacacacacacacaccuuguuuccuaacacaugaugagcagaccuuccauauagcauaggcaaccccagcuuaaucaauagcaggucccuccuccaguaucagaaaugucccaggugggugauacauuacugaucauuauuuguauuucgaugugacuauaauaaaaacaauaaaaucaguucucuuaaguuuuucuuugcuucuuuuuucuuuuaaauauauauuuuuuuaauuuauuuuuaaaguuuuguauauguguauucagaguagaugaccaaaaucauauacaaugaagaaggacauguccuaagucaguuauaaaaccagcuaguuugugugucuaucacugaaggcagagugagcucguuuauuaacaucucugagcugaaugcucaaggcugaagguaagguugccgaucuuccuagagucgcaagucugaacccuuggagugagaagggaguuaguuuuuauaggccauguuucuguauugcauaauagcagcaggugaagguagagagcuagugcccauaggaauuaaucugaaauuuuaugacgcuuucacuuccugccuggcuucuauccaccaauguuacuuucuuagccaaugucacauugaagucagauuccaaacuacuccugugacucguuacucagcuuggaucccuuuccuuccccuuccucucaagauuaauguauauucaucguucaaaaucucggacacuagccgggcuugguggcgcaugccuuuaaacccagcacacgggaggcagaggcaggcggauuucugaguucgaggccagccuggucuacaaagugagugccaggacagccagggcuacacagagaaacccugccucgaaaaaccaaaaaaaaaaaaaaaaaaaaaaaucucgacaccaagcaguguguauacaggaggaggcugagaggaggcugagguuaacacugggaacuggccucccucauuugcuccccaucuuacuuuugugacaguuucccacugaacggggagcucccugaguuacuuaggcugcuagccagugaguaccaaggggcugucugcuucuguuuuacacaguccuggggauacagugagugucacugugcccagauaauuuuuuuucccugcccugagugcugcagaucugaacucaggucuuaacacucacgcggcaagcacuugugcuggcuaagccgucucuccagcuacaaaauaauggaaucuauaauaacacuuucauauaggcaugcaacauccuuugacuaccuucucuuguucucucucucccuuccacuggccuccuacuacgucccaaacagccuccaucugcuuuccugucacugucuagucuagauggcacguucgagagccuuuccaugaugucaauuucauggcucuauagucugcuuugcucucauccuuuggcuucugacugcgugaucuauuuucacaguucggugcagcucacaguugcuucuucacugccucugaggcucugcaucauccuucauccaaaaacuccucaguuaauauuuaauucagccuguuuugucucccgagaccuugugccuuagcacugacccuuccagaagacuccuuugcgguuucucucaaagcugcuggaaaauacaguuccugcagaaggacacacuugauuugcaucucagcucugccacggucaccguguaaccccggguucaccucuaagccggaggaugcucuauggcuuuccaaaacuucuuccacucagcucugcugacuuauuacuugggugaaucuucuacuucacuggggcuauagugguaaaaugugcuagauucaauuuucagcacugaacgacaaacaaaaaagaauuaacugccgugugugugugugugugugugugugugugugcgcgcgugugcgcgcgcgcgccgugcacacucuucucuuuaauauuauuaugccaacaugaacuauaauaacaaaaauucccaacucucagugacuugauucauaagaguucccuucugcuuagcagagccuaggguacgggggugcucucuuccaccgaugacucagcacggaucuaaacuccacccacucacuacguggcuccucuaccacagaauucuuccccuugcccagccccauauaagcagagagagggagaaugagaucuuacaggauaauugguguguguguguguucaugagugugcagauucauguuuguucagguucauguguguccagaugcacauguaugcauauuuguguguggguuaaagaucaaccucugauuucacuccucaagaauuaucuaccuaguauuucaagaucaucuucauuggaaccuggccccacaaauugggcuaaucuggcuggccacugagcccuggaugcuucugucucugacucccuaguacugggauaacaagcaucugccaccagacuuagcucuuuuauuuuuuuuaauuuuuaaguagauagguguuuaucacauaaaguaaaaauagaggguuuuaagaguagaggugagaagauuguugcucuccaaaagauucauuaaaauuucuuuguuuuccuucuuguuguuguuaaaccuuuacuuuuagaaaauuacaaagcaaaaaaagaaagaaagaaagaaagaaagaaagaaagaaagaaagaaagaaaggaaagaagaaagaaagaaagaaagaaagaaagaaagaaagaaagaaagaaagaaagaaagaaagaaaggaaaagaaaauuacaaagcaaaaguuuuuccauauuaauaagauaugcugagggucaggagaaauggcacagugguuaagaacacugacugcucuuccagagguccugccuucaauucccagaaaccacaugguagcucacaacuaucuguaaugggaucuaauguacucuucuggugugucugaagacagcuaauaaacaaacaaacaaacaaauaugcugagaauuuuucacuaauuaauuaauuuacauccaaauauaagcuuccccucccuccucuccucccaggccccuccccucaccccuccccuuaccccuccccuuaccccucccuccuuuucuucucagagaaguggagaccuccuaugaauaucaaugccccuuagcacaucaaguugcaguaggacuaggugcaucuucuccuacugaggcuaggcaaggcaguccagguaucagacagggguccaaaggcaggcaacagagucagagacagccucuucuccugcugauagaggucccacaugaggaccaagcuguacaucugaucuauaugugugaggagacuagaucaaucccaugcaugcucucugaugggcaguucaguuucugugagccccuaugacccaaauuaguugguccuguaggguaucuugugguguccuugaccucucuugcucaccucaucuuucuuccccuucuuucaagagaauucccugaacuccaucucauguuuggcucugcgucucugcauuuguuuccaucagcuacugggugaagucucucagaugacaguuaugcuaggguccugucugcaagcauagcagaauaucauuaauaaugucucuuugcccaugagauugggccagucauugguugggccaacuucuguuccaucuuuauuucuacacaucuuguaggcaggaauaauugugggucaaagguuuuauggcuggauuggugucucuaucccaccauuggaagucuugucugguuacaggugguagccauuuuagguucuguauccccuauugcuaugaaucucagcuagggucacccacauagaguccuaggaguuuccauuguccugcauuucuaguucagaugaucacagaaacuuauccccuacccccuacacauauugauuccaguucucucucccucugcccucuccacacuugauccuuccccuucucuucccauucccucuucugcucagcuccauuucuucauccaugcugcccccacccaugucuauuuuauuuccccuucucagugagauucaaacauucucccuuuggcccuccuuguuacuuagcuucuuugggucuguggauuguaccauguuuauccuguacuuuauggcuaauaccacuuauaagcaaauacauaccauguuugucuuucuguguguggcuuaugucauucaagaugaucuuuucuagacccauccauuuaccuacaaauuucaugaugugauucuuuuuaauagcugaguaguauuccacguuguaaauguaucauauuuucuuuauccauucuuugguugaagggcaucuagauuguuuccagcuucuggcuauuauaaauaaggcuucuaugaauauaguugagcaagugucuuagugagauauuggugcaucuuuuggguauauguuuaggagugguagagcuaggucuugugguagaacuauuuccaauauucuaagaaaaggccaaauugauuuccaaagugguuguacaaguuugaacuccuaucagcaauugagaaguguucccuugcuccacauccuugccaacaugagccauuugcuuacucagccuuuuccaugggaaucaaacucaggucgcuccuccuuguguggcaagaacagaacccaucugagccaucuccucagcccucauaggauauuuuuauagauagcuuuguauauacaauuucuauucacucaccguuugccagaagugaaucucauuugcccaccuccaugcacacaaaggagaggcaugggugcuuagacaguauuggugagcagacaacuaggcagugagccacaguuucaucacagucaaugugcacugagaauaaaacugcauaaugcuaucaucuguuuauguuuuuucuuuuaacacagaguuccacuaaguagccaaguuggcccuuaaccuaaccuucugacugcaucuaaccccuaagugccaagguuacaaacaugggccacucuauccaguuuacaaauuauauuaacaaguaaaugauacuguacuguaagcauuuuauguggguuaucucaucugauuuaauuuuguagcaguuuaguuguaagacucaggggagcuuuagcuuacaggggaccucgugagugaaccacaugaagccaggaucgaugcaaagagcaagaggaauuuauuguuccagugcacugggguuaucacagacccgaaagagagguggcaaaccccggcaccaguucagcgaguuuuuauaugguuuccaggggcagaacagagcaucagcaauuagguacaauaugauugguggaacagugcgcccuuuaaacugauuggucuuuagggaaugaggugacaaagacuucccuugucugaaggugggcaauggucaguccugaggaaugugucaccacccacagguccauucccacccuguggucugagaaaugcuaauuagccucucccugccagagcgguguuucaugaccuucccaaaguuccuaugcugaccucuucaaagugacauuuuguaaggauuaagcaaggcaaacguggacguggccaguuuacagcucauggcuggcacauuccacagacacuggaccuguggugagguagaacaccuaacuauggccaggauggagagagagccagacaugguagcucaugccuguaaccccagcauuuggcaaacugaagcaggaggaucacugugaauuugaggcuggcuuggacuacauaguaaguucaaggucggccuccacucuagcaagacccugucucaaaagaaaacaaagaaaaauaucuaugggugguaguaugcaucugugaccuuaguaugugggagguagaggcaggaggauuacaaguucaagaucgccugcugcagcauaaauuggaggccacccugcacuaugugaaaaccugucucaaaaauaaggugauaauaccaaaaacagacagcaagaguguugguuaauguacugcuaagcuccucccagggaccuaggccagcgggcaggugugagccaaguggcaguaaaaguauaacaaaguaaaaacaaaauucuaggccuuuaggcccaggcuagggaauguagccuuugugaagguaugcuaaucauaaaacagauagcgacauuccuccacugaccugcuuccuggguucaaagaguguucauucagagaaagucacccugaccauugcuggaaccugcuaugcaaaugugcuauuguuaggggcucuuagaaacugucuugagaaacaacccucacaauuaccagguauuccuagugacucuuguaacuuuacacuuccuugugacucuuaacugguauuuuugguauuuuccaacaaugcccuucccaccuccuugaguugugguuucuuccuuuaaauacccccuuauccagcuacucgggcgccacgguccucuaccccugcgugguguaugaccgugggccugagagugcucuuaaauaaaaauccucuugcaguuugcagcaagaccauuucuugugggugauuuuggggugucgccucuccugagucagagcgugggggagucaucacguugugggucuuucagcagcaguggauaaggaggaccccagcccucuucuucucucauuauuucucucuguguucccauguguuccaggcccgccucucuuucugacauccucuguccccccuuucucugccuccaccccuuuuccagagcccugcuccccucucuucccacaauaaacugcucuuuuauaguagacuuuucaaauggcaacuagcaacccauccuuuaaugcaggagcuucuggaagcauuuuagauuacaacccguacagaaaauaauuaaaaaaaaaaaaaaaaaaaaaaaaagaggaacgucccaucauaucauaccagcauaucagguugaguuugccagagucuucaauuagaagaccaaacaaccaucuuacaggcuauuggaaagcauaaagauaggcaugccuaaaaucugacuuaacagcucgguaccauugauguaauaugggugcugccauguucugucuacccucccuuucccuggaaagcauuuuccacuggucuagacaguuuggcugaauguccaguucagguugauccccagcccgugagccugcccucugcacagccuucugcugcccaggucuugcccuuugcucuaauucuuguccacugucuuucgaguucugauccagccucuguaccgggcuucugcagcgaagcuuucguuacacaucugccuccuguuacucccagucacccagaggauggaugcugaagaggcugccagaagcugauaaggaaccauaacagauuuugacugaaaauggggaaggaaaggcuuaaaaaaaaaagggacaaagucaguugguggucaaggacaacaagaggcagggagaaggaaagggaaauagucuugcauucuaauuuccagucugcaugaauuuguuuucaaaccacucauguggauaaaugcucccaccaaguucucuccaucauugugauggggacucuugauacagcuucuccacaugucgcucuguaagacugagaauccagugacaccuggccaagaaagagcaccacagucccgauuccccaguggauuuggguguaaaccuuuguaaugugggcagguaggacuccaguggauggcaccuuaggggaacuugcguaagcuucauacaccauggcacgguugcauugauccaaggucagggagugaguagcccaccaugaggagcugcgaauauugacacugcacagaaagccaugccaccuuugaaucugguucuguuuuucaucuagucaaaggauguacaagagagcuucuuuucagagaaagaagggaagaaaugucccaccaaaaaggcucuuauugaagaagcuguaggaaucuguuuucaucuuguaguaaaauuuccccuggggcgucaggguuaggagcaagacgagauuccgucaggcccaugaggggcagucucuguucauacaagcuguggccucuguuccuacagagcccuuccauugucugaccccagaaagccugcuggacaaaccaaugugugcuuuguuucuggacugacuugcuuucauuuuaagaaguuuacgucaucccgagucacucguggugaaguugaugugcuuagagauauuuccaaagagugaggagggcacuuuagcacaugguugaaacugacugacaauguguacauuccugugacccugucauagagucacaacuggcgucagggaauccucuaacaacugcaugcauuguguugaguugaggauguuggugugcaaagacacugaggguuucuaauaaucaaagacuucuuuuagagccucuuuuuccuuuuuuuuuuuuaauuuuuaauuuuuuuuuagggggcgaugggugggggugggacagugucuauguaacccuggcaguccuagaacuugcgauguagaccaggcuggccuagagcucacagcggccaccugccucugccuccccagugcuguaauuaaaggcaugggcuaccacaccuacaacuuuuuuuuucuugauacaacuuugccauaauucauaaaauaaauguucagaaguccaucaacacacuuuaucuagaugaaaaccaaggcauucuucuuugugacuuugauuuuauguacacaaaguaaggccaacucaagaaucaagaauuugucaggaaugaaagggcaguggcaacucucaccgccagccuaaaugaaaagugccuugucuucuuuuuauuuuuuucccauuuuuuaaaagauguauuuauuuauuauauguaaguacacuguagcugucuucagacacuccagaagagggcaucagauuucgguacggaugguugugagccaccaugugguugcaagccuuccuugauguugucaaccucucugucauguuuguuuauuuguuuguuuuaaagugcacuguagcuaucuuuagacacaccagaagagggcaucagaucccauuacagaugguugugagccaccaugugguugcugggaauugaacucaggaccucuggaagagcagucagugcucuuaaccgcugagccaucucucccagcuucccucugaccuguuuuaacacagacuuuugcuuuuaccagaacaguuguaccugguuggggggaggggggagggggaaucacaaagcagguagagaugaagacagagguaagauugagcugaaguauugcugagagaggccuuagguuucuuuggaucacacucaugaggcaaauacaacaaugaugcgcauaaacccucagcaagaguaguggcugcugcuguguuccauggaaaagcucuagcagccucaggguuugccucucuuucuauuccgguucgaggaucaaguguccgguuucaacaaaucacuuugcccuuuaccucuguauuuuuguuaugagcucaacuugauuuuucucugaccaccaaggucccaguugcaccaccagaugucagccuugaccuugcuggugccuucaggaggcucugaggaaauuagagacacaggagucugccuccaggaaugacucaaagggaacucucauagaggagagccagaaacagcaucggcggcaaaaccuccgaggcuacagacugcuacaaacuuggagcaaacgugugugugugugugugugugugugauauacuuuauugaacaaaccucuaucauguggccacuguaagcugggguuuagccauuuccuugauucauuuccuaaacugaagcuuuguaaggaggcuagaaaaaauaaauauguuuuaaagagacucuuaggucucucaaugugucaguuaggcuauucaaaccauagauccccaagaaauagaaaucacccuaggaaucucauacuggaaggaggaaacagcuccaggggagccagacgugagaauuugucucccuccccaaagauuucccauagcuuacaggacgacagugaagcccagacuauucugggugggcggggcuaugcauccacuguuacugcuuagaugugcaugacaauggccagcugucuaaacucuaaucucuucucauucaggaucccaaagaguugggagggcgcugagucucuuugucuuucuccugcaguugccuaauugaggaaggagaagguagcugaacugucugguacuucaagguuuccuuguuuguuuguuuguuuguuuguuucccaccagcuugguuucagacccaggacuuggaacuaaggaguauauuuacauaucaaagcagaccuggccuccagguucacccagccucccuuggucuuuaagaggcauccccugcacaccaaucuugaacuuuccagcccaggggcagggcugacuuuucccuagcggcucuucccuauaaaauucagacuccagaggguggggaggaggagccagggaucagaaacagcagcauuguggguagguagcgacccaccccuauaaucccagcugucaggaggcugaggcaggagggaugaguuuauagacaguguagggucaguaagacccugucucuaaaacauaaauuuaaaaauuuaaaacguguuuugcucuccaggaacaagucuuauucuagauuuuucuuccccauuaagugcauaccaugaccuugugcucuuggcccuugcccauaaacugggaauuuuaugaguacuuauaauggaauuguuguaaaccuuccauagaaaacauuuagcaaagcauauauuuagacugcaauaaauacucuauguuauuucaugugcaaguguggggcuugaggcccugugcaagcugaacaaguuuccuagcacugaacuauacccacugccccagcauuuaccuacuacugcucgguucuucuuuuuucuuuucuuuuucuuguuuuuguuuuguguuguuuugguuuugguuuuaagauguauuuauuuuauauaugugaguaagcuguugcagucuucagguacaccagaagagggcgucagaucccauuaccgaugguugugagccaccaugugguugcugggauuuggacucaggaccucuggaagagcagucauucuuuucuuuuuauuggcagcggcuggcuaugugucccaggcugcucucaaauuccugagccuccucccucagcuuccugaguguuaggugggugucacuagguuugguuucuauuggcugauagguuauuucuccacuggugaaaugagcccauucaagccagauuagauuauauacaggcagguuuauugaaaagcugcucuaggguccaaagccaucauggggagagagaaguggggagcggggagagaaagaaagggcaugcacuggcugcagagagaggagagggagggagaggaagaaagggagggagggagggagagagagaucucugugggaagagcagcccagcaccugggauggaacguucaggguugggggguaggauagacgaaguagggacugagggaugcugggagaaccuggagacgagcuaugcuuugauauguaaaauauguccucaguuccuuaucccggggugggggcagggagucagaaaccacaccuuggcuauuucuaagaauguuucucugaccucaaaaugacuaccugaaccagcaaauauauaagguguccagugaaaaaucuuaaaauguucuguuaaguuugcugcuuccuccucuuguggacccagccaggagagugugccugacaagaaacaggcaaagaagccucuaagugaauaaauaggaaagggacuggacuauucgguacuugugauacacuugugauaugaagaaaccaaacaaauguuaaugaaguaagaugggccccugcguucuagaaccuucuaccaugucgggcauguaaagugcuaguuuucacaguggaugcagcucauagugguggugagaaaaaucugcaaacacaagcguuccuugugucccucaacucacugacaggccuccgcagccucccauguuccucagagcuagcuguguuuguuuaugucggucucugcuguuacauaucggaucugggacuuuuccugcuuaauauuuaacuugccccgggguuccugugccacacagcucauggacuagcaggguugaguuuaaggacuccguguuugcugucuuagccugcacugccgcagaaacacagauuuuuuuuuucuuuuuucuauuuuuaaucaggucuuguucugugucagccacccguaccuaaacaaggucgauauaaaaguuacagcaaauuagacaaagcccaggcuauccgaugcuccgcccagucagacuggaccgccaggugccacucuccaccuucauuaagcccuuguuaggaaucuuuguggacccaagcauagcagacuuccagaaaugggcuuaauauuuaaccccaagggagcaaagaacaauaaacaugaaauaaagucucacgaagcuacaaaagagucacgcagggaaaaacugucaaguccugggaggaaggagaggagaccuuguaaggucuugaccuaacgcguccuuauucugcuggguguuuugauagauguucccagcaagcagcagccggcgcuuuuacuaucugaccacagaaagccugugugaacagaagcgcugggagguggugugccuuacgucaucccagcacgaaucuccaacaccucuagacuaguccgcccccgacgaaugaugucucaacuaagaugugcucaggacaagccgcuucucuguaaucaaaacugaaucuccaacauauccggagaguguagcugugggauauaccauacugcagcuguacacaugucaaucacuuuauugcuucccuaacaggcuguaaaaacucuuuggaaucugauagggcaggaccuagauacugcuaucuagccuuguguggcaaugauuuuacguggaauguuuaagcacgcacuuagugugugcauaugcuguuuaugugugggugcacauaugucacaaugcagguguauauagaggucagaggacaacuugugguccccugguuuucuccugcuacuaaguggguuuuuauaggggcuuaaauucauucaccaaggucaguaguaauaaauuauuucucuacacuggacaaguaagucgauucaaaacauuaaaauauguauaaauguaaguuuauugggaaggggcucccuggugguugaguucauggccccaagggaaaaggcgggauagucaucaugggaacggacacagaggggaggggaaaaagaaagagagaaagcauguguauagagagaaggaaagggggaagacagaagaggagggggucggaggccaaaaggucugauuauauagggaagagccucagggggaagggcagcccagccccugggcuggaaaguucaggguugggggagggauaugcaggguugggacugaggaauguugggagagccugaaggcgaggucugcuuugauauguaaaaauauuaugcaucucagucccuugucccugggucugaagacaaacaguuaguaaggcucuuuaccugcugagcuaucucaccagcccuacauuuuaaguuuugaugguuauacuugguuaguuauuucuacauaauuuaaacauuuagcugauuaagauuuuaauuuaggcagauguggugguggccuggcucuaaucccacaguauguggcccgcugaagaagcuggagggucaggaguucaaagucaucuucagccuccuaucaguuuuuaggcuagccugggccacauuaagaaccuguguauauaagaaacaaaacaaaccagcacaaacaaccaggggcugaagagaugacucagcucuuuagaguacuggcugcucuuagagaggacccagguucauuucccagcauccacaggguggcucugaacuccaccuggugggucuguaacuccaguuccagggagaugcaaugccuucuuugaucucucugggcaucagucaagcaugugaugcagacagaacauuuauacacauaaaauaaacauuuaagaucugaaauaagagaaaacaauuauaaaaauuuuauagcuauuuuauuugcuuucuuauauucuacccccucccuuccaacccuuauucccucuauaccccaauaccagguaggauagaaagguuagucuagaaaugagguguaggucucuuuaaacuacuuccuacuggauaggaacauugaguuccuuggaggaaaguccaaucuuugucuaguuaggaaauguccaauuucuucuuaucuuuuuuuuucucuagaccaucaacaacagcaggagcaggaaccaucaggagaaacagucacacacacacacacacacacacacacacacacacacacacacaccccuccuucaaaguucccucucagggcuguggccuuuauacucuuuccauauuccuccuaggaauuauacuaucagcagccggcagaaucauaccccagccagagcaggcaugagacaauuagucugcugcuguggacaaucagaagcagccccauauuccacuccugggguuaagacaaaagcauguucauauaagauaauaaaauucucacuucagagccgggcgugguggcgcaugccuuuaaucccagcacuugggaggcagaggcagguggauugcugaguucgaggccaaccuggucuacaaagugaguuccaggacagccagggcuacacagagaaacccugucucgaaaaaacaaaaacaaaaacaaaaacaaaaauucucacuucagaaauaaguauaccaaaaauaccaagaugauuugccaaguccugcauagccuuguggaagggucagcauggagcagagcuggucaugggcuuccaugaguguugcugguugcuaggcguaagguaaggcuuguuuguauaauaauguauuacacuucauguuccuccuucgggaaauauucucccugucaagguccaugauaauuagaaacagcaggaguccaagaguuaagggugucuaaagauccucagacaugguaaauacugugaccuuuaggacagcccuuaagacugugggaaagaacucugaaaacaugaguucaugaauguauagcuuuucaacuguacaaaauauaaggaugcaauaugaaauguauaaggggcuucauggaccuaaaagaacaaaggcagcugcauuaaugaaccagcuugucaggaagauacaaaggcaggcagauuucugaguucaaggucagccuaggacagaacaaguuuaugcccaggcuuggugaggaugggauuuuacccagcuaaauuuauuguuugugugcacaaagguaggcagaucucuaaacucauuugcuauguuuaaaaacaaaacaaaacaaaacaaaacuugcugucucuuucuaaggaucaagaggcuaaggucauaaaaugcugauuugugggauaguuaaaagggaaccuggguaaaugacuaaauguguaaauaaaagacugggcuuugugcuucgaaagcuacccagagagaauuguuuggagagcaaacauagcucuuuuugaauuuuucuagcagaacuccucacuuuggucagaaaaaccaagagcuauccaguuauuacuauucuuuacgauuuuuuuuuuuuaaaaucaggauuucugacuuuaguuggaaaacccaaaaacuauccuagagaucuguuacagcucuuuuagcauuuuucuagcaggauuucugacuuuggucagaaagcccaagagcagaggucaaaauuagguuuuauucuuugacccguccagcagguccaguuauucgagggucucgaggggaccuucuccuaagaaccaaaugggggguagagagagacgagggucuugugcgaauaacgacacggaaacguucugaauugcaucaagaccccacuguauugagaaaggcccaaggcuuaaaugcacaagcaaaaggggaaguacagguacuuaucagcaggaggguuggggcaauacaagcaaaaggagaaguacuuauaagugggaggggggcaauagaaauuuuuucuuuuggcagcuacaaggggaagcaggaacuuggugguaucaggguguggucaggacaucggugaugauuuagggcuggaacauucuguggcuguucucggaauggugugucgguggcccgcuuuugacccccauuucuucuuggggguggggguggggggagaagcccaauucagagaucaggacaauuguguugucucaauggcucccaacaauucuucaggauccauccaucuuguuauuaagaaggccucucacuuggcuggaaacuagccacacaaaccaggcuggcuggccagggcgccccaggagucugccugccucaucuucacaguaauaagcuuacagacaugugccacugugcccaacuuuuuacauuugcuccuguguucaagcucaaguccugacccuuauaugacaaagaaccuuaccaaguaagcaccauuccucaacccaaaaccuucucuguguucuaaaaaucucagcuucaaacuaaauugaagucucugaaagauacaacacaacacaaacacacaaacaaugccuaggcagcagccuaagucuacagcucuguucccaggacauuuggaaagccuguugacaggagaauagauaauucaugaccaggaaaauguauaaauuugugaggaaaaaaaaucucuggguauaaaaaucugagaagaaauaaugcaaugccagguaaaaaucuaguaaaccccagaaaaauuauaaugaacucaaugacccuacuguaaagaucuuaaaaaacaaaaccacuaagaacaaaauagcugaagaagaauggcaauuuccacaucaucacuguauguucuuuggcaggggaaggggggggauauaaauguaaacugcuagaauaauacaacaaacuaaaacaagacaaaaaaaagaaaaaaagaaaaaugaccaacaguguggacaacugucagcauucuugaguugggcagugcuauauagcauucugccacuucuuuucuguuuuuccuuuucucuuuugacaggcucgcugguaacucauguuggccucgaagucauggcaaacuuccuaaucagcuucagcuuccuggaauacaggcaggagccaugucuggucccaugauuucauauuuccccaucaguggagaaaagacuucuaggagacagacaguucuauaguugaccacugaaggauuagacaguggaugcagagacaugccuucaguguuccuagggcccacauucuaugccuaauacccaaguccucaguaagauuucuugagugaaugagugaaugaaguagauuaaugacagcaaaaucuaaugucuuuugauugacaucucaauauacaucugaaaagauacucucuccuacacuuguacguaauuccccaacacagaauuauauauuuaucaauugauagaaaaauucauaagaaauuagaagcacaggguaacccccuuccaacaaugaccuucaugaucugaaguuuccuaagaaagauaaaagcuuccccaaacugacugaguagaauuucauuucuguagagcuagaauauugcugauucaaggccaaaauuauccuggguguucccaucaguagccauuuaucaucuaucuauaucugaucuuccacacuuuuguaaagaaaaaaaaaacugcuuacuuugugugugugaguguuuuguuugcacagcagaagagcuuauuggauccuaugggacuacaguuguagaugguuguaagccaacauguguaugguagaauugaacucaggaccacugaagaagagccaaugcucuuaacuccugagccaucucucuggcuccuggucuuccauucuuuuaacuuuuaguuaacauuugcggggacuagagagauggugcagagguuaagaguacuggcuguucuucuagagguuuugaguucaauucacagcaaucauuuauaaugagaucugguucucucuucuggccugcaggagaugcacacaugcagcagaacacuguauacaugaguaaauacaucuuuaaaaaauuguggaugccacuagauugacucugagacccuuaguauacaguucccugcuuugcuguaacugccugucugauaaccacauugagguaccuaaaggcacugucuuaggacuuuuuuaaaaaaauauuuauuuugugaaccugagugcgcgcgcgcgcgugcgcacacaguguauguguuugcaacacugcuauagguaccugcagaguccagaugacgacuugggaucccuagaacuacaguaacgggugcuugugagcuggccaacaugguuguugggaacugaauuagaugucucugcaacggcagcaaguacuugcaaccacugacccaucucuccagccuccccugccucuuguuuugugacaagcccauguaaccccuugccacugugaaacaugucauuugggucaacuuaacucccacguccuggauaaugucacucaugacuugauaagcauagauucuccuauucacuuuggagaacagaucugcgcuuugucgaguccucugcauagagaggcagugcuuuggcaccaaguaaguauggaggcaacuuuucuaaugcaguuuuccaggcagaagacacucagaaacuaucacugagcauacccauaaagaaacuugguuacucuugcaaguaagacagaaucccaugcguuuucucuauucagucagaagaucacuuugagccgggcgugguggcgcacacgccuuuaaucccagcacucgggaggcagaggcaggcggauuucugaguucgaggccagucuggucuacaaagugaguuccaggacagccagggcuauacagagaaacccugucucgaaaaaccaaaacaaaacaaaacaaaaaaaaaaaaccaaaaaaacaagaucacguugaugugaauaaaaaauggccaguuuguuuucaaagagagaaaaagucagcacuugguaauuuuuaaaaauguaacauuuauuucaugcuacuguguuuucauacaaucaucuuaaguauuaugguacaguuuuauuaaagauagcaaaucacacucaagaaauuuuaaaauaaagccauauauuaaguacuuuuaaacuuauuuaacaauacuauaugcgaucuuugacggcaaacuucauuuuggcauacagcucauuuguccuuuugguucugcagugaagaaauaugcaucauaccugaaguucagguggcaggaaaucauuauuaaugucaaucaucaauuucaaccagucagaaacaccacagugcucuggaguuauucugaucauuuauagucaaaguaaaacagaauucauagcagccagagucaguaccaaggguucaaaauuggccuugaaguugacuaucuccacaauacauuugaaaggaaagauuuggaaacucaggaaauccauuugaauagaaagcagugauauucuuaaccuggugucuguccuuccaaagcagaggcaccugucacgugaucuauaaagucagccacaccucaucuaggcaaagauggcugaucuuccucacauucccuuccauuucucaaugaauuuccuuauuaugucuuuuggguaucacauguagcccaggcuagccuuagauguggugauccuucugucucugcagugcuucgauuagaggugugagauacuagaccuaauaaauuaguuuuuagauagggucucuguguauagccaggauagccucaaauuccauucuccagcacgaaucuuugugcugugagccacccugcccaguuguaauuaaacuucagaaggcagaaacaguaaaaaagauaaugcaguuuucauuuuaauaaaaaaaaagcccuucuaauucauauacuguguuaaugaagaaacaaaaaacaaaaucugucuuucuaucaucaaaacauaaacaccacacacaaacaaaaaaaagagucuagaauuucuuaucuaguuuuguuuuugagacaaagucucuguaguccaggcuggccucucaccacaacucuccugucuccacuuccugaauacugggauuauaggugugagccuucuugccuggcuuugaaaauacauuuuauaagggaacaaggaagaauauguccaagaugcgcaguuaaauguuaucucaggcagugaauaaguaaauaccguuuccucuuugaagaucacagacacaaauccacaugaagaccaaacucauuuaaacaggcaugguagcucgggccuauaauucaaguccucaggaggcugaagcaggaggauggcuaugaauuuaagacuagccugugcuauacuagaaguuccuggccaacuuggaauacauacagaauaagaccuugguauuugaaacaaauaacaauagcagaugauccucccccuucucuucaaagaucccugaugccacuuuugaguccacagugccauaaaccuguuucagcugaaugacuuuaucccacagaagaaucuacugugacagggauggaaggcaagagacucaaggaauucggccaagcugcacaagucuggguauaguccaagauuguuuuaugccucauucacuaaucaaugagaugauuaaacuguguucuacccagcccaagcagcacugacauuuuaggacccauggacuuggaagguuuuguuauaaaccagccuucagguacaucucacucccauccaauggcuggguaagaauuugauucgagagucuaaagcguucaauaacugcauuaaacuaauaauggcuccucuguauuuauuuuuagagaauuaaaauuggccacagauucuaugcaggucuucucauaaaagguacugcuuauuucucuguuccuggacucugggcugguuuuauuuauuaacccauuuucaaguauuuauucacuuuaauuauauguauauggauguuuugcauuauaucuauauuuguguaccaugugcgccccugguacccaagaagaucagaagagggugucagaucuugugccacuagagcaauggacuguugugagccauuauguaauuuuaggaagcaaacucaaguccucuggaagagcaaucuaggcucuuugccacugugcucucucuccagcuagcuguuugaauugaagaaagucaaaguguuucguuucugagcuacagaagagaagguugcagguugucucuagauugucuggaacuacacgaccuggaacuguggcuuggagugguuugcaugaggccaucuguguuagacggauuucucucacuauaacaagauaccugugguaauuaccugauaaagagaaaaggguuauuuuuggcucacaguuuuugagauuuuaguccauaacugauuggccccauucgguacuaacucaccagugaggcaugugauaagucaggacacuguguaggagcaaauggucaaaccaaaugacuugucucagggccaagaaauaaaugaugaaaaaaagcuggggucccacagucccaccaggggcaaacuccccaggucccugcaguucucucaucagguccuaccacuucuucguuugcaucuuugaggcaauauuuuauguggucucagacuugcuuuguuaccaaggaugucagugaauuccugauccuccugccuccuccacccaccgagugcugaaauguguggcugguucuaccuugucccaguguugccacccuagugaaaagaacuuauuaacacaugggacuuugggagacagacauucaagaaucaaaugacagcagcuuccaagaacaaaaggccuccgacaacuagcucaccgaauacaaacguguguguagaccuccuggcaccuuuggagcagugguuggucacaucagccaaaugcugacaacccucagagucgugagcaaauaaaaggagcuauugugugauauaguuuggggguugcccaucagacaacaguaaguagcuaauguacuauuuugggcaaggaacaggugaaggcuagacuuuggguaccaaacaguccucgaucugcagaugcugagcgucuacugagggagacaggcaugugaccaagcaaggacauucuaaaagugacugugcucuaauagagguuuggaugggauuuauuggucuguaggaauuuggagaauuuaaaauaggaacaucuuuggggauguggcaaagauuucucuaagaugacacacacacacacccaaaggagcuaauaaaaauaaucggggggagggggugggcacaaagagggagaaguaacauucuaaaaauaagauagcacauaugcaaauacugaaugaguccaacagggcucuaggggaccacgaguauuuauuaauuauuuuaugaggcuguguguguuugcauguggaggaaggagcgagggagagaaagagagagagagagacagagagagagagagagacagacagacagacagagagagaaagaaagauuaauuccccgagguaggaagauuaguaugaguuugaggacagccuaugcuacacagcaauagcuuuuuaauuuuuuuuuuuuuauuuuuugguuuuuugagauaagauuucucuguguagcccuggguguccuagaacaagcucuguagaccaggcuggccucuaacucacagagaucugccucuaccugucucugccuccagagggcuaggguuaaaggugugcacuaugaccaccaacacccuaucuuuuuuuuuuuuuuuuuuuuuuuuuuuuguaccuuguuuguucucaguuuccuugucuaugaaaagaggacguguguagguaacagugcccaaaaugaguuaggagagcacaucaugguggcgaaggauuauccucaugggguuaagaaagggagacucgccggguguguugguacacaccuuuaaucccagcacucgggaggcagaggcuggcggauuucugaguucgaggccagcuggucuacaaagugaguuccaggacagccaggguuacagagaaaccaugucucgaaaaacaaacaaacaaaaaauaaaaaagaaagaaagaaagggagacucacugugacuauaucacauccuguagggagacccgccaacugucaccaauacccuaucuuuaaaaaaaaauguucucgcuggugagauggcucagugguuaaagagcauccacuucucuucgggaggucaugaguucaaaucccaccaaccacaugauggcucacaaccaccuguaaugaaaaacaaauaagaaaucuuuaaaaaaaaaaaaaaaguucucagccaggcagugguggugcacaccuucaaucccagcacuugggaggcagaggcagguggaauucugaguuugaugccaacuuggucuacugagugaguuccaggacagccagggauauacagagaaacccugucucgaaaaacagaagaaaaaaaaauauucucuggcacuuggucuuuaaacuggggauaagaagaacccuaagaggucagccaaacuguucuucacucccucucugacagacaggggcuucugagguucugaguuuggcuaaagggaaaugauaggaucuaggguucaaggcaaagggcauuuggaggugagcagcaagaaggauguaguaacccacaaguacuccugcuaucuugacaggcaaggaacaccaaagacagaaacuagcugagauucaucuucuaaggugcuaucgcauccgaauguggggcugugagccuguguuagcccgaguguggggaguguggggaguguggggcugugaguauguaaucuuacuuaggaaguacagaaucaggagcuugacacugucuuaaaaccaaccaaccaaacagacagacagaaauucaagccaugugguaaggccuccuauuuaguagccgggcuguuuugagcauaugacgaaccaacccacuuaggaacagcguucguc

SEQ ID NO: 7758 - RNA, 23662 nt, Mus musculus
cccagagcuuaccgggcuguuugucggugcucuccagggaugucgccucagugccaggcucgaucuccccacccgccacggaucgaaacuucccuucccuccaggugaccagcagcaaguaccgauccauccucuucgcgcccggacucaguguuaggucucaaaagagccgcgcgcaacgugcacuuccgguuuccugccgcucagguuggcugcaaaauaauguccuacgucgguuuucccgccaauuauugugggaaauuauucucucaggagccacacucucugcuccucucauaacgaaaccgcuaccggcggggacccgaguguggcggggaagcagaugagcgcacgcgacggcaguaggaaccuucaugcucgggugucuguguuucccgccggacccguggugcugguuccccggcggggcgggugcaaaguaaaggacgccgcgggucggagagcauguccagcuucucuagggcgccccaggugaguuugcgcguuucgggcaggauagugugcucaguacgcuggcgaaaaugaagagcaguguucacagggauuuagugcagaagcugagcuuucagggaagcugacacccguacccaagaaaugcuuuaggagucacuuaccagaggguugugagucugccuaccacuugauaucuuuguuuuggcuccuuucucuccucagucugccccuuucgugucuuuuguuccuugcggaaagagagcuaaagugaaauaauagguugaaugacguggggcaguaaaaaccacuaaaagauguuuauuuuuguuuaguacaguaggggagggggaagggaagguguggagcuguagcugauguagcguagcaugccuggguuccauccccaacaccgcauaaaccuggaauuauggugcacgcauguuauccuagcacuugggagguggagggagaaagauccgaaguucaaggccagccuucuccgauacuuagugagcuugaagucaagccugcgcugcuuaagacuguuuauaaagaaugaagaccuguuguagaguuuugaccuagaagucuuaggcaucagaaggaucaagcaagcacucaagccgccagguggaagauaaacuguucacagaugggagaucuuugaagggcuaaagggagaauucaguuagaauucuauuuuaguguaccacacaaaauacucauuuuacaagucaggcugaaacauuggaguucuaagaaguccacaauauauauuaaagauuugaauguggguguaaagagaaacaagaauaacuuuuaagaauucugguuugggcaaccggaaggcugacucauagggaauacugaaacugaagcagauucuagauagaagagaaagaauuaguuucugauauguuaauccaagacaacuccuagccuaacacuacuugaaguacauuuccuuuaaauguaguuguuaccugucuauaaucagguaaauaacagaugugaauauuuaaaacuuugacagcaaguugacauguggcaguauuucuauuauuuaucaagcuuuuuuaaaguauuaguucacauggaaugugguaaacuugucuuuugcguaugcauaggcuaguuuaaaauuuaggauaacuaauaugaaaccacaagcuuauaaguguauuuuucuagcauauaauccuuguguauaugcauaugaaaguaccuggacaagaucuuucuggaauagagauaauuuccuuaguuuggaggcauugaagacagugauuuuaucagaugaccuaaagaugucuuggaagacaggccuguaauaccagcuauucuagagaaugaaguggggauaguuguaauuucaagccuuuggcggguacagggugaacucgaggcuaagcugaguaacuuggugagacucuugucucaaaagcaugaaagggguuagugaugggucucagugguagagugcuugccugguuucucaguucucacacacacauagacauacugaaucuaagcuauacugcucugauugcauaguuguguuuagcucuccuagaacugaguucuugaauaaucuucaguuggcaguuggccacucagcuuucuguguaacaugccuuacuaucuuaaugccauaacaagaaaagaccucagaacugguaauggaaacaaauuacacacccacacaaacuagugauagucuguuuuucaaaguaauugcuggcauuaguuauagaauacccauaauaguguauaguaaugguuuuaauuguuuccauuuuaacuagaauuuucuuauucucuuuauuuccuagcaaugggccacuuuugcucgaaugugguaucucuuagauggcaaaaugcagcccccuggcaaacuugcgguuauagcauccaacaaacugcaaggauuaaauaaaccaguguaccaucagcugaguaaguacugccuuagauccgucaugggcagccgugcuuuacaacuccagaauaggaacuucaugagguuucacgggacuguguucaagggcuccuuucugcguguauauaaagauucucuauucuauuccuucuggaagaccucaucaggugcuaaacugaauuugaugguguguguguguuuuaaacagucccauuugauacuauuacuaaacaaaaacccaccaguaaccuuacuugcacuccagugcuguccugauuuccacuguaaauugaguuucccuucuuccacuagucucuucucaugacgacaugccuuugaguggagagguuuuaauagauguugccuauuuucuaaaauuuuuccccugggaagguagagccagcuugaugugauaaguugccuuucacucuugaauugaagauuuguuucuguaugcuguuuauaaaauaaacuuuucauucuagaagaguuuugcuuguaggcauuucgacaugaccuuuuacugaggcauuuuccugucauauccaaauuuuccucacacugaaauguggacacauccuagugugcagucuuuggaccucuucucauucauuaaguugcugauuucugccucagaucucuaaaaccuauguguaugauaauacuuccauaugcccgucucuguuuuugaccuguaugcugaacucugaaccuacugucugcucagcauguccucuuggauauccauuagucaucagcccaguuagagacauuauacuccugguuuucccuacccaaaccaacuggccuucucaauuuuccccaucuuaauucauagugucuguguccuuucugauggugugguuugaagucuucucuacuucuguguccugugacucuucuucugugucccuacacccugccuaaacagcaugcugaaucuauaaacuaaagagcagcguuccugcgauccggcaccaucucgccaccccuuccuucuguacuuuuuuggacugcuguucuguacacuauuuuguucauacauaguuucugcacagaaaacuuuaagaaaaaaaaggcuuaguuaucguuuuccaaacaaaagaauaaaacacaaagugggcauguccccugcaggacucauuaauggggcuccugcaccuccuaacauuauucucgccugccccugagcaauccucuguggccugcuguugucuccuuaauuggccugagaagcacaguuuugcuuggguagcuuucacgcacccuucucugucugcauguucuuccccaguccucguugguucuuuccuuugugccuuuuguauuucuggccaguuauuucuguccugaaaagggccuuucuggagcccucucuccaguugcccauucauccuuuacauugccauuuuuuucugaaacagcauuuuagguaucacuuggcaugaacccacguacugucuacuuuucuuugcuaaacuuuaaaaaaacaggaauucuaaguaccuaugauaguguuccacacacaguuuaaaucuaagaaauguuugcauuuaugaauacuaauuaaguagaugaaaagaggaaagaaaaaaaaaaaccuuuccagcuagugccuuggcauuugagcugcuagaguuugaguuugagaucuauggagcuauagcaagaaaaaacguguuucggaugauuggauuuaguuaagagcauggcuuuaucguuuuucucauuuguuaauccuguugcucuuucuucuguaauaaacuuucaguggaguaugagcauaauccauacucugaagucuguguguagaauaugaauguaaggauucugccaugcucgagcacccccugcagugugugguccaggccaaucacucauuaggaguaucauguacaggacaguuuuaaagagaugcuucacagauacaggcaccucuuggucuuccugggagauugguucuauagucacugugacaacuggauuacuaaauauugcacagcacgucaagaagaaaugcaugucacaacauuucuauccacucaauaucuaaccuuguuuuuguggguuucuguaaggaucuuaauacacgcgcaugcacgcacacacacacacacacacacacacacacacacacacacacacgcaugcauauuaauucuuuagcacugagcucuuaacccacaacauuauaacucacuugugaaacuuacuuaauacacauuuaucucuccaagcacaucacaaccuuccuguacuugagaauuacacagcauucuaguaccaaaguugaggggcucuuuaaagacugaaggcacuuaaaaaaacaaaacaaaacaagcacagaggcuacgacagaaaauaaccuccuugguggcauugcuugcauuugagagagaacaaacagcacauugcuuucuguagccaccgcuggcaauauguguaucuaacagcuaagggaauucacaaauaugagcaaugaaaucaacugaauuuugaaagaaagaagcagcagcauuuguaauaaauguaauaaacuuuuaaaaaaaaguuggcagaccaaaaacauauacuuucauagaauugcaaauuuauacaauuuuuuuaugacuugagguauuuaaccugcuucagagguagguaaaaaugcugagagaagaguuuagugauauucucauugcccuucagcucccucaaagcagagcugggacuggaauuugggguccugcuuccuugcauaggaaauucuuauugcuccugugugugguugcuuccuguucauguauuuccuccuuaggaagggaggcaguaaauaguagacagcuucacugguugguccacggagaaacagcaguguuaggaaacuggagguaaauggaaacaagcaccuaauuucuguccccaagguuagcacuuaacagccugcucaguaacuauucuguauguguccuuuagaugcuaccaguacacauucuguuggagcacaagagcagcugcugugacugccuggaggucauccuuucuuaagaauagaaaauagcuuuccuaugacguuggaaacugacuucuucuuuuugcuuguuuggggguuuuuuugguugguugguugguugguuggguuuuuuuguuuuguuuuguucaagacagaguuucucuguauagcccuggcuguccuggaacucacuuuguagaccaggauggccucaaacucagaaaucugccugccucugccucccaacugcugggauuaaaggugugcaccgccaaugccuggaggacauuuccuuuauuuacuuuuuuuuuuuuuuuaagauuuauuuauugguuauauguaaguacacuguagcugucuucagacacuccagaagagggagucagaucuuguuacggaugguugugagccaccaugugguugcugggauuugaacuccagaccuuuggaagagcagucgggugcucuuacccacugagccaucucaccagcccccccuuuauuuacuuuuauguuucaaauguuauccccuuucccggugucccucccucccggaaacacacuaucacauccucccucccccugcuucuaagaggguguucucugcccacccacccacccacucccaccucccugcucuugauuccccuacacuggggcaucuaucaagccuuuguaggaccaaggaccucuccucccauugauacaugacaaggucauccuaugcuacauaugcagcuggagccauguguacuccuuuguugauggcuuagucccugggaguuaguucugggggucugguugguugguguuguucuuccuaugggauugcaaaccccuucagcuccuucagucccuucucuaacuccucuguuagagaccccgcgcucaggccaaugacuggcugcuaacaucugccucuguguuuguaaggcuuugcagcagggcucucgggagacagucauaucaggcuccuuucagcaagcacuucuugacauccacaauagugucuggguuugguaacuguauaugggaugacuccccagaugggacaggcucuggguguccuuuucuuuagucuuugcucuacacuuuaucuccauauuugcuccugugaguauuuuguucuaagaaggaccaaagcacccacacuuuggucuuccuucuuacugagcuucauguggucugugaauuguauccugguuaucuggagcuuuggggcuaguauccacuuaucagugaguguacaccauguguguuguuuugugauuggguucccucacucaggaugauauuuucuaguucuguccauuugccuagggauuucaugaauacauugggaaacugaacuucuucaagauuaaauuccugcuugccucacuguguugaacauguagcuguccaucagcaaagcuucucaugaccacaagaugucgcuacagucaaauuucuaaaucaccagcauucgauaaaugcauugucucuuaagaauuuauuuucaacauuuaguaguuuagcaagcagcuguuaucuagguauuaggaauucauaaucacugcauacaauuuuuagacuucuaaugaugacuauaaaguuggccacuagguaucagacaguaacauaaguaauaauaguugaacugcuugauuugucagacagaccuuacacaugauuuuguuuucucuuucucucucagagcuguguguguguguguguguguguguguauguguguuacuagggaccugggucgcagacaugcuaggcuagcacuauaccucugagauuugacuuuugugggacauuuaggucaaggaggaaaagacagggacucagcagcauauuaucacaguccucacaguaaggguuuaugguaacacagugaccuauggcuauacacagguucauacuagaaaccauguucacaugagguuuuuuuuuuauauuucaccuuucaaaauugaaaguaaaaauaaaagcaaguacuguuuuuuauuguuuuaccaauuuugaauagcaauuuaaaaauauuccucauuccagaucuuaaaaaucuauaaaaccagugcugcacugguugaaggccuuagccucuuggccauaagucaccauacaccauaauccuaagacucuuggguuuagcugaaaaaauaauaucuugagguaggguuugagaggagagggauaaaaaaagcuuuaaacuagaaggaaauauuuacaaacugcacaguuaacaaaagacuugggccuaaacuauauaaagaacuucucaaacagcacuaaaaagcuacugccuaguuauauggugaacggguacacaaaagucuaauacaagccacuaugggaaaugcaaauuaaaaccacaguacacucauaaaaauggugauaaugaguaaacaauggagaaacuauuacucgucucauauugguggaaacaaaaugguacaaauaggaauucugauuuauuuacauuccauacauggauaggaacuguacauuuuuauucaaauguuuaaacuugggccagugaauagcuccaugagugacaaaccuugcuguaucccuggcgaccuugguucaaucucuaggagccugagaaagguggaaggagagaaccacgucuggaagguuggccucugaccucugugugagcuucaaugcacauguguuccugcauucacauacacagaguaacaaccuuuaaaauuugugacuggagauuauaucuaucucauuaacagaaauuuagacaaaagcaaucauacuagugagggcuccagccuucuaucccaguggguucuuuuguauuaguccaugguucacuuagacauaaauauuucaucacagauccauuuuauuuugaaguaauaggaacaagcuuugacgauaaccaaaaaaaaaaaaaaaaagaaucuacaucuuagauguaaaagaacuugcuuucaucuuaauugugguguuuugacuacugccuguccgaagagucuuuuugacuucuguaaacuuuuuaagugacucugaugauuuguacauauuuacagccuuuuuaaaauuccacuauaguacaaaguuaaaaggcuuuccaguuucuccuucucucccuccuuuuacacuaguaaugaaaacugacucgccuucccuaccacccuugaucgaaaauagacaccugucugaaaauuuguguuuagguucauucuuugcguggaaucuuuucaugcaauuuuuggagauuauaguaguauacuaauuuauaguuucuauuuuuugugacauuuaaaauauaguucuagaaucuuuuguugggguuuuuuccuuaguaguagaauagugauuuaagguuucagaucagccagugacgucauacacagugguucauguugaaacuugcauguugccaucucaguuugcuuuucauggacgcaaacuugaagguguuuuuccggaggacacuguugcagugcaugcacuuugguccucaggucaccuguccuguccauuaugguuacagucauugcugagaguaccauuuagguguaauuaguucaguguggcuggaaaacgccucguggccauaguuaagcauaaagccauagugcuccauuguucucuaaaauugaaaagaauaguaaucgauuguaaugucucacauuuguuucuaauucgccuauuggcagaacaugcuucgugcuuuuaugugcagauuguuuucauggucuuugcuauuuguaaaggaaaacuuguaucauccacucaaagguaaauguaauagaaauguuuaaauguaaacauuuuagcacagagauuuaauuaucaaugagaggaauagagggaauaggaauuauaugcccuaaagaaugcauugucaucuuuuaaauuuuucuuuuaccguuuuucuaguguugagauucugcagccagccugccagcucugucugcuuacauggugcuuaacauccagugggacaaauguggucaaggcuguuguguugggauuucauuuuugaguguguuguuagcacuuugguaccuaaauaaucaagccacuuuuuugaguguguaaggcuuugauguuuucauauacagucucugccuuguuucuuuuuaaaccuaggugacuguggagaccacguugucauaauaaacacaagacauauugcauuuucuggaaacaaaugggaacaaaaaguguacuccucacauacuggguaagagaacaccauggcuaaggaacgugguucagauguguagcuuuaaugaugcuguugcccuugguuuaaagggaaaggagaguuuuugaaaagggcaucuaaggaaauacugauuuuccugauguugcguguguagcuuagugaacaaacacagaccaccaccagucaguacacacucgucuuucuccugugauccaucuuauugcucacagugcugucuggacgcugaaaccucacaugggaaugguggcuuuucucuagcucccgucuugucugucuccgucucuccacagagaugcacuuauccagguguucugcggguucccagggacaaugggacucucuccuccaucuucccaguuuaggcuguuguuuauuguaaaauagauuuugccaugucaguauuguggcucguaauguuuacugccagccagaacuccuaagguuuuuucacguguuccaguuaaaucaaguuucuuccuuuuuauauguuuuaauuguguugguccagugguaacagauuagcuggugcaguuuagauuuucucuccaucauuugauuuugagguccugguguugcucucuguguccacuuaaccgauucaggugacggucagaaucuucuuaagccugucucugugcugucauccguuuuauguugaccuuccacucuuuucuuuuaaaaauuguauguguauaaaaauuuugccuccauguaucuauguggcccacuugaguauagugcacaaagaggccaggagagggcgcuggaaccccugaaacugcaguuaugcacaguugucagcugccaacccugauugucacuccugauuaagaucauucauuucugaccacacuuucgccuuugaugucauaguguucuuucccucucuuacccaagugcuuuagauaacuuuauuuuuuaaagccauaauguguccguuugcccccugaaaauaugucccggaaauuuugauacaguuucacagaaauaaacucacgugcaucucuaguaacuucugcuucuggcaaaucccuguaaacugaguucuacaaaacaagaaguaacugggaaagcauuguaaaaaguccugagaacguguguugccuuuaaccaagaugcugugucggucccugcagcgucccacgucuugcugcagaugcagggcagaugcaugaccgcagguggcacagugcaguggugggcagccuguguggggaggacgucagagguaccaccuccucccuggcuggugagaaaucacagugcuuuucaugcugcagcugacagugaugcuuuuuaguguacacugauugcuccccuccaugccugugcaugagugucucccccgacagagugccauucacccucuuucucaagggcuccaguuuauccauuagcccucgucucuugucaacuccuggagugccuucccucuguuccugcugcccaggagaugaucgucuucuguuucucuguuugcuguucgccauaccuguguguacugcucucuuaugcuuuuauguacuguaucauuacucucuauucagaacuuacuuuuagucaaaauuuuuaccauaugugauuuuagaaagugaguuuuuuaaaaggaaugaaauucacuucuuauucaugaccugacauuuuaggauguauauaaguuuaugucuuuuuuuucaguuucauaaaaauuauuuuagucauuauauagcaguguauuauauguucuaccauguuuaauuauucuucuguguuuaaaaugaaacaaaauuuagauauuuacagaguuggguaguaucauuaucuauuggcuuuauaaaauauguaaguucauuuaaaauaauccucuggaaaagaaauuaauuucaagaugaaaggaaugaauaggucuuuugaugggcauuucuggaagcauucuacuacuguagaaacacacacauauauacauauguguguacacacacauauauaauggcuuuuggugacugugggcauaauauuagaaacgauacuaauaaggcuuugaaauguuuauggacaucugauuauuuucguuugcuuaauaguggguuuucuguccuuuuguguuaccuccccucuuuuuguuaagugggguagaacauuauuuauucuuugggguucuuuaagauagacguugaagcccaggccugucuuuagcucauuauguagcugaaucuggcuuugagcugcccauccuccugccucugccugcaagugcugggcguuuagaagugugccucacucccagcuuccuaaccacugcuuaugagcuuuuaaucuauuaggaauuuuaguauauugucauauuuuuguuucuuauuaacuuuaugaugauuuuuuacuguuacuuaacuuuuauauaauuuaaucuggccuucgcauugaaguucuucuguuuccugucucaggaaguccuuucugacaaguaguuuaugaacaucaaccucucaugguuucaguguuguuaccuugucuaaacucauugaaguguguugacauggcugcgcagaaucgcgucagcacucuucacgucagcguccugucuuauuuaccugggcaucuccaaugcacugcaaaacagacucuuagaaaauauacguggaauuaguucacaugggaagcuuguggcugucaugucgucagucuuucuucacuugugagagucagucgcauaccgcauuacuugagcuacccacugcuugggcuuugcauuagccuuccagguccuuuaggagaaaguccaaagcccugaaauauagcguaagugguauuaugcuuuagcauuugccagcccacuguuaaaaauagcaagauggucuuuaguguagacguuacaaaguaguuuuccaugaagggaaagaccauaggaauagaugucuagacgggugucuuucgcgaaaauugaaauuccaugaaacaaauaaguuguaucaguuugaaaauuacccaucuuccucaguagauguuuaaacuauuuuuuugaguuccuaauauauaguuucuuuccucagucaucuuaaaaugcuuaaagaauuucuugaaaguuacuuaaaagaaacuuacuugagagaaauucaaauuucuguaauccuaaauuuuucuuuuaaaauccacuggauguccucuuuuucucuuuuugcaaaaauuauuuaaauuuuuucuuuuauuuaaacuuguaaacuuauauagccauggagucucaguuucuuacacuuuuauaaauguaauuuucuccucugacacauagacuuuuaaaaaauugguuggggcaaauaauaguuuuuauuagacuaacccauauacagauauaaaaccagagucucacuguuacacugagagccucugacagagucugauuuccagcucuggaucugguuaccaggcugacuccaguuuguccuuuuaaggcugauaguugaucugagcacuaggaaguauguaacuuacuaucuagacccaacccauaaguccuagugaucuuucacugacuuuuaaaacaggauaguuaccugugugaugaacuggccagauugcugggacccaccuacauucccagcacuugggaaguggaggagagaagaucaggaguugagcaucaaccuucagcugugugaggagguagaggccagccugagccaugagaccgaccgugucucaguguaagaagggagaaugaacuugacucaggaccaaguguucugccaccaccuuucccguucucacaccuagauugcauaauuagucucacuugguaaggaacagaaauugacuggcucacugcuguuucuuucuucuucuuuuuuuuuuuuuuuuuuaauaaaugaguguaaauuuaggcagaacaaaugguuaaaugaaugaaugacaaaauuaauaugaaaauaauuaugccaagaacguuuccugagauaaguaccuaugaaauagucauagccacucaagagaauaauauuucaauuagcauggcuuacuaauuaauuuauuuuuaauuugugugugaaagugggcgugugcucaugccacagcacauacggagaucaggggacaaccucggguggugauccuuacguuucaccuugguuugaggcaggguuucuggguccuggggugugugcugugugugcuuuucugcugucagauggucucugugcaccucccaucuggagggggcgguaggacuauagcuggcugcucugcaccugacuuuucuacagcucccagguccaaacucagguccucguucuuacacagcaagcacgucacucaccgagucacuuccucagccuccuugcuauuucuuuauuguuccucgauugauuuuuaaagaaagacauccuggagcuggagagauggcucagcaguuaagaacccuggcuguucuuccagaggaccaggaaguuugcuagugcuuuuauucgaguguguguguguguguguguguguguguguguguguguguguggugcccaugcauauagguauggaggucagagaacaacuucugcuuuauggagucaaggagucaguuccacuuucugggucccugggaacaaacucagguuaucaaucuuggguaaaagcaguuacucacugagccauuucacuggucccauuauuauuuaaguuuuaagaacuaauaaacauaguauacagaagcaaacuauaauuuauuagaaucauuauguuguuguaaaagcauggucauccuaagagcauguuucuccuuuuaacagcuacccaggcggcuuuagacaaguaacagcugcgcagcuucaccggaaagaccccguggcgguaagcaucuugugugucucgguuauccgggcaagacugauucagacuguuuaucauguccccucuaauguaggcaccauucagggcgauacaugcuucauuguauuauaccaaguuucuggagguuuuuguuuguuugguagguugcuuuuuugagacaagauuucucuguguagcucugaccguucaagaacucguucuguagacgaggcuggcuucaaacucacagagaucuauaugcugauauuacaggugugccuccccccuccaccuggcuacacaguuuuauuaaugucauguucauugccauucaauucuauuuccuaauuacuaucauuaguuacagcaacccagauuuuagguaguuuuuuuguuuuuguauguuuguuuguuuguuuguuuguuuuuggccaaaucugucauuguauauaaugagcuugcuccaaauaccuuggagaaagaaagagggauauaguauauuuacuuaguguauuuuaaucuuaccagcuuguuugccugauuuauuaucugaaaaaagguuuauuugauaauaaaaucugaguuauggauuuguucauuucuauauggcucugucaguuggggcauugcauaguuugaagguuugguguugggugaauuuaaguuagugauaaucuuacagaacagauggaccaaggucgguguguuuggccuucaucuccagcaaugcuucuuacucuggggucuacugcucuccuaauaugaauauagugcaucagucuuuugauuugcauuuaucuggaauauaacuuucuauaguuuaaacuaacccuucuaacauccacuaucccucccaacacuucacggaggagaaaacagaccccagaaagaagacaggggaacaauggauuggaaccaaauaaaaaauacacacaccaacaaaaaccaaaaccaacaaaagucaaaugauaugaagauaaauaacaggaguguugaauuagaagggguaagacaucuugaaaaggcauguucguuaaggauuaaacccagugucuaggucaugcuaggcaacgacucuacaacugaacugcauuucuagcccuacgagauaguuuaaggaacaaucaauagcuugauuauuaaucuaauaaauaaauacguguuacuauugaaguauaugaaguagcaaacacucauauuaauaauauuaggaguguagcucuucacaguuguggcuucuggcaggggccuggggaagaacucaagucuuuaaggggguuuccacugggcguuuggccaugcuccagugaguauguggacaacacaaauaggaguuguauguuuuuucuuuucuaagggacggggcaugaagaugcaggggaggaccugggagaagucaaaagcaagugugauugaggcacaguguaugaaauucccaaauaaccaaugaaaauauguuuagaaaauaaucauaauaaauauuauuguuauuaucauuugaaugauauacuuagcaaaguuauaauccauauguuuguccuacuacugcuaaaaauaagucuacuuucugguauuuuacaacuuaauuuuccuucuugguugucauuaaaccuagucuuugaacuauacuuauagcccuuucccuuuugguaacuguuagcuuuuuucuuaaaugcuuguauaagugaauaaggaaucacuucaaaaucacuccuuauuuucaaauaaaaaaaaauuggagggagguaaguacauugauugucaugaugcaaccauuuguuuaguacucccuggagcuuccuugaugaaaugcaggaaaggacguucggcugugcuuagacugggcgcauuuagaaguuccacaguugccgucugaaucauucgugcagacguuacuucuuaggaaauaguuaacacuguuucauagguaguguguuuuuacacuauuacgggucccuguauugugcucaacuuauuugcuauggcuugaggcuggauggauaaugcucucuacuacaacuguugcaacaaaucagaauuuuaauuauaaguauuuuaaaagucugggaaguuaguuucuguuucauguggguacguuaacuguacacuaggaagcaauacaauucaacuuuaauauugauacgauaagguuuguuaaaaguauuuuaaauuuuccuuacuuuucaaguuaccaugcaacaaauggguuuaauuauggcaauuucauauacaugugucuuuaugcuuuguucuaauuuuaguuuugaugaacaaaaauagaaagaaaauacaaaauguuuaguaagagcuucuaaaauauuccauuuagaccuauuugcauuauuaucucauugaaagaucucaauuugcuaacauuuuauuuaucaauuuuuguucugugaugaguguuuuaccugcauguauggcugugcaccaugugcguuuagugccacaaaggugugacaucguugugacuuauggggagaaguguauuuugcaugugauugcacacacuguguuucucuuccuggcagcaauacuguuuaauuugaacuccaguacagcauuugauugauagauggaauuaggucacuaucugcacucaguuuucucugcugcuagcugcggcugguuccaguacuugcuucacagcaucauccauacauuguuaaaaugugacacacugacuaccaugcaaguagugaauuguugguggauaaucacugugaccacugcugccaacuugugucuuacugucagugucaccacacucagauugguuugugaaguuaaagcucacugucuuucuccuggaggagacaggaugcagucccacggguucuuguauaagcuuagagacugacuuaggugaaacggagcacauacaaggugcucucccgucccuucugucugcucuuuuacuccauaaacaauaaccaagaggcccucuaggaaacagcaauguagaaaggaacacaagucccuuucuggugcuccuuuggaauguacucagucugucuccuucccgguucccacagaaucuuagccacgcccuugcacaacuacuaaucgugucugccuucagucucgcuggagucccaccuuguuuuaagccuccaugugucuguuuuucagauugugaaauuggcuauuuauggcaugcugcccaaaaaccugcacagaaggacaaugaugcaaaggcugcaucuuuucccagacgagguaagucggcagcugagggcagugcuucuccuuggugcgcaaggaagcacuacuuccugcuuccaaacaguugcuggaggcuuguugucaauagcuguaucucagcuuccaacauacuuguuucguguuaaaguacacaguguacacacucguaaucauuccuccauuaaacccauaaguggcauaucauugagcuaacagucaaacagaucuacaaguucuguuugccugucagucacugcuuucuuuuuaaugggaacuauuauggguacccugugaaagaggaguccucaaugaugguuucauuaccugugaaaaaauaauaguaaguuuguuucauuuuaugugcuaaauagaagcucugcuuggaucauggaucaauaacccugguuguuaauuuuugcccaugacuuaacaaggaguuuuuuaagugaggacuuauacaagcuaugucacuagcugcauggcaaagcuaaauucugagaaggaaaaguagcauucaggaagcaguagcccuggauacagcaacuggugcauacacucggccagauggaagagugugaggguggacaaaacagcuccucuuuauagcagacaaaaaggaauaaauucauuacuacuuuuuaaaaauuaaauugccaaaguggcacauaucuguaacguucuuggaaagcugagauaggauaaucacaaguucaaagccaaccugggcugucuagaauauuuuuauggccaaccugggucgagccuugucuccagaaaauaaggagcaguaaacagaaaggaggaagagcaggaggaaggacgacuacagagaacaucgaugcuccacugaacuucucaggauuuauacaguaugcuuuaaggauuauaguguuuucuuguuccuuuugguaguuuuuaauacuaaguuuauuauuuacuaauaaauauauuuuaagauuucuaaggccuugacauguuuaauguaggauauuccggaagauauucuuaagaauuuaguggaagagcuuccucagccacggagagugccuaaacggcuggacgaguacacccaagaagaaauagaggcuuuccccagaguguggacuccguaagucugcauucccuugggucuuuccacucuucuguuugcaaacugaacucugagaacugugaaacccuuaaagguggcaggagcaaacagugucagguccccuuugcaacucagcagcucuuaaccucagacuccaaaggucuguaagccuugugaccgugugaggugaggguggggugacuguuguaguggcacuccacugucaucauccuaaagggggaaucugcauuuuuagauggcuuccuaagacagugucaccuaaugaaacuccguugacuggggaauuuuaguuuugauccaagaagaaaaaaucaaaauguuuuucucucuuccacacaaauuuccuguaccuuauguccauuaugacaagccaucucuugucugauugucuccaggcucugacuuggaaauacagaggauguggcauguaacuucauuuucuugggcagugccucuuguaguccuuaucuggcuugggcucuaacguggaaaguucuuucacgcugugucuccuagcauggguugggcauguguuugucucuguacuguccuguguugcucacaagauuucacagcucgcaguaagacuguguccuugucuugcuuaguacuaagcacagcacccagcacacuacgugagcacucggcacgcucucaccaagugaauucacaaagauaccgaauguucuucaucagcuuuuguacgugaaguucagacgcucuaggagacaaagaaacaacauauuucaguuuuuauagccauuuuucacuacccagaguaaucuaauuuauaucauuauuauuugucuuccuauauuaauaacuaaauauagcaagagguaagaaagcguuuaccauauuuuacauguaauuacagguucuuacccucugaggaacuaauaaguuaguauugguuaaucccauuuucuuauaaguuggaaaguaucggcagagaaguggaguagucacuaagaugguguacuaagugugacuaaggacugagcagaagguaacuagcuccuaggucauccucccaacuggagcacuggagcacuuugugcaucuucggugagccgagcugucugugugucagcuacugcugcccacaguguacguacugaacagccauuugucugagcagccccacuccuggagaaaggaccugccacgugcucucagggcugggugagaguucccaaaaaaugaagagauggauccuucccuuaccaacuuccacacucagggucagacuuuaccucuauauggcuagguguaaacccuucacuaagccuggcuucucaucuggacucacacaguaucagcgagccuguuuguacaucguguuuacauaaaguaucuaaguaggaagaacacuguucccaaauguucaguuuuaauaaauuacagcuaaaaaguaaauagucuuugaagcuccaucaaguugccuuccuguaacaacaucccauaaauauauuccauaucuaauauucucauagaauccuuaucaaaaauaagcuuauauucaugaccagcaaaaucgugauagcauuuuuuaaccagaucuaccagggaugcaauuaaaucaaauauaucaccaaccacauuuuaugaacuugaaguucuaacaauaaucuaaagaguuuaucuaaagcaguguggaaauacacucacguucaaaauuaagucuauuuaauguuauuaaaucaaacaaugcuggucacaacugcuucuuuuuauaacugacugucucugucuccacuguauaaauacagaaagggcuucucugcaaugauuuuuaaggacucucaguggagccuggagcugcuuggcuuagucgcauuccuacuguggggauggauuuuccugcucuuucacuuuguauucccuguagcaggaauacacauuagacggcaggcuuuucuuuaugguucauuaaagucuuuccuccuaaguaguuaggccauauguuaacuucuauugccaaaagaguaaauggauauacauguauuuaaacuuuauugugguggagguauaguaaucauuuaacauaaaucauucaaaaugucauuuucucugcaugcuagagcugauaucagguccaguuaguuuuuagugcauggaacgcaugugcccaggaaaagcuuccuagccggccagcgccagccgcuguagcacugagcugugcugucaucacuguugcugaugacuugacuuugauggaacuuuaaguuucaguaaccacaagggauugccuugcuggccugugccauucagguuuagcacuucaaguucuagugcauuucuguauacuuuaaauguagaauuaaaauaucucaaauaccauucaauucaauacacuaaaaguggaauuucuuacuauugaauucuccucuaugagaagaagaucucuccuuuuggaggaagaacuuaccugaaauagcuauuauuccaccaaaaauagaugauucaagaauaaagucucccuuugggauguaaucauuagaaauuagucaggacccaccugauggugaaucugcagauaugauggaaacaugugugccuagaccgcaccaggcgugaagauacugcagauacuagcagcaagaauugucaaccuaaauauuaagcuaacuggugauuacuaagucugauuucauuucauucaaaacuacuacucuuaggguugcauuugaguuguuuuagugcuuacagaggcucuggucucuuaggccuuuucucagcauaugcuaacuccauuuugccaaguuacugaguagucauuuuuuaaaauaaugguaggaaauaagaggugaaagcuauggauaacaaaaucauaacuuaaagucaagccauuuucaacuggccauucaucugauuucuuucauuaaugggaauuuaucauguuagugcgcuuuacaguacagaacuuuuguaaagaaaaugcuguaagguuauauuuuaugcucgagauaauaugaauagauaugugccugauugaucacgugcugacugugcagcugauacuuagacuaccuccuuacuuaugagaagaaauugaaaggaagaaagaagaaaaaaggaaaggaaaagaaaggggaaaggaaaggaaaaaggaaaaggagaaagcaagcagacaucuguugccugaaaucauagcuuucaaguggacacuuauuuuaauacuaucauaucaguaauuauuuccauaauuguugcagcuuugccagcauauuacacaauuccaauaaucauagccugugugguacucucauugaaguggaaauuuuuuacugugugggcuaaaaauuaaaauuggaucacuuuaacuucuuuaguuuugaguuuugcauaguuuugccggagagcuuuugucuggaaagacugcguaagugaacauuucuuaaucuugaccugcuuugcauuuuacucucucacuuguuagcucaaugaugcuuuauauuaaacacaagucaccuuuguagagaaacugaguggaaagucuuagcaucaguggugcuugaaaacguagagugaacccccagauuccccguguaacacgugcuacaguguauacauugagaaaugugccaacaggagaagggcagagaggguggagcugagaaggacugagggugaccaugaguggccuucaaacugucuuuccacagaguggaaucaggguuagagcguuuaaugaguaacacacaugacacuaggaaggcaaaguagcuccaggugcuggguacaguggcacaggaaacaccuagggagcacuagcuauagcuagugacaggagcaaggggucauucuuagugcaugcccucagaagugaaagccauucagccuaauaaugugcauauugucaauuuuauuguaaauaauauuaaaauaaguguuuuguccauguccuuauaaaaugugcauucgcucauaaacuugaagguagugaagagagauuuugcccucucuaauccuuuaaggagcagggacccagguagcgagcauaaggguuuucuguaauguugcuagcuagccuggucaugugggcuuucccacaagacuuaacuuaaauugcuguuccucacagucaggagcuauuugggaauuugggaaagaguauguugcagccuguuucaaccaguccagcacuggccuaaaccguagauguggguggggacuugcagugcugaguuuugcucacaugaggccuucuaagcagcugcucuggguaugaacagaucagcaccacuuguuaacauaaaaagaaaucuauuguaaagggaaaaaccuuaggaacuuagguuuuuugcuuucuuguuuuuuuuaagcacauagacauacgucuggaggucaguuaucucuugcccuggugugggauucagggguaggucuuaggucaucaggccuucacacuagcaccucuacccauugaccuauccuaccacccugagaaacugaagauuuuaaguuacuaaauacauauauauuuaggcacagaaacugugguuuacuuuguaaaguacuuugaaauugucccuucuguuuuguaaugcuuugguuugaauguguuuuagaaguucugccauuaagugaacaguuacuuccauuuuaaagugggaaaucuucauucaggagaaaaugaaaaaguaguucacgaagaaacacacacauuuuuuuuuaaucuuucagaccugaugauuuucggauguaggagaauggaaaugauagaacauuacagcaagagacugaauguuuccugaaguauuaccaugacccaaggcagagagaaaccaugggaacucccuguggggaacacucaagaaggccaagccucagcaggaaagugcaguagaagauacuguuuuacagacaaguccuguguaaccugcuuuaaaugcuacacauguuaauaaaaugcuuauuugguuagcuauucaau

SEQ ID NO: 7759 - RNA, 69026 nt, Mus musculus
cugcuuccccgccacacucggguccccgccgguagcgguuucguuaugagaggagcagagaguguggcuccugagagaauaauuucccacaauaauuggcgggaaaaccgacguaggacauuauuuugcagccaaccugagcggcaggaaaccggaagugcacguugcgcgcggcucuuuugagaccuaacacugaguccgggcgcgaagaggauggaucgguacuugcugcuggucaccuggagggaagggaaguuucgauccguggcggguggggagaucgagccuggcacugaggcgacaucccuggagagcaccgacaaacagcccgguaagcucugggcggagaagaggcgggaacgaccggcggcggggaagcgaaggauuugaguuucugaugaaaucccggagggaggcgcauaggucgaauggucccgggaacgugcaacuaacucucugaaguaguuucuauaagaacugagcaguaguaugucaauggaaaagauauaaaguuguggguauuagaugccagugucccaagugcuuggugaacugaauauuugccugguugaaucuucugguggcauagucaucgaauuuuugcuuuuagggaagguaugcuugcagaaagaagugucccuuggcguuccuaccaccuugaagaaagcacagaaagaaaugauagguucugcagaucugaguuuuacauucuaugaaggaaacauuccacacuaaaaaaagagaaaugaccagcuuuaaaagauuuuagcugcauugcuuuuuuggcguacuugacuaaucucaauauuacguuuuccuuguuuugauuaagcagacauuuuuaggaagaaauguauauaguucguauauacuucuuuuggaaggaaguuuugauuucuuguuacugauuagcauauacaaaugaggagacuuggcuguuuucucugcggugucagcacuugaauagacuuggucaacauguauucugucuacaacuuacuggccuucagauccucugauagugaaauggaaacaggcccuagauuauguuaacucuugaguuagaugacugagucaggucuuuauuuuuauagauuugaccgcaaccaauauuuaucaccucuugaagagaagcaucagcgauucaauccauccagaugacaguacauucccugguaaguacagaaguguaaugguaaugaaauuccucuccuauccaccaccaccccccacccccaaagucugacacagcauuuuuuuggaaaucagucaguuugauaaccuaggaguacaagaaagacuuguugacuugagaggcacagggcuauggggguaucuuaaagaaaaccucaacuacauuacuauuccuuccugauauuugaauguuguaaguuuuuauaaaaguuauucuggguucccauugugagaguuuugcuuccauauaacccuugcucuccuggaacucuuuaucuguagaccggccuggccuugaacucacagagaucugccugcuucugucuucccaagugcugggauuaaaggcaugugccaccacugcccugcuuguggaaggguucuugucuugaguaaagacaacccguuacagcucccacucugccuucuuuaccacauguggguguuguuuuccugucuauuuuacugauucucuuaaagcaaaaacagcuuugagucaucugcuuugacuuucugaaguucucacuacuuuuuuuuuuggggggggggcaagaaaucuucccuacuuuuaguucuauugguacuuuacaaauauaucuauuuguaaauguauuugauaauuuucuucucuuuuacuucuccaucugauaauauccuuuaaggcccagaaaauaugaauauggagacagaucagauccuacaagcugaaggaagugucuauaguuggcaggaaaaaauagccuccuuuugagagcugcagcucucaugauucuguuauaaucggcucccuuccuuauuggagaaccucuagucucgggggcagcucucaccacuaaggauugauuuccaguauguaggcacuguacuagccuguuguccacguucuaaugguacucuuauuaauuucugaaguugguaaaguuuagcgaauucuuuaaaacauucuagacuggguucucaugaaaguauucacucugcuuggaaggacaggguuucuuauaagacaccccuuuuguacaguaaugcagaacucugcaagugauguguacugaaggcaugcaagaccaucccaguucaauaaucaauuagacaguagaauuguuccaugaccuguaacauuccuaucaaagcuaauuaaaaacucuuguugguuuuuaauggcucagugggugggguugcuugcucucaaggcugaugaccugaguucauuccccaggaccuauacugaaggagaagugcagcgccugcaagucaucuaucugaucuccacacagagugugacacauaggugucuacacacacacacacacacacacacacacacacacacaaugcaacuaaaaagaauuuaaaacacugauuguuuuaaauauguaagacagugaaagaaauaguaaagauaauauuuacuguguguucuguagguuauaacaugagacacagugcaauugaaguauuuuguuucuuuguuaaaucugcugaaaacagucgggcaucaaguucuacuuugccaucauagaacuuauacagauuuagcaucguuucugugcuuuggcgacuuguacucuaguucuaucagcuucuaguguuuuuucuuugggcugucagucuugcgaacuauccaugcauuccuuuaauuugacuguuucuugcuagcaccauuuucccugggacagacaucguuaccgguuuuagcauguuugucacaguaacuaaccuagaacucuauuuauauagguuugaaaagcacuuuagcacccauaacuuuguuuucuugcuauucuucaucuuucucagcaaaugccuuuucugguuaucuauuggaaaaaauuacuacaaugaguuuacaucagaagaccaggaagaaacaaaauuuagauauuuugcuuucucugcauaaaauugaaugguaagauguucagugacuaguuagcacacugugaaaguagugucacgaucagucacugcaugguaccuuuuuuuuuuuccuggcaaugguuugcguacuaaaaagcuagguugguauaguuaugccgacaucguuguaaauugugucaggguauuugggcuuuuuccuaauuguagucaacagccauuaaagguuuuaaugcagggaagaugaucagauguuguuguucuucauguuuuuccuccucgucuucguccucguccaccucuucuaccucuuccuccaccuuuuccucuucuucauugcuuuucuuuuaagugggugugggcuauuuauguguauauacuuguuaucauauguguguguguguccuagggaauccccccuucucugccucccaaaugcugagauuguaggugucugacacaccugcuuggcuuuuaugugggcucuggggaugugagcuggaguccucacaguugcauggcauguacuuuaucugugagcugucuccacaaccugcagaucugcucugaaguacucuaguuggaucagacacauuaggcacaguagguaagguuauagcuaucgggauuauugcagaagaucagcugaagaacuggggauggccagcucagacagcaagcauguaggcaguggcuaucugagggcaguuagagggagaaagccugacuuaaugcugagguggcuuagguuaggagaaaggaggcauaacugacauuagaagucuggcuggugccauuuacuaagaaggaagcauugcuaagaagguggcauuaugaagaaggaacuaagauguccuguguagaacacauggagaguugccuaguaagguauuguagauauaaaaauugaacagauaugccuauaucucaaacuacaggaggguagugcuggagauguaguuauacaaucaucuggguauagguggaaaccgugcgauagaggagauuguuuacagaugaugggaagacaaaaaaacaaaacaaaauaaaacaaacaaaucucaagaauccaaguauucaaggaacaucauuuuuaagagaugccagaauuagugccacagauccaacugauguaaggggaaaguagccacacacucacagcagucaccauugagucuucucugauuuaugcugagagauuaaauauuaacaaagcuaaaaauuaauaaggucguaaaaagucaguuauuagcgacuucgaguacaauuucaguggcauguguggaacgaaaaauccacuaacaugccuuugaaggguguaacaaagcuaaugaggaagggaccaccacagguaggcagcauuuucaggggggcuauaaagagugacgaaagggauuugcagucuuugaacacgagcagcuaggacuccauugggaaguacugcuuugaggaauagguuugcgguuuucaauagugagggggguggcuuggagugccugggcugggaucauuuugaggaguagccuuggagaggaaggucaguaccucuugccuguuggcaggaaggagcgaaggaagaccuaacaagaagguccauuucccacagggacuaauacucagugguucccaguaaggaaacaugauuuugcugagcucaguggaagaaaaguuucaguugacacucagccccuuaccuugcucccacaaguuaaacucacgguucacucuuccuuuggagccucgagucugguuucucuccaaagcucucaauuucguuuggcuccucugagauaugcuucaaggugaccuuugaguucacucacucucucucucugugucucucuuucucuaguuuauuuuaugguauugcauuuuccagguaauuuuccauuugccugugaccagguagaaccaugccugcaugaucuuuggagaaggaauugguuuuacuuaguggccuacugguuuugugucacccaggcauaauugaguagccauauuuucuuaaaacaucuuuauaguagaucuuaaaugauuaaaaaauauggaguuugaauuaaugcaagcuaauaauuuuuuaaagcagguuggauuuuugcaagagauuuauaacuuggaaaacuauagacuauguuaaagaauuauacaauucucuaaauaguaaucguuacacugacugcuuuuucauugucugccuuucuucuaauaagugugauuuguuuucaagcuuguucaguggguggcacaccucauuccaggaagugguucuuugcggugcaagcaauaugcggauuuuaccagguaauagcuguuagugaacgcauuaccuacucuaaagaauuucacgaauccacucuguuuaaugccgccuuuugauuuguugguuuugcaauagcuauuaggaaaugucugugcuauaaaugaugacgugacuccauuacuuaccaucauuuucuauuaguuuuguaguucugauuggcaagagauacauuuugaugcugaaaaagauaaaaucgaagauguucuucaagcaaauauagaagaaugucagagugcuguugaguguuuugaagaagaugacaguaauagcagggaauccuuacccuuggcugaguaugcuucuaugccuauacugccuugcagauguuuaacaguacccuguuguuuugagacaggagggaaaagauuggauauuuuagcaacuauaguaggggauuuuuaaucaacugcaauggccaauacuucaguuuuggaagacaaugggcagguuagaccucucaucuaauugauaccugaaaacauuuaaguucacacaacuguagagugcuguugguaauggcuuaucauuuuuuugaagauaaauucugccugauccuguguugucuugacuaggggaguuauuuaaugcuagcagauaacacucaaauugaaagcacacuguguuuuuggccucugagacugaaaugugggacucccccccaccccccaauuuauaugccucuucaacauuucugauacuuuuuguagucuacagaguuucugaggaauaucaguugacgucacuuguaagucucuugaaucuuguuagaauggaagaugaucccgacacuaaguugugauaaccucuuucuuccuaagacauuccauuucuggcucauuguuaaagucuuuccuuuuagcguuugucaugugacaggaaaugcuuuuguuuuguuuuaguauucauuguauaggcuuuaagaaucucuucuuacugguuucacauuguguugguuaaugcaggaagcagugggaagaacuguggacuaguaggaguuagaaaguacuguugacugugugaggcaaagccagggaauuagcucaucuagucuuuuguuuccucauucaccaagugaggaaauucuuuuagguacuuucucagacaccuucacugagccuuaaaaagaccuuauugauuccuguuuuaccacugugaaaaaauaauguggcgccaccuuauuuccacaagagggagccuggaaacaauagugagccuaacaugcuuucggcuuuuguuucagacagugucaccuuaugcggaaggauuuaaauacuuuuauccuguauacgaacuucuuuuaagaauagaauuucacuaucugaauaaaauauguagguuuuuaggaaucugggaaaaugucauauucucagggaagccuuaacuaacucagagaagagcaguguccuuuauuauuaaaaccugcugcuggcuuguuugggagaguagaaaaguguuuggucuguuauuuauguugaauauauaaaauauaaguuggggucuuuguucccguuauuauuaucguugguucuguuuguguuuuacauguggguaagagcuuguacuugcagguugaaauagggcuuucacacauaauagguacaugguuuugggacauuuauuuaaaggaaaaauacuaaucuuaauggugccuggguuugucagcuaagucaaauaagguaaugugucuagcaugugugacuguagcacauagaucacuauugccuauuaugauuauaugauauagaggcauaauuaugcauauuuauauguauauuuguauagggcauuuuuccucuaacuguauucuuucauuguagccuauaugaagaaucagcagaaaauuugcaucaguuaucagacaagcuucccgcuccugguaauacaauaacuguuuuagaucauuuguauuuccuacuuuugaugcgugagugauggauucagcaucuucaguagaaucccaguccuggaacucaaggacaaauugcuuuuuaaaggagauugucaggaugacacuccuuuauggugccgauagcguacacaucaccaaauggaaugcccuguaguagggugaagcucuuggaucagcaguuuuaaaauagaaaccacuuuuucuuccuaaaacaggaagcauauuuuauaaaauacuauacgauauuacccuuaaacacuuuuuuuuuuugguccgaguagcuuugcuuuguauuacucaaauaguuauuggcaaaauucaguacaguuugguauucauaaauacuuuugcauuuuuuaaugaaugugucauuauugaaucccacuuauuugcuguacguuucuuugcuaucuguguaguaugucaugcacuguccugggaacugaauauacagugguguguaaagcuagauagugauacaggauggcacaacuacaauucuuacguucacggagcugguauuuacagccaaguuuacuacagaguccgguauagaaaguaaugaaggcuuugugagauggcucagugguaagggcccugguugcucuugcagagggccuggguucaguuccugucacucacauggcagcucccagccaucucuaacuccauuucugagaacucuagugcucucuuuugccuuccacaugcauuagaaaugcauauucaugugugaauuuaaaaaaugaaaaagaaaauaacaacguauucacaaauaaacauuuuugcaaccuuuucaccuaaggauugaacccaaagccuuguacauaaaaaguuacccuucagcccaucagauuucuuucagugaaauguauuaguucaaaaauaugcacuaaaauuuuauacaguugcuauuuuugucuaauuaaaugccuuugguuaucaaauuuuuguuugguuuucauuuuauuuucuggucuuucaauaaguuuguaauuucaugucauuuaaacuggugugaaguaaaaccuccuuucucagagucuaauggugcuaauuuaauuuguuacacugaaugcuuuauuguccuuuaagagacaugauuuauuugagcacugcaauuuuauauucauucccuuuuggauaacaaaauuaaauguaggaggauauaaugaaauugcagggguuuuucccccuaucuugagucccguagcauuggugaccuccagagcgauacauauauaacuagcuaugcuggagaauuagcaagcaauuaugauauaguuuauuguucuccagcacgauggcaugaucucaaaugaugaaguauuauaauguguaaacuccugaggauguguacuguuguaaaauagugcuuuguuugcuaaauaugcuuaagauucauuuguuuagagcacuguugaaaccugcuuuaguuguagcaugcuuuaaaaacuaugguauuuuuuguuuuguuuuguuuuucuagguagagcaaugauagacauaauacuguugccuucugacaaagacccuccuaagcuaaaagagugcuugcccauuguaggggccuugaaacaucugaaggaauggcauucagcaaaaguuaucauagcaggaaguuacugugagauguaagcuccuuuggucaauaugucauuguucugcuacugggguuucgauagauugagccuuugaaaauuaccuuaaugugacgagguagucuucuguuguacugugacuagagacuugaaucuuuaccagaaccuagguuuuucuccucuccucuugcugagauguuuaagguuuugauagaugcugucagugaugccgugagucaccauugagcaccgugucuccaaaugcacugugcacuuuuauaaaggcuuucaguaccucugcgcacuaggguggcagcuccacaggacuuaccauguccugucuguuuucugugguacaugccaagguacacacaguuguauuugugacacauuaguagaggucaguugugcauuccacauuugauuccaaacuuaguacuuaaaggaugcuaagccagaccuagcauuggaugcuggugagcccccuguauggaaaggaauuccaggcaaagcaggacugcuaacagucacaaucaccugugaugaaguguugccaugaaauucauaaaacccgugaaggacauucagggugccaguuuagcuuuuugaagcugcggggcugacauugagucuguguaagcaucggacacaguucagccagcaguaacuggaaggucucuguuuacaccguaggggugacaacucuggauaugugugaauguaacagcccuuccccagagacggccuuaauggguaauucauauuaacagaaaauugcaguuaccucuccuaggcuguaguuaaaauguagccauuaaaaaaaaaagaauuaccgucauuuaauuaucaaaaucuuuuuuuuuuuucaacagaaauugucagaaaauugcugaauaccuuucagcuaguguugugccuuuagaagaauucagaaaugccauugauccgagggaacuguggcggggagagauucagaugcgggaacgaaagguaacugcuuucauaucuucgccauguacaaacggagaaggccuuuggacuuugcuucugguacaacugaagucaaugccaggguccgucagggaagaugugcucgacuggcaccaggugguggaguuuucuacagugaugcaaacagugcaucugcucuuagcaguggccccugagcugcauacagcuacagagaacugucggucacuuguucaguugguccagcuuuuaaguuuuauuagauuuuuauuagguguaaugucaguagucacugugguuagguuuuagguauggcuguuguauaguguggcauuuugagaacagcauuggaccuuagucauuauuuacuuaagacauuuuguuucacugccuguauuauccacccaaaacaggacugggagcaguuaucuauggauucuuaggugaucucagucagauacauaccagcucacuugaacaguguuuuaaaauuuuuauuagagccuagauauaucagcuaucagaugaaaauagucauuuagaucacucacuucaguaagucuucaauuuuacaggugagugcuguugauuuuuuaaguucuaucuauuuugaaauguguuuguauauauacguuuuguagaugggaaaguuaagauaguuuccuaaugcuuguucgggauaaugaaugugcucuugcguucccauugguucuguacuuuguccuccaugaucuuucccuggcucagugaaccauccucuaagacaauaggagcaaggugccuaagucuaucuagauuuacaucccaguuguaugaaaauucagucuuuagguaaauugucucugcaaauaguguuaauagggcuaauuaauuaaucuuccucuuuggcucagugcugauuaacugauugauugauugauuaaucagcauugagccauaguggaagaguugacagugugcuuuggagaauugccuugguuuucauuuucugaagucaugugcuuacaugugggcgcaucaugccagaguucuuaugugauucuuuuacuccuuuaguaugaaacugcacacccaucaguccagagucuguguuucaguuuggagucguuucauagcuuucagccggcagucaaucuagugauuagagauguagauuguagagcuacaaugccugaauucaauccugacucgguuccagucuggugugacuucuuaguacuguaguuguguuguucucuaagccagggaugagcguaguagcucauaaggcuuguuugacuuacauuauuuugaguacacaguagugacacaggaagacccgucugucagaauugucacaucuuuacuguuaacagucguacugcugcuacuucuaugguaacuguguuucucaucaccacaugcccugaagguaaaccaugugaggcucaguaucaugugucuaguagugaagaacacaggcaguucugucugacuggcaggaagcaggcauugaaugugcaccaacgagguugcuugaaaugaguuaguauacugcugcugacuaacccagggugacugaaagcuuuuuaugaaaaacugcuguuuaaguuaauaguaaaauguguacuuagcaggaacaacuacccguugagcugagguauuaaaaaaaauucacauuuguguaucuauuuauaguaaggucaguuucuucucaauauuuucauucuaauaaaauauauccaucuuuauucauaacaccuauaauugaguucuuuugguuucuuuucaguuuggauuugaaauuaguuuuccugaauuuuguuuaaaaggaguuacgccuacgaauguuagugcguauaauuuaaauaccugcuuccuugccaagaagauagcaucuucuaagguaagaauauguugccuaagguaagguauagacauuuaaucuuuuuccuaucauccauuugugcaugcuuuucuaugaaauauuuuugagucuugacuuacuaauacguaugaugaucugugcucacccgcauagcucauauaacucuaacaguuguguguuugaguuacauugugugaugagcauuauacauuggcgagacugauugcuauagaguuuuuuuuuuaaugaugugauaauuuuaaagucaguguaagccugaaugaucuugaguuggaggguacuacgugacucuuuuaaguucagugagcuagauaggccuggguuugaaacuugacucucuaccugcuguauauuggauacagccucaguuagauugacagcucauuuaugaaaugagagcaaaaccauguuacaaaguuccuaugaaaauuaaaugagguuagagaucagcaccugaugcagagccuggaugaggcuuaacuugugguguuaggcaugcuaauucucgucucauaucuucuauagauuuauucuuuaaaugcaagcaauuauaagauauaauaauuaaaugcauauaucuaggauuuuuuuuucuguuguuuuucuuuuuaaauauugaaagccaggagaagcggucuuuuacaugagcuuuugaaauccaccuuacaauacccaguuuaagagugugucaaauacagagguccugaaauuaugggacgucaaacaauaguuaauacauucugaugaaaggucaacagagaaaaggaugucauuucugcugugauuucuuuucuuucuuucuuuuuauuauauauauguguauguguguguguguauguguguguauauauagcuucuuuagagacacaagaagaaggcaucagaucccauuacagaugguugugagcuaccauguguuugcugggauuugaacucaggaccucuggaagagcagucaaugcucuuaaccgcugagccaucucuccagccccucugcugugauuucauuucccagaguuguuuacuguaagcaacuugccacguccaucuuucacagggauuuccaguucuuucaaaaucuuaacacuuaaaagauuuagcaacuucagcuucucuuuuuuggcaguguaaaguucaaguauaauaaucuauuaugaaaauuguuuuuuuguuuuuuuuguuuuuuguuuuuuugcuucuaaugagaauauucuuucaauuuaaccuuuuaaaugaauuaaaguaaaauugauuaaaaucaauauuucuacucuguaucaguuccuuuucuauugcugugguaaaacaugaccaagguggagaguauauuuggccuuacaguucuagggcgcuaaauccauggugguaaacaaaggcaggguagugggggcaggaugcugagcacacacauacuggacugcaggcaugaagcaaagagagcaaaaagcccaccuuaaucuaacaagcuacccugugaugguuuguauauccuuggaccagggaguggcaccaucuggagguguggccuuguuggaauagaugugaccugguuggaaugggugugucacugugggugugggcauaagauccucacccuaguugccuggaagucagucuuccacuagcagccuuuggaugaagacauagaacucucagcuccuccugugccaugccugccuggauacugccaugcucccaccuugaugauaauggucugaaccucugaaccuguaagccagccccaauuaaauguuguuuuuuuuauaagacuugccuuggucauggugucuguucacagcaguaaaacccuaacuaagacauacccccaacccccuagucccuuagagccaucagcuaggaagcacaucuucaaguugcccagacuauggggagcaucucauucagaccacugcaugcccccauauaugcauucaugggagggugggagaaagaaaugggguggggaagugggggauugcucuuguuuucuggaaacuaaaccugauuucucuuuggacguguucuugcuuccugugaggcuuuuaaaauuuuaaacuaauaaucaguaauuuguuugcuuucauuucauuugcaggauuuaaagugguaaacaacuugaauuucuuuuccagguuuuccauuauuaugguccugcuuuggaauuugugcagaugauaaaacuaucagaucuucccuccuguuacaugucggauaucgaguuugaguuguauccuuucguugacauguucauuuuauuuuacauucugugggucagauagaaugguuuggcaccagccaguaaacguguguuagguuuacauugcuuuucacuuugccaaguggaaauuucuaccauggaguuucagaggaagggaguuccugcuuucuccacauucuccugccagaccgcccccaaccccauuuccagccggucagccuuucuuucacuguagauugcuugcugugggcaggauuauggaagagauauggagcugccugaaccuugcuuccuugaugcgguugugauguugagugcuugagcacgggccauaucuacacacagaauggcguuaauuggagcuguccugcccagcacugucuggauccacccacguugguuuuguguuuuauuacugcuuuauuuaguuccaaauggcauuuaagaaucacuuucccuuuucuggaauccaagaugccucuccaugacuucuguucuuucuugacacuguucugguaaagaaggauuguggaguaugugggugugacucccaauuccaaaguuggcuuucuaaacggucucacuugcaaaagcccacuuguaccaagaaagggcagaaaaagcacacgugaagcuguuucugugauuucccuuuacauuuacauguuggaucauacccuaagauaauucaguauauuuuucccuagucauggucuuaagaaaaguuucaaaguuuauccccaacuccuacgccaugcuuccugcacuaacucauguuucuagaauaggcaaaggcuuccuccaguuuggcccuuuugugcuugugagcaucagaggagaauguuaggaauauguggggaaagcagaggaauuuaugcacaauucugaccugcucagauauuccucuugccaucaguaugauagauuuaugaacguuaguuggaugauacaucuuucuguacuuuuaaguaauuauaaaugccaccauauauguuugaaauauucagagucuucuugggggggugggucacuuguguguaggucaggggacagcuagcaggagucacuuaucuccuuccacccugaggguuggcaaaagggcaggugccugcaccucgugagccgcuucacugguccagaacagacauuuuauauuacauaauugcugcuuugaaacagaccacuaacauagcacccuugaauauuuuuaagacagauuauuuuuuuacucacucuuauuuuuaugcuuuauaguagauacuuagaacuaauaauuaaggaaauaguguguaacagaaagaauaauugguaauucuuauacuuaagcuuaaugaaugauuuuucaguaaauugugggagaguguaauaaucaagcuguuuuucccaagcugagcuauuuccccguuagucucuuguucuuuuuuuuuuuuauuagauauuuucuuuauuuacauuucaaaugcuaucccgaaaguucccuauacccuccccccauucuuuaacuccuuaguacagagaggugacugggcacugcacgaggcagaauuccaugcugcuguuggaacagaucucuucccuguguggcaagguauagaaggcuuuguucauugucuaucugauacuuaacauuucaggccauguuacagaaaguaaauacagcucuugcucgugaacuuggaauguaacccagcuuugccaguaauucaugcuaagauacugcucaaauguuuuguagacaaaguggcaccugauuuuauaaaaggacuuucggaaaugaaccuuaugagcaaugauuuuaaaaguuacuuuaaauuucagaguauaucguuaaucucuucugugauaucucagcccagcucugggaaggcauuuguaugacuuaucuuuucaugguacgacagggggaggcaguaagaagacuuaagacauccuuggaugguuauucuuuauauuacaauuuucucuuguaauccagugcuacaggagagauuguagcuauuuuaauagcugcauguguauaucauaugauacuuuuggugucuuuuuaacauuaaaaaacugggacacauaggauacuaugcagaaucuugugucuaaaguuauaucauuuuuaagaggaaaaacacacaagucuauuucuuucuauaaauuuugucaacgauugcauuucuaucgaaaugauuuuaauacacagcacacuuacuggcuauauuuauguaacauuuucuuaccccuguagcaccagucuaguaacaagagcuccugggaggagauagggauuacuguaguuucaguagcuuccccagggcaguauauuaggcugugcuuguuacucccauagcaaacugauggcucuaaagggaaugugauuuuuaagaugaucccuuaaaauuuuggauuccagucccauuuuccuauacaauuaauagcauuuugaauaguguuucaaaguauuuuggauaaacuggccuuugaugaugucaagauaaaggcacacaugugccuaugauuuguuuaauggagauaugaaaugacccuuagucuaucucguuauugaagguaaugcuuaucccagaaacuaacaaaguuauuuaauaccuuaugugcagcuauuuuguuugaaauuuucuccaagaacccugacuguaaagcaucagucuauaaugcacaggucagcguguauaagugcggccguacaacuuccuuucugcagugcagcagagggagguacaugcagcaggugcugcccuagucaggguuacucuugcugggaucaaacaccaugacgaaaagcaaguuggggaggaaaggauauuugacucauacuuccugaucauaguccauuacugaagaaaucaggacaggaauucaagcagggcaggaaccuggagguagaagcugaugcagagaccauggagugugcugcuuacuggcuuacuccacauaacuugcaucagccugccuucuucuagagcccaagauuccuagccuagggguggcaccacccacaaugggugggguccucccucauuaaucacuaauuaaggaaaugcccuauggcuagaucuuauggaggcauuuuucucaauugaggcucccuccuccccagugacucuagcuggugucaaguugacauaaaaguagccaguacaugugcugcgacuuacacaacaaaucucuuaauuugaagccauuuuuuuuucuauauugggucauaacuugucauacuuuucaaaauaaaguaauugaauugcugauucuuucuugaaguucagugcuguguauguagccuuaguuuuuuuuuuuucccuacuaaucuuacuaaaaaguuuuuguuuaguauguaagaaaugucauugugacauuuucauaaugugugucauuauaguuuguugcuuuuggacccucguuuguuuaguuguuguuuaucagaaaagaauguccacuguguuauucagauauuaaagacagcaagaagacaagacaccccaccuccugcugaaguaugaaucuacacgaucaucaggagugucuggguuuugcauuauccuucaucugucuuucucuuugauuaacuccagaguaugcaugaacauuucuuacagucuagccuuucuucauugacuucacggggauauuagagucuuuauagcgcuacuucaugguuagaaaaugcgguuuuuaaggggggacuuugcaguuuuaagucugauuucauuagugauugcuuguuagagaggagauggugggauaacuggauggggguuggaagugaggguggaaaugugcuacuggccuuugaguuguggacucacagaggcaaccacagcauugcccugagucucaagucguugcaggguuagugcauggugagaacagguggucgggauccaagucuguuaugauccauaguaaguagcugacucauauauuuuauaggaaauuaaaacuugggagauuuagaaauauuuguguucaccuuuguuuuaaauauuuauagcaacuauuuaaucaaaauuagacuguuuaaaaagugggaccacgguagugggucaugaaucaguauauaaguuauauguagaacugcuuucagcacccauagacaacuguaaaugugaacguaucugacguguuccccucacaguagugcuggccuuuucuucaccucgcagcugugccagccuguucuuccaugggcugcauuuuggacaauguacccaaggagcuaaagggaucugcaacccuauagguggaacaacauuaugaacuaaccaguaccccggagcucuugacucuagcuguauauguaucagaagauggccuagucuuggccaucacuggaaagagaggcccauuggacaugcaaacuuuauaugccccaguacaggggaacgccagggccaaaaagugggaguggguggguaggggggugggggggaggauaugggggacuuuugggauagcauuggaaauguaaaugaggaaaauaccuaauaaaaaauauuuuaaaaaaaagaaaggacugacuuuuaguauuuagagaaugagauguguccuuuauauugauugauuauuuucuauugcuaaaugcuuuacuuccaauuacuaauauuuggcuguuuaaaaugcacuuaacuuuuuagaaauuuucccuauaauaaugaagacaaauacuucuacuuucccuaauuuuguaccuguaauuaagaaugcauaaguaaaaagaauaaguagcaacagaacugacauuguaaaauccuaacucagugucccguauucaugguacuaauccauuuauuuagggcaauuaaaacagauuuucauuagguuuaagauauuugacuaaugcuuugccuaaauuucuccagaguuuuuauaaaauuaauguucuuuauuggaauaugcugauugauguaacugaauuucuuaaauagacgauauaacuccuaaagcuguaauuuguuuuauuuaguccuuaaucaaaaugagaauuuagauaaauacaucauagugauucuuuugagcaaauauuuaggaaacaucugcaugcuuagccuugagaauacaaauaugaaguugaauuugcucauaaaucaguccgaagcugcugugugguugguuuuuugggaggggucuaauuuguuaucuuuugcauuucaccuacuagcauuaaaucuuuuauuucuaggaaugaaaguuucuuuuucuugcccucagauaugauuaugaagccacaaaaauaaucaauauagcugaaguguuuaaaguuuuggguacuaggucccucguuucccaguguuuuccagauguaccuagguaucauaccaacaaccucugccauaacacacaaguacagaaaauauuaauagcaaaaugcccuaguuauuuuucuguugccgugguagauuuccugacagaugcaccuuaagggaggaagguuuuuuuuuuuuuucuggcucacagcucaaggauacaucacaucccaccguggugggaggguguggccuuaggaacuuuaaggcaccagguccuauugcuucuagaguaaggaagcagaaaauaccguuugcgccugcucaggcugccccccaccuccgcuguucugucccggacccaagcccaggcaguggugacacucacuucuagagaaggacuuucuacuucguuuauccuaauuaagauagccccucucaggcuugccugugaaguagccuaaucuaaagagcuucuuacuguugugucuggagguuucuuccuuaucuaggucuugucaaguugucaaucgccacugaccaucagacaaaguuuucagaaauaauuacccuaguagaaaagaaaacaggagacuauaguuuuggauccgucuuucugcuuugcuuguuucucuuuucuuugguuuuugugggggaagagugugggggccuuuuucuuuucauuuucgcagacagguacuugagagagcacuacucaguaucuguuagaugugugcaauaugaauuucacaugacaguugucaacaguggauuucagugugcaagcaaucugagugugcucuguucuucuucagguuggugcucucuuugugcugccguguacuguuagcaauguacucaucccaccucccagccaacuggccucaagaaaguggaaggaauacauggcuaagaagcccaagaccaucagugguaaguacaaggcuuucagaugguuuguugguauauaauagauaacucaguaaguggaaguagccuucacgggaauuuauuguuuaauaccucuaaccaugcccauuaggaagggcaguagucgaaaagcaggacuaggguuaauuggguggcuacugagguugaauauuggguucugagacacauggcaagaacaaaucaggugaaaaugaaaugguucacuuauuacauaagcccgugucuuagucuggguuucuuuuuuuuuuuuuuuuuuuuuuugguuugguuuuucgagacaggguuucucuguguagccuuggcuguccauccuggaacucacuuuguagaccaggcuggccucgaacucagaaauccgccugccucugccucccgaguguugggauuaaaggcgugcgccaccacgcccggcuuuagucaggguuucuauuccugcacaaacaucaugaccaagaagcaauuggggaggaaaggguuuauucagcuuacacuuccauacugcuguucauuaccaaaggaagucaggacuggaacucaagcaggucaggaagcaggagcugaugcagaggccauggagggauguuccuuacuggcuugcuuccccuugcuugcucagccuguucucuuauagaaccaagaccaccaguccagaaauggcaccacccacaaggggaccaccccccuugaucacuaauugagaucagagguugugaauauccuuacagcuggaucucauggaugcauuuccucaacugaagcuccuuucucugugauaacuccaucuugugucaacuugacacaaaacuagccaguacagcccgugucuauaauuuucugaagaacuuaauuauauaaugcagguuacuugugccccauagugucauagguauguuaacaauaugacuuuuauaauaacuguacauugguuugucuucauguuacaguuaaggacauuggugcuuagagaacuuagcagauaauuggcagaaauugccagacucuggugcugggacuucaagaauaguaaccucuacuuaagccucuaauaaucuaggauguucaguguauggggcgcagggguccuugugcucacagcugaacacuagggaaaccaggaaugguaaacacacagguuugguuguuuggugugguuuuguuucuaaaggcuucuuuguuaacuuuaagaagccuuuuuuuuuuuaagaucgauuuauuuauuuuauauaugugaguacacugucacuguuuucagacacaccacaagauggcauuggaucccauuacagaugguugugagccauccugugguugcuggaaauugaacucaggaccucuggaagagcagucuuaacuacugagccaucuaucucuccagcccuuggggguugucccuucaaaggaagagguguauaacuuguuuucugcccagaaggcugggggcagagguugugaauauccuggugaccuuugcacuaucuguaugacugagaccacaccagacagauccucccccugacccauaaggugccacauguaaucgaucuguagagcccaucuuuauggaagaggucacauguacuucacgaguuuuauguagucaugucuuaagcuuuauugugcacucagaauugaguuaucaccaagauaaucaacuuuuuuuuuuuuuuuucaaauugugcugucccuaaauguaucuaaagcaaacugcucagagucagccucuagcuguacaaaccacaccuagcuacugagccaggucaaaaggauucauuaccgccucaugcagaucgacacucuacugucuguggugguugcagcgacccccacgcuuccagauaucagccgaccgugcaguguuagaacuuguguaagggcaggcuuaaccugucuuggcugcucauggggaaugggugcagcugguguuuauuaaggugauucaacaaaaucaaaaguagauuuauagagcagcaguauaguagguuuccuucauacugcaugaagucaugggaaacuaugcuuauuguguuuaugaaaaaaaaauucuauuuucagcucuuaaauaaacucaguauucuggauagcucaucauugcuuguuuuucuuuguacaauuucaaguagcugcuaagucgacaguuguaagucuaagagaguuuauugauugagaauuuaucuaguuuuuccucccauaauuuuuauuguaccuaagaaaauaccuugucguuugaguucauguuuuagacucacugccuccugaaacuuggggauggauaguggaagcuucugaauaauaauaugacacaggucacauggugugaagaguguugauuacugauuagaccaggucauuagcacugauuaaacgugcuccuugcaggaguucuuuuuuaaaucuaagaagcagaacaaaaugaaacggaauaguugauuauggucuuuccuaccuaugacccuuccugaaggggacagacauuugggacuuuguugacaaaauugagaagccaagugguguaggaaacagagaagguaacuguugauuaguuucacuaacucucagauccagaaaacuucauacccgugcguaugucacuaauaguaguuucucucauuaguucacauuuacucucaggucauccucaaaccauaacuguguuuuuugguucuucaucguuguucuugaagucucugaauuaaggcuuauccugaacagguuccugauuguauuucuuugugacuuugucuaucauuuucuuucauucauucauucauucagccagccagccaguuaagcauucuuugguucauuuaucugaacaugaauggguacugucaucuacuagaugcggcacagugauuugaggauuacugcuggaaguccacuuuauaucccacucauuguuuucauaguauugcauagaaaauuaauguugagaaguguagcuuuguaucuacaguugacuagaaacaacccugaaaugaaaaaagcaaggugugcauuaaguagauaucuauaaaaagaacaccuuaauaugugaguucagcauucauacauaugugcacaugcauuguucauggguuugccagacauuuuaauucagcaccaaugauuuacuaggacuguuuaucacucuugacccacauuaaaccaaaucuugaagcuuacauuguaguagagauaaaacccuaaucuguuugcucauucaggaucagauuugccauaacacccaugguugccagcagacucuccugguauacccaucuuugcagcgguauuguuucuccuuguuucuuacugcugucuaauauugcaaauuugucccuggcugauacucacagguacuuucagaaauguguuaaaucguaagugagguauguauugcauacacauaccaaauaaaaauguaaauaaauaaauaaagagcuucuaguaccugaguucauagacauuuauuuauguaauagauuuauuuaucuaaaaauggaccucaugucuaaauuuaagaacuaaaauuguacaauuuguaugaguuaacagauaccccaaaaaagcacauugccuaaaauggaaaaauaaaucuguaaguuagaaucuaccaaaauuuuaaaucuauacuuuuugagaaaaccuuugagacaauuuaaaauuaagcaauguauaaggagaaaaauagcuccaaucauguuuugagccuggauagaucuuuagaacucaguaaaacagccccguuagcaagugguuaagucuugaauaauacgucauggcugaagauguaugaaugacuaagaacccucauggaagccugcucagcgucacuagucuuuugagaaauguaaaugacaaccagaaugugauccuauaggacacucacuagaauaauuguaauuggaaccaugacuaucacauauuaaggauguagcaaauauugcauguuuuuuuguggagagggagaugcuuaauagaauaguuguuuauuauagaaaacauuuugagguuaaacuuagacuuagucauauaacccaagaauucugguccuagcuauccaccaaggagaaaauauguaugagcaaauacaccccuauauauauauauauagauagauagauagauagauagauagauauagauauagauauagauauagauauacacauacauauagauagauagauagauagauauacacacacacacauauauauaaaauuuguauaggcauagagaaaggcaacucucaacccuagucagagaagugucuguuuucaaucauuaguccuuagugcagaccucauggcugagagugacggauaagggcuucuccuggaugagucauucacuaccuuuucuguggcucagggacaaaucauggacuaagagagagacagcguguuagagcuugaagacagauagcagaggaaccccacagacacggcauaaccuguguggucucuuacacaccgcaguuacaguuacuaugcuuggcuugcacagacaagccugacuguacaggcaugaaucagggagcagggucacugaacccuacccuucccugaugaacuuuggccacugauggucucugggagacgggagccaucaccuucaguugugugaacuucucaggguccagugaguuauuguaaccccaaggccaugcagauggcucuggccaaacucagagggacauaaaccaaagagacauuaauguugugaagagauuaagaggggaggaugguggaugggagggagggagguggaugagacacaaugcugggauuacaggcacaugccacacucagaggcauuugauuguaaggcucucugaaguccucuuagaagucaauguagagcuuugcuugcugcaguucagugauuccucacagcagcuaaauguuagcaaaguggagcugggcugcacccgagaacaguccagugccaguggacgggccaucgcucuuguagaagcaccugggugacugacauguguuucccccaugcagcuucuucagcccaacuggagacucuguuacugcagagaaaacucagguggucagggacagauggagaauggagaagcuggguuuggaacuuucgcuuaccuggagaaagauaccaccugaguaguagauuucaaaccugagucucacuguuaaugaggauaaagacuuuggaagcucugggauagccucgggcuauuuugcagaggcuaacugcuucuuaugcuguucagcaauaaggaagucauuguucauaauuggaggccucugaauagauuuucuauucauuguugcuuucgaauuuuauauuuuagguguuguaaugaaaagaagauggauuuagcguaugaaaaugauguuacuuauuugaaaaggcugugggagaauuuguaaaucuuuguuuuguagucuccacaguaggaggcuucuuaaaguuauaaauucagcuaucaguuaaaauucucucuagaacugagcugcagauauuuuauugcauagucauauuaacagcuaaauugcaugcuaacauuuucaaagcuuaguuaggggauaaaaugagggaucaauguuggcuaucuauguuuggaagauguuuuaggaaugugaaguuaguagauuggugugugugugugugugugugugugugcgugcgcauaugcaugugcacgagugauccuguguaugcauucuaggccccugcuugucucuaugauuauuucaaaguugaguuuauaauuaaacaaugguaucauuguuauaaagauuauagcucccuaggaugccuacauugaauccuagacuguauguugauauuuauuuuuggcauaauuauuaaauauuauuuuuauuauuuuuucauuuuaaaggauuauauauaaaauaauugucaguaugucaggguacuccucccucuuguugucugagauauuuuuauuuccccuuauacuuauauggaauauuauuuccuuuacauuguuuuaauuuuauguuuguguuguugaucugugaauaaagugaguguuagaagcuuuuaaacccacuaaaaaacuuacugagauaggacaguggcucuuuuucauuacaauagaacuuugccugagaguggagcacagugguaccgcacuuaccuguaugcacuaggcuuggcuuugaaccuagcacuauaaaaauaguauauuuuuuacuaaugaauuucuaaucauaauauauacuuccacuaugguuuauguuaauuuguaaaauuugaagcaacuaguugauaauugguaguuucucucuuucccauuuuaucugugucauguagcuaagaugcuucucugccuuggugaaggagcauguaagccagacguugccucauugguugauugugccaaauacagcauucagaaauagagguuguugucuuucauaauccacugaucagaacugaauaacugcuaauuguaagucugguauuuccugugaaauuuacgugaaagucauuaaauaagucuucaauuaacacuugccaaauucugagacauguuuucagugacuguaguugucgugguugggaguucuguaaaguaaauguuuuucuuuggagaaaagcuagguuguuguuaacgcagacuucagugucuacagggcuagccaaguugcgagcuaagacaaacacagaaagcaguggagagaagugcagcgugaacugcucucaucugauugcaggagucaugugauacucuucuuguuuaggaauaaucuuuuauucacacauuggaucugugggguagacuguugcugugauaauacuauuuuagugguuuuguuuucucauuuuuucauaugugcauguauaucagauuauuauuuuacauuauauuaguauauauauuaaugagagauggcucagcaguuaagagcacugacuguucuuccagagguugguucuagcucuaacauaauacaagcaucuguaacucuagguccaggaagugugccauccucacccggccuccacaggcaccuggcccccauggagugcacagacaagcaugcgggcaaaacacccauauacauucaaaaaggaaaaguucaguuaugguauuuaacuuucaaaauucugcaaaucaugcccggaaggaauguucagggugcgcuguguccaguaucuaggcauucagugacagcccguggucaguggucuucauuucagagcuuggguucugcuggcuuguguugccuagacauagauaccuuguucuauccccauuagacaguaaacuuuuugucuuggguacuuugcuagauuaccucuaauucuuguauaauacaguugcuguauaaaugaaaaagaagucuguacauguuuaaauguacaugcauuugucugccaauacuuuuucucuguaguugauugaauucagagaaacagagccuguagaaaguugcuuuucuguucuauuuuccuaugaucgguugagugguuuaugcuuauaagugucaguuugaagaaauggaagggaugugguacaggcagaucuuuggagguaaguggcugggcaguuuagcggguuggagagcuccagguucagugggaaacucugugccaaaauaguguggagcacggaacucaagaagaagaagaccauaguguggauacuucuauccaucuuagaagagggaacaaaacacccauggaaggaguuacagagacaguguguggaguagagacugaagaaaugaccaucuagagacugacucacccggggauccauugcauuuacaaucaccaaacccagacacuguuguggaugccaacaagugcuugcugacaggagccugacauagcugucuccugagagguucugccagugccucacacauacagagguggaugcucacagccauccauuggacugagcauaggauccccaaugaaggagcuagagaaagaacucaaggagcugaagggcuuugcagccucauaggaggaacaacaauaugaacuaaccaguacccucagaguucccaggaacuaaaucaccauccagaguacacaugguggaacucauggcuccagcugcguauguagcagaggauggccuaguuggacaucaauggggcccuuuguccuaugaaagcuguaugccccagugugugggaaugccagggccaggaagcaggaauggguggguugaugagcagggggagggggaaaaggguagggagaggguguuuuuuggaggggaaaccaggaaaggggauaacauuugaaagguaaauaaagaaaauauccaauaaaaaauauaguguggagagugacugaagaagauaccacauguggaccuucaccagcacacaaucugugugcacacacucaucuacauaccacuuaaauauauauacccgacagacaugcaucaugcgcgcacacacacacacacacacacacacacauacacacggaagcuggaaaguauggacauguagguauaagaagaauauuauggaacuuuaggcagggccaaagaacaaguacauggugauuagacaaauggaaaaguucauccuuuuucuugcuuuuauaacuuucugcuucaguaccuucucaacuaaagagucccagauguauugaagggacagcuuguuuuaucauaacaugccagggaaacguguagucggucccucugagggaucuaacgguugcgugugauaagcaccauuucugguucuuagcuagaucuuuguuuuccaguucccgauguugccgugaagggagaguuuucuggcuaucaucuccugcugcaagguaugggcaagagaaaaugcagagccacccugcugcacucggccagccagaucaauggcucguuugcacucagugucauucaugggaagaugaaaacaaaggcaggagaagccagaccgagugaguaauaacuuugugagaagaugcgcuuucuguacuuacugggaggguuaauuaauuuacauggcuuuaaguggcaggaaagauaaugaaacuccauuucugccauuaguuuaucuuuuaagcacaccauuuuuaaaauauauguaauauuuugcucuuauucuuuccccuccucuccauccuucuagguccucuuuaccuuuuuaccuacccaccuucacguccaugcucucccugccucaaaauagccaaaaauaggaaaucgaaacuaacaaacaaaaaucaauaaggcaaaaaauaccaaacaacaacaacaaaaagcacacaaacccaaggaguccauuuuguguugacaaacuccuccuggcauggggccuguccugguguguggcugauauccccagugacauuccaccacagaaaacugguuuuucuucucccagcagguauuaauugcaaauagcuucuugguuaggggugggacuuggcauccauuccccugucuccaugcugggauuuuaaauauaacauugcuagaauuuagaaugaagaggauuaauuucuuuacaauauacagaauaaaaauuagcuauuagcuuucaaguucagauaccaaguuguuaauguuuacuguuuucaaaacucaaagcaauuauuuaaaaaaaaaauuacguuucucucaagccucuuguuucacuggcuuuguuugucuuucuauuucuccaaguuucuguauuuucgcugucuauugcugccugauaaacuuccucagauuuagcaaagaccagaauauuauuauuacccgucauacucuguuguauguucaccugggcuuugaauucucacaugugguuauaggcacaaccagagcucucuucaucuggaaacacagagccugcuguccaugauggcuucuccaucccagcacgguaucugggcucagauggcuggggcacauggaucugauuuucuuucuguguguauauauauauacacacacauacauaugcuaugucacuaggcuuauuacagacagggaacagagggacagaaacaacccaggauccaucacaggccagccucucaagauuaauaagcuguaugguacaaauaaagucuuaacugcucguguuguacuaauagcacaguugagaaggcauucuucucuagguugcaugcuucuggggucacaugacucccuagaccaaguuuugaguagcucacugucuuggucaggguuucuauuccugcacaaacaucaugaccaagaagcaaguuggggaggaaaggguuuauucagcuuacacuuccauacugcuguuaucaccaaggaagucaggacuggaacucaagcaggucaggaagcaagagcugaugcagaggccacggagggauguucuuuacuggcuugcuuccccuugcuugcucagccugcucucuuauagaaccaagacuaccagcccagggauggccccacccacaaggggccuuucccccuugaucacuaauugagaaaaugccuuacaguuggaucucauggaggcauuuccucaacugaagcuccuuucuuugugauaacuccagcugugucaaguugacacaaaacuagccaguacacucaccauugaagaugagagaggaucagaccccaagcuucuuuuugugugcccuuauaguagauuuccugcgcguucuaguuaucugagagcuacagacaagcagaaaagagggugagaugggaucagccaagucaguccuaggaccguguugcauaguuuuauccuacacucacugugcaaggaacugaauagaggaugacaggugcaugccuggugcaucauggggacugugggcaaccuguacuuagaaacaggaaacuguuguguccuuagucuaaggagguagaagagaauaccaaguagugcagucugcuacaugcuacccccaaggaguuaagagucagauuaaagauuaaaacgcugaacaauauagcaugccuauuucccauguuuaauuguuccuuugaaauccgugagaucaagagaggcgauugcugccucuuccuuuuccaguuucguccugacacauucccuaggagcugagucaggagcugaaucuuaauuauuaucacagacuaccacuaauguugacguuuuccuauuucucagguuuccccuuugacuucucgucacucccaagguuuucggaggagcagguuuuacagagagagaaacaauuagccagcuuucaaguuuuggcuuugaaagaaugccugaguaagugacaguuugggcuucugcuuguacuguaagaaugugagucuguuuaaugggagcugccuggguuuacgugcuuaucccugugcacguuaucuuuaaggugugaugcguaaauagggaucuaguguugacuaggucugcagugcuguuuuuacuggagucagaauauauaucuugguugucaguacauaauuuuucauauuuuaaaaaccuacauggccaaggaaaauucauauuuaaaaaaugaauacucugagccauaucuuaaaaaagacauagaaguuuguuauucuacuuaacacgaauaaucccuauggaguuuugguagcaggaaggcagggacggaaaacagaagaaagugagguuagucuguuagcucgcacauugguucuuuaguugaaccgucacugaaggaucgacaccuaagcacaguucacauacuaggcucucaucaggagcuuuccuuagcuggggcacuuaacaccuuuuaaaaagagauuagguauuuuucuuucaccauuaauaauaaaauugguuaucagucugaauuuuuauaaauaucaggcaugcauuguuuccuaauacuaguaugcuuuaaaucacugaugcauaauuucuaggaaaguccauaaauuggagauaguagccuauuuauucaguagaaaauaaguuuagaguuaauuuagaauauuuagaaaaaauaaucacuacuuaguuauucauguaagcgcuacaaaguuuucuuaguuguaucaagguaguuguacaucaauuuguaauguucgaucaaggaaaguacuguuaaaaagaaacaucaguuucaguaaacggugggacgugggagugagaggguucagugggcaaggcgcuggcacccggccugauggacugagucuauuuccagaacucaccugauggaaggacagaaaugauucugaccgccaccugagcaccguggcauguacaggcaugugcgagcauacaggcacacucgugcacacauacacacaugcacgcucacauacagguauacaaauauaaaaggaaaacaaaugguaaugcauguuugucuggggacacucauagcucaguugauaaagugccugcuacacaagcuuggggaccuuauuucagaugcucagaaccuacauagaaguugaccguggugcuguguaccuggaccgcuuguguggaguuagcccuggagcucacuggccagccagccuagccaccuaaugagcugcagauucggugagagacucugccucaagaaauaacauggagacuaggcagacucaguggugugaacccugggacaccacguuagaaggaaugaagucaugccugcacauuguccucuggccaauccaugcaccccaucccccaacacagaaaugauuaaauguuaaaaggaagaauguggagaacagcgaaggaauacaccacacacaaauacauguguacucacacaugugcacuuacccucaugugcacacaccauagaaacuuguaacuggcagucugagcauuuagucuuggcuuaggugagugguacagugaauccauucauggugacuuucucgcuaaacacaucucauccauccccguacaguuaguacuagaugaaagcuuugguagcaaaagugcauuuguacauuuuaagaggcggaguaauggguuggcaacaaguucccaguguuugagugucugagugcgcccaucagugauuucucaugugugaggugugaagagaaaugcuuuuaagcacauguguaugucgugaaaccuaaauguugucaaaaagaucuuuuaaaaucagcccuuugauauugcuaagaaagucucuuugcauaacacaaaccuucaaaaagauauccuuaaaauaccaauaaaacggaggauaaacagccccguucuuacagugucucccugacugcuuucaaauggaaaggaacuggagaauuucugguaaaaugugcuaguuaauaaugcuguugagacauacagucuuuuaaaauagugugaauaucaaauaaagcuuguuaguguguaacuuuguaaaugaguucacuuucaguuuauuuuuaaaagguaucccauccguuguauuaaugauauauaaaauauaacuuuguaauuuaauauuaccaguuucuguaauuuaacuuuuagacuuggcaagagcuaacaauaccacaccucaguaauuuuuucaagaaaauguuuagaaugcugacaagaaaauuuagcauuugaaauuugaguugaguaugaugugaaauauauaauagaaacagcgcugucuccaguauuacauggaauacaccagugucuuaucuuuuaaaaauguguucacccuacuaaaauccugauucauauucagcugauggcuuuuagauauuuauuguuaauuaauuuucauuaguguuagcuauuuaauaaugaauauagcauuccuuugcugaucuauuucagaguauuacauuuccuccugagugguuaucgcucacguaauaugcaagcuuauuuguauguuuuuuuuaaacauacauugaguguguaauuuauuaaaccucaucuucccucaacccaguuauuaaggucaaugugcucucucuuucuaagucaaggcgggcgcugagacaucaguauacuuuuaguuaauaaaaggagggacugacuccugaagcgcauugcuccuguguaucuucaguggaaaagcgagccauugagagcacuuuccuuuagaaguacuacuagcugauuguacagacaggaaauacacugaggcugcugaguucuucccugagaagaucuuuuagaaaugagauaucaacaacucugauuuuacuguuaauauuucuggccacagaaagcuucuguuucuuaccuugggcuaaaugugcaaggcccugagaauacccccuucagugagguaggguguuccaggcccaggucauaaagcugguguucuaaaggggaaggugggcugcuuucucaccaaaggccugcccuguugguguacaagccaaccugcuguagccuaaucugcuugaauccucugagccugggccccgggagagugccaggaggcagugaguucucaauagaugucugcugaauuccuaucaguuuauaggagagcagaguuauuuuagaagaaaaugugauugguucagaaguguuuuuaaaagagauguuucauaucaauguaauucauagauacagugugaaaauucagaugauacuggaaaacuucaagugaaaacaugcagugccuucccaacccuccucauccuucugccucugcccucagggccucuggucagccuccugccaguucaggccuugcuuuuuguuuguagauacugugagauuguguguauccaguuucagaguucucuucuaucuaacuguggcagauaaagaauuaaugucccgcugagugggguggcgcaugccuuuaaucccagcacuugggaggcagaggcaggugaauuucugaguucgaggccagccuggucuacagagugaguuccaggacagcuaaggcuacacagaaaaacccugucuugaaaaaccaaaaaaaaaaaagaaaaaaaaaagaauuaaugucucuucccagugacccugaacaaugaaggcaugcaugggcugguuaacauuguaacagcauaguuaaguuuucugcugagcuguggacuauauuaugauacagugccguuggcuugcuuugcucucagaaaucuaaccccacuccugucugcugcagugaucuuguuuuguuuuauugguucgacccacucccugacggcauugucugucugcagaaggauuacugugaaucaucauauguaucccucaccccaaccccauagcugcuuuaccgagcuguauacaugacaggccauuuucuuagaacagccucgauuguucuuagauaaguauuaauucuuuucccaguucucuuuugccuagaccuuguauaguuauguauugacgucccgggccagaacacuucuuuuucuuuucuuuuacuguguugucuuuuucuaguuuuacaacacauauuccauuuuauuuugcagaguuuuaaacguuugaguucuugucuacuuaauugugggaaucuuuauugguuguuuuuugagacaagguuuuauguggccuugucuugaaguagguguauaauugagggugcccuugaccucucgaaucuuugauuguuaguaccaaucagugugcuaggauugcaggcugacauugucacaucugccgaggaguccuucuguguuccaugauaguuucuucaucaaagcagccugugcuuaucccaguaucuucuuuauuuuagaaaaauauuaauucuaucacguuuucucuuauuuucuacaauguuuugguuucuuuugaauccuuuuucuuuuguuucucuuccuuuuguugccuugauugauuuuguuuuguuuugauuuuuaacuugagaaaacucaacaauaccucuuuuuccaaagucaaagucaauuuaggaaaaagcugaagaaaugucaggauaaauuauaggugaaaauggugugauguuuuagcuuauggcccagcuggcuuucucguacauauaccaagucuugcacuuagcuguaaccgcuggaauuggguaacuacagaccaaccauacaaaggaaggucccuggccacacuguagacaggauauccuggagacuggcuggcucuguugaauguaaaaggaaggguuagucaaaguuggccuggucacguccggcucaccgagugccuggagcaagauggagcugaccggccuccugugcugaaguucuugcauggguaaugguagcauaggaaaugcagggcccgucccucagcuccucugcagggcuuccgauuguuuucuguccauccuguuuucagcugcagcuucuaucuccagccucuaauauaacacauggcaaaccucacuggggaggggaggggaggggaggggaagggaggggaggggaggggaggggagggggggggaggggaggggaggggaggggaggggaggagaagagaagagaagagaagagaagagaagagaagagaagagaagagaagagaagagaagagaagagaaaaguauccuaaauuuaggguuguuaaaacaauacauaaacggaguuccacaguuauucaccauugugacaugacauucgcacaccagcugccucucuuuuuuuguuaauguuauuuuucuccuguguuuguggggacacagagcuauagaacacauguaauguaaaauaugucguccuuagucaacugacacuuagcugucuaccuuaaacagauuauuuaccucccgcagguugcuuauuucuuuccuuuuuuuuuuuuuuuuuuuuuuuuuuuuuuuuuugguuuuucgagacaggguuucucuguauagccuuggcuguccuggaacucacuuuguagaccaggcuagccucgaacucagaaauccaccugccucugccucccgagugcugggaucaaaggcgugcgccaccacgcccagcagguugcuuauuucuaagcagacagugaaguaucuuugcuagguagaguagcugggagugcugaguaauaugaccucuauaaagggccaagcacacagugauagugugucuuugccaccgaacauccucguugccuuccucaugcccauauugcucuuuucuaaagaauaguucaggcauccaaugugagcccaccauuguucgagcccacacuggaagugcagagagccuucucucaagaacgucaacugcugggcuagagaguuggcucaguggucacagcacugguuguuuuuucagaggaccuaaguuacuugccaguacccacguagcagcucccuacugucuagcuccagugcacccaaugcccucuucugaccucugaagacaccaggcacacauaugguaagccgacauauauacauacagccaaaccacccgagcacauaagauaaaauaaaaaaaaaauuuaaagucuuuaucauuaaaagggaaauuauugaauuuucccccaagugaugggauuuuuuaagguuuauuuauuauauguaaguacacugucacugucuucagacacaccagaagagagcaucagauuucauuacagaugguugugagccaccaugugguugcugggaauugaacucaggaccuugggaagagcaaccagugcucuuaaccacugagccaucuguccagccugugauguuauuuuuuuuaaaagcuuuucagagucauguuuagcaguaguuaugguuauuacuacuugcuuuaacuaauagagaaaauagacaaaaaaaauugccaggcaugguggcgcacgccuuuaaucccagcacuugggagguagaggcaggcggauuucugaguucgaggccagccuggucuacaaagugaguuccaggacagucagggcuacacagaaaaacccugucucaaaaaaacaaacaaaaauuauugaaacuuaguuuuagcucaucaggguggcauaaccccagcacuugggagguuugcacgcggcaauaguaguaguucaaguucacucagugcaucugacauuucaagaccagccugagcuacagaagacccugccucaaaacaaacaaacaacaaacaaacaaacaaaggaaaaccaaaauggagcugggcaugguggcucaugcauuuaauuccagcgcucuggagguaugggcuggaaggaagaugaguuugaugcuagccuggccuacagagccaguucuaggacagccagggagggauacauaauagagagacccuguuuguuuguuuguuuguuuguuuguugaaagcaaaauaaaacaaaauaacaagcacaacacaaguuuuaaacguuuuagcugccaauauauuuaaaaauucuuuuuaaaguaaaaaccaguucagccaggcgugguuuuauggaaaguccaagaggggaggggaggggaggggaggggaggggaggggaggggaggggagggggagggggaggggaaggggagggggagggggagggggggagggggagggggagggggaaggggaggauuuacugcucugauuugauccggccucuauucacacccuggcaucagcauccagggcucuucucccugugggcguucagcuuuaugucuuguucuuagaauccucuugugucccacuggcuccaggcagccaaggagagcugugaauauggcccagauagacucauaaaugucauaggugacaaucuuugucacagaguugguuacaucugucgcucugacugugauccuuccaguaggccauuauagcugccgguauuuugguaacagggcuugagaucugauguuuacaauacuagaacuuaccccaucuuuaacaugaccuuucuacauacuugaagucucacaguuuggaacuauuagaacaaaaccagaauggaagcagugaugccugucucugaggcuggacgguggaggggugagccgagcuggagcucugauuagcccuuuguguccagucugcuuugaggcugguaccucaugacauuuguccaugcucccuggcaguagucucugcaggcaccuaaagugaugaccccucuguucugcugacucaguuuaccacuuauuucugucuuccauaguuuguuaagaaggguacuguuuuguuuucagauuuaaccugccuuuagaauuagagaaagaaggaacagggaugcauguuauuguauuuaauacaaaaacuauggguauuaauuuuauaugcuguauuaguuaggguucucuagaguaacaucuuacaggauaacucuaaguauggagaaagagguuauuagcgugacuuacagacugguccagcuaauccaacaguggcuggcuguaaauggaaaguccaagaaucuaguaguuucccgguccaugagcuuucagcugguuuucaguaugugcuggaauccugaagaaauguguucuaaugccagugaagguguacaugugccagcaagguaguggcgggcaaagggcaaagcucccuccugucaugcucucggguaggcuuccaggagaaggugugugucuucccgccucaagauccagaguagagauagaucuucccacuucagaugaaguaaaaaucccucaccauuguccccuccauuuuuggauucuaguuaauuccagauguauucaaguugucaucaacuuaaaugacaaccaagagcagcccuccuauaaacacauuaauguaagaucauuuuuaaugcucugugacguauguauuucugaagacuuguaagcuugccuuuacuguccaucagcuccuaguguuaaccaauuacucucuuucccucaugucucauaacucaaaacuguacuguuaacuaugaguaaguucaaaaugaaaauguggcuucaugaagauguagacauuugucuuacuuucaaaauuauauuuaacaaaagauaaacacuggaacuacuacugcaagugcucugaaaaugucccaugguuaacugugucuauuuguccugcagaaagaagaaaggcugcaaaccagcccgaagccuuuucugccgaugaacucaaaagucuguuggcacucacgagggagcgcuuccuaggucacuuugauguucuccccacugaagcagcuuuagcacaaacagacaccgugaaagcugccggcgugguaaaugguaagggccuuauuacguuaacauuuuugguagaggugguaguguguguguggcacuucuguuaauauuaauucuguuaauuaaaauuuuaugagcuguauugggcaagccaaaguauauuuuauacauuuaaagaacgccguauuuguuuacacaugugugugucucaauucgacuuacuuaaguauggcagacuuuaugcuaacaccuuucaucgagcaucuuuaacuguuuuuaagcagaggaggaagcagucuguggucuuagucaucuuacuaaguggcuagaaaggauagguuugaaaaguaaagaaaguaacaagcuuacagugagcuggauacaggcagaacuaugugcuaggacacuucccggcugccacuccuugggguuaggaggucaccauacuucacaggggcaguuagcaaucauuucuuuauaagucuaauguuaugaugaauuugaauaaagggaagcuuucuggugucuagcaagaaagcaucucucucuugauguagaaacagaggacaaacuuuuguuuuuauuuuauaggaaccauuuucuuguucagguaaaugaaaaaaaaucacagaaucaaauuggcagugguguuugagcacccauuccacgauagccaauagucacacagaaaugggcaucguacuccuuucaaccacauuacacuguagagcagugaaugaaaacagugggccugugcccugcuugaauacagacgccuucuaguuuuuauuugggcccuguuaacugcggucuggauuauuuuucucaucuccuugauaaaauacuuggcaaaauguauuuaaggaagaguuuccacucauggugggagagcauuccacuguagugggaagacaggaggaugguagagacaccagcuggcugguccauuguguccucucaggaauuggaaaggaauggacgcugguauucaccucguuugcuuucuccuuucugcucaguccaggacccaaguccauugcuuagugcucuuccacauucaaggugaauccuuccucaguaguuacaucacagcacauccagacuuaugguuuuuuagaugauuucaaaaagaaaaaaguggacagugaagaccaaccacuguaguguugugggcccucacaucucugccacugggccucuagguaucucauuagcauggagaucucuuucugugguccuacaggaccacacaucucuuuuccuguugucuuggucugagauguuagggaugucucauuuacauguggaagggcuugggguguuuuccuuaugugacugaggcccacaaaucuaugggggcgggggagaguggguggaggguggagggaaugggcggaggagcaagggaaguucagucuacuaccugggcauuuugugaggauuaagugaguuaauggguguaaaacacuuagaaaacaauaaguaccacaaacacggaaccugucauuugugguauuagucccaucguuccauggcggugccaacaucaaauagcgauucagaguaagacauaugaagaguguuggagacauugugucaccugugaauagaguucuauacagggagcaggagaacauguuuccugguuacagccugugcucuugagcaagaguaccaaggcuaaacacuggcuauguaagugugggcacguuuucugaccucuccaccuuccuugcccuuaccuuuaaauuaagagugacuaaauuaauugcuuuuuuacuugugagacaaaauaccaggaccaaggcaacuuauaaaagaaaguaguugagccgggcagugguggugcaugccauuaaucccagcacucgggaggcagagacaggcagauuucugaguucgaggccagccuggucuacagagugaguuccgggacagccagggcuacacagagaaacccugucucgaaaaaccaaaaaaauuaaaaaaauaaaaaauuaaaaauaaaaauaaaaauaaaaauaaaagaaaguaguugagcugauggguuagaguccauaugggugcagcaaagguacagcagcaggaacagugagagggcgcaucuugauccacauguaagagacagagaaaguuacccaggaauggggcaaguauuuugaaauccuaaaaccugccuccaguaaguacacacuuccuccaacaaggccauauguccuguuccuucccaaauaguuccaccgacugaggagcaaguaucaaauguauaaaccuuuggaaucguucuuauucaaacacuccagugggcuagacugccgugaagaugaaugauuugugaacuguugugaagugagugcugcauagugcugccuauguaaaauggcauacauuuagaagacaugacuugaacuagaguagaacaauuacagagccuagcucgaagcccagggauguugacauauggaaggagaggagaagaaaggauuuuucaaggaagaagcaacuaguauagacuagccaugggggaguaugagguaggagagagguuuggcuugucaaaggauuugcaugggagcugagagagaagagaggcaucuuugacgugaccugagcgagcaagccuaggaugcuguuagcacugggcuguagguguuugugguaucuccuaggccacaugucauuccuuagcucaaaccacgcugauugcucucauucgcacagaccaugucauccuuucuggcuuauacaagccugagcagacccuggccuugugcuccaucugguucccaaauuguacauuccguuuuccuuaguacaucagugagcuugaucccuggacauguccuauuuuccuccauggcuuucccuccgccuugucuucagccuagaagucauuucuuucagcuuuuaccuacauaucugcucuguggauguucagguguucuucucuaaggccuucucaggacuuggccaguuucaaccauuuccaucaucuuauauggcauagauuuaaaugaucuaucugccuguugcugauauuugucuucucuucacaucagggugucuugaggguacaaggcacacuuacuugucuccauagcugcagggccugucagagagccuggcauaaagaaaaggagccccccaaauugcucauuaaacaaauggaugaagacuugucagaccugaaccgaaaacuguuaggcuauucauuugcgcaugacuccuaugaauacaguugugacuguuagcauucuuugauuugaauaaauacagcuauaaguaaauugaacuucauguaaaacuaguaaggccaaucaauuuccuaucuugccacacugcaaccaggcacaguuguaguuauuagugauacaggaugaauuguacugcuucaguuuuuguggacauccuagcaagucuaacaacugacagaucuccacuuggccaugauggagccagcuuacuggcucacugcugaaguuggggaggacuuuccaguggauauggugccucauagcugacacaggaagugucuuggcacuucucgacagauagcaaggccauguauaugcguuucguagguagcuugaaaucccuuuugguauuucaaacauuuaaugucauguuuauaauugcgcugugaaauaguuuauacuagugauaauuucauuuuuucauuguguuuauucuuacuuuagcuguaagaaguaauggcuucuucuccuuagccauacauagugauggcugggauuugugauguuaaggccgcuuuucccugguuuccuaauuguauugguuauauuucuauuucuucaucuuguaaaauaagguaauuuucuuuacuuuucagggagccuucuccuacauuuuuuagggggacaugguauauaguaucgugagacacaaauaaauaaaauacuguauuuuauuuuacuauaagaauuauguuuaguuauuaccccaaagaucugacauuuacuaauguuuguucacuguucuuaaauauuaggcuaugccauucauauuuguguauguuacauccucagauaauaauuuuuucuuguaauaugcaggacuacauuuuguuuuuaaaugacaacuugaauccucuuaaaagcacagagugugcagugguggagaacuggcauugauuauuuucuguauguuuuuauuacaaagccaugucuccauuaagaagcacauugcuuugcuguaaagcucauuacccuauaaaauggauuucaccacucuuaauaagaaaugggaaaugguguguuuugaugaugcuuguugaggacauccaaauguagguauuagaagauauuuugaaauaaugaugguuaaauaauaaguagagagaaaaugagagauauuugcuuccauuuuuauaauacuuauaaacaaaacagguauucuguuagcacugacguaagcaucuagcaauuuuaaggcauuuauuagaaugcuguauaauagguuaaagcaauucuuuuuuuuuuuaauuagguauuuucuucauuuacauuuccagugcuaucccaaaagucccccauacccgccccccacuccccuacccacccacucccacuucuuggcccuggcguuccccuguacugaggcauauaaaguuugcacgaccaaugggccucucuuuccacugauggccaacuaggccaucuucugcuacauaugcagcuagagacacaagcucugggggguacugguuaguucauauuguuguuccaccuauaggguugcagaucccuuuagcuccuugguuacuuucucuagcuccuccauugggagcccugugauccauccaauagcugacugugagcaucuacuucuguguuugcuaggccccagcagcuuaaaauucaaagccauaauacaguuguuaauuuugcacuguuugagcugauacuuucugaugagaauggaagcuguccuuucaaguuuuguugaguucuguuguuaggagcagacucaguauaauucccuacagcauagcaaccagcaagauggugcccaccugcacucuuguuggaguggaaugauacugaguuuuagugauuugagggcaucuccaauuaacagaugagugggaaucacaucagaguaacccugagaacauuauaagcauauaguggccauuuauuaugccuuugggaaugagguaaucuuuuuguuaacgacaugaaacuuuucauucugcuuugccuguuucuaguaugaaagucacauagcauuuauuauaguguucaccauagacugcuuuccuuuucauuugaccucuuuugcuaagaauagugaacuugugccuuuguuccacgugagcuuuaauauuuucauuguguuuucucaguaauagcucauaaacucuauuugaagguauuuuuauuuccaacaauauuuuuaguaacauuuuaaacaguucaagucauuugauagguucuuaacaaaugucucaguugaguucuuagccuacacacacacacacacacacacacacacacacacacacacacacugcuuacuccagguaggccuugaacacauuauaaagccuaagcuagccuuacauugugauuucccugucuuaaccucccacacaguaggauuaugggucugugucaucacagccagagagagauauguuuuuacauagagcauucauuguguuacaauaugucaaugcugauguuuauuuugcucuuuuuagaugacgguacaguugaaccuuauucuucaagccuaauggaaaccaauccucuggaauggccagaaagacauguucuucagaauuuagaaacuucugaaaaagcuaaacaaaaaaugagguaauauuugaguuuguagaaaugcauguucaguauuuucaaaugaguucucuuaauauuuuaauuauuuaauauaucaguagcuuauaauuucauuauaaaauagaaauacaugccuucuuuauuaaguagcuaaucaguagaguagcauguccauuaaaaggggaaggucaucugccuuuucuauuauccuguuccuuuguaauuaugcauaacuggugaauacuguaauucuaacuuuauacagcauuuuccaccaacauucauacucaguuuauuuuuuuuauugcugagauaaaacagugauuuaaaacagcuugggaagaaaguuuuuauuuggcuuacauaucccaaacacaguccaucgcugagcgaagucaaggcggguacucaagcaggccaggaagucaaccuggagucaagaguuagaacagaggccgugcaggcguguuccuuccauggcuuguuuccccacacucggucagcuugcuuucuuauauaauucaggacuuccuucccagagugucuucuucucacaccaugacaaugccccacaggcuuaccuacaggccaaucugaugaaggagguuuuucaggugaggucuguucuucucagagacauuccucuucucaggaaagucacuugaaaguguucugauuguguccauauuuguccauguaguaaguagguaggcugagacagaacuaaccuuggccuuuggcuuuggugcacaguagacacuguguggcugcuggaugguggaguaggaacucgcuuacccuucuuucucaguguguagcuccucuguugauaucauuuuaugaccugcuguacccucuuuuucauuuuugcccacaaguauugauuaaauaccgguuguuuggcacuggggcacaugaggaagagcaccagugccugucuaauuugugagcuccuuuuaguagagagucaaucaaaagaagacgagggccacacauggaaaggguuccacagcucccaugucuucagagcagguggacagcucagggaggggcgcuaugagcaggugguauuugcauugguguucuuuauugcuccuggucauuauugcucaucgucacucugaccccaaagcucgucuucuguggcuuucuagaaagggaagcaggcucuuccucaagggucucccuaguugacacugauuuccguuugaacagagaguuucauguguaugcauaaucauucuugaaccagaagcauguuagacccucagcaacaccuuucuuucuugcauccuucacaacacuacagcucaguguugauuccuucuuuaaacaugaagggccauguuaugacgucugugaaugcauuuucuguaucucccugagugcugaauuuaucucuguccacccucacuugcuuggcucugcuggaguccgaccugugcaguaaacugugagcugugguugcgggcucacaaaucagagugagcuuuguuugcugugcugcagugacauuuauaaaucaaguggucauuaaggacugaaggugcuuugauaggaaaaccacaucaaguuucugugugagagcaaacauuacauugcaugucuucagaauuguguuaguguuaaaacauuuaacuagagaaucauucuguagugaaagccagaaggcaauaagaauucaguuuuagacucaacucaccaaccugugucaugacuuuugucacuaaaugagaguggaauaagagauccuaguuuuaccuuaaaguugugaaagccucauggcagaauguaugugaauguuuaaagcucaguugucaggcuuaguuuuuuaaccuaagacaccuaucuuggucuugugcaguguaucacaaauuaggcuuuuaaaaacugcuuugauaucuuuguguuuggagucuauauaaacucaaauuauacuuuuccguugcuuccagccugaaacauugauugugauuaguacugauuaaggagcauuguaagauacuauuaaagaagcuauauagaaauuaaauuaaaaucacaaugcagcucuugcccacccagaguaugaaauucagagaaaauguuccuguguuuucuugcuugacuauuuuuuuagauucuauuccuuuuaacaaugauggggcuagaaaggggaaauggacccgccaccgugugcugauccuuaguguguaaaaacacggcucuaaaauucaaugccagcauuuuaaucauagaauuacucauaaaaacgucgcaucugaguaauacguaaaauauaaucaagauggggcuggcuugguggcucagcaggaaaagaaaggaagguauuuuuugcuaagccugaggaccugaauucaauccccauggccucccugguagaaggaaaaaacggacuucugcaaguuguccuuggauacacacaugcacaggcacucacacacauguacaccaaugcacacacgcacacgccgaauaaauaaauaaauaaauaaauaaauaaauaaauaaaugcaaaaaagguaaaauuuuaauaugucauguugacauauugaaugguuuuuauuuauccuacagugacagagcagugagugguucaggaacuaauauuuacuauuuccugagaugaaaguauuuuccucuauucauucauucauucauucauucgcuugcugugugauugucugguuuauggagugauaaaggcagcgguagcuccuagcuggcguccgucuaguuuugagcuauuguaagcagcucugcugugcccagucuguaaugugacugauauaugcuugcagacuucagguggaaagugugaggaacgcuuguuucaggcauggugcacugauugcauuuuuauaaaguccucacuagguguuacuuuguuuugauauaagaccuguuucauauuuuuucaaggaaauuagugaagauuaagaauauacuauagguaaaauccuuuggaaaugcacucaguguguauucaugauguuguaagcauggcuggaggagaccuuggagagaauuuccauuaccgucucauuucauggcugugcuuuaaauaaucuuuuaaauguagagaaaauugaagcauucaguccuuugcuuccgaaauuuauauugugggcuuucaguuuaaauuuacccuuuguagaacugguaacuucacauuacugaacuguuagcguguuguauuuaauaaauaacauaaucucggucuguaguuacugucuugugcggauguguuguccgugccuuccguuuuguauuuguaauggauguuucucucaucaucauuuccuggcugcgguggguuugaaugcaccuuuaauaaaacuauacaaauuauuuucccagaacuggcucauuaccgcguucgucugaacaguugcugggccauaaagaggguccccgggacucacucacauuacuggaugcuaaggagcugcugaaguauuucaccucggauggguuaccagucggagaucuucagccguuacacauucaacgggggugaguuagaaacuuauaauuugcaagagucauuuaaaaauagcauuguauuuuuuucccccuggaguuaacugaugcucugggcugaggcagaaaucccagguucgccuccacuguuuaucacuagccucaguagccucauguuuacauucacccaaugcccuucugcucuguggcccugaauguaaagaaaauaaagaugaaggggcgacucuguccauuuccuuaguauuuggggcaagggaggcuacucuguauacaaugaaaucagggugcaaucuguucuuccccguguuuccuuuguucuucuuugggguguuugugcauguguggcuccggugugccacaguguacaugcgcaugucagaagacagcuuuggagaguccauucccuccugcuaccuuuccaugaagcccaggcggauuuaacuuuuccucuucugcauuagugucucuuuuugcuuuugccacuacuuagcaugaugguuguuggucauaacuacuaacagcaaaaacucagagccuuccagcugaaggaggggagaaaauagucaagauucuuuugaaacuaugaccuuaccaagugcaagcucaauaucugcaucaauacuuuauuuauuuauuuauuuauuuauuuagguuuuucuagacaggguuucucuguguaguccuggcuguccuggaacucacucuguagaccaggcuggccucgaacucagaaaucccccuggcucugccucccaagugcugggauuaaagugggcaccaccacugccuggcuauaaauacuuuauccuaaauuuacuuuggagacagcaccuacuaaaguugcuaguuaacaaaugcuggcugcuccugcugcugccuacaguauaaauaaaauuguagcaucaauuucuugugaagaucacauaauuuacuuccccaaauucuuuuuuauuuuuaaucuauuauuuuaaaaaccuucuaaggaccaaaagguugaaucucucuuugaccacugugauucgauaauuuugaguugugcuaugauaaauauuuuucuuaaagguaagcuuuggaagggguuugaguuaucucagaaauaaucagagcacgguugccuuucguacaaguuacuggggagaaaggguccacgaaccccaucacugacagcaggggaauuguguguuaguggccuaaugcuccaaaugaaauaaaagugacagaacucuggagucgcuuacuuccuuguggcuuugagagguugaaaaccccuuuuagugggaaguggggaagcagagccucacacagaugcucaucucuagucaccacaccgugguccuugaccgaccagccugacuccaucuuaagguuagaagccaucuuauuacaaagucaaaauaaguucacuccuauuuccuugcaugugagcaggucuugaccuguuuucuagaguuugacauguuccacacccuauacccugaacuccacucugauaagauguuuugccaaauaacuuugaaauguucugccaaguuccucuguaaccaaaaacccuugaaaaacccuuaaucuugcaguuugggggcuauauaaaccccacuguuuucuguguucaguguuauuuucucaaaccuugcuuuaggggggagagcacugccuggcagaaaauaaagcuuauauaacaugaccaaagaauguggguaauggucuuuccucccgguugguggaaugaacagugccuucagacagacagcccccgcugcagaugaaugcgcuacaacagcacgguacacucaccucccauguguucuuuuacugcagugccuuuaggaugcaguggaggcaaguuguuacaugugauguacuuagaaaagauuucuuuuugguuuugcuuugacauugccuuauauaccuuaggcugaccucaaacucacucuaugguccaaguuaaccuugaacuugcaaucguucugccucugccucccaacuguggagguuacaggcacaugccacuuugcccagcucuuagaaaaacugcaaugguucuuucacauuaggaaaacagggcauuauuacugccucuucacuuaacacagugguucucaaccugugacuugucagcccuuugggagucuaaagacccuuucacagggggucgcguaagaccaucagaacacauagauauuuuaacauuaugauuuauaacaacaaaaguacaguuaugaaguagaaauagaaguaauuguauuguuggggucaccaugacaaugacagacuguauuagaaggucacagcauuaagaagguugagaaccacugaccuaacaugacuguuaaaagcugaacugaccuggcugcucucaccugggcaagguaccaccugguggccgugcuacauuaaacaaagggacagccaugcaccuuagagugcaccaagggaauaagaaacacuagcaaacacuauuuguuacauuucuuuuagaaggacugagacaaaaacugaggaauuaaauaaaaauaaugcaguggggagaauugaaauaaauauugaagaaaagaguaaaauguggagaacuuaagauucuuguuuuacagauucuucauuugaagggucccuccucaaaauaaugaggucauugcaauuuacuaaugauacuuuuuguagaacacuuucaauagcaguauuagcauaugagguuuuguuguuguuuguuuuguuuuaggauucaucaguugguacaugugugacauuugauguaaugacuucaaguuccuguuaagcucuguccaucuuugagcagaugcacugcuuugcuuugcuggguuuacuggccuugcuggagugcaucuuguuuccagcucugcauuccacgucuguucacucugcacgucaccauguaaaggccaacccuguggcagacucugcccauuuccauggaaccaaugcugagucucagggcugugacugaccauuagaccagugggugguaacucaucaggaaagggaggccgagucaggauaacccagugaccuuagccugaugcagcagccgcuuggauucacaguagcccugcagguuuggugaggaaggacuuggaugaugcuguuguguggaagcucuaagggcuugcugagugaagcauucugcagaacgcagugcagcacuuccucuggagaccugauucuguguauuugcucacuccuaacauaaguggcaugugacuuauaguaagaaggaaauacauucuuuuguuaccaaagauucaaguuaacuuuauuccucugauaaaauguuuuagcugaacaacuggacacaaacucguuucaccaagggucagagugauacauguuaggaauaauguugcuuccugaauuuacguuacaaauaauuuuucuuucgugauuuacucagucucauaguuuuauccuguggguggcaucccaucauaaacaaauggagaaaggacagacuuagccugucucgucauugccuuuuuaggcuuuuuaggauacguuaggucagcaggcucucauucucucucccaguccugccuugcacucacccccccagcccaggcuggccuggaacucaaggcgcuccuugcaccuccaccuccuaggugcugagggauugcaggccuguaccaccgcggccagguaccuugacucgaaugcuucgugucuuaguuaggguuucuauugccaggauaaauuacugacugaaagcagcuaggcuuauacuucugcaaaguccauagugagggaacucagaggaggaaccugaggcaggaacugaagcagaaacuaugaaggagcacuacuuaguggcuugcuccccauggauugcucagccuguuuucuuagaaccuccaggacccgccagaggagcaccgcccacaguaaguuagacccuccgguaucuaaaucaucacucaagaaaaugcccccaggcuugcuuacagccauaucuguuagagauauuuucccaguugagguuuccucuuccccgaugacuguagcucauguaacaaaacaaaaaacaaaacaaaaacaccucauguagggaaagaagucagauuugucuccuuagaaacuuuaacuuucucugcuauguaguaagccuuaaauacaaaugaaacccuuuucauuucagggaaaagccuuuuguuuugacaccagagcuuaguccuggaaaacuucaggucuuaccuuuugaaaaagccucggaaugccauuaccacgggauugaguaaguuccuuuuacacuuuugcguauugcugcuacagcugucuuguuguaaguguuugcugcaugugaaauaaaaugaugucaaucgauacagaccccaaacaaaguaugugcccaaaccaguacgcaauucauguucuacuagaggagaaugacuugucuaauaauuuguuuugguucguuuaaguaucuuuuuuaguuacgcaauauuuuuaacaaaauuucuucggcuguacauuauuaguauguauuuucucugucacuaauuauauuguacuugcuuagaaacgaguagaugaacuaagaauguaaacaaguuaauuacguguacgucauuguaucauuucaguugacuuucauauucaccuuacucuuccugucuuaucuccuucccgcucccccuaaacuccuuccccuuagcaaacgccccacccacugcccugcaacucucucaccuuucuguguguuguguugccgcuaaguuugauuaguguugcguacagaagcauuuauagcagauaagagcaacuuaugaauggcuacaccacugaagaaaaauacccccacccccaccaccccuaagcaccauuaggguccucagggaggguggaaccucuccugaacccaugaugcgacacugauaggcccagucuuauguagcucuugugcugguggugacagcuuugugaauuucagauggccaugucauauauccagaagacacauuucucagcgccucucccugggcuccugcucugacaguuguccugccuccacuuccaugacgcucccugguaugcugcaaagggguggccuaggguggagcacucagcaauugguucugcucagcacucuaagcaguuaggagucuguuaaccauugcuuccagcacacagaggcaucucugaggaagccugggugcagugcugaucuguggguacaaacauaaguguugagaaugcccuuuugugggaagccggguccuacacccuuugacagcacagauacuuuguaacacacuaguaauagguuccuucuaggaucuaugacccuagaaccuacugcagcccuuaauuguuucuuuuaguuuacucuuugauaguuucauacauucguacauuuaucuugauaauauuacuuaccucuccuuauaucuggcauaggauuuucauuaaugaccuuugucuucugggagcagcaucaucaugcaugcaggguauuuacauucagacuuuuuaaaauuaaacuuuuuacuugguuuacaaaguagugggcuuuuguauagcuuuuuucagucacccuuaguuuuaguuaucagccaccccccuuuacugcuccaucccuucacccccuucucucccacccuucccucucaccucuuuccucccaccccuucucucccacuccuucccucucaccccuucucucccaccccuucccucucaccccuucucucccaccccuucucucccaccccuucccucccaccccuucucucccacccuucccucucaccccuucucucccaccccuucucucccaccccuucccucccaccccuucucucccaccccuucccucucaccccuucucucccaccccuucucucccaccccuucucucccaccccuucccucccaccccuucucucccacccuucccucucaccccuucccucccaccccuucucucccaccccuuuucucccaccccuucccucucaucccuucucucccacaccuucucaugcuucucccauguucacuccccuaaccuccauaucacauucucuucuucauuggugccugcuuccagucuucguuucagaagcacauucuuggcuuucuuugguuucaguuuuccuuaguguuuacucuuauaggacaccuucuggcaacacuuuuugucuccauacaaaacugucugcuaugaaaaaugggaaugcaccuccccuuuuccuuauugauuugauugcuaugcuuacguuucauuuauuguuguguuuuguguguguguauguauguauguguguacuguguguaugugagacuacaugcauauguauaggauuucuuccuguguugcucucugccuuauucccuucagagucucucacugaacccagagcucagugauuuuuauccaagcuggacgccagcaaugcucuagcaauccuguuucccuguuuccucccuucuggagcgggaguuacaggaauccacggcuauccucagucuguugcccugugugcuggacucagguccuugugaauggcuagcaagcacugcuacccacugaaccaucucuccacugauguuugcuugguugccuuuucuuuuucuuucuuucuuuuguuuguuuuucuuucuuuccuuccuuccuuccuuccuuccuuccuuccuucccucuuuucccuuccucuuccccuuccuucuuuccucccuuccccccuccccccucucuuucccuucccuucccuucccuucccuucccuucccuucccuucccuucccuucccuucccuucccuuccuucccuucccuuuuccuuucuuuccuuucuuuccuuuccuucucucuuucuuucuuucuuucuuucuuucuuucuuucuuucuuucuuucuuucuuucuuccuucccuucccuuuuccuucccuccuuucuuucuuucuuucuuucuuucuuucuuucuuucuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuucuuuccuuccuuuccuuccuuuccuuccuuuccuuccuuuccuuccuuuccuuccuuuccuuccuuuccuuucuuuccuuucuuuccuuucuuuccuuuccuuuccuuccuuuccuuccuuuccuuccuuucuuucuuucuuucuuucuuucuuucuuucuuucuuucuuucuuucaagacaaggucucauauagcccaggccagcuuagauuuucucuguagaccuggcugaucucauagagauccaccugccacuaccucccuaguucagggaguaaagaugugcaccaucacgcccaaagcccguguuuuuaaauuuauauuuaaaaucccauuccuuauauuaugaccuagaaaguucugcuccuuaauuuugauagguuuagagcccucuauuuuacuuaauagucuugaauacauauacaaugauccuaaccuauaaugaaacuuaagugggaguucaauauagauaguuugcauguaacucacaucugaggguggaacccaguaggcucuguuuauauuauuagagacagaguguccaugcuaagcaaagcagugcuagugaugucugccuugcugcaccgacacgcaccccaggacacaggugcuuuuugcuucaggcccuagaagcucauggaagcucugcuuugagugaaacauuaacacuugcauccuaauaucuggcuggagugccugucaucugaccacaugguagauuguguuuccacaaguaauuuacuuuuguuuaucuugugcuucaucuuucuauugucucuugauuuaauuuaauaagaaaaauauuagugguacaucugacuuuauaagcaauauguucuucauguucauuuauuagaauaguaaugaauacuuguuugugcauuacuggccuaaacccuuauggcauuuuauuuacagugucaugagcugcauuuaucucagcuuuacuggcuuagugugggcuacuauugcuauaaaacaccgugaccaaaaccacguuagcgaggagcagaaaggcuuuauuuggauuaugauuccacauccauaguccaucacggacgggaguuaggacaggaacucacauggggcgaggagcuaagggugcugcuuacgugcuugcuccucauggcuugcucacccugauuucuuauggaacccagggcaaucugcccagagguggccccacccauaauggucugggcccuccugcaucacucacuacuuaagaaacugaucgacaggcuuaccuguagcuccaucuuauggaggcauuuucuuaauuggaguuuucuccucucagaugccuuuagcuuaugucaaguugacauaaaacucaccagcacagcagccauaaaacauuuagcuauucuuauguagaaaauacgaaacuguuaaucauuuguccaacaguaaauauuucccugacaucagauauguaccuuguauucugugucucuccuuuaccgugucacuuugucuuaaagggcauuuuaaugacagcacagggagcuugugcacagugcgugauucaguugaagggcauugggaguaccuagaauuauaaggcauuuaaaagucuacaucuuagaaacaaaacaugguaguacgaaaauacccguauaaucauaggauaguuuucucucuaaacaguucaauauacaggcucaucacauauugcauugcuucuugcccagagucugcacaaauccaugguucuuaauauuacuguauauuuuauuuauauccccggacagaguaugaguaaccucagaguuauugcuauuccccccccccccacacacacacacaauaagcuaaaccaaaggcuagagaaagaaucaaacaucaggaucugugaucuaaacccacucuuuugccugucaguccucugacugaagcacugauugcuaauaguucaaguuuagaccaggguuccuccacucuacacuacuacacuuuaggaucaccgaagcagcuuugaauuuccgcuguauauguaagauauauaacaccaugguauugcauaucugcagaguggcaugauuacuacagucaggcuaacauagcuacacuucacacaguuacuucuuuuugccauguguaauaagcacugaaagucuaaugcuaggaaauuuggggaguagaacacacacgguuuccuccugcuacauuagagcucuagauuuauucauucuacaggacucagucauuuuggacccuuggacugacaacacugucucucuccuaacaaugaccucuauucugccagcucuucuguguauucucuuuuugucuuagaaucaucuuuaaacccuuuuuuggaagugcuagugauggaguuagggugugugguauauauguucagguuuccaguggauuauaagaucuaucugcauugacuagaacaagaugacccuucuuccuuaaccucagggaugucacacuaguaacuaaaugguuacuugggcucugcaaucaucaacuacaguuuacauucugauuaugcuccaugugacuggugugcuguaaggugcacaaugguagaggguaaaucuggggaugauggaggcagccuuguucauuugguggccacugcauguuuugaagucugacccuaguacaccacucacaauuaauccugauagggccuccuuccauaaguacuucaaaucacauuuucacacuaggcagcagaagcauaaaauaaucugcccgaauucacauagcuaauagguaacggaaccaggacuuaaauccauauaaaucuaugaccuauaaucuuugaaauaaaguucugaaagccucaucgggcuaucggguguccgagaauugacauguuccuugggagaugagcucugguauuaggggccauguuagaccccuuuuacaguggaaaggacagaugaaaaagguuugugucuauucuacuuggaccacccaucauucauggugaagucauuugugguccuugaugcaguuacggaaaggggaggauguggagagcuuugcaaggccaucgaugcuuucccugcuucuuuguugugcuuggcguggauuuuugaguccagaagcaguugcacagcuaauacgucauugacucacuggauuagguuaaaccagagcccagauauacaggcaaccaacacguuuaaaagaaaaucuguaagucgggugacaagugaauuucaguguugaauaccguuauaccuauaaaucuuuaugcugacagugaacucacccuuuccagcagagucagcauuucccauaguugcauccccaucaugcugagaacucagggguggcuagaguuuuaagaggcauuaaaacaacagccaugccaguuuggacauaauccaaaggacgaacugaaucucuagccacagaagugcaucgaagaggaauuagauuguacuucacauucguaaaucuuuuuguccaauagcagacuaagaaaaaaaugugagcugccgagaaguaggccauucagucaacuuucuaacaauuguuagggaacuaggcaaguuuuaagacagugucuugcuguuuucuuuuagaaagggaaaaaggccccauuguucuccuggauuugauuucaacgcucuuuucucauuuuagauauugccuggaugaccaaaaagcuuuagaaagagaugggggauuuucugaacuucagucgcgccuuauucguuacgagacgcagaccaccugcaccagagacaguuuuccaguccccaccgugcugagcccucuuccauccccugcaguucugucagagccucagaguguccccgaaggagaagcacugcaaggcgaacugaggacugaaguuucuggauugaagcggagaucuaaagaccccagcugccuguacccccagaaaaggugaccugucgaguccacagggacagugucuccagagaaguaucuuguucucugggaggauuuccuuucaugucugccucagacuuuuaugcugcugauugcauggguuucuugguucauuccuucauacuaggaaguucguuuguauuuugaguacucaacugguuuugcuucuaagguguaaaaagaaaugacuuggaaaagccaagagcuuuugcuuucuguguugaugcucagcccaucagcacagugggugugugaagcugucaagucaagagcucuagaggugcccccaguaggugaaggcucagcugcccuuugaagaugauaguugaggguggaauuuuuuguuaacucucucucugcucuuucuuuuauuugcauuggccuucaaccaagaggcuucauggggcuccauucaaaaaccacucauuacauguaaauaaagcuucaaaaguguuaguacauuuuauggaacuuuucaagacacuuuguuuugcuagccaaauaguccaaauauauuagaauuuagauguugauaaaauaaauacugaauuuauagaucuauaggccauguguuagauuuagcccugggcauaaaauaugcuguaaguucugacuacacuuaagccuuuaaaauaacuauaaaauguguagaaauaaaccuucgaagaucuuuggaauaggugaaaauacgaauaugcuguuuccugcuaugaaauagcuaaaugauuuuuaugacaacuuuguuaguucauggcauuuuuuuaugucugauuaaguugcaaagcaaaggcguuaaaaagauuuauauuuggacaaaguauacuguauacuacaguguacaguagccugagaggaacagaaggaugcuucuaaugucugcuuugaaaaaggaaaacauuucuuuuuuuuuuugguuuuucgagacaggguuucucuguguagcccuggcuguccuggcacucacuuuguagaccaggcuggccucgaacucagaaaucugcuugccucugccuccugagugcugggauuaaaggcaugugccaccacguccggcuuaaggaaaacauuucugcgucauuguagaagcaauauaaaugauuuaggaaagcugaaauaagaaucauuuuuuuuguuuuacuuguauuugcuuuuagguacuuauuuugcacagaucguugcacagguauagcacaaaggcuugugguuucuuucguaacauucuuuagugaaggguaugagugcuuccucuaggguucuaaguguauaaguagaggaauccuaauauugcucauuacauuccuuguuagcuugaauucuaguuaucacuugccuucucuuuuagcacugcccuugcuacuuuucugauaaaauacucugacagaagcagugucaaaaagaaaaggcuuauccaccucacaguugaggucugcgguccuucauggcagggaggucacugugguaagauggagaagcagugcacuuaccccgcccacacucacaagcagggagcaauccaugcaaagugcugcucagcucccagacagucuagcaugccauggagacggagagggaggggcccacucacgguaagaugggucuuuccacagcgauuagugcggucaugauaacccaccacaggcacacucagaggccaucuguccggagaggcuagauccugucaaguugacagcacuaccacagugcauaagcacggaacuaaagaacaaacagcuucauucuuuggugucaguuauuuuaugcaaauuacuaagagauuuuaguuuucuuggauuuguguuuaaaugaaaauaguugugacauuaaaagcgaaaaguaggcuccauuguugauucauuucauuuguacuuuuucccuccuuacagacuuacgagaucagaaaguucugauuguuugccuucccaagcgaguugcaauaguaaucaucaccaucacacagggaaacccaggaagccucaggcagagcgcugugugucagggcuuccucugccuggccgggaagcuuccaaagauaccucaaagaccaguucaggacaaaaacgagcacacgaaucaaaaucaucaaagcaaaugaaggaaucacggucccagaaacacacacggguaaggacuuccugcuuucucacuucugcaugaaaagaaaccucauugugugauuuuuuuuuuuaaauagaaaaccauaugccuaauggauuuaugaagaauaaaauaacauucaaaaccuaagaucaucagaugcuaggagcauggugaaggcuggagcucgcagguagaccaguugccuaguacggugaaggcuggagcucgcagguagaccaguugccuaguacggugaaggcuggagcucgcagguagaccaguugccuagcaugugugaagccaguucauuagacaguguggcuagaaaagaaacuccaugaggagaaccuggggauggggugugaaggacacaaaguagacagcgugauugcuuauuguaaaaguuggcaugucagugcagcaaaacaggaacguuauaaagguacccucuugauuuuccaugauugaaaucuuucuucuaaagauuucccugcaguguauaucuuggcauucagauuucaggucacagcucgugauuucaauuccuuccccuaguuacacuaggcauuuuccugcugaaccugaguccugagacaugagugagcauggaggugucacaggcugcuuuuuuuucaaguguuuugucagaacaaccauauuuaucuuuaguauaggcaaauaacuauauaacucacaauucauuuaucaucaaaacugaaacaguugugccauuucugagaaauaucagccagguguuccuuucuguugaagaugcugaaggaggugguaaaagacaccuugaagaggcaccacaucacggaggcccaugagagcuucacggccugcagccagagacucuucgacaucuccaaguucuaccugaagguguggugacuucccuacucaccauuggguuuauuucaugcucugauguguguuaggugugugcacauagguuuuauauuaucuguuuacacuugcugccaggccacuuuaaacgaaggcagaaauacugcagugaaaccaccuuacauuugcuuuauuugacauuagccuuuuguauagcaagcugcuuuaaucagaggccuuaguggguuuccuaacaggccuuuuacuaaggcagagcuuuagcauuaauugguaauuauuuuauaauuaagcuauaugaagcuaaauggugaguauaguauuuuauuacaaaaaguacuaaagagguagcuguuacuuugggccagaugucaggaguccugugggggugaggagcugcucaggugaucauuuuucuuauuuucuuuucaaaucauguguuuuugugugcugugaaugugugguauauugugcaugcacucguaggccaaagaugaauagcaagacagagucuccgaauaacuugcaaucuugccguuuggcugucauggcuagucacugagcucccacgauccuccuggcuccaccucccagcucugagguuaaaagaauacucagccgugcguggucuuuuccaucugggcugaggauuugaacucagguccuugugcuuacacaauaggcauucugucccgcugagcuucucccagccccuaggugagaauuggaugucagcuuucugaaacuugggugcuguuugaucgucucugcgugagaccuacccagcaagcagaaguaggucuugggguaaaauuacaggacugacacaugcauucaguaaccucuuuuaagucugcuuaagacgggcagcaucacuacaaaaaccaaguggagaaagguaagaaaaaaauauauuuuguugaguauuuuaaaaagcacaugaaagcaugugcagaguaaaggaaguugugagaagccuaccuuguuucuacauguaauaccaguaaggccggugcuguuucagccagcagaagccagaggagguagaggaacuaaacgaaccacagugaaugaccuucuuccacagugugacuacagggucuuugaacaguucuguucccacaccucugacaguaaagucucagagcaaaggggguggcagugagaagccagcuggucaucugguccccuuccuuguaaagccaccaaacucagcacucauggcucccauauuuucaguaucucuaaguagaagagcacagcgaaggacuagcagacugugcacacaacuucugacucaagggaagccaaaauguaaagagaacuccaaaaguuagagugggagaaaaguuauaaacacuagaauucucccagaaauaaaacugugcccauaaaacuagaacuacaugcugucaccaaaacacacagagaauacaaaggcuccucucaguuaaaggugugaggaaaccaauuuaauggaaacgcugcacagcucagcuggagauguuuuacaaauaguaagaaauaaaggagaagaacucuagaaagagaaaauggaggcuagauccagaagacccucuacugauaauaugagggagcuucaaagguagagacugugggagagaaauugucaaaaauaaagcaaagcuuucguuagggacucacucagcucuugacccugcauuuccuucgagccuguugcaaaugggcaguguccaugaccucaggugugugcuuacgguugagauacagaaaagcuucugauacgcaaggagauucuagagccugccacgcuguugaguuugugguuccuagaaguuuucugguagaauuuuuagaaucucuucuguaugauaugccaccugcaauuagugauccuuggacaaaucuugugcccucuguauccaaagguuuccuucucuuauugcucuggcugugucuuccaacacagucuugaaaaggagugaggauaauggacagcccugucucgguccugagaucuuugcgguugcuucaaguuuuucuucccuuagaugauguuggugugagugucucuuccauagcuucuguuauagugaaguauguucccuccacccuccuccucuaggacuuuuaucaugaagccauguuagguuuugucagaagcuuuuucugcgucuucuguuuuuauguccauuuuguugaaaugucccugaaucucagugaugaagccaccuuuaucccuaguggauaauauucuugauauuugucuguauuuggguuguaggcauuuuguugaguguuucugaucuacauuucucagggagauugaccguaguucucguuguucucuggucaggugucacagagagaugagcuucacuggaggaguuugagagugaucguuguuaaugguuucuuuguuuguuuuugauuguuguuauuuguuuguuuuuauuuuuaauaguuuaaugaaagucuggcuauagaucuuuuaaagucugguagaauuuugcugugaaucucucaggcucaagacuuuuauguuucuaguucaauguguuagagaucuauuuaggguauccaucucuucucuuccuguuuuaauuuggugaugaagucuuuuuuuuuuucuuuuguuuuguuuugguuuuuuuuuuuuuuugguuuuucgagacaggguuucucuguauagcccuggcuguccuguaacucacuuuguagaccaggcuggccucgaacucagaaaucugcuugccucugccucccgagugcugggauuaaagggguaugccaccacgcccggcuggugauaaagucuuaccaacaugguucccuaaacauggccugaaugaggauggggacacacacacauacacaauaauuuaagaaaaagaaagccauagauuuagaagacagcgggggagggcuuaccuggaaggagguagagggagaaaaggaauggggaaaaugauauaauuauacuauaaaaucagcaaauaaaauauauuauauuuuuuaaaaguucccagaaaugaggaacccaggccuauugcuggaaaagaugcugcuuacccaagucagugaguaaaaaugacaucaagccacuggaauguccaauauccaaguucucagaauauuuucugagauuuccuaagagaaagggugcuuacuuauugaaaggaccaagaaugaaaugaugucaagcuucuccaggguaucucgguacccaggguaucucgguauacuagaagacaguaaaaagcgccuucuaguucugagggaaagugaccuagcugguguuaauccaaagugaccuagcugguguuaauccaaucacaugagaagacucaauaacaacauuuucaaaccuagaaaagguuuuaaaauauaucuuucucuuuuacagaaucuguuagaaaaucaaguggugcacauaaaaggcuaaaccaagaaauaaaacaaaacuugaccuagaacgagauaaacaaaccccuaaggagacuccaggcaacuguggcaggcaggagggagauccauggguuagaaacgauaaugagauuggaaggaaaaccccaccgaaaauggaagugagagguuauccaggacaugucagugguuuaaaaagccuuuuuaggcauuuaaucaacccaucauuagagaggggggaaauagcagaguuauguaggugaaacacuguugguggagaaaaaaaacaaccaauaaccaguccguuucccuagaggaaguguagaaucugagugaaagagacauggccacagucugacugccucauggcuacaccgccuuugcuuggauauaauaaagcaaucacaagcuaauuauggggcccaagcugugggguaaccguacggcagaggaagagaaagagaagggaguguugggcauagacuuaggucugacugcuagugaucgagcucuuuguagucauucugaaauugcuaaaucaucaggggccagcaaagcaugacagauggagccgugaagguacccacaggaggaauggcuagaagaauucagaguggccgccucucugagguaucaccugcuugcuggaggaugaauuuaccccuuuuguacaauuaagcuuuuauuuuaauuuuguguuuuaauuugaaauguucuccaccuccucugccugccccacuucuaugaauugaacccaagauuuuggacauggcacacagguguucuacuacugagccaaauccccagccugaccauauuuuagaaaguaagacuauagcuuucuuccucuuugugguggaaugaaauagcuaagaaaagaaggaaaaaauacauaucucagcuauuaguagaaaccaaauguguaugucccaaguacugauacauuggugguccagugugagggugagcaugggccaggacugucgaagacaugggaugugggacagugugugugugugugugugugugugugugugugugcguguguguguaucugucugucugucugucugucugucuguguuuggugagagaauuuuugaauuucagaaugagacucuuauuacuacguugauucugggcaauacuuuucuaauugcagggcacugguagaauucuuuaggauaaucucaaguucauuuauaaugaguugucgguaauguaauaaacaagguuccaaaugcuguguuucauuaaugucuaggaucugaaaacaucaaggggucucuuugaagaaaugaagaaaacagccaacaacaauguggugcagguaaguaauucucaaacagccaccuuccauuaaauggggauuucgucucaggguugcuguucugcuguuacucuuacaguaaaaauagaggugguguuuucaacucugaaauguccuugauauuuaaugauagacuuguucaggcaagguguauuaacacuuaguagguagcuuuaucaaaaaagauuuucucaaugauauuaaaagagaaaagugaaaaacauaauucaaagaacuaggaaaaauacucuauuuugauuagcuguuuuccaaguuugguuuaacucuuuugagugaccauuuccaaagguauuuucaaauaaugguaagaaaguggccugagccauugucuggcccauugaggacaguuacagggcucaggguugcaugugaggcucaagaugcccuuaauuuggaaaagaaaauaucuuuaaguauaaagacugaauguugucuuuuuacuuuauauuuucuguacuaucuuuuaaggcuuuguugaaaaaaaaaaacaguugagguuuaauauauauauucuaauauuggaguaaguggggguuuggggcuaagggaagugaggugcccuggagggagggcacacccagaacuuaauuuugaaguuguuuuaccauguauauuuugcacagagugguucuauaaucauguaucuguuuucuuccccaggugaucgaaugggugguagaaaagaugagcaagaaauaagcuacugcacccccuuuccuuagagaacuguacacagccuguaaacuuuccccaaagagcagaugccucauuuguaaggaggguccaugguguccuguaucuauauaguuuugugacacucaguuauuuucaacuaaugcacuuauuuuuacaguuuuacaauauuuuaaucuaugaaauuuuuauauauuuuaaauguuuuaacucuugguuauuuaauuguuaaauaaacaguaauauuucauuacuucuugga

SEQ ID NO: 7760 - RNA, 12192 nt, Mus musculus
guuuuuuuuuuuuuuuuuuuuuuuuuuuuuuuuuuuuugagacaggguuucucuguguagcccuggcuguccuggaacucacuuuguagaccaggcuggccucgaacucagaaauccgcuugcuucugccuccugagugcugguaucaaaggcgugcgucaccacacccggcuuauauuuuugaaaugaaguccucccuucuauaaaucaagguauuuuuguagagcuucuaauuagaggcuaauuagggguguuauaucggauuuuccucaaggacgacagauucauauuacaaaacaccaucuauaccaagcauaaaauagcuuuguauuugaaaaguuuuauaaacugggggcuuuauauuuagucccauguaaguaaaaauguauguuucaaaaacuuaacucucagccaggcgugguggcgcacgccuuuaaugaggccagccuggucuacagagugaguuccaggucagccagggcuacacagaaaaacccugucuccaaaaucaaaaaacaaaaaaacuuaacucucugcuuacccuagucuuugaauauuucuuaauuuccagucacauauuuuucaacagaugguagagauacagauacagaugguacuuuggaugguaaaauuuauucacuuuaaauucauuauugugauuuuucuugguuuaauguuggagacagaccuuaaauucugaagguauggagagggacccauaacuacaauguaccuuguuuuaguuuugaaggcaguucugucauuucgacuucaacagguucucaucugcacugacuagauuuuuuuuuuuuaugugguaguggacccuuaaguuaccaauguguaguguuuggugagucaucacccucguuacauuuucuggacaaacauggaaaugacauggaacacuacuuauuuauugagccuguuuaucaguguacaucuggaguccacauccccuuuguagaagauuucuggacuucgcacacuuucuugaagcccauucuauggauguacuuuuuuuuuuuuuuuuuugguuugguuuuuugagacaggguuucucuguguagccuguccuggaacucacuuuguagaccaggcuggcauaugacagacauaugcaaccuuggacuucugauccugcugcuaugcccccacccauacccuucccauucacaucaccccaaguggugggauugcgggcaagugucacccaccaugucagggaguaaauccuguacuugcaguuucauagccuguucgaauacuugugauaaaauaauuauuuugauuuauuguuuuguggggagauauaaaaaucauccuguacuaaaagcaacuauuaacauaaucagagaacuauuagcaccuaaauaaaguuggucuuaacuaaagucaaacuuacagcagcuuucuucauuuaucuuaaaggauggauucacaguuaagggagcugaaaccuaccacaacacgcgcucuuuaaggucucugagaaaccaagcacaaacuucuucagagucuaguuuugacaagaacguggacagaacagagaaauacuccaauggcagacauuucacaagguaauacaagaaaaacugcuugcuuuuauuuuauguuuuuucauuuuacaugacuuguacaugcauguacgugugugugguaaguauguggauguguguguguguguggggggggugcacuuggagguuagagacugauguggagugucguccuugauuguucuuuguaggaacucuuguguacuugcccugccucuggccuuuuacacuguagccagcacccuauuuuuucuuucuuuuuuaccccauuuuuaucuuuuggguguuuucgagacaggguuucucuguauguagcccuggcuguccuggaccucacucuguagaccaggcuggccuagaacucagaaaucuaccugccucuugccucccaagugcugggauuaaaggcaugugccaccacugcucggccuguuuuuaucuuauuugugucugaaaaaacagauagucaauacuguagggaaaauauagaaaauuugaggggcuggugagauagcucagcagauaagagcacugacuguucuuccaaagguccugaguucaaaucccagcaaccacaugguggcucacaaccauccgcaaugagauccgaugcccucuucuggugugucugaagacagcuacaguguacuuacauauaacaauaaauaaaucuuuaaaaaaaagaaagaaagaaagaaagaaagaaaagaaaagaaaagaaaagaaaagaaaagaaaaaagacuugagaagccauuccacacuggaucuaaauauuucugugaccaugauguucuugccuuggguccagagaucacauaagucaaccuucagagaacacaugaaaccugugaaguaauauuuaaacuuguauuugcaguuuucuagguagaaaagacuaaggcuuuacugagauucgcaggguuacaaucuggccacggauuucuuuggcacacacuguaugcaucugugccaacuugcaugcuuuuaugguguuaguuuugacaggcauagaaugagaagacugauaagacuaaaauauuaguuaucuuucuaguaccuucacaaaaaaauuuaguaauuucuguaaaauuaaaagcccaccuaagccaggcgugguggcgcacgccuuuaaccccagcacucggaaggcagaggcaggcggauuucugaguucgaggccagccugaucuacagagugagucccaggacagcuaggcuacacagagaaacccugacucggaaaaaccaaaaaaaaagccaaaaaaaacaaagcccaccugguccaguacaccaacaaauugcuacuuuaauugcucaaacucuuuuuuccuuuauacucauugauugaguggguguacaugcugaagacaacugucaggaauuuuuccuucugcuaugugaauugcagggaucaaacugaaaucagcagccuugaugggcaggugcuuauacccacugagccaucuugcuggcccugcuuaaaauuaaaagcccuuauuuucucuuguuguuaccuuuguuccaagaaagguaaggaguuaauguuuucucacacguuucaaaggauaugugagugaauuauucuagaugguuuccuuuuaauuuuuuaacuuuagcauuugguaugaguucaugucuaggugugugcacauguauguaaggguacaugcauuuuuggauacuaggggacuauauaucaggugucuuuuuccauaacugucuaccuuauuuugaggcaggaucucucacugagcuuggagcucaucgauuuagcuaggcuagcugaccaaugaccucuagggaucuguuucaguuuaccuccaccuucguccccauccccagugccacacccaggucuuaguugguacugggaguccaaacucagauccucaugccuguguaguuuguacugaaucgauauuuuuccucuuucuuuucuuuuuuuuuuuuuccccagacaggguuucucuguagcccuggcuguccuagaacucacuuuguagacuaggcuggccucaaauccgcugccucugccuccgagugcuggguuugaaggugaggugagcgcuaccaugcccagcuucuuuuuuugaugcaaaagaaccuaggaccccagacauacauaggaagugcuuuaucacugaacuguaggccuagcccuacaguagagaauagagucaauacauacaacuauuuagauaaaaauauauauagguuuugaaagaucagaagaacccauguggaauguuuggguuugguuuuguuuuaauucaguagauucugugugucauuuuugagcuuguauguguguuuguuucagacaaggucucuaccugagccuagccuugaauucaaagcuggcuguagacuccuguguuuuuuguuguuguuguuuguuuuaucuuuuuuguuucuuuuugagacaaggucuuccuauaaagcgcuagcuguccuagaacucaguaagcuguccuagaacucaggccaaguuaaccuugaacucggaucuguuguuuuucugggugugugagcacuccauaguaauacucuugacccaguuucucagguguugucacuaguuucaagcuauuguucauagaaaacaguuaacauaucccuaggguccaucaauucucuuuagauuuccaaauuccucaaggucaugaaguugccauauccuuguaugaaacacguuuuuacgcaaugcuuuuuucuaccuuaaauacucgguucaaggauuucacuuacuauuuuaagugagaaacuuugacuuguuucuucuguuuggcuagaguuaguagccaauaaucacaucacuuagaauaccgagucagguugaagcuagagagauugaccagcagcuaagaauacuuugguucuucccaaauucaauucucagcgccuguaucaguuguuucaaauggucuguaacuucagcuccaggggauccaacgccuggacuccacgugcacaaauacauauaaauaaauaaaauaaauaaagcuuaaggcugaaguauugcuauuaguucaagucuagccugagcuacaaugugagacugacuuaggguuuccucugcugugaagagacaccaugaccguggcaacucuuauaaaagaacauuugcuugggguuggcuuacaguuucagagguuuaauccuuuaucaucaugguaggaagcauggcaguaugcaggcagauauggugcuagacaaggagcugagaguuuuaccucuugaugggcaggcagcagaaggggacugugucacacuugcguguagccggagcauauuauaaaaaaaaaaaauccuccacucgcgaggcagaggcaggcggauuucugaauuugaggccagccuggucuacaaagugaguuccaggacagccagggcuauacagagaaacccugucuccaaaaacaaacaaaacccucaauggcugcccggcggugguggugcacgccuuuaaucccagcacucgggaggcagaggcagguggauuucugcgcuugaggccagccuggucuacagagugaguuccaggacagucggggcuacauagagaaacccugucucaaaaaagccaaaaaaccaaaacaaaacaaucucaaaggcugccuccacagugacacacuuccuuuaacaaggccaccccuccuaauaguguuacucugucugggcuaagcauccaaacacacaagucuaugggcgccaaaccuauucaaaccaccacaaagacugucucaaaaagacagacaaauaggucuguuacuaaauucaaaacagacuugcuuauccauaacauauagauauccucaguguuucuuggguuuuuaaguaucccaguauuauacuuucuugaucuaacuuuccacuuuaguuugucauauagaauguagaauuuaaaugucugucaauuguauuuuuaauugauuuagcauguuuuuuuuauaauaggcaauuugcucgacagcaggcugauaaaaaagaagagugcaaagaagguaaguugugcuaauggcauuucaccuuuguaaagcaugcaguucauaauauuuauaggcucauugaagcacgugcaaaaaacuguguacuuuguuagacuugacauaguauguaaaagaagccaucauauacuaauuucaggaaaauagccuuuaccccuaaaaguuucuucaaguuccuguuaugguuuggguaagaguggccccuguaggcucauauauuugaauuuaaaguaccaaggaaguggaacucugguggaauuagaaggguuaggaaguguggccuugaugaauaaagugugaugcugaggguagacuuugagguucaaaagcccaaccaggccuagugcaucucauucucuuccccuacagagcaggaucuuguucuuagauacuguaacuaccaccauguaugucacugugcuccccaccauaaugauagaggacuaaaucucugaaacuagaguugucuuaguccugguaucccuucacgguaauacaacagugacuaagacacugucauauaaucuaucuugguucuucuaguuccugucuugcccucagauuccaaaguaacuaccagucuguucucuuuuccuagaccagguuuucuccauguagcccuaacuguccuggaacucccucuguagaguaagcagauccaccugcaccugcuucccaagugcugggguuagaggugugcaccacugccgccccuugacuaguuuucuguugcuguagauuaguuuguauuacuuagagaucauuccggaucucugaacuuagcacucgaugguuuuuucaauguaggaugcucuguuugcauguacaccugcaugccagaagaggacaucagauccuuuauacaugguugugagccaccauguagcugcugggaauugaauuuauuagaccucuggaagagcagucaguguucucagcagccucugagcagcccucagacugaucuuuuaacucaggacugccugagcuucuugaggucagggauugcaggcauuccacagcaccugccuuuaucucuucaucuuucaauagacuugagcuguuauugauugugagcuauuaaaacugcuuuaagccggguaguggugguccaagccuuuaaucccccacuugggauccaccgcacuggcagguggauuucugaguucaaggucagccugaucuacagagugaguuccaggauaaccagggcuacaaagagaaacccugucucgaaaaaccaaaaaaaaaaaaaaaggaaaaaaacugcuuuaaacuuucaaauacaagucuucauaugauguaucuucucugaagugagguagauuauaccauaccauagguauauguuacaacuuaaaaguuuucuagaaaaacaaguuuaagauucuauaauuuugcuaugaaaguugauguucuguugcacauuuucaaguuguuuugcuaauacuuauuuaaaaucuguuuauuuuuccguacauaucuauaaagacaaaguuauuccaguuauucgcucauugaggaauagaaacauugcuccaacugcagaacauuugcacgaacaaaguggagauguugaaguucgaagaaguugcaggauuagaagucguuacaguaccaugaaccagucugugcuauuugacaagcuuauaacaaaguaaguuccagaacaaauuuugugggugaaggauugugcugugggcacuacuguccuuucucccccuccccugacauguaaaauuauguaauuggcuguccuugaacucagaucuccugccuuagccucccaagugcuaggaucaaagugugcuagcacccuggccuuuuccccucucucgcccuaaauuuuagggauuggauauuuauuuugugcuugcauuacaauugagcuaaauuccugaccccauccugaacauuguaaucucuuugauuugggugaaacauacaggagaauuagucaccuuuauuacauauguguguugaaauucuuggaaagaaguauugaauauauuaccaaguaaguuaaugccgccuugcugaaauucuguuucugagcacugcugaagcuguacuucaaaagauggaugacaugaaaaagaugcgcagacagcggaugaagaagcuugaagacuugggaguauucaaugaaacagaagagguaaccauuuuuuuuuucauuaggugaugacuuaacaucucauuuagugcaugaucuacucaugaguaauaaucacuuuguccagcauuuguugauuugucacagauaacuacuagaauuaaaaguuuauaguaugucugcauuuuaagaauaguuagguuuuaauuuuugugugaacauauacuaaauauuaauggauuuuauuuaaauauuuguagaguaaucucacuauguacacaagaggaaaacuaaaggcuauccagcgagcugaugaagaaacaacugauaaccaggacggcaguguggguacguuuucuuuuuaucucauguuuucuggcuucaaagguaagccuuuuuuuuuuuaaagcuuuaucuuauuuauaugaguauacuguagcugucuucagacacaccagaagagggcauuggauuccacuauaaaugguugggagccaccaugggggugcugggaauugaaaucuggaagaguggucagugcucuuaaucgcugaguccaaaguucagcauuuuuaacuuaguaggcaauagcuuucuuauuuagauucuguggcauuuauuguaguuucugguguuuauaauuuaaaagaaauauagacaaucagaaaaggauacucuguuuuguuggagaaaguaacugaaaucaaugguuuuaaaauaacugguuugcuuguauaauaaaacuacagauaguuuaucauacaucucugcauuuuauuuuaguuaaagugauuaaaguuaauuaugguacuacugcauuugagacuuaauagcauauuguauuuuuuauuuuuuaaauauaaagcauuuuuuauuagauauuuuauguauuuacauuucaaauguuauccccuuucccaguuuccccuccggaacccucuaucccauccccccucccccugcuucuaugagggugcucauccacucccaccucaccacccugaccuuccccuacacuggugaauugagccuucacaggaccaagagccccuccucccauugaugccagauaaggccauccccugcuacauaugcaucuggaacuauguguccucuuuaguuggugguuuagucccugggagcucuggagguucugauugguugauauuguuguucuuccuauggaguugcaaaccccuucaacuccuucaguccuuucucuaacuccuccauugggguccccgugcucaaucuaauagugaccaagccugcucagucagucaacgccuucuccaucucaggaacaaggauuaaaaagaaaaagaccauuacacaacauuguagcaugaccccagccaguucugaggcugaggcagguuuauuuuuucccauucuacuuuuauaccauuuuaauuacaugcaaguaauaaggucaagcagcacaauaaacacaaauagucaaggaacaagcaaggcaauaagcaaaguccuaugaucacuccuaagggcuuaucaagaugaccaagauaucugagccuacuucccuguccuagccaaaaguuauacucgugccugaagccuacuuuuguucuaaaguuagauuccugccugaacuuacuuccuugucauggccaaugucagauuccugccaaguagccccaaaagcucuccacacaacaauugccugugagcaucggccucuguauuugucaggcucuggcagagccucucagaagacagcuauaucaggcuccugucagcacuucuuggcauccacaauagugucuggguuuggugucuguauaugggauggauccucagguggggcagucaaugugaguucuuuccuucauucucugcuccacacuuugucucuauauuucuuuuagacaggagccauucuggguuaaauuuggagaugaguggguggccccaucccucaacagagagccuugccuaaccucugaguaugaucucuacagguucucccucccuuuguugggcauuucagcuaaucucaucccccauggguccugggaaccucuugcuuccugacaucugggacuugcuagugccuaccuccaguuccccauccccuguugccacauacuucaaaaacagcuccuaaaauauguugaugaagguuaucuuaucauuaucauaaaugucuuuguuagacugauauaauucccauagcugggaacugaacucaggacuucugaagaggagccagaguucuuaaccacugagccauugcaucagucccuuuaccacccucuacuccugcaucuaaauuuuauuuauuuuuauuuauauauauauauuuuuuuuacauuacuuuggguauuuuuuuuagauuauauauguguguguguguauauauauauauaugaaugagcacacuguagcugucuucagacaaaccagaagauggcaucagaucccauuacagaugguugugagccaccaugugguugcucagagucaaacucaggacuucuggaauagcagucuggagugcuuaaccacugagccaucucucuagcccuugcaucuaagguuuuuuguuuuuuuuuuuuuaauaauuaauuuauuuauuauauguaaguacacuguugcugucuucagacacuccagaagagguagucagauuuuguuacggaugguugugagccaccaugugguugcugggauuugaacuccggaccuuuggaagagcggucgggugcucuuacccacugagccaucucaccagccccccuaaguuuuaauuuuauaauuuucacuucuauuuugaaaaaaaacuuuauuuuuuaaaguuuuauuuauuauuauacauaaguacacuguagcugacuuuaggcgcaccagaagaggcugucagaucucacuauacaggugguugugagccaccacuugguugcugggauuugaacucaggaccuucagaagagcaguuagugcucuuauccgcugaaccaucucaccagcccugaaauuuuuuuuuuuuuuuuuuuuuuuugguuuuucaagacaaggagguuucuuuguauagcccuggcuguccuggaacucacucuauagaccaggcuggccucgaacucagaaaucugccugccucugccucccaagugcugggauuaaaggcgugcaccaccacugcccagcuugaaaaauucuuaaauguaaauucuuuauaugaauaauggaaaagcagguaaaaaauuuaaagauuccuuucuccuaacucccuauguuaaaaauuguuaauacuuuggugaguauauuggauguauuuccuuuguaaaauuuucauuacauuaauuuuguggguguugguaagaauguauguggaagucagagggcagcugcagaacuugauuuucugacuuuguggguccugggaauggaacucauuuuguuaguuuggcaguuauccuuaccugcugacaucucucuggccuccuguguguauucuuaauuuuagaaucaucugaagagggggaagagcaagaggaugaugauggcgaagaugaagaugaugaagaugaagaagagggagaagaagauaaucaaaaaagauacuaucuuaggcagagaaaaacaacgguuuacuaccagucuccacuggaaaguaguaaguacuaaaaugaucuuugaggaggaagauuuauuaccucauuuuuacugucuuucugggguuuuccuuuuaaaaaacauuuuuuuauuacacuuaaaaauauucugugugaucugugugcacacggggccgccagucagaggacaguuuggaaucagcuagcugucuuguacugugagccuuagggucacacucacuucauggagcagcgccuucacuaccugcugagucaucuuucuagcacuguucuguuguuuucguuuucucaaaaaaaaaauuuuuuuuuuuucacuuugccaaguguucauacugcuuuucuuuaagacaggacauuucuauguagcccaggcuggccucaaacuuggcgaucacacugccuucacccucuugagucuugggauuauaggugugugacaccaugcucugauaggguuguuuuguuuuguuuuuuaacaaaaagcacaggguuuuauuucucacccacugggcaggguugugcaggccuucgcagggcagggagaaggcuuuacuugccagcgaugagcggauuccgcagcaccacaaugacggagucccugcucaggaacaucuuggagauguagcgguccuuguuaacaggcuuggacuugcccuugccgcucuuggggaccucaguccacaucuccuucacauuuuccagcaccauguugcagugccugucaaaggccuucacccggcccagcgcuucuucuuguugugacaguuaaugagcacugagaggggaccuguguugaauucuuccuccuccugcuucugcagcuccucuggggucaucucacucuuggguuuauugaggagacucaugguguagguuuugcucacagaucacu

SEQ ID NO: 7761 - RNA, 17301 nt, Mus musculus
cggcucucggcucucccacccggaaacuguccuggccgccuacucuguuguccucuccuccugggagacuggcgacaauugcggccagcggguuguuuaguugaccugugagccacagcuucgggucauggagggggacggccccgccgccacggccccgcaguaccagccggucuguccuacgcgggacgcaugugucuacaacagcugcuauuggugagagagcgcgggcgcggaccccgggaaucugcgcgguuucgcgcgccgccaccaaugcgccccucuccuggaugcuccccugagugcugcugcuggccuacacugcccggguuuagcgccgggaugaggaggguggggaacgcauuucuggucuccuuagcugagccugagcaguggggugaagucggggcgucuuagugcauagggacaagggagggaggggaguuaggcuggagacccaaugguaacuguugaagucugcauugauucagguugaaguauacgucuuuauaauuuuaaagacaauggagacacagaauuugugguaguaggaaauccaguucaggcaacuggcuacccugauuaccuuacuggcauuaccuuacuggccauaugauaaugguugcauuugcaccauccuugccauaugcuaggcauuguuuugcgugcaugguguaaauuaacucaguugaaccucacaguaaucccaagagguagguacuggugugauugcagcuuggaagaacucugagguacugaagggugugcugcuguuuuacacaaggccccgggauugugagguuaguguccuaggcugcuugugcaaacaccguucaccuugccuuuuuugucccuaggccucaucuuccuuuuguguagggacugcuaucccaacucaggagaaaccucaggaucauuuaaauagacuccucucaacucuagcuggucacucaaacaaggacucuaagaacuuagcauucagcugugacugaccagugaccacuuuagcucaaguccaagugcuugcccugguucucaaucuuccagggcugugacccuuuaauacagaucuucuuguuguggugacccacagcuguaaaaacuucguugcuauuucacaacuaauuuugcuacuguuaagaaucguaguguaaauaucugauauucaacgccaugacccacagauugagaacagggggugguagagcgaugucuuggagacagguucugugguaauuauugacacuacaaaggcugaacuauagaaugguugugguuugucccagaccacacaacuaaguggaaugagaucuggagucuacauggugguugggaguccuucuuuuuuagcuguugcauuauagaucugcuccgccugguuuccaaauccugcuaguuuuuaucuggaacauuuacucugugucuuccauuuauuuaguaaauauuucguagggaugugaaauguauguugguugauucuaugcacagaggauagagcaguaaacaagguagauaaauuuccuggcagugccaaggacuggccucagcugggaccggguuucugaaagaagggguguuugggagcagugaaaacuacuugaagucaaauuguugguccaugcugguggucuauguuccgcugauguggcuuucuagacugcucucucugugucugcuugagacagcuuuuucuugcuauucugaaaacuuuuugguugaaacagcuagcuuucugcucaagacagcucucucugcuauuaaaaguucuaaaagcucuuuggauagcucauggguuugcugaccaagucagaaauccuguuagaaauacucaaaaaguaauucuuggguuuucugaucaaaaucagaaagccagaaaaaaaauucuaaaagagcuguguucacucuucugccagcuuuuucuguuuagcugcuaggagacaugcuaacagagcugugucaguaaaucuuauuagagaaaauucuaaaagagcuaagaaaagaucugaaagagcuguggucgcccuccuuacauugucccaccauguuccaaauccuguuagaaaaaaauucuuagccgggcuugguggcgcacgccuuugaucccugcacuugggaggcagaggcaggcggauuucugaguucaaggccagccuggucuacagaguuccaggacagccagggcuacugagagaaacccugggagggugugggggagggcgggaagaaagaaagaaaaaagaaaauucuugaagagcuguucucaaccuccagguuccccuuugauuauccuaugaauccugugaccccaggcccuuaauucuuaggagacuacaagcagauuuucucccccuuuuuuuagcauuguaaaagaauucagagaucuggcugcuuuuguaaauuuagcuaguugggaccuuguccggagauuaccauucugaccacuccuggaccuaaauuugaucuguuccaggcuugaacucagaaaucugugucauauagaguagcugccucuugucuauuuagaucugugaaacuccuuauacaauucauauugcauccuuauguuuuugcauaguugagaaauuauauauuuucaaacucauguauuuagagcucuuucccacagccuuaagggcuguccugagggucacaguauuuaccauuuugcugagacauuagccacaccuucguuuucuggacucaugcugucucagauucucauggagucauugauguuaacugggaggagggcauuccucugaggagugugaaaaaauguccauaauuauacaagcaagcauuaugcccacaccugcuagcccuguccuaggggcaggaaucaugucauucuguccuaccaaggccaugccagauuuggcaugucaggaucucacaauucuuauauuucagugaggggaaagcagacagccauacauaagcuaagucuggcuggugguaaagacugugagagcaauaggaugagagaaaagaugaugacuuuaugucaggauacuuaaggacaacgugguugaugagauaaugcugaacagacaucugagggaaaagcauaggcgcuuuguggauauuagaaggucauuucaggcacggaguaaagacuguucagaagcuccgagaauacaugcagugaguguuccuaggagcaguaagggguauggggaaauggaauggagcggucagguggaggagggacaggagguggcaucucuccaguaggugcgagagcugcucagucaaaucaggaaccaccacuauggaagugagggugauuauaggaaaggcagaaagcagaugcaagagacagauaugggaagacugcuggucaguaccaugccagcaaccaguguauuuuuuuuucacagcaacaaaagcaugacaggauguugaacuaugacuacaaaugcuuacauggggaguuuaugguacacaguaucuaugucugacuaaggcuuuagccuuagacagucucucaaggacauaugcauaacacgccaaggcagauguaagcagacucacucaucauuaacugcaagcaagaagucagccaaaguaaacuccagaugugauucccacaaauagguggucucuuuuuggcuuccugagcugcagcugagcucucuggccaucguggcggcuguuggcuuccuaauaggccuguuugccuacuucucugugauggauaauauuguugauuugacaggaucuacagucacccgggagauaaaccugugggcugugggcgugucugugugagagauuuuagauugcauuaaugaagauagaagguccacccaaaaagugggcaacauucuauggacugaugucccugccugaguaaaaaugagaagcagagcugagcaccauauuugucucucagcuucccugacugccgauagauacaaggcaucuagcuguuucaugccuuccccucugagcuagaauagaccuuuccuuaggauguuggcagcuggguggagguggcacaugccuuggaucagccugguauacagagcuaguuccaggauagccaaggcugcacagagaaaaccuaucucaaccaaaaaagaaaaacaaacaaaaagauguugccauagcaacagggaaaguaacacucuuucaucuucugcugguuucauauugcucaaaaccucauacucuucuguuugaauguguugaagagucaucugagagcuuguaaaacucugaguuuuaccugaggguucuaccucagaguuuggacuuacagguaguacaauggaggaguguaaggcuguugauuuuuuuuuuuaauguguuuauauauauguccaugcaccacaugaguaacugguacccaggaggcuagaagaagauucccccagacuggauuuagugcuagguccuugagaagagcagcaagugcuuuuuacugcugagucaucucuccagaccacacuuccccuuuuccucuccuccccucccguccccuccccuccccuccuuuccuauaaaacaggaucuuacugucaaggcuggccuugaacucaaagagauauaccuacccugccuccugaauugaacucagguccacuggaaaaguagucagugcucuuaaucacugagcuaucucuccagcucgcgcucucucucucucucucucucucucucuaucuucgagacaggguuucucuguguaacccuggcugucaugaaacucuaucuguagaccagacuggccucaaacucagagaucugccugccucuuccucccgagugcugggcuuauaggcgugcaccacuaucuggcacauuuuauuuauuuuuacccuauguaacauucacagaaacuugagaaauaucgggcaguaugucuucaagccauaucauguauucugccugcuaaugcuauuuguagacuccuggacuguacauuaaccccagaccaccuucaggauggagauggggacaaggcaaaaaggagaaacugcuaaccuguaccuuugcugcuuccucucucucucaguuaaugagucccuccucugugcuuucuuuaugcaucuuuaauggacccucugggauaauuggugcuuugcccguaggccucuuuccaucuguagccauuaauucacuaucuaagcacuuagccaugauuugugucucauaugcccuugaagauugugugugcuuaaaaguucagaauuccuguagaccagaccaacacgcgucuugucagaacuuggauaaagauguuauggggugugcucagagcagguggccugaagaauggcuucucuguuuacaacacacccaagaagaaucugggaccauuguaaugaggggcacaagcaguucccucucugugaauggauccccuacaugugucuccccuauucauccacauggcuuccaggcaaacccagugggacaggacucaguaccggguaugcuccaguacuuagcuggggggugggggauguccagaccauaguugguucaugugugaguaguccauggguggucugaggaugaagacugaaccugaguugguuguuucuucaccaccuggauccccaggagugcacgcaggccuuuacccucugagcuauuuugccugcgcugaauuuuucuuaaaaggguggaugaggccugaggagcuaaagguauuggcuaccgaacgggaggaccagagaguucagucccuggaauccacaaucccugaaaacuugcccucugacuuccacauaugcacugagcaugcauaaauucccccuucccccaaauguaauagaaaaaguauauuucuguaauacuuuuaguuuacuauaauuucaugaauuuccugcaugcuguuucucggguagugaggugugggugacuagaaaugggugcugacacccugagcagagguguuugugauucauuacacagagcuaggaacccagaagcuaagccgggaagucagcuaggaguggcuguucuugccugugcuugggaaggagacucagugugauacucugagcacugcuuaggugggcuuugacuaugucagauagcuaauggccugucacauagggagagauuugucugggacagaucaagaaauggugaauuucaguuucuaaaagaacuuuuuucuuuuuuuuuuuucugagacaugauuucuuuaacccuggcuguccuggaacucguucuguagaucaagcuggccucaaacacagagaucucccugucucugccucugccucugccucucgaguccugggauuagagauaugcaccaccacugcccagcuucuaaaaagacuuuaaaaaugauuucuuuuucuuuauuuuauuuucuuucgucuuuaaauugaaauguuuuugguuuauuuuaauuuauauauguaugugaguguguauaugaguuuguguuugugugucagauuucccuggagcuggaguuacaggcaguugugagcugaaauguggugcuaagaaucagacgaggacccucuagaagagcaguaggcacucuuaaucaccgagccaacucuccagcccuauuuauuuuugaaacagguccuuacuauuuggcccagucuggcuuugaauucgaagagauaugccucuccaguacugggauuuguaaaggguuauagcgugguguaagaaugugaguuuuacagaggagaaaaguaggugcuuagagaagccagaacaugcaaaguuguuuaucucagcuucuggaguccugagguaguguguuacuggccacagucagccuucugugguagguaagggcccucuggacaugugcacacauacagguuggcuagcagcuguugacuguacuaaagccaccuguuagcccucugucagaggaggugguuaaggucuucucuaguuauauccucaucaauuuuuuguuuaaauccaaaagacagcuguucacuuguaauuauauugauuaaacgauuguuugauuucagugaggaaaacauuuggaagcucugugaguacaucaagacacacaaccaguaucuguuggaggagugcuaugcagucuucauaucaaaugagaagaagaugguaaguugguaagugauugcagaaggagaugagguucagggggaccucagaagccaagugcaguauugacgcugugcugucuauaugcuuuggaacagcaagcuuucaaacauuauuuucauuuagauucaauuuagaaguauucauucccuuacuccuaggagaugaacuaugugaugguauauuuaugcagauugcguacccuuccuuucuuuuugagacagugugucaaaguguagaccuuggcugaccugaaacucacuguguagaccagacuggccacaaacuuaguguccuucugaguacugggauuauagguaugcucuguguauggcuuagagcuuuuuaaaaauuguauuguuaagccgggcgugguggcgcacgccuuuaaucccagcacucgggaggcagaggcaggcggauuucugaguucgaggccagccuggucuacaaagugagcuccaggacagccagggcuauacagagaaacccugucucgaaaaaccaaaaaacccaaaaaaaaaaaaaaaaaaaaaaaaaaaaauuguauuguuagagucauguaacucggauuugaaguaaagguuugucucugaaguuuaaguagagcuguaguaaacuuuugugacucauuagaaguaacccauuguguugucucauuugggguuaauaguucuaugaaacaggcaagauuuauuuuagugacuucacuucuguuuuuagagacagggcucauguuaccuaaggcacuguagccgcacauucauuuuguagacaaggcugggauuacaggcauguaaugccguggccugcuaacuuucuccacauaaaagugaagaaggaagguaggcaguggugggugcauuugggaggcggaggcagaggcaggcgauucuaugaguucaaggcuagucugaucuacagagugaguuuuaggacagccugggcuacacagaaaauuccugucucgaaaaacaacccaaaaacaugaagaaggaaagaugcaaagaggucucaugacuaacugaaugggaaggcaugacuugacuggccuugugucucccaauccaaaccuuuuuuuuuuuugguuuuuggagacaggguuucucuguguagccuuggcuguccuggaacucacucuguagaccaggcuggucuugaacucagaaaucuaccuaccucugccucccaagugcugggauuaaaggugugugcgccaccacugccuggcuaauccaagccuuucuguucucuggaggacacauaaacauuuucauuucuuaaaaagagacuuauuuacuuuuauuucaugugcauugguguuuugacugcauguaugucugugugagagugucaguuccucuggaacuggaguuauagacaguugugcgccgccacguggguccugggacuugaaccuggguccucuggaagaacagcuuaaccacugagccaucucucuagccccagcauuuuuuuuuuaaagauuuauuuauuauuauaucuaaguaugcuguagcuaucuucagacacaccagaagagggcaucagaucucauuacagaugguugugagccaccaugugguugcugggauuugauuucaggaccuuuggaagagcagucagugcucuuaacugcucagccaucucuccagccuccagcccccggcccccagccccaacauuuuuuauuuuaaauuuuaauuuaguuaguuuaauuauuuuuuucugagauaagguuucacuauggaccuuuggcuggccuggaacucacuauguagaccaggcuucauauucacagagaaccaccugccuuugcuuuugaguauugggauuaaagguaugugagagcaugcuugacugauugucuuuuuuuuuuuuuuuugaggggggguaacauguauguguguuugccuacauauaugucuguguaccuugugugcacuguaccuaccgaagccaggagaagguuggaguccguaggaacuggaguuacagauauuugcuaaacugcccuguggaugcugggaacaaauccuggguccucugcaagagcagcaaguccuccacauugcucacccagcggaggauuaguuuauugcucaucaguguacugcuuuagaggaucuacaaggauuugagugaaacucacggauauccuauauuuuguagguaccuauuuggaaacagcaggcaagaccugagaauggaccugugaucuggguaagauggccacccgagcaucucugaugcguuguucuguguggccucugagugaccaguaugcuguaguggagacuacagaauugaagugacacuagagaaaggcuaugacaauaguuaguaaaaggaucuucugagaaaggaugccugggguagaagcacuauggacauccccuagcugggggugcuguucugugagguuguggaacccaugagaccugaggucuagguagcagaagugaguuacugggacugggcccugaagguucuaccuaccuaccuaccugugguuuugacggguguucucuuuuucucuuucuccuagccuguugucaugugagggacaguugccuccuguucuuguugcuguggacagucacucccggcauuaugccuuucccauaggguugguuugcuguagucucugaaaccaugagccaaaauaaacaguuccccauuuagguuguuugugucagguauuacauaauagccuggcugcuuuuuugacuuaucuggagacugauuaaaaguauaaguugccuuguuaguuuaucuagagaaggcuucaagauuuagugugaguucuugcguguucucucucucucucucacacacacacacacacaccaggcuuaguauuuuuuucugaauauuuauuuuaugauuugucuacugcgugugcgugccugaguagcaggugcacacagaggggaaaacacaaucuuguaguguugcuucucaccugccuuguggaggcagaguuucuuuuguuucuauugcccuacuguggacucuaggcucgccagccugugagcuuacagacccgucagcaccuuccaccucggagugccggcauugccaugcacugccauacaaugagaguaagagguaguggcguccauucugucaccaggcagggcuaugagagcugacuuccuccucccuugagaugagguccuucucaggcagaugagagcuugucugcuugguuugguuuccuuuuuucuuuuuuuugguuuaauuuuuuuucuuagaagaguaauacaaauuggaaaguugcauccuccuucaccccaacccuggaagccccagaugaaucgcagcacaggaaagguuuauuuugugcucauuucugguuucaguuuaugacugcuuggcucugcaucugugacuauagugcggcagcuacacgugguggggcagagcuguuuauagccaaagagagagagaaggggaaaggacugggcucccaauaucuccuucagugauucuccuccagugaccagcagacuucucacuaggcuucacuguguuuuuguuguuaaggucucaguauguaguucuggcuggccuggaacucugucuguguaucaggcuggccuuggacucacagggacccaccugccucucccugugaguguuggagugugugucaccucauccauccuggccucaccucuugaagccuccacagucugucucaucucacccugauaaguaaaccuucaaccaaaggguuucuuuggggggacagugaagauccagcguguggaagacaucucuguagccgccgccucagcauucauaugugugaaugagcguaugcuuuugaaugcacgcguccgucuuuagaugaucauacuuuaaaauauaauacaaaauacaucuauguccuacaauugguuuuccuguucagcuguagaacaugggauaucacggaacagugugucacacacugcgguuguugaaccauuucccggucacuggccguuuuucaguauuggggcuuugcguuuuauuaucgucuagcuuugguauuccgaggagggugacguuagccuggccgcugcuuuccugcugaugcuugugcgcugacccugcaaugcugggacggaccauccuccacuaacuggguuaaccucagugauuauuauuccuaggacuaccaugugguucugcuucaugugucaagggaaggacaaagcuucauuuaugaucuugacacuauuuugccauuucccugcccuuucgacauuuacauagaagaugcccuuaagucugaugaugacauucaucugcaguuuaggaggugaggaaauucaguacuaaguuacugauuuucugaaguaagacuugguguuuacacagcaguccucucugccucccuccuucucucccuccgucuuuuccuuucuuuuccccuccccccucuuugcuuccccuuccuucuccccucugucucugucccccuguuucugcauuauuggugugccuguucuauaagaacuuaagagcaucuuaaaguuucaaagguuccucaucauauaaggggugguggcauuagaaauauuagugugcugaggaccagcuaagcuugaagacccaagcuccaucucugagauccacaugguggaaagagagauugauucccauagguaaccuuugaacacacacacacacacacacacacacacacacacacggcacauguauuaagaaaaaagcgaaaaaaaaaagaaaaaagcgugaugagcuucucaacguucucuuucagauguguugaggauugcuucuuccuggacugugagcauggcuaauguugucaaaaccaagaaaguugcaaggcaacaagaguccuacccuuugccccucacgugcaauaucaucaguauuaugugccccuuguguguacauaaaaacaacugaguagauuuacucucuguccuuguguggcuugggguuucagucaccuccuucagcuuguuuaauagguguuaaccacguacacguagaugcauugguauccgugccagaccuccugaguagccuugugcauaucauagaucagagcccauuauagcaaugaguuggauggccagcugugguaccucccugacauaagcguguguugauuucccugcaggaaauuuagagugguucgugcugacuccuacuugaagcacuucgcuucugaccggucucacaugaaagacuccagugggaacuggagagagccucccccagaguaccccugcauugaaacuggaggugagccggggcuuugccugcccauugcucagauccauguuucccuuauucaggcuuguuuuguuuuguuuuuuuuugagacaggguuucucuuuguagccuugacuguccuggagcuugcucucuagaccagacuggccucugacucacagaagucugcuugccucugccucccgaacgcugggacuaaaggcgugagccaccugcgccuguuacacuuagucaucuuuggggaagcucccggaguggagaggauaaaugagggcaccgguccucugugcuuccuggauucugcaugaggcacagagaguaagugcugaggaacagaagccagggcaguagccagcugcuugauuauuguccacaucugcugggauucuaccgccacacuggugugugcuacuggaaucaguagcacauggccaugguggggcucuagucgcugguagaagaaauccccagcgcauccucccuaugugugagcugucagugacccugcaauagaccugcauucacagaguuuuaccgcgccucacuuccuuucugugcuucugagcagcaguccaguugagggugccuugacaguuaggaacagagcaggcuggucacccuuguuacuguugcucagcguuccuaugcuuuugagacauuaucucugauuguagaucuuucacaccauuccaguuaugggugauaucaucccaucauguggcuaaugcagucuacaggaaaguggccugcagucugggcaggauucugcagaaacagggcaagggcauguggggaagaaagcauaaaauagcuagcauauuugaaaugugugaacuauuaucaguccuuuggcuuugaugguagcucaucaggugccauuacucaguuuaugcuaggcuuuaguuauuucugcacauauaaaugucaucuguaauacgagcugggaagagggcuaaguuggucaaaugccugccaaacaagcauggggaccugauuuggauccaccaacccccccccccccccgccgcccccaccccugucuccuagagacaguuuuucccuguagcccugacugucuuggaacucacucuguagaucaggcugaccuugaacucacagaucuagcugccucugccucccgagugcugggauuaagggugugugccacuacugcccagcugaguuuggaucuucagugcccacacagaggccaggugugauaugcaaccuuuuuuuuuuuuucuuuuuugaucuauuuauuauuauauguaaguacacucuagcugucuuuagacacaccagaagagggcaucaucucauuuuggguaguugugagccaccauguggcugcugggauuugaacucaggaccucuagaagagcagucagugcuuuuaacugcugagccaucucucuaucccaugaugugcaucuuuuguccuagcacaggacggguggaucccugaagcuggcuacguuaguuggaccagugaaguccagcuuccaugaggaaggaaccuucucuuaaaacaugagguggagagcuaccaaggaagacaccggcuguugaccuccauuuuccacauaugugaugcacagccccccauguaccacauaaacaauccuaucuuaagaauauuguuuguuuguuuuuaagaauuauuuauuuauuuuauguauaagaguacacuauagcugucuucagacacgccagaagagggcaucagauuccauuuacagaugguugugagcuaccacgugguugcugggaauugaacucaggaccucuggaagaacagucagugcuuuuaacagcugaggcaucuuuccagcccaagaauauuguuuuaugggggaauuuuagagaaguuuuaggaagagaaagaauauggccaaaauacaucauaugaaacgcucaauaaauaaaaacauuuaaaaaguguuuuuuuauuuuauuuaaaacauuuuucagcacuccggaggcagaagcaggcagauuucugaguucgaggccagccuggucuacaaagugagcuccaggacagccagggcuauacagagaaacccugucucgaaaaacaaaacaaaacaaaacaaaaaaugauaaugauaucaaaauguuauuagcacauaccauuaaucucaguguuugagaggcagaggcaggaaaaucucugaguucgaggccagccuggucuauaaaucaaguuccaggacagccagggcuacacagagaaaccuuaucuugaaaaaccaaaaaaaaaaaaaaaaaaaaaaaaaaaaaaaaaaaauguaauuacacuguuuuccccuuucccuuuuauuuuuuaaaauuuauuuuuauaauauuuuauacauaugaauguuuugcuuuugugugucugugcaccacauggugcugaggaggucaaauggggacauuggcucucuugaaacuggaauugugagccaccaucuaggugcugggauucaaacggagguccucugcaagaacaaauguucuuaacuugggagccaucucugcagcuccucucuuuuacuuacuuacuuuagacuuauaaaugaggacacucuccuacacuacuuauuuuagacaggaucucacuauguauuccuggcuggccugaagcucacucuguagaccaggcaauuuuuuuaaaaaagauuuauuuauuauuauacauaaguacacuguugcugauuucagacacaccaaaagagggcgucagaucucauuaugggugguugugaaccaucaugugauuguugggauuugaacucaggaccuuuggaagaggaagagcagucagugcucuuacccgcugagccaucucaccagccccaggcuagucuuaaauucauagagauauucucccugagggcugggauuaaagguguaugccacaaugccucuaacucuuaaaaaaaaggaaaaaaaaaaaagaacagauuuguuuuauucaugauugcuugcuugcauacauguacccucagacccagaaguggguguuggauccccuggagucacagaugguugugaguugcacgugagugcuaggaacugagccuggguccccugcaauggacgccagugcucuuagccacugagccaucgcucccugcuuccuuaagaauauuuuuuacccgggcagugguggcgcacgccuuuaaucccagcacuugggaggcagaggcaagcggauuucugaguuugaggccagccuggucacaaagugaguuccaggacagccaaggcuauaacagagaaacccugucucacaaacaaacaaacaaacagaauauuuuuuaauaugcauauucucuuuccuugccaucuauauugaagacacugggaguaagagugacaauguguuguuugugacuuuguccuugcugucccuuugaauuuccuguaacuugcccauuuagcuuggagauugacaguuugauuauguaugcgcccuuucuacaaaauuauuuuuaaauaauuucaggcuucuagaaaauuugcuaaguaggacagaguucuugcauaacccucccucagguucccuuagucuuaaguuuucuuuuuuuaaagauguauuuauuuuuaauuuuuaaugcauauggggguuucgccuguauguaugguaguauaccuuuguguccggucagaagagggcaucagaucuccuugaucuggaguuacagaugguagugagccaccauguguguggcuguuaggcaucaaaccuauacccccuggaagagcagucagugugcucuuaauugcugagccacuucuccacgucuuugguguuaacaguagcauauaaccauggaagcauuaauaacacuguucaguuuuucagggcuucucacucacucccuauuucuggugcagaaucuaacucagggauauggcauuuaguugucauaccuuuuuuuuuuuccaccagucggugacaguucccuuucuuuccucucuuuuacaaccuugaaaugugagaagacuauuggccauuacacccuggagcauccuuccauagggugacaugaugcugugucuugaagagauugcuauguguuugaugugaggacauugcaagagugaucuugaacuccuguuuauuugaguggacuccucaccccuuagguuucugcguucugcugcugcugcuaaccugaaauuuauuucagcagacacuuuuauguucuuuucuagacuccaaaaugaaccugaacgacuucaucagcauggacccugcaguaggauggggagcugucuacacgcugccugaguuugugcaucgguucagcagcaaaaccuaccaagccugacauccgggcugcagcuagagaagcucuagggucugaguaagccauccuuccauuuaagagagagcgugguacagguggccuauagggauauuguucucacuaaaugugaguggaaacauuagugaacacagaugaaaaugaaugacuaagucccccacccccuuuuuuuaggcuggggaucuaucccagaguucuaucuccaacccuaaacagucagaccccagccucagacauagauaugccacauucgguauaugguugcuaaaauguuuccauggcuugcuuacuucggugugugaugacguaggccagcaauugcuuuuguaaaacuagagguguggaccuggagucggcuccuuuugucugcuuccucugcuuccugucuggcuagacucuaaacuccuugagcacagguuuguggccuguggcucuaagacucuguugcccauuagaggucccgguaaaauguuucuagagucagcacugcugcuugguaagggacaguauugugagcugaaucagcuguaaguauuagucuuuuuggacuacgauguuuaaaaaaguugcagauaucuugucugagugcuauuugacccacuuauauauguaguuuuaaauaaaauugacuuaaaauuaauuuugcuuuuga

SEQ ID NO: 7762 - RNA, 4461 nt, Mus musculus
agucuuuuccuggcugccuucagaucaagauguagaacucucagccccuuuucuaacaccacuucugccuagaugccauguuucccaccaugaugaugauagacugaaccucugaaucuguaagucagccccaaugaaauguccucuauaagaguugccuuggccauggugucuguucaccaugaaacccuaccuaagacacugugggaacuaaaagguggcuggggaaagaggugggagggaggauagcccacguccggccagaguuccuccuauguucugggcaggcagacgugggagggcugccagacgcuucccacucggccccaggugagcaucuaagccacugacccaacucaacaggggguugggggguggacaaggggcagcccccaaccuggggccccagagcaacacccuguagccccaggguuaagggagagaggguuuagggagagagguucccacacaggugagagugugggccuugaugagcagagacuguuuaugguuuuagagcuuuauuguagaaaggcagggagaagguaaaagagagagagagaagaaaggcuagagaggaagagagagagagagaagaggagaggagaggaggggaggggaggggaggagaggagaggagaggagagaguuagagguaagugagugaggagugagagagugaggagggguaaaacagccccucugauagugggcugcuuuaucuuauuguugcuagguaacuggggaggaguuuagccugaaggucagaagcuugggucuuugccuacuaaccaugguuagugacuacuaaccaugcuucucuugugggggcugagggggcgguaacuucgacaggaaccaggguccaggagacaugagagaacuccuuccaucccauguaggugaauuaucaccaccggguuccaggguucaacauuucaguucaacuggagaccuaucuguagcccaaugccccacaagacaccaugucuauguaaauagcucccuccuuaugcacucauaaccugcuucuuauuguaugcaagagcugaacacaggccaaggacagugacaucccauaaggcuacaaggccaggcuaaagcuguccaucuaguuucuguuuaucucuuucugagccacauguucagcuuucuaacacagacccugcgcccccucugcaucuucaguaucuaccagagcaucugcuauauuggaggugucugauaggugucagucaaauugaugcauuccaucaauuccuugguacuucaggguacauugugaguccuaaaggcucucagauucaacuucaggccuuuuucuugagaguucauuacggcugugagcaaguaggaggugggaugaggguuauugugggauuuauugacaacuaggcacagauggugauuaauuuggcaauuacuuauuuuggucuuaggaagcauuuuuguuguucuuuaguccuugauugaugggguggcucucaacagcauguggguacauuuuaugcuucacuggugagucccacaaaggcccacuacaucaauuaaguugagagaugugagaggaaccaggaagauaaucugucauuuguguggcagacaaagccaccuuugcagggcagauagacuucuaucccacaguuuccuagacugagugcugaguaaaggccugauacaugauauguggacccucuguagaugcugucuauagaaauccuagggaagcagggacaucuguguucccaacuuaaaucccagggauaaagugucaaguguagaguguaaaagaauguggggaaaacacucugccaaacaagaagggagacgugcugguuguaaggaggguucaaugguauaggggaucacaaaagauuuuucuggaagauaacauuuugagucuggaaggcuggggauguuggaugugcagaggcggugagaaaaacaucuggaugucaaacauucccugagcagcggguaagaggaacagaaauuauagucaagagcaauaggcuccuccuggcuaagcaugagagacucugggucagaaaucugcaguacacagugaggucuuugggauaaauccuggaagcccacuuucuaguuuuugagagcuuggguguaggagcagagauucuuauuuuggagucugacuuuagguaucugaccuuagacuuauuagcugacugacccugggcagcuguauuaguggacaccagaauauauccaacucucucucucucucucucucucugucucucugacccuguuagagagacucaaauagcucacauaagcacuuauuacagucuguggaaagcagucaguacaugagaguggauaacagcuaugguguuauucuugcuauugcuagacaguggagucccugguagauaucuugauguguaggaaaggguggcagauggcagcagaaucuacuauggaauaccuaggucaugacuucucuuuuguuuugagacaggauuccucuauguaguccuggcugucuugcaacuugcucuguaaaccaggcuggcguugaacucacagguacuucuggcucugccuuccaaaagcugggacuaaaggugugcaccaccacaccuggacucaugacuuuucuuaugagcuuauuuuauuagugaugcucuauugauauggacauugauauggauaucacuuggugcuuacaggguacgacaccauuuaucuaggguuauagcaaacaguacuguguaucuuguguauuagaguagaguagaguagaguugauuuguuauaaucaacuagagaauuuaggaaggaagaacagcucaacucuaucauacuuuaauuuaauuuaauuuuauucuauuuucuugagucaggcucucauguaucccaugccucaaacucuccaugaagcugagggugaccuugaacaccugauccuccugacuccaccucuagagucaugggacuacaggugugcacuaccacacucaguuuauuuggugcugaggauugaauccagggcuuuguggaugcuaggcaaguacucuaccaacugagcucuccucccaguccccaaacauguuuucaaaagauguaaagggguugagguuguagcucagagguauaauacuugcuuagcacaagcaagacccugggcuugaucaucaggcccuaagucagaaaguuuuaucuagcagugccugugucuuaaauaucaaauuaggaagugugauacacaggucagugguuggugauccccucuaccaaccaucucaauuggggucauaaaaauaaacugacaugaaaauaaacacaaauguggcaacuucauauauauguauauauauauauauauauacauauauauauauauguguguguguguguguguguguguguguguauaauuuuuucuaucuaucuaucuaucuaucuaucaucuaucuaucuaucuaucuaucuaucuaucuaucugaauuuagggaacuaauuaaacaguuguagaccaacaguucuaauacuguuauugucaucguuguucuagugcuagaaucaaauacugcgaauacugccucuugugacagcacuccuauuuauuuauuuuuuuuaaagucaccagugacccuuucaugguuaaauugguaaauuuaaaacuggaauuauggcacagacaacaacauguauguuucuuuacaaagcaauaccccaauguuuuguuauguuuaaagucacuauacuccaauucugugaacuuugaagauacuuggguugggauggcacaaacggcugacaagccauuaaaauuucccagcgguagauaaccaacuggugugcuccucacuggagaagaauuuuuuucccccaaucucagcaucccuuagucuuuucuagcucuucguguaaaguugaugccuuaugagcugcccucuaucucugaccauguuagcaugucuauuguuauuguccuuguuuagccugaguuuaggugaucaucuugauaaggcuugguggguguuucucuuggcaucccgaggagacacauucuuacagcaagcucccugaguuuggcucucacaaucuuuccauucacucucccccagcaaugcccaagcauacauguagaugcauccuuugggacugggcuccccaacucuauacuuuucuuggcuaugguuuuucuaugauuucugucuguugcagagagaaguuuccuuaaugagggaugaggacuauaauuaucugugaguaaggacuacuauuuagaauguaguuagggauuaugcugguuuagcaaacauacacaugagaguaacauaauauagacugaaaaaguuuuauugauguauuucagaauauacauauauguaacaauuaaaaaagagucaugaauucaaaagagagccaaaaguggcacaggggaucauugaagguagaagggaagggagaaaugugugauuaguauccccu

SEQ ID NO: 7763 - RNA, 43192 nt, Mus musculus
ccgcccuccuaucccgggcuccgccgcuagggguggcggcugcggcucgggccugauugucacggcgcgguugcuuugagggcgcagcagcccuaccgagugaggccggcgugaggccagagggugggaaagcggucggcggcggagggcggcgccggaggagggcggcgcgcggugacucaucccucuggaagaucagacacgcucgccgagcucgcccgcgccgccgcuccucauccgggaggcgcccgcccgcccgcaccgcccgcccgcuccgagcucccggcccggccgcggcgcagaaaguuuucccgggcucacggccugcgggaagcggagcgggcacggcugggaggcggucgccgcgcgggcccgccgagugcauggugucgggcgcccgggccgcgcgucaggaggacccggggcggggccgggcugagcccagcuccugagccucuguccagcugcgccccgaagccgucuucccuugggaccgcugcgggggucgcgcuccagcgccaugucccggcugcugccgcugcuggggagccggacggcgcgcagccugaggcccggcccugccgccgcgccccgccugccguccuggugcugcugcggccggggacugcuggcgcucgggguucccggcgguccccggcuucugggcacacaccccaagaaggagcccauggaggcgcugaacacggcgcagggcgcgcgcgacuucaucuacagccugcacuccacggagaggagcugcuugcucaaagagcugcaccgcuucgaguccauugccaucgcacaagguaagcggguggggccgccugggaagaccuacuucucagaccccugucgccuccccacacucugccccgcuccuggcacggccgaaaggggaaacuuuccaccuuccgaguguccccaagacaggacacgagcggaucgugccagguaguuagggccgagcuuggcuggugccucccuggccguggaauuucggagcuucauccugaaaugucagcugccucucaggguuguguuuugguuuguccugugccuccucucuccagcccuccauucccuaagccuuuggugucuuccugagaccguguacccaugcagguggcaugcccugccuggucuaagaaagugccaggaacugggcaggcagccggaaacuuucuugaagguguguggauguccccucccaagaugcucuugguuuguuauauugcuucucacauuugguugugaaauggcccaaggaaagauuguaucgagccagcaacugaguguguacuggaagucuggagauucaaauugaacuccagaguuuguuuccuuggaguuugaaagaaugaagugaguuuuugggugguuggggcuaagaaaucugugacuugaaaaugaaaagcacacuucuacuuaaaaauaauugggaaaggaugaaaggaaagcuauuuuuaaacagacacguuaagauaggauauuuuuaaaacaagugcggaaugugguaggucagaauuugaguguaugugaaaaggcauugaaaagaugcaaagacuacaauggauucagucuuuaaaguuuuuuuuuucuugcuauguaaauucuguuguauacacaaaaacacagcuacucuuuaugugacauuuggauguguuaggaaguuuuuaaauaguugaaguugguaauauaaaguauuauguaaacauucuguaaguucugaaguauagaacacuucagcacugauucggaacguggcuuucaggcaucuugaaagguugcauuuggccugugcacgggaggaaagcaagcucuugccugauauuagauuaccuuuacaacuuaagagacuuuuuauugguuguauccuuuacuacucugauuuuuuuuuucuccccaguuuaggggauugugagccacuauaaaguaauggauaauuucaggcauugcuuacccacaacacuuuuucaggaaaaugcaguauuccaaucaauucaguuaguaaaucacaacauuacagaaaaucauaaccgaaaacuagcauaccuuuagucuauguguggcuuaaaaagacucaaauucugaaaaaguucucuuugaaaacaauauagacaggcguaucuuagaaagucaguuugugucgcucaggugaggcuguaaacgucauuuucccuuuucuaaagcgaggucuuggaaauucuacauugucaacaugguauaagauuggaggauccuuugaauauaauuuuauagcaguuauugaaaugcacguuuuacaauaucaauaccugacuugcuaaauuuuaucuauuuugcacauaccagcaggguauuggguaggaguguuagauuuucuaaugaagacaguguuuuaaaaucuaagaugguuuuagcuauccuuggaaggaccuaaaaccucaaguccauggaggucauuagcaucaauaaaacuuaaggaucuaaauuauuugaggaagccguuggucauuuaaauguauuuguucaggaaaaaacaaagagagguaaaucuauaggaaacaauuuggcgguuuaaugucuccccuuuauaagcuaaaacacuucaaaguuuggacaucugucuuucuuuguugaugcuucuggcuagcuuccgagucagugacacuuagaggugcugcugcgucaguuuuuagcgugccuuggugcccacuuaaguuuuauucccaaucacguaguuaaggggauaacuagacuugcuuaguauauuaccuuguucaccaauuacauaagguaaaaggaccucacugcccugggaauucuugucccucauacauacuauucuaaaaucaguggguuucuugguuuguuuuaaaugaaaaccucucauguuuucuuuacccuuuucagcauucuuguuuuucuucuucuucuaauacuuucaucacuuauuugugugugagcaugcuacugcaugcuuguagaaguuagagaacaacauauggggguugucugguuuuuccugccaacacacuggauccagaucaucaaacucaggcccuuaggcuuggcgacaagugccucacuagcaggccaugucauccaucuuaauucuguaaacuaccaacuaaagcacuaaauguagaguacuagcuauacuuucuaaugacauauugucccugggcaagggcugguucuuacuauaggaagccuguguguccuuggaaaggugcuuaagguuauccugggaagcauucaggcuuugauaaaacauuacagaaaggaaaaaaaaaucaucucugcuuugaaaugggucauaagaucugcugaaauguggcacucaguucuuaucuuucucaugugucuaucagcaggccugugguagaauuugugacaagauaucacucuagaaucaguuuauaucagaugaggcagaccuugugggauaucuuaucugagugaauuggguuguuucgguuuuaaaauuacaaacugauuuuuccuuuccaaucugaaggcagaguuuauguuacacucuuaccugcucaacuuguuuucucuugcagagguagcaggcauuccacugacaguagggguuggcucugucaaaagcagagcugauguaugacgucgguacaguugccuguuagcaucagccaagauuuuuaaagcaaauucuuuccuccucauuuuugcaacuaacauuucugcuuauaauuauuuuuaaagucuuuaaaaguacauuuugcuuuugaaacaagauaguguuaguuguuauucuaaaacagguuauaucaaacacacagaaacacagaacaagcaccacacaguuucuaguguccccaaguccuggauccacucauuuggguauuucuuauucauagucucucaugauauugaaaucaagcuuuuggcuuucugaggucuuggcuauggcuggaaggaguucuagaagccagucuuuuaugauacagacuuagaaguagccuaucuugguugcagugguaccuuguagaagguuccuacauaagaacucuacaguuacuguagaguuauguaagacaagagcugguuuugggggagauaucauaagagaugagaaucgaaaaaagcuucuuaggaaauguuauugucauauauauucaaaacuuaaaaaaaaaaccaauuuuacauauggcaaauaagauugaaguuaccugacagaggcgauaccaugaucaaguaggugguuuuccuaaggugaggcucaucuauggcacucagggcaugcugccuccuuugauuuccccauguggggcaaacuuugugucguuugugguagugagggacuguguucacacuuuaaaaagauuauuuccaggugaaucgugugugcaguuuuucuguuagcagcagauucuuuagcuuucaucuuuuuuguuuguuucucuguguaaacaguaguuauguacuuuuaaaauguguuuuugcuacugaugaacuccauauuacuuuuauagcucuaaacuguaaugucuucaauccuccccacuugugacuguuuauuuaagguagauaaagcacuccguuuggaguacuuggcaaguagccuacagggucuuagacagaauggaagucuggcagcuguuggguuggacaucuguaggguccaaccaugaccaaguuuugucguggagaucacucuacuagggaucauguaccuuuaaaaacucuuucccuauucuccacagcuuaugaguaagaagcagucgugcccaccucuuagccucugggguggauaaggaugaucucagcuuuugcucagagagaaaaacauuuccuaugccaauuaacaugaauaaaaacauuucagugccuuagcugagauuauaaaaguggaauaagggaguguuagccccaacuggcucagccagaggggagccagcauggcuucaccagagggucugagaaggguuuacucacagauuucuggucccagcuagaacugcugacccaggcagauacagguuuccucaauaacagugacugugacauuucagaagggcuguaauauuuagguaauaggucagaguuccuagaaaaaauguuccaagagagguaagagaagcuguaaaacuuuguaucaguuuccuauugcuguuguaacaaguuuaguacccacucagggcuuaaaacaacacaacacucuuguguagaguuuuggcaacucaggguccaaaaugagucuuaaaggcgcuugucaacaggcccuguccuucuggagucucaggggagaauguguuccuugcuucuucgagcuuuuagcauuccuuggcucuuggccucuuagcuugaaucucugcucaguuguugcucuaucuucuuuccccuugaccuuuugcuucccccuuguaaggacucuugugacuacauuuaguuuccaugagcaauaaucaugcccuggaaaaacauuauagcacauacuaugguacaaagcuugugacaaugucuaggacucagugagauaauuuaggguaaucucucucaaaaucuuaagucacauuugugaagucccuuugcuauauacguagcaaacucaaaggguagaggauaaggcuguggacaucucugaaggcccagauccagcuuccuaccaacuuguuaggaccaugucuuggaagcccacacugucaucuuuguuuccugcuacugaucaggagaguaagucacuagggcuauucuagauuuaagggaagagaaaucuugagagagcauguuaugugcgugaucaugucuaauaauuauaguuucuuuaaucuguacauuaacuuuucuguugaagguuuugcaauuauuaugucaauuuuuauaaggguauggggcacugucuggaacauuugcuauucuaccaggugguagaacagugacucuuuagacacggagguguacagcaucccucugucuuuaucaggauuuuucacucucuaggugucagcauuuugggcugggaaauccuuuguugagggucuguuccccucaugggcuuuugaacagcauuucuauccugcaccuaccauuugcugguagcacccuugcaagcuuuccuaguuguguuugccaaaaaugucucuaacuguagcuacaaguuucuuggaugguugagaauguggaaccucauggagaggcuuaucaaagucuccuggcugagaggcaucauguauagggaauguugaaacuguuucuucagcuguugggaccugucucugcucucaccaucugcaguccccacccacccucugcacuguuuguuuuccgugcguuugugucuugaugaggacagaggauaaauuccuuaucuaucuagccaacuacucgucugucugaacuuuaccaauaacuuuuccuugguuguguuguuucuucacuacuaaauucuaaacacaauaaaguuagaaaauacagcuuucaaauaaaucagacauugcccugguuuaauuuaccauuuuccauccagcagucacuucuucuucuucuuuuuuaaacagcaguuguggcaagcacauuuuuaauaaggaaauuugugggugggaaaguuggaguaacucauuuaugggcucaugaagaagguuggcuggagcugaaagaaacugggugaucuugaugucggguaugaccugauauuaaaucauuauuagaagagauucaauuuuucuaaaaauagugauguuugcauaaucacguucuugccugcuuuccuguggcgugccugcuuauaaaaucacuggaacaaauagagaccaaaucccugcgcgcagauuuuauuagcaucuugcccaagucaguugaauuaauuaguacgcagcuuuauaggacuccagucuugucucugucuuauugcuucaugucuuuucuaaguuaaggcacacaaucacguaacaaguaguuacauguuaaacucaccuuagucugcuuaaugugaggcucuugugaaaagauucuguagggaaacugaaacguuuauucugcuugcuuuuaaugucguauuuccuucucugucuuagagaagaugugagugugcuuauaacguaccuugcaccaaaugccacaguccuucuaugcuguauuuugguacagcgauuuuauccgaggcuacuucuauuuguagacucacuagucauuacaccaaaugcccgcagagcacagcuguuuuagguggcaucuccauagacugucacagugagaaugagguaugucggccuuagcaugcucugcaccucccuccagagcucucacacauucagcucugcucucacauuccugguggcuccuuccugcuccgugaggaggagugcaucuuggcauuucugcuacugugucuaaggcacgcuacucugcuguuuguuacuaucccacagugcuuacaauuuaauuuucuuuuacucacaaaacaaagccuugggucccuucacuccacucccagaagguuuagucuugacagacacuucaaggaccauccucuuuucugccagcugcugacauccaucacauggcuauagauccagccucagcuuugucagugaaacucuuucuugcaaguaucuggguuguggcuggauuaccguuguucuacauaccaaaaaaaguaguugugaggggauuacuuuuuauggaucuuuaaguugcagaggaauuuaaguucgaaugauguucuuggcuuaguccagauuuccuacuuuuccuucugaauuuuaggaugaacuauuuagcaugguuaaaaaaaaagucucuaaucuaaaaguaucaguaacuucugaguuuuagccaugugcuguugcugucuguuuugcuguuguaagcacgucgucacggcugcuccguagguuauugggugcucgcugaaugcuguacauaccaaacugacucuucauauacuucucucaucuacuauucuuggaagauguuacauuuuauagauuaagaaacagaggcuauggguacuuugcccaagaucuuagaagcuacaugucauauuugaguuauaacucagccugucuagcuuugaaacuucaauucuuacucuuuuuaaaaaaaaaauauuuguauuggcauaaauauccaaauagccaauggaaaaaccaaaaccagaaacaaaugugcuaguaucauuuucguguguguuuguuugcuuguguuuuuuugagguagauugcuucaaacgcaccauccuccagccuccuaaguacugcugguauuguaggccugcaguaccauauccagcagguuacauuguaaguaacauauucuagucugucuucuguauauuugcucaaauauguauucaauauagaaaaguaaacauggcaccguuacuuugucaguaggggaccucaagguguauaauaguuaauaagauuguauaaaaguuuggaaaaguaaggaaagcaguauuugaguucauucauagcuuucuguauauuggaugccugugagauaguucuggagagcuauucaguaguuagcugggugucgggacacuggggauccaggggagcauucacgcuugagcauccgacucacauagguaauaacggaggcaggcagaguggguggagucaaaggggaagcuccuagagcagagguucucaacccuccuaacgcugcggcccuuuaauacagcuccucaugugugccgacccccaaccaugacauuauuuugcugcuacuuuauaaguguaauuuugcuguuguuacgaauuguaauguaaaugucugauaugcaacccccaaaggggccaugacccacaggcugaggaccacuguccuagaaguuuuuuguuuuuuuuuguuuuuuucugaaaaacaucaacaccuggacagggugaagaagaaaaaccagaauuagauggugaugaauaucuagagagagagauggaaagucgugauguguucuggauagcugauauguucguaguagcgaagagagcauuucaaaagagagagugagaacauccuuuggcuuccagaacggagcggucagaagcaguuucugauguggccauguggggaguagccugguuuaguuggcugaaaaggaaauauggauaaggaaggguuuaacucuguaaaggggacuugggauauggaaaggagcuacagggcuagauuuuaccugaucuucucugugcucauguuaauucauuaauuaauaugcuaauuuccacaggugguucagguagaauucuuguucaucacagucaugauucccaaucuauguuuagauaucucugcuuucucuuucucuacccuuuucugacccucaacuuauuugcaaauuugaagauaacauucuucuugugcuguauuuugaaacauggcuucacagcaggaugauacuuugacauuauuuuuuuuuuccuguagccaacaacaaaagugaccuugcaggcccauguuuacagggcuaucuuccauugcuguaaucucagaagccuacucugugcuuucuacagguuugaagcgaacuggaacguaauucauauuuucaugacgaaaccuuaaauuuuauauguaagcaaaucacacucuuucuggcagcauucuguagaaaaugugugggccauuuagcagguaggaucuguuccuugugagaaacuugaaggcagaguggagaugccagcauuuacaugcaccauacguagauaaggcgagccgagucuaguuuguauuuagguggucuauggcgucuguguuccuaggaagacagggaaggugggaacguacgugcugaacugggacaugcacuuguggcuguggaagauacaagaauguguuagagaauggaagcacucaagaccagagcccauuaacauccugauuucacauccucagccacuggcacugugccugugugccuugcacauuccuuaauaguuccaggugcuugugguccaaggauggcagugagcaacguuagcauuucagggccagcuggguuuugugaguccuguuucuguuacagccugccaccuugucgagugggguucuuauuuugauuuuccuguuuuccugcaacuauuuuauuuuacuuuucuuacaagaaaauuaagcaggcaaugaaaagcuuuuucaaugaaaaugcuuaagaggggucagagagauagcucaggaguugugcacuguacccuggcugcuguuccagggcuagcccccacuggcugcuguuccagggcuagcccccacuuagcagcucacaggucucagggugcaagucuaaagguacccaacacccucuucuggccucuguggguagugcauauacauggugcacaaauuuacacauacaggcaauacacucaugcacauacauuuaaaaggaggggaaaaccuaacugagggccagggggacuuuucuucucuucuuccucuugagauaucucuuccuucccacugcccaugcccccaucaaaaucauuucuacacuauagugggcaaacauauuugguauuaaaauaccucucguguuacauacuggacauauuacuugcagcuuuggggucaagaaauauaagucugcuuaguuuuagagcauaaauguucuuaaauauuuaccucccaugaucccuuuuuuucugccugagaagucuuuauagguucuuggggcuauagauguaugacauagauauacaaauuaacauucuauucaugaauagacauguuccuuauuuuauguagagaccuaaaucuuggcugcauauuuguuacugcauagagcaucuucuauuauucaaaguuuuacugccaugaauugugcuccauauaaauaaauacauaguacaaaauggcagaaguacguuuagggccauuucagaaauuguuggaaauucuguuuugguaaugaaaaucaaaccacuuaaagugacugcuuugaaaaauuaagugcucuaacaauguaaucuccacauacugauuugauaaauaaaaaaaauaugcugaggaaugacaagagugaaauauugucuuuguuuucugaaguuaaaccauucuguuucuuuuaagggcagaacacuuucuauggguaguugaagcauaaauaguucauaaauaguuuuuuguuuguuuuuuuauaaauaguagucuuaauuugagccaaggucuuucaagccauguuuguuggucuugaguagcagucagaaccaagguacuacacgucugggugagcauggagagacacuuuggguucauuguguauaaugugggguagaaaucuuuaaggagccgcaggcagaaacacccagucuaaguguuucuguacucuggucagccgucacacugccucuccuugcuccucauuuguucuagcuggacucuuggugguguaagguugcauguaucucagguaaacaacugcuaaugucuccucugccccugcaggcucucgaugagguuccaguugcuugccuagcgacuacaguucucuuagaggccugaaaggagcuuuggauuugaauugacuuuggaaguguuuauuguaaaggugaauaauguuccuuggaacucucuguguuucagugcaaaguagacuggguuuagcaauguucacuauacagacauuaccuggaaauauagaauaaaugaagacuccaugucaggaaauuuaaaggcacuucuuuggggauuuccauguuaaagauucgggaauuauauauuaaauaacaaagguuagagcuuuuuauucauuuauuuuaagguagagaauugaaacuaugcagauaguaaacuaugcagauagguacauuugaguggagaauauaaacaaaugugauuaugaugauauaagauguggaguguuuugcaaaauggcagaaauuuauauuuggauauaugaaugaucuuauauuuaaaaaauauuacccuagaaaguuuuucucugcuucagaggggcuugcuuuguaaagacaguagaaaaaagguauccgguuaauauguuuuuuuguaagcacccucaagaaaugaacauuguguaacaaaugccacauaaggaugcugugcccaugucagcauccauguauuggauggauaccauguccugcuguaguggaugccugagacaggcaauguuacuaaaagauaaaacuuacuaaggucagaguuugggcagagucuaaacagccuagcuguucaagcucugcagcugccucuuggcuacauucccuucauggugcagacggacagcagcauaaggguugugugaaagucagugguagaccagaagagguacaagaggagcagucucuaaacagaaagucaggggcaggggagggaggaugugcgugagaggcugacaggcccugggucuccuagguuuacauaaucccuuucuagggcguauccccaaagaccaaggcaccacucagagucuuguaaagguucugucuacugugggcacagugcaccucuacaggccagucaggucacacucacaccauuacagugaugaacugcauauaccguggugguucugagauaggacagugccugcugacaacauccccguugaagcacauucugauguuugcacaacuaaaaucuccugacagcauuuuucucagaugcgucccuauuaaaugaugcauggcuggauugcuuuuuacucauuuucuuuuauauuauauuauugucuagcauauacucuccaaugaaguauuuccucagcgaacaugccuccaggcacagaucuuuuucauuugcuuuuuaaaaugcuguucuccucguguacuuucugcacauauuuuugauuacuuagaauuuuuugguacaaucucauauuuauagacuucuaaguauuguucaauaaacauuuuuuccccuuugacucauuaaaaaaaugaguuuuggggauaaaguccuauuaucucaguuauagguuacuguuccuugggaagcagucugugagacaaagauaaacaggcaagaaguauauugggaaauguugcugcaguauuguucacuacaaucagaguacuuuggugugcacuuccuacaaacaggagcacuuuuucuggaggaaaggaggaauuggagaaaggcuaaccaaaacuaaggauguaugaagaaaucuuaugaaacuuacuaguuugaaagcuaauuaaaaauagaauuaaaagaaaaaaagaaggcauuugaacaaagguaccccuccagccaacagugugaacagugaacagggugagcaguguucuguacagucagagagaccccagggacauccauacgauauaggcuauugccacuguuuguguuauguuacccaccacagccagguuguugcugaagacaccacacugguuguaggacuugaugaaaucaaucuugaacugaccgagaaacugucuccuuacuggcuagcuuucccggagcuagaaggugcugugcaggcuucuggaagagaacagacauuagccaucuuaccaguucuagauccugcaugcugcaauacugacugccaggcacgauggcacaauaaaggcaaggcaguguguggaacaauccaauccuugauuggauuugaggccugcuccacaggacugaagacagugcugguacugaaaacacugugaaaacucaaggcccaaggggagaaccuauugauacuguuuugcuaaguggccauguuguccaacuucuuucuaauauuuauguuuauaugugcugcuucuagccuuaguugaagagacgucauguuguaucagguagugguuaauguagauauagguaacuguucaaagugcugagaguaagugagcgaguggucagcaguaggugcuguagcucgguguccucaagguccagggaacagugcugaagagggagugcaaaggauaucccagacauaggagggagcagggcugugaaaugcuguccucuggacaugaugacaucauaacaguugcacagaugacuucacaagaucaagccgguuaacacuuccagcauggaaggagggaagacucccaagguguccccucuagcugaggcuucauuaguaguuucuggcugcugaggaagggagcaucauuuuuggggugggaugcuggaagucugcucaugccuuccacacucacaggcacaugggcagcacuauugaacccagcccguuguaaacugaggacaggacgagcagagggagagggagggagggguggcugugaguaagauacauuguauacauguauggacacuuuaaagguguuuaaauuaaagaacauuguccuguauggccauaucaucccaugaguucauuacuacucuuuccuuccaagaugcuuuuaaggcuucagcaauuauccacuacuuuuguagaguaaaaagacuuagaugaguaacucaauauguuuacuuguaacguuuguggggcuuccucagaucuguuaguuacauaaccuugacacuuugugguauuauucucaaagugaacaguuagugaacaaagagguguaugugucucucucucugugucugucucuguguguguguguuucuguaugugucucugugugucuguauauuguaaagaauuuguaauuaaccuaguacuacaugguacauuuuaauuuucuuacuuucugcauuucuuuguagcucuauccucugguggauagguaccugauuccuacuguucauaaucuagucauuuucuagucacugauucuguuugucaccaguguacgaccaccagaugccuucuugugugaauguucuuucacuuuaguuugggcacugacacccagaaccacaaugccuuccacucugucacauggaaggaagccuuucucauccagaguggacuucaaugccuuguuuuggacugacugccccccaccccccgccccaccccaauguauuucuccuuacccugcuucagcugugaaacccuguuguauagcauaaaauauaacgucuuuugcauaacaucuaccuaaccuacucuccucauggcuuuuggacuguguuuugugagaagaaauggcucccuccuucuccuccuaccugcuuaaaauccacagugcuuuaaggcuaagcccaaagccuuucuccuguggaauccuguccucucuuaggagugcaguucuuccuguuggaaaagcacauugugcauuucugcucucuguugacucuauucguauaacucuuugguaucaggggugauuuucuauaaguucuuuuuuuaagguuuuguuuucuagucauaagucaaaucuaugauaaaacucccuauauuuuuaaaugcaagguucaacagaugaacuuccuucuuuguagcuuaguaaauccuaggcugaucauugaaugauaguaaaauugaauaauuuaaaaagaaaacauuuagcuucuaagaaaaauacuuuauuaauuugcauauguagaguuuaugcauugaacaaucuguauuucauuugcauaggcuguuucugcguuagugguucucagguacauggcauaagucuccaacacugggacuccaacuuuauuuguuuauuaacuuugauuaauuguacaaaguauuaauuguacaacuuacagacuuuucugcaaauuuuguugugcgcuucaguucacagaccacucuguaaacacagaugugcaugcugaucgugaccaaccucaucacagugcauuuguauuuggccacuguauccauuauucaguucauuaucagaccgaagugcaugcaauuguguuuccguguugucccauagugauaaacccauggaacguuuuccagaguggauaaccgacaaggagcugaagaucaagcgugguugcacaugacuguaguaacuauugggagaaugaagcaacaggguuacuugaacucgggaguuuaagccccucugggcaacacaccacaauccuagcucagcaagcaagcaagcaagcaagcaagcagcaaaugauaaagauucaaucaugccugguuauagugucauaugauaggcgcuguccucuggcuuccacacagggguaccugucccauccucacauuugcuuuuuauauuuaagaaaggguuucacuuugcucaggguacccuggaauuuacucugugguuccgauuggucuuaacucuugaucuuuuugucucugcuuccuuagugcuagggcacccugccccugggcuguaggggguggaagggguacaucuuuaaugucacagaaucauucaaaauuuuccuaccaguuauuguuguuguuauuauuguuguuguuauuguuauucuucuucagugcuggggaucuaacacaagccaggaccaccuacuuggcaaacguaucucggauacguauucuugcccgacuggcuauuaugacuguaccauuuaauaucccauugccaguguuacauugcugugcauaggaaggucugccuaugugcuaguauguaacacuguaaaaaacucuuauguauuuuauauuugcacacguuguaaugacuucguugcuugacugcguucugauuuuagacuauuuuuagcgugcagauuucccaagccugagguggucauugcgaagcgcgcggaggaggugucagcagcagagaccccugauaguuuugguacaguacaagcuuacaguguugucuggcagauguuuguugcaaacugcaaagcaucuguuugacaggucuuuuuguuuguuugaaauagaaugcuuaaaaacauuuuuuugcauuaauauuuuagauuguuagcagacuguuuccauuaccuaauccuggccuguggauaugccugaguaauaagugcaugcuuaacuaacugaaggguuacauugugaccaugagaaaguauaagccggggagcagggcauccuuuacugcuucuagggaggccgagauagaccguagcucacagccacccugggcuacaucgggagacuguacccgacugcuccucauauauagacacgcacucuugagcagucugaaaauugauauaaguucuaaguuuaugcuaaggccagaagugaaaggcuauuuugcuauauuuuguuagauuugguagcuguacagucgcauauacuaguaguggcagacuuguuuguguguuuauguaugaaauccacacagagaaauauaguuaaaaaucaauguucucuaucauaauuucaauucguagucuauuuaggauuuaacauuaacuaguuaacauuuaacauugcucaagaaugcagugcagcgugugaaagauaucugaauuauuuuauggcuuuauggguugaagaaauuuuguaaugauaagaauuaaguaccacucagauaguauuuauggggucaaggacaaaagccgaguugucagaacuucagagaaauguagaggcacaagugugugcacauuuuugcgcucacauguuaguuccuugucuggaaaauccuauauuguacuuugcuaauucuaaugccagugugaaaagaaggaagcagguaagcacacacauaaugguagcaucguuugaagaggaguuuugguugugagcuguucuggagauuguuccaacauagacagagaaaugcuauuugcuccauagcugauagcacacaaccccagcaguuacugcacuaccagacgguaacugaacaacaguauggauuauuugguacaguguuagaaacucagucuuuaauuaugccccuaguuacuacuccucuuugcgacauucagguaguguccuuccaaaagcuaccaguauauaacaaagacagauaacacaauugagucuuugggaaugcagagauugaaaucucucauaugugcaccaagaaaauguguucaggauucggcaucuauuccuugucagagcaggcauuugcaucaggcccuguggaauuuuaguucagagcaauuucaggacaauguguuuguucaggguuagagacagagauuggccccaaacuggaggccacauaguucugaaaccagcagaaaucugaugugugcaugccccaaccccauucccguaguguuuuaucugguaaccgugaugagccauaaggaguuuuauuuuccuuucaucaugaauggaggugagauguaucagauuucuuucuucuaaaugacuguuguuugaaaauuaugucugagagaaauuauauucuaggagagagagagaaaacaacuuuaaaaagauauugguaguuuauuuaauugagguuuuuuccuguuucaaauguuaacacaugaccauugucuugauaguauuauauaugugaauguugguauuuuugauuguucuuuauuuucuguuggagguuuauuaaaucaaagagaauuugaaccuagaaucuaggcacaucaugauugaaucacugucucugugccuacaucuucauaucuucaaagcagagaauuuccugauggccaugcucccuacauuuagacugaauaguucuuaguugugauggacucuguaucgcuaagaaguuuagaaucccuggugcuaggagcaguucauauuuuuuaucauaugcaaagcagccgugcauuugcuucuagagggaggcagcaucccaccaagaaugcugugcuuucggacccuuacaucuagucuucugugagacuucuucuuugaggaaugauaggaagagaaaagagaggcaacccacugagaaaucuguucuuuccuugauguuaggcaauuuuaucuuaaaaugaauguccuuauguaaccacauucacagacagauguacuauuuaugauauuuauacuagguagauuuuuuucuagcucaguuuaaguuuuucaucuguaauauuauaaaugacuauauaauucuuuuucaaggaaaaugcuaauacauacaauaaguaaaaguagcaagaucugacuguacuuaaaguuacacuguuguuuugaugauuagccuuuuaaaagacaaagcacauguaaucauuuccugucauccacaggcauaaaggcagggaagccuguguuaaggagccucuguaauuguugcauguacacagcuacauauguaacagcaaccaugcacuaauguuuuguuugguuaucuuaaaagacagaaagauacugugaaaugagacauagguuauuguacgguacuauaguaauuauuacuuaggucagaguucaauagauuaguaaguucauaucuaguugagcaugguagcugucuugucaacaccacuggucagcuccugcuuuagcuguggugucacuggcccagugguuccucuagguaccugguugggugcaguccagccuuauagagcccaucauguucuccagaaggccaaggggauggugcagcucugcuagaacgcugagcaggauuaucuuugauuauauaccauauaaucacuacacacacacacacacacacacacacacacacacacacacacacacacaagauauaugucuaucaaucugucauaaucuuacaauaagcacuucuaauuacuaaauaaaacuacaggaccauauucaaguacuuucaagggcuuaacccaaagcauguauuuaaaauauaauuaaaaaucuuuacuugaaauuacuauuuaaaaggacauauuaacuaaacucuacuaaaucaguuaaguucuuugcuguuucuaaagaguguucauuuuuuguuucuugcaaauauguuaccgagccaugauuauguuauaaauuaugcucuaaaucucuauuuuggugcauggcuuuuuguugucuaauauaacuagcuagauuuuuuugcaugcaguaugguuuguguuuuguagucuuuaaggcauuacugugaauuucaucauacccguuugaugguuugguuccuauuaaaaaaaaacaacagguauccauaaugcgugggaucguaguucucugguuauuguuuaaaaacaucaguuuugucuuugcucuccuucaugaguuccuuaauagaugaagcugauuugugcugcuggcucuguucccuggacagaugcuguguggaucugcagugggcagguguccagaaggucaggcacaggcucuagguugucgccugucaucucagagagaugcucuuuugcuacucacacuuauuuaaaugauuuaaaaauaucucucuugauauuguuuacauuuauggcaaaaggcugaaguaaaccaugaauuacugugcaaugagagaacaguaaaguaguuggauguaagcugcuuggguuugcaaaaccucuaucauuucaagaaaugauaaagaucaccaucauaagggcccagucggccaucaaugggagaugaggcccuuggccuugugaagacucuaugcuccaguacaggggaaugccagggccaggaagcgggaguggguggguuggggagcaggguguggggaauguauaggggacuuucaggauagcauuugaaauguaaaugaagaaaauaucuaauaaaaauuguuuuuaaaaaagaaaagcaacaaguaaaaaaaaagauguggguaaguuuaaugaguguuuaacauugaaacaacaaaucaugcuuucuauggaaucaugcauaauagguuauuguaugccacgggcugcaguucugcuauccaggggcaacugcuggacaauggaaacuaaaauauggaaauuauagcugucucacuuacacuucuccuauuacagucuuucaguucaauuuaaaaucuaucuuguagaagaauuagaaaagaaauacaccaacaagcguagcuuacucuaagaauuauucuauaaauuuuacuaauauugauaaaauuaucuuuaaaggaaaauaugguaaagaagagauauaaagaucaaauccuacaguaaacucagguuuauccucuuuuuguuguuguuagagucuuguuauuuaaaagaaagagacaguuggagcuugaaaauuuuaaaguuucuuucuuacuuguauuuuaucuauaucucaaaacaugaaaguauuuuuauagaguuugaccuaaaaugccagcuguguacuuggcacccugguagcugcagcccuugaauggcugaggccagagggccacuggguccaguguagccugggcagcaaggcgugaccuccaucugaagaaacagggcaggaaagcagcacgguggggcuuguuagacauacuuuuccugggagacguuuuauagcuuucaagcagucuuuaaauacacguuuugcuuuuauuuuggguucaagaacaccacaggaaacaccacuugauaacuuuucugaggaacacaagagauuuagguauggaauccuaaguaugaaaaaacaacuaauucaaguuuccaauaaaaguuaaucugcuauacauuuguuuacguuaauagacagaaaagcucaguuucaaaaauuaaugaauuuuuguuguaaaaucacuuuggcuaaggcagaugggauauaaacaaauacuguuucuucuuuucuagauaacauuuucggauaauauauacucacuauauuuguuuuuguauaguuuauuuuacuaauuauuuuguugugaguacaaauuuaucugaccuuuuuaaaaauuagauauuuacuuuauuuacauuucaaauguuauccccuuuccuaguuucccuucugaaaauccccuauccccucccugcucccuauauucaccaacccacccacucccacuuccuggcccuggcauuccccuacacuggggcauagagccuucacaggaccaagggccucuccucccauugaugacugacuaggccauccucugcuacauaugcagcuggagccaugagucccaccauguguuuucuguaguuggugguuuagucccugggagcucuggggguacugguugguucauguuguuguuccuccuauggggcugcaaaccccuugagcuccuuggguucuuucucuagcuccuucauuggagacccugugcuccauccaaugguaggcuucgagcauccaccucuguauuugucaggcacuggcagagccucucaggugaaaacuauaacagguuccugucagcaagcguuuguuggcagcacaaaagugucuggguuuggugguuguuuaugggauggauccccagguggggcagucucuggauggucauuccuucagucucugcuccacacuuugucucuguaacuccuuccauggguauuuuguucccccuucuaagaaggaucgaaguauccacacuuugguuuuccuucuucuugaguuucauguggcuugugaauuguaucuugguuauuccgagcaucugggcuaauauccacuuaucagugaguguauaccauguguguuccuuugugauugggucaccucacucaggaugaucuuuucuaguuuaucugacuuuuauuagcaacagaagucacauguacauauuuuaauucuguaaaacagcuaaguuauuauaucaaagugaggaagggaaauauugccuuaccaauaagggaaaauauucuacauguauugagggaccacaggucaaagauacugaugucugcauggcauggcacaccaugcacauguguguguguguguguguguguguguguguguguguguguguuagggagauugucuuugccuccuugagagaaaacagugcccccaaaucugucaucguucccucuguguuaaccccuccccuccccugugggauguugagcacugaccccggggcuuguguucucagggagacucuuaagacaaggcuugcuucuuucucugcuuuaucccaggaaaguacccuauccacggcuaacgcagugaaaguugggagaagguuuuuaaaguucagcucuaguguuuguuguucuaaaagcuguuagugacuuuuuuuucuucuccacacaaaauaguaaugauugacguuaggauuuuguuucuccagucuguucuucaguguccccugugagugauaagccggacuuucuaucugcuacggcagcagagcugauugucuguauuccugucaucucaggcuucacagagccucuuaccugaacugucacacacacagccugccuuucugugccucuagaguacagugucacuugauuuucuuccguaaccugaguuuuuauaauauuuuaauguaagucacaugugagcugugaguuguggguaaaauccagcaggaguagccuaggauugaagcaaaugugagcucuaaaguggaaauauuugcuuuacagugguuaggucauaggauuucuucaguagugcaagcucagaucuagaauuuacugucuucaguaugguauguaucuuuuggaucuuauuuuuguuuuuuugagacagggucucucuucguagccauggauggcccccgaacucacagagauccaccugccucuaccuccagagugccaacacgcccaguuuuacuuguuuguuauuugauacagggucuuacuuacuuacuauguagcccuggcuggccuugaacucagguucacggccugugcucauugugcacugcaaggcuuaaaggcggagccacuacacuccuggaagagcucugccaaugagaaagccucuuggauauucuccaguauagcaaaaaugaaaagcuaauuagcuggaguucaguucauuagaaucagccuccaguuagucauuuccucucccaccagaugccucacuagacacagaagaaaaacaacuaaacaguuggcuaaggauucggcguaaacuuuuuagaauauaaccaagggguccuggaaccuuagaggcaagcaaaguauggguagaccuuggaugauucucugcuuucucaggcagauuggcacuguacugucugucugucugacagugauugacccaaugccuagagaccucuguauggcugaguaacagauagauuggaggccugaacgcccugugcucgacaauggagccucgggcuugaacuuccuguguggccuggguuucuucucaaguuuguuuguuuuuuaaaucuauuugacaucaaauuucuaauuauuauuaauuuuuaaaaacuucuauauuuuucauaauuuuuuauuucuuucuuaucuaacuugccauuauuuuuacaugaauggaguuuaaaguuuacauguuuauguaacaaauucaaaagcaccuggguuggaggagggaaaauguucuuuucuggcuuacuugugguuuguaugguggacgcucucaauuucaccuuuccuagauaaacagaaacucagcuucacaguggggauuuuauucugguacaguaucucagucaucagggaaugaaaaugagcuauuccuuagguggcuacaguauuuuauagcuauccugguuuugugguuuguuuuggucauguagaaaacugggauucuucaucuuuuguuacauuuuaaaacuaacuuuuguuuuaugagcauggguguuuugcuuauugcaugccugugagcugugucuaugcaguuccugccgagucagagguugucagaacccgggggggggggggggggggggggcuggaguuacaggagcugagaacugaacccaucuggaugagccgcagccagugcucugaaucacugagccaucucucuagcacccuuuauuaauuacauuuucagaaauuaguuucuuaauauuaaauuauuuuacuauuuauauuacuacaaauuaacuguguccaugaaggaaccuggccuguaauuuuccauuuuucucccucccuuugauuugaaggauugaaccaacaacgcuguaccugauacacaagcaccccaguucugagcugcaucuccagccuguaacuuuauauugacuuuuauuuguuaggcuuuguuuucuuuuucuuuuucuuuuccuuuuccuuuuuuccccccucccuuucucccucuugcucuggcccucucacuccaggccccacucacucccccugugccccuuccggcccauagguuuuuuaaaaauguuuuuguuguuguuacuguuuguuuguuucucauuauggaugguugugagccaccaugugguugcugggauuugaacuccugacccccagaaaagcagucagugcucuuaacugcugaaccaucucaccagcccuaggcuuuguuuuuaguauuauucuguucucaaauauauaaaccacagcuauucauugccgugacuaaauacaagaaguuaaaacacacacaagcaagaaagaccaaaaaacagucuuuaaggggaagaguccucuuggcucccaguuucaugugggucagucuguaguggguuggccccauuguuucccgguggugaugaggcagaccaucauggcagaaggacaaggagcaaagccgcucagcccauggugucugggaaacagacuggaaccuguccagguaugucuuccaguuaggacccacggcucccuuccaccaccucugaauacugccacaguccuaaugcucucuaaggaugacuccacugaugaagucagagccccagcgauccagauccagccacuuccccuaagccccaccccugaccccagcugcacagagagccaagcuuucuguauaggugccugcuagggacaaaucuguacaggcucuucucugaguuaccuagucaucuacuuaagauggagcuauuaacccuuuuaacuuucacagagggugagauguucuaguuacauuuuggaauaguucuaaguuucuacaugacagacauggcacgucuguuaaucguuggaagaaccuugucauguauugccuguugccuuucagcguccugauuaaagaugagcugucugccacacaguaugaauagcauauuauuauuauuauuugcuaucuuagauaaaacacuaugucuuuuuagguuuguuuguuuguuuguucugguguguagacuacuuauucuaguuguauagcguugaaaauuuuaaaauucaguauauuguuacauggaauuaauuggaagaccugauacaagccaguaaaaccauuauuguaaugacauugccuuuaaaauguaauuuccaagugguugugguggcacagguauuuuggcagcaggaagaucguggauucaaggccaaccuggacuguauaacaagacucugucucuaacuaaauaaacaaacaaauauaagcauauuugggugguuguuuuuucugcucucauuguuaguuuguauacuuguuaagucauccagagcuuccuuauuuucuagaauguguuuuuacuguaauugaugcaaaugggcuccuugcauaacgacaccauguccgagaugaaagagaacccccaugugugacccacagcauguggccgaagcuguuuaguuccuagucuuguuauuuacuccauaccaguauucuuuaaaacgaguaaucuaaaucuacuaacauaaauucaucuuuccauuuuguaagucuguuuuauacacuuguaacuaacucuugcucuguauccuuucuuccuuuagaaaaauuggaagcucuaccacccacuccaggacagcugagauaugguaaugguucucuaauuguuaaauugauaugcaccucucuuuuggaccugaaggaaugauuucuuauaggagcacaacagucaguaaauuaaagccuccuuauaaauaaagguuguccuauuuuucauguaagagcacuuucauauaucacaguauuaugggauaacuaauauuuauucuuaccaucuaguaauaaaaguaaauuuauguuagaaguuuucuuuucagaaaaaauauauuauauuuuacuuccuuggcaaaggauguguuggauuuaguugggugacugaggaacuuaauuugagauuugggcuaacuguucucugaugaggccagugcuucuggguagcuagcauuggcagcaguacguacggaaguaagugcagugcauuugaggcggaggaaccucauuacugagcuguacuguucuucucugauaagaguggauauugcagguuaacaugggagugguguaaaacaguuuagggucuuauuagaagacaguggaagagaaucauuuaaaaguguggaggugaauuugaguaggugguaauuaaguagguaauuaaauauuaaaugucaucugcuaacagcugcuuagcuauagaguaguguuugccaaagggaauuggaggaacagugaauuaacaggagaucauuauucaguggaaggcaaauucaaacgacuaggaacaaacuaaugauaguucuuucuuucucucucucuuagguagaauagaauuuauguuagaaauuaguaacuuuccucaaacaccagaacaguguaagauuuuuaagaucucucuucccaggugaucuuuccugauucucccagccuagacuucugauucugugcucacuguacaugcagcacucuaucguuuuuguaggcgauguugaaaugaacuguuuauguggcuagguuucuauguccaacuccuuugcaguguggaaaccgaguguugugugugucuuuguaucucaaguucccagugggguacccagugcauacuuuuuuuuuuuuuugaaaaacuuaauuuuucuccuuugaauuaaaaguaguuuuuuauuuauuugacagauuuauuuaaauauaaagauaaaagaccuacucuauaguucaagcagcaugccuuagugauacugaccaggcgucucccaagaaacaaucaauguaaucuuaauuuaaugccauuaacaucuuauugagaugccaucauguuauuugcauaguaagugaucucaguugauuuccucguuauucugccauauuuguguuucagagaccacacuuagauagugguugacuguaaaauuuccaguguacuccuuugccuauuaaauguauauuguaguaugaaguuaggauugugugugugugguggguguuuuggaaguugcuuacuauaaaaagucaggauguucaauaggcauccaguggacgcaggagaaaaaccagagaaguaagaagucugggucuugagugaaucccaugccacgaaugcagugguuggcuuuuaccaucuugauagcuuucgcagugaugaucacaguggacuauucuguucuucgucaugaacguuguuacugugacaaguggcacugaaaugacuggauuugucuauuguauacgaucaauguaauaaucuauacauggugguguauaucauuuugcuggaugugacauuucuuugagaguaguuguggguagaagugucuauuuuuuuaaaucccugccucguagcauuuccgauggaagagcucaccacagcaguaucauguuuucauaacuucuggauuauacuuuaauuacaucgaaucugaagacacuagcaaauauaaccaacuggcuuaagggagaacuauuuuuaaauagaugguaaagcucaaauucuugauguuuauugaaaaaaguugucaguugaucugccauugucuaugccauugcaguuguaaagguuaguuagaauagucucuuccuguucccagcuuucuguuucacagccuccuucaggugucuaaacaugaaauuagcuucuuuuucagguuaguaauccuugcuugcuguaagcaauuauuuuggagcaucugcugugcccuaggugcuauauagugugcuaaaggugcaaauuucagaaaaugaggugggauuauaaaauaaaauacguuuuugcuacuuugacguuuaauauccagguuuuaggcugugugccauagaugacaugggaagugucuuuggcaggaagaggccuuuaagucacauucugaugcagagcaaauacugauucuugcaguuucaguagcauuugggaaucugagaugguaaggacugcacagagaugucaggugaaguugucuuuucuuaaaaauucuuuaaagaguugacgagggaguaaaaaugguuaaauaacuucccuggaauuugaauguaggcauuuuuaaaaauuauuauuacaaauacagagauuaguaguuuugugauaguccucaggcacaagagagaaauagacuggcaugugucagguuaaaugggggcaucccguguuuacagacuuacucuuccaugaacugcauguaugugcauugcccgugagaaaacauaaaggccgaaaaauuguuuuuuuguguuacauauuuguauuuuguuugccagcauaacuccugucaaguaaacucacagcagcaacaggaucuauggucguuuuagcucuuuaaucacauggcuuguuuuguucauucuaaaguuaccaagaaguuaaaauauauuuuucuguguuuugauguuuuucaguauucuuccacaaugcgauaccuuucguaggguuuggcuuuuuggauaacgcaauuaugauuguugcaguaaguccucaccaauuguauuuugaguaaagaaauuagugugcucuacauuuuccuaauaacuuguauauuauaccugucaaguuaauuaacaguaagcaagcucaauuuuaaagcaucauguauguuaaucauaaaacuuuuggcaaggcauauagacaaauguuuaugguuuauauaauucucuucuaacauuugugugcagcauaucugggguucuuaguuguguuaguauuuguuaucacauauagaggguauuugguuaguuccuuguugaauuuucucauucuagacuaccuuagguguuugggauguaguaaggcuugagucucagcacuugauccugaaauguguuaagauucacguugcaacaucuucugccuucguuguguuguguaguauuaugaaaaguucccucuagcuguacuucuagaaugcuuuauggauucaacuauuuuggauauuagcaguaaauagacugaaggcuaccuaaauccuuggaagagaagaaaguauacauuauuuauuuuguucuguguaccagucugaagucccaaggagagcuuuacugagaugcauuugcaaaacaaugcuuuucugaauuaggagaauuccugagaauuuauugugagcuucacagagucuaacuuuaacaauuuucuaugaacuauuauugaggaaacuacccagaaagauggugggagagagagggugggugguggcgggaagggaggggagauggaagaguguuugguguuuuagaauucaccuguacuaucaaugaagauaaauagauuuaguuguaaaauagaaacuuuaaaauguaaauuacauaauuguuugauaggcuacaggcauuguuuaaaauguaaaaucaguucauuaaagaugaugugguugcuauagggucuagccuugcauccaaauuaaugagggcccgguuuccagugguccgcuguccaguugguuuaagagcaguacaggggucccgcagcaugucagcuguagucagcagucacaugacucuggcugugcacagcuuggggucauaagcaccucugcaggguuucuuggugucaugcuguggcaagaccagacuuacaaaggcugacacagguuaauugagugggcauaagauauaauucuagaauggucauuuuuaggcuuauuucccuaguauacauaugagaagaaaaugguucaauguauauacaaaugucagacgaguacuuaauuauuuagcgcugcacugcuuuucucaggcuacuaacauugaguugucuaaauuacugcuguuaaugcagagcauaucuacuuauaauaaaagcuccauauugaauaaaggggaguauguagcaguaguuugaagagagacaggagaaugggaguuaauagcuuguuagaucucuaaucagacccugugcaguaucuuauaaaaagcugaugaugagugucugugugcagauggagcuauucauaggacuagaccaaacccagcaaaacagaccagagacuucaguucaguguuguucuuuguguuccucguggcugugccucauuccuuguauaucauaggacaguguuuuuccagaccugagauucuugacuccagguuaccaauaaccuguuuacauaaaauccgucuucaaggacacauccccagccuuugcugaaauaaguauuuuaaaucacugacuucagcacccgaugaagaguaauacugguuuugauaaagauucagucucuguaauggaaggccauuuucgagagggugacaaguuccaaugagguguuuucuuagacucuagaggugagcacagaugaguaacacaauggaagagucucugaaccaaguaaucauugccggcuucugaugugccuuuuccuuuuguuuugucuuugcucuuuaccaugucuuaaagcacagaugguuuuucucauuguggagcagaugugaguguuucagacaggacgaguuauggagucuucugcccugucauguuauaaacuaacccuccuccuucucuuagaugugccuucuuggcuuuguagucaaauuucucuauaucagcuauaauagaccuuuauuacuggcugcuaguaauguucagccuuauuauaauuguauauuacuggauuguuuuuuguaauuuauauuuuagccauuuugggaauugauuuguuuuacaauucaauuaggauagaauuuuuaagaauagguuaauuguaagguaagaguaauuauggugauaguuuuaacuuuaauaacuggugagauuuauuuguaauuccuaugucaucuauuaaaauaaaaguuuucggaacacagagcaaaauaaagauaauauuuuauuauaaauaaauuuagggaauuguuccccaagcaauaaagcaugcaaacacuucuuguuucuucucuuuuuuucccccuaagauuuauuuauuuacuugauguaugugagcaugcuggcugacaagcuagaagaggccacuggacccaacuacagaugguugugagccucccugagcucgcugcgcccacuucuuguuccuuacugucacuuuguguagggagugauagggccaagccuggagccucgugcaugcuagcagauacucugcccacagagcugcaccgucagcucacacggaugaugucuucacagguucuucuuggguuacucaccguggcucaccacuguuaagggugcugucacauuuaugauguacuugugcacagcucuguaguagugcucuacugucuucccauuuacacgaaaauauguaucuuuguuauuuuucucuccguuuuauuuuccucagaaauccgcuauuuuaggugccaucagaaguuaauuauuuuaugugucuaggagagugguguaccgggcuguuuggucauaaucagcaagaauuacauuuucaagggguaggacugagagcggagggaggggcagagaauugaggaagugucgcccagacuuuuagcucuggacugccugccuguugagcacugggcucgugcagcacaucagacagccucuuuuucuuauagugguaguugauuuuaaauguccaaugcuagucuucuagggaguuagcgaaagcuaaguuuaccuucaucaaggauuggagcugaguuagaguaguccuaggaccuccucuguuugacagccgggagucaugcaucccugucaccucagggccaccucgguuaagugggugggcagcgugagcuccucccuuuuacccaagggggauagaaauguggggaccuccacugagcagacccaguggguccucauuacugucagugcuguugacagugacuguuguccccaugaaaacacacagaucccagucacgcuauuuaaugguuaaggaaccaaagguguugaggaaaaucuaucuaguggggguuuuccuagaaaaucauguagucuuucaacucuuuugauacauugagcaagagagcaauauguuacagaauuuagcaccuaugcauccaucuuuguguucaaagagcuuuaaaauguauuucugggagauaaaaaaguaaaauuaagggcuggagagauggcucagagguuaagagcaccgacuguucuuccaaagguccugaguucaauucccagcaaccacaugguggcucacaaccaucuguaaugggaucugaugcccucuucuggugugucugaagacagguacaguguacucaucuacacaaaauaaauaaauaaaucuuuaaaaaauaagaaaaaaaaaguaaaauuaagaauuuagaaauuagacuauuaaugaugaauugauuacuaccuguguugcuauuuauuuuuagaaggcacaauuuuaauggaugaaaugugauugguuauuucgucaugaauguauauguauacauagaauuaaaauauagaauauauauaacaaauauauagagauauauaaauauagaaccaacugaauauauaggaauaauuaagugaaucaucucaugcugugcacauacauggauauuuuuggguguaauugugugguagcagcauauugacuacacagucuguucuuauuaacauguugauauucuuuuauagccaucccaacuuuaauuuuuuucccaaucacuuuucagggaacccaaauugaauugucuauuggaauuaucuuggggauuucaacaauggcagguauuuacuaauagcaaauguuaaauucuauugucugcauguuguuuaaaaaugucaguguuagauuuagaagacaauaauuuauuuuaaaugaauuugcuccucaaguuguuuauuugcuuagguaucuuuaauguuaaccuucugguucuuaguuuucuguguauguuuuuccccugagaaauuguaaguaauuuauguuacuuaauggguaacagaacucaacuaaaucaucuauguuaaggcauuuuucucauaauucaauauuacccuaaaucuuuuuacccuuugucacuauuaaauuaauuauuuucaaguugaauagaaaaaaaaaucuaaaagaaguauuucucuuccuuuacuuucuugaguugggcuugccaacuugacuuuauccuugagcuuccaauauuuaaauuuccugaagcaaacgucacacuaaagacaaaaccccgaaauuucaguauugaaauaagaauagaaaaugucugcuauaauagguaagcacucuaucaacggagguagaauauuauaaccuuagcauuaugcuccauucuaaacucuugacgccuagagcuaucccugaaccacuucgaacauaguuguuacagccaagaaauagguugacugcaggagaccaaggcucagugccucucacgugauacaauacugugaccuuugcuggcuugcuuuugauaauucauuguguguuuuucacauuuccagcugcugcuuugggaaaucuuguuucagauuuagcuggacugggguagguucauugaugauucaucucugccguuguguacuuacauguucuugucuuuacuauucucuaauaacgcaccucuaaaaagcacaaccguuuuuucuugggguuugaaacuaaaaguuuaaguuuaauguuucuaaaucaguaguacauugaauauaguuguugggacaaugugccaauaaaacugaauagugguuccaagaauagauaaaaccaugucacuauauaagcaaaauagaauuucuauuuauaaaggauauauuuuguggacaucuacaaugggaacagagaaucaaaagcaaaccucugucauuguuccauuuccuuuuacuuacaaaaaucccaaagauaaagagauaugacccaaauuugaagauacugaccugcaaaagaaacaauguccaagucucuucccugcgcuccccccuugcuucucucucaugguaagagaauggacauggggucuuaugcaccuuaagagugcaccccaccucugagccaccccccagccugcagacauauguuuacuuggucauuucucuuucuuuuauaugguaggaaugauaacacaaaaggaggauggcugcccugaaaagccagcuuucucgcuuucuuccagguagcagauggccuggcugcuuccugggcuugugaaagcugagaaguuggcacucagugguagggcaaaugucucucccccaccccucugucauugacauugucuccucuuuuggcuacucaagucguauauuuugagauuuguaucuaguaggagucaauuucagcucauagucuaagaagagacagucuuauaaaugaucugacccuuuuuuuuuucaauauauuuuuuauuagcuauuuacauuauuuacacuucaaauguuguccccuuuccugguuuccccuccaaaaaaaccccuaucuccucuccccucccccugcucaccaacccacccacacccucuucugggcccuggcaguccccuacacgggggcagagagccuucauaggccucuccucccauugaugaccgacuaggccauccucugcuacauaugcagcuggagccaugagucccaccauguguacucuuugguuggugguuuagucccagggagcucuggggguacugguugguucauacucuuguucuuccuaugaggcugcaaaccccuucagcuccuuggguucuuucucuagccccuucauuggggacccugugcucuguccaaucugaucugacccuuaacauuagacaucugcacuugaguuugaggccaaagcuaauuuuaagggguuuguuuuguuuuguuuuccugggccaugauaagaauuuuauauuccuggaauucuugacauaaaucuuaucuugauacagacucuuugacauuucauuuaccauuuccaaaccuuaggcuuaauauugacacuauucuauaauagugucuauauaccuuucugauucauuaauggaauaaacggauagauuuuaaagccacuuaguuuuagauugaggucugaagacuuuuaugaagagcuucuauguuugagaacuguuucuccuucagguuuuccuuucucucacagaugucacuuuauauguguuccuagauguacacuuuuaagacaucugaagccagaauguaucuuauuauugucagugugccuaauuggcaagcucuuuucuuucagauaguacuuagaacaagauuaaugcugacuuagaauugaucacaucuccuguuagucuaaaaguucuggucugucauucuuaaguacauuagucugauaaaaaacuguuacuuucugaucauaguuaucaaauuaaaucauaugaucaaacacuuugaguuuggagugcaacaauuauauguguguauguauguguauguauguguguguguauauauauauauuaccaugauuguucucuuaaagauaaugauaaagauuaaauguucuuagucacuguguauuaaaugugaauuugaaaguauuuuaagccagaguuauauauacauaauaaaaugcaaguugugauuuuuuugcugucuagagugauaagcacagggacagagucugguuucucuuuguagugauugguuuuacucugugcauacacuugcaugcuuccuuaaacucucucguucucuuguucucuuaaagccuugcagguuauguugaggccuuggcguccaggcuaggccucucaauuccugaucuuacaccaaagcaaguugacauguggcaaacacguguuagcacacauuugguaaguuguaugucuuauaagcugcaccuaguguccagcauggcaguuucaagacuaguugauuugaguuuuacccaggccuuggacauucucagaaaaauaauucgcuaucccuuuauccuuguauaagcaugauugauuuuuguaaaacauuguucagcuugguuaauaugcagggcuggagcacccaaagguguuggaauccuuuguucauucuggaagugauucccauuucuacugaaguuguucacugguggucauuucugaggaugucucuacacuguuaggggaggaaaggucaaauaguaacggauugaaaugucagugguggcaaggaucaccccuggucuagcauuucuaaggggggcgagaggggacccuuggucacugugggugauaguguaagacauuuuaacagaauaggugggugguugggguucucuuagcaaauggucauauccuagggcagucaggagccauauaauggucucucuguugaaauauaaaugaacaaaauauuuauaucaaaauaagaauuuaagauuaacucucuuaguaucuggacagaacaaaguuuucuuguuauaucucugaaacuauagucccuuuaaaaauaguuacauagugagcuuggcagauuuaacuauuaauauaaagcacaggcauuacccccacagcaaacagcagaaugccgcaguaacagacugaaaaagugucguauacaguauugucaaaacguugaugucuauuuugaaaguuauuacagauagucugguagauugcuaacuggaugcuauccaagagaaaacauuuccuuccauguugcagauuauguagcuagcguagcuucuguaaugucggaugggacuuauugucuguuuucuuaaccagaagcuccuggaggaaagaucaacucuaugugauuaguccuugucucgggcuuaaccggcacagaguuuaguauacaauagaaccucaauaacuuuuuguaugaaagaagaaaaguuaacugaggggcugaagacauggcucauacauuaggaauguauacuguccuaauagaggacccaaguucaguuuccagcacucagggcucacucacaacugcccauaaguccacuuccaggguccagugcccucuuuuggucuuugugggcaucuguacucauacacacauauucacauacaaagacacauacaugcacacaaauaguuuaaaaauaauaaaauagguauuuuuaagaaaggaaaccuaauugaaaagcuuaaauuugauagccaucaggaauguuaaauuuggaaucauuuauagaaguaaaaauuuaaaacuuuucacaauguagauuucaaaagucuuagugugauauauacacauacauacaugauuaaaauuggcacugcacauuuguaguuuugucaagugugaaagacuucaugaccguagucuaugaagaugcacaaauauuaacauugaauuuuuaaaucaucaguaguagaucccuucagugucaucucaguaguggaaugucaggggagguuccuuaugcuuaggaaagcuuucaggagucaagaauccacuauucaguggaacuugaaggucuuuauauagagugcaugcagcgccuuggaaacagaaguauucgaaaacauggcacacagggcagagaagcagagagaaacaguuucuauaaugguugguuguaucuacauauaacuuagcauauaugggauuaaguccugaaggacaggauacaaggguauugaguccagaugcacugagacuagcuggcacauucuccuccuguguuucagucuucugauauuaaaaacacauaagauuuaaacaauuuuguacuugaauauuucuuugaugucauguuaauggguuuuuuuucuucuguuccuuuaaauuuuaaaaugacguguucuugaacauuugguagcuuauuuuaauacguagguuucuguaaucaauaggaauacaguuguagugggaauuacauaguguauggcagugggcuguugucaucagucuguaagcaaggauaccucuuuucgggacauguaauuuuaagaaguacucucuucuguuuccguagggcaaggcuguuggggugacgaucggcugcauucuaggaauguucccguugauuuucuuuggaggaagugaagaggaugagaaacuggaaacaacaaauuaaucaccuuagaacaccuauaagaagauguaaacuaauguaccucaucauuaacuauacuguccccacaguuagcagugaagacaguagcaguguauagauacgggaucaaauaacucagcauguacuauggaaacacuaacuuauuguggcuuggucuucuuaagacaucuuuuuaaacuuacuuaguaucauuuuauguaaauuguugaugcuuuccaucaauggcagucgacaugucaucuuuuccuucucuguguaucaagauauuauuuaacuuucagucacugauacuguacuguacuguacuguucugacuuggguuugcauauuuguuacauaacaugcacgggaauaccuauuuaugguuuuauuuuuauuuuuccuaugguuauaucaaugcugcgguuucuccaaauuauuuaagauguuuaauaucaguuaacauuuuaacucccugucuggugguauuacuucuguguuaauucacagugaacauuuacaaucauauaaauucauucaauuuuuaaccuuucacaucuauccaaaaugaagcaguguuuuaaguaugucugauucacuuuaauuuugagccaugcuguguuaagagccagagguuaaucggauggaacaauucucuggccucccuuuuacacaaaccauacaugcuaacaaguguacuuaucucugauuggcucuuuaccuuuaauuucccaacuuugaacaaucacacagugaauucugguuugugagagaaaggcagugcuuggauauguccggucucuuaaaauagggauuaagagaguagggaaaacuaagaaauuuauaaugacauuuggaaauuaggcuaaaauaauuuuuuuuuuauagaaaauggaaauuuucaaggagguugugugggguggaugauaaaguuccagugcugccgggaagguucaggaagcaucaguucuauggcuuuggaaagaguuuccccugauguguugucauugucucauggaacggaaggagccaaaauaucccaugcuuaauccuaaucucauuagaucuugcuuugugacuuuuuucuggaugaauauuuuagaaacaacauguauuuucuaguuugcuaccuagucuguaacacaaggagagguccuuucucccuuugguggaugguuuucuucuuucguggugguuaugcacacaguuggugaaagcugugugugugugugugugugugugugugugugugugacagcuguguccugugucugaccugaacaccguccugagaaucccgagcuuuaauugcugaacugcccccccccuuuaucucauuugcucuacauguuaaaaaguuauauguagcagaauaauuggacauguggaagagagaaacugaaguuagaauuuaauccuuggggaauuaaaauuauucauguuuccuaaguagauggaaaagaugaacuucacgugacuaugcuuucuaaaucuuauuuuggaguuuuguuugcacauaauuacuuugggcuccuuuuaaagaaaauuucuuuuccauaagaaagcaugucauauauuguuuucuuugcacuuuguccuguccauuuaucauagaauuuaaggaaagauagcauaaaaguaaaaaacaucaaauucucauauacacaaguaauauucuccuuuggucaggcuagcaucacaugacuugagguggcagacagauucaucuuugcucacaugucccacgacagcaagcacaagguuccaggugaaaggcuagaaugcacauuuuacuuucuguguagacaugugagugcucuuuccuucccuuguguaucgguggcauguccugucuuuguuugucagugcuguauuguggugcuuaacucuucuuuguauuaaauaccaucuccagaaacuugucuuggaguuuagaaagcacuuuggauuguugauuuuuuuuuucuuucucuugaaaaagcuccucguccuuauuaccagaauuucuguuaacagaauuaugccaguuuuguugaaaacuucacuuaugggagguguaacuuucacacgaaagacaugcuaauuuucagucaaaauuuuugaaucauauuuaaucaauaaaaugcuuucaaucauuaugauacuucguuuucaaaagcagacaaacaaaauuaaagucucguucucucgagcucuggcucugaccuaacaugguacuuugcacagugugauuucugaagguggccccuuuaaguuaaggacuccauaccacccguguugagcguuuuucaccacagagacucugaugccagcugaaacuggacugcccucuuucucauagcagcuguucucuaucagcguuagagcugcagcggacggcaucgugcgcugcuguaguccugucuguucagaauccaugguguuuguguauuaugauuuauggacuuguugaugcauguaaacugggugcauucuguugccucuguauguuaaauagugaccaauguuuuuacgaaagaauugaacaaaaaaauaucuuuuaagacguuuggaaugugguuuuugauuuuaaaauuugguuuucuuauuaaucucagaggcgcuggguuauucuaugacagaaggaaacaggaucaaugaauaaaugcagguuuguaaugacgcggcuucuguaucugcccucuuagagcucccacugaugugaaccccauggagugugagagaaggaugauuccaugaaacagcugcgaacgagcgcuaggccuuccagccccagaggcugcucaggcugcucaguucacuucaggcuuugucuccaugcagggcacugugaaagcaguggaaggguuaaaauuuacacugcuccuuggucugaucucacuccuccccuaacuccucccaggcuccuuucacaccugacuuugagccccuaccucaccccaccccacucacccucacccuccaucccaccaaggccaaguugugcugccaaauaguccuggcugaguggccuuccucuggaguguggcuggcuugucagggcugcuauacucuuagagaaaacugacccuuccuuucucacaaauaacaaaagacaauacaagcuucugucugacaccaaaaguuuauguaagcuguuuugaagcaaaucugccuaguuuuagaauuccacauuauuuauggacauuuuuacugugcuguauuuuguuuugaaauaaaguaccuggggauagaauuauaguuuuuucauccccaccucuuuugaggugcucuucugggaacaauugcuuagucugcuccccccccccccaaguuguguagauuuagaaagugaauucccauucuuaccaugaauuauuugaaaagauaggaaauguguuuuggacuccaguggcaguaacaucauugccucccuuuuuauuaccauugcuuuguugcucugugcugcaguguuucacacaucuuaccacggugaaucccaacugcacuguugaugcaguugccuuauuuuauguuggguaaacugaggcacagugaagacacagcauuaucuaccugugggcuugaauuagcuguguccauguaugcuccuuaugaucuuacucgauaggacaucauucuuacgaacguuguguuaucuguuguuuuaauaaagaaauucacguucuuuuuacaaagaaacaguuuuucaaaaaccaauucauuuucucaucuauaaccuaucagaucuuguuggaaaucucaagcucugcuugauaaauucugucagccugguuacauucagugugcuagcagcuguuuaaggaacuaauaccuacuguuugucugugagguguuuucgcuuuucuccuuuucuugacacaaagucucacuaugcugguaccaaacuuagggcauuucuuucaccucuguuuuugagcgcuggaguuagaggccuguaccaccagacuuagugucucugucuucaugaagcuuauucuguugggaacauagguggggggaaaagaacauagaaauaaaugcaugcuuaaaauguuagcaugcacaguacagauagacaucugugcagagaagugugcuagauucuaggaaauugauguugcccuaaucucagacauaugaaauaauauuuccccuuggugugcauugugaauguuuuccucuuuauuucacuuucuuuuucuuuuuuucuuuugaguacacuguagcugucuucagacacacaccagaaggcagcagcgcuugcacacugaccuggaagucccagcagcagcaucacguuuguaugccucccgugcuugucuccuuuuccuuguuuucuuuucccgaaccucaggacgacagaaguaguuuuuaggauacauuuuauguuccaugcugugacuuuaaaaacaugccaaucaaacauccucucuuuucuucuccauuccuacuugaggggagaauaaauacaaguuaaguaguuuauuucac

SEQ ID NO: 7764 - RNA, 50736 nt, Mus musculus
uguguccaugugcacaagugugcuugaguguacaugcacaaagaugaaagccaaccuggcccuaacacucgaacacagguuagcucugugaaguuuuuccuuacagagcacaugugcuaucaauauaauucuacaggcaccuuaaaauaacuggcauacaugguaaaaaccaaaccacaccacauuguaggcaaauacuggugccacaguaaccuuggaagaacacuucaggcacagccaacgugucuaguuccuuuuauuagggcaagugugagcgugcucugaaacucucacuugcaagcaugaacagugaggggccugccucuaugugggccguucccgaggucuggucacaauaugccaccacagugggggcaagucaccuucccuucuggcaggaggcaaagcuucagucauaauaccaucaggugauguuuccuccugcagcugcuuaaccuagaaggggacaaggaagggacaauuacagaaggacucucacaguaagacccaugugcacggucagacggugggcuaugucucccuccacccggaaucagcaucaagaagagguuauuucauauaaaccugcacuguuucuaugccugagucuaccaaucacaacaaagagucucccugccuugccuucccaguggugucaucccuggugagccagguggcuguucucacuuguucucuuagcaaggcaaagcugcguacucuccugucaccuacuccuucagcaaagccaguagucugccugagucuguuugucauggucucccaugguccccaagaaaacacuccugucuaaucacucucccaaagcauuaagaagcccagcucagauguauuagugaugcaaauuaacaaguucccagggagcagccaggacaagaauucaggugaagucacaugaaaaguaggcuccgcccugccggauguugcccaacaggauucucaacaucacuguccuaaugggacuggaccuagaaguaagagcucaucuacacacagcacuggauaacauccaggagcugaaagcaaagagagaagcggggaacucaggagaggcccucaguggucacuggcagaacaaaccugcggcugaccaugaaaauauauucuaagccucaauaugcucuaauacuucuuacaaaacaugaugucccuuggccacagaggccuuucuacuccaccuuggccuggcucuggaguucucuuacuuggcuggagaaacggcucagugggcaaacuggaccggaaaggucaguauagcuaaggagaaaauacuagaacaaaccaaugucuacugcaccaauugcccagugucagaugggccaucacugucacuuggcaagccuacuuuuccaugugcuccccacccgccauacccacucccgugcuguccucaggauacugagaaagcagaagcuguuacagagaagccucccuuucaccugaaugcagcuacacacacgugucuacaacagaggaaagagccuuuuuaguuuccucucaaggaucucagucguuuccacaguuuuaaauauaacugaaaacaugacagacuuccauuucuagacccgauuccuacacuccaaaguugccaaguggaauguuuccuucacagacgccagagucccaagcuucacccuuccgaauguuugauaaucccugacacccgggacuucucuccaccuuacaccagucuugccuaccuggacaccagcccugaacugcagaaccuggaaaccacugguuucucauguuccugaccccauuccccacagccagugaagaucccuccaggggacguucugccuguccaugucccuuccacagcuacuguagcacucugugggccacacaacuuuuucacugaaacuaccacacaaacccuaaacugggcuccugauuccuccuagcuucuccaacauagcacccacacuaugacaagagcugcuuaaagcccaacucugacuauccuaagcugaaugaagaaugccuaggcucugggguaggaaaagggcaaggaauuuuauagaagaggaagaggagguggaggugagagaucagagagguucaaagcgcacuagagacaacauaucuggaagauggccaaugugaaauugaacacagugagaaacuaaaagucuagcuaagaagccagcaugaccaucauggcuggacuccaugcccacagagguaaacuccauccacaugcugaccaagcaaaacgcuauggugcacugucgaaagacgcaccucccgaucccagcucuccauccucagcuucuuccacugcucucucuuggaaaaguaaucaggauacauugcuuucucagagggaugccaguaaucuaagcaccauucuggaaccugccaaaagagaaaagcaugugugauuccaauggguaacuagaaaugccguggacaaggccugcucaggggacagaagacaaaacucaaggggcugcugucagucaucagcugguucaguuggucaagugcuuaccacucaaccauggaaaccugaguauggaguugccggcacccaugcaaaugcaggcguggugauaagcaccuguaaucccagugaugggcaagacuggugaaaggaucccuggagcuuacuggccacccagccuagccaaaagaaaaaaaagagagucuccagguucagcagagaccucaucucaagaaauaaagaacaaccaaguuagagcccuacaaauggccuuggcuucuaccaguauacccaccaacaccaauacauacauauaucacacaccacauauacguauacauuaguguguguguauguaaaaguuauuauuggaccauuucugauuguaagcaaugaauagcugagggcaagcagaaaccagagauaagagagaacgccuuaaagagcuauguggcugaaacauuaaagguguccaagagagcuggcgucccuccucucuggcucacaucuacuaaacaccaaggguuauggaaacauuaccugagucucucagcaaugcucaguaccaauccaaacuggcuaacuugaaguuccccaaaugagcuauguaccaaauacuuuaagcauugugcuuugccaaaaguacacugccaaaccuuagagcugaauuuaugaaaagaagagaggaaaaaguucagcggucagggaaaaaucuggccacggcucaaauggcacaugguauauaaggcagaggugugggccuggggacaaggcuggaguccugccagguacccuucaccuaccuuguagcacucauaucucucgaaggaagugccccccggagagucugggaagauauacggcugaggaugcugauucugccagaauucuucuucugccucccucagcagcuggguagcccucaucauauccuucucauucuuauguucuucaaaccgggcucucaucaagcaagcaaaguaccgguacuugucccuuaaaucgaaaugaguguggacaucagaaccguuaucuacuugagugggcagcacuuaucaaugcaugccagaugagcaccuuucuggcaccucaucaacuucaggccgccgugagcucuuccuccguggcccucggaacagcaacagaugcugaacuaguacagccgggccacuuccccaucaucaguaacagcacggugcauuaagugcaauccucucuccucuaaggauuucgacaggaaaggaaaaggugacaaccuuugcagguucauucgauaggcacucauuggcgacuaccacagguccucucaucuucugcuagaucacccgugccaucuccaggauuuggcacagcaucuagcaaaagaugggaagacccgugucgcugucagacaagacccaagaaaacaaaacaaaauacccauccagaccaccaagucaugagagggagccucucuagacuacugcuaaacgagcuguauagucugggagaguuacuuaauggaaaggcugacauacacauuucaagagcauauauacaaaaguacacuucacaaagugguuggcagguuucaaguucucagugauacaacagucauuacaccaaaaaaaaaaaaaaaaaauuuacaaaaagcaguguccaauaagguccaauguaugaggauguguguuagaggcagaaggggaacuagggaacccuugaggucaccuagacagcugaauugcuaguaaugucauuagcuggaaauuugagaauauaaucagcaugaggaauuaaaaaaaaaaaaagcuugguuuuaaagaauuuggauaaacucaguuuaguagauagcagaugaccucauagacaacuagaaauacagcuaauucaagcaccaacacugaggacauccuaaggagacacagugccuaagacagagccuuaggcggaaccagugaauguccuagaagacaaaugagggcuagggggauguggcucaguagguaaaguaccaugcaagcauuaggaccgaguuuggaguccuaaaacccacguaaagcuagacaugggagcacacaucaguggucccagcaccccuccucaggacgacaggaugugacagaugcccacaaguuuacaggccagcuggccuagcaugccagcagugcugucccaacaaggaggaaggcaagguugucacacaggugauaucaacacggguuuuuuuguuuguuuuguuuuaagggaacugaugcggacaaggacuaagaaaagaugucagcuuucaaaucuguuagugcugucauaguagcuaguuugauuauucccuccaugaauaugagcccuaauaucuccaacuguacuauaacacugucuggauucuugaagucuuaacuucuucaguaacacuguuccuucugaguuuccccgucacguuccccguuaauccaugggauugcagcucaaaaucaaggguuaacugucauuuauuugccauccagaauggacgcugaauugcaaauucuguuaaauaaauaagaaaaacuuaggaaagaagcuagcaacuguucagcauuguacacugcaccagccugcauaacaaagagauguaaccacaaacuuguauccuaggauuccaggguuacccucugcaggucuuacaggguuacuugauuuuccaucuuuuucuuggaaguccuccuugugggauuagguuuuaggguaagaguguagcgguaugggacuuacacaucuucgguugucacugccccuugcauuucuuuuaggucaugaaagucuacacguuuuaacacuauauuguuguuuguuuguuuguaagaaggguauuuuuuuuuuuuuggccuagccucaaacucauaauguaauggagaauaucugucucccccaacauaugccaccguaugagacuuaacgagaagacuaguaacaaugguuaaagaaauaaaaugacguaggagguggaauagaaugagccugcuuaucuguaaaaucaggcuaaaauaaucacuaauaucugaguuacucugcaaacuaaagauaauggacaaauuacuguuaagguuagggacgacagagucauaaaaacguuagcuuuagauccaugacaaugacaguccuagguacuuuuuauuucuucaugcaacuuucuacgcuggguccugguugcgccccacacaaucaucuccgccagaucaagcagagaggacugcaucgggacccggguucaagggcgggcucccuucacugugucccccaaguccuugaucagccuggcccacggggccccucggcuuccguccccgagccccggguccccucuccccaccuguggauacaccaugacucgagguggcgcagcgcgcgcuuauacagccgcagcaccuucugcuggugggucagguaggccgggggagcgcagaacgccauagcguccggcucaccuucagcggccgccgcgggggcugccgggaacccggaagcgggcgguugugaggcggaaccggaaggacgagcgugcucugagccacuuccgcuuuucccugggaggagccugccgcgccgucaugagucucuucaaguucguggguaagggcagguuugucuuggucgugagccucgcugacagucccggguccccuuuucgcggcauggccuuuccagggcacggaagaugcccggaggccucgcgugcuggcaaugacugaucugguucuugcuggaggaugguuucccuagugcauguucauuuaugagcauucccgggcaaugaaucauugugacuugugcuuuuuuuguguguguuuaauucaacuggaaagagaggaauagguguggggugugcuucagccguagacugaucgccuagcaugggcuaguccccgaguccucccaucucucaaaaagcaccgccccccaagccaaucacuuuucuucugucuuucgugaacucuucuacauggccggccugacagucccuccaagguaccgguucacucagucaucccuucauaccacagacaacucugggaggcuugacauugagucccgggaauguggccaaguccugcucacaggccaucuagacauaaacgggaguccucagacgggaggggguggcaaauugugucgccucgcaaguuccacgauccauccgacagcuggagagugcggcaaggauucaaaaugggggacauuguaagagucaggguuggaaggauaacuuggaacccuaaagucucgauuacuuaaauuucacuucuauugggaguggcguuccaaugaaggcuuuucagcaaaucuuugagugccaguuguacggaaagagucuugccuucugggauaccgauguggguagucucaguaugaaccucgucguuguggacuuucccugcuauuuaagggugggaagugacagggaggagguuacccugauagucguuuuguagauuuuguggcagauaaggggacgaauguaaguauuucagguuuugcaaacagggaaaagaauagaaaaagagaaaugggaugguugugcauagcauuuagcacugacuguucaugccuguugugggaagugaagacccaaagauggcagguuaagaaauaccuaggccaucuggaucuaauagauuagguccauucgugaguuaaaggacauccaaauagagacauccuccgagcacucaaaaguggaaucaggagagugguuaagguuauacaguaaaaucugagagacaccuuaagcaauauauuuucccaagacacuguauuuaaauauggaguugugagaaaucuagucgugaguuaguuuccacaccagagacgugaggccuauggccagucaaagcaaacguggggagaauguuagcagguuuuucaaaaacucugugagaaagccugaagugaagguuagguguucuggguucuugaugugaugugcuaggaagugguauguccuggagagggcacaagagcccucacuccucaccucauacugucugucccuguuccugguuguuaagagucuacgcugggcguuuccagguucgugguugcuuauccaaagaacuaaagagaagggcucacacagacuuacagaauaagugaggaaaccuuauuuuguggagcaauaauauauauuaaaaagcggaaugaaggguuuuuguuguuguuuuugagacgggguugcucuguaguucuggcuguccugaacucacucuguagaccaggcuggccucgaacacagaaauccaccugccucugccucccaagugcugggauuaaaggcgugcgccaccauugcccaguuggaaugaagguuuguuacuugcaauguuauaauacaauuuaaaauauauuuaauguuguggaucugagaguguggcagagaaugcaguuuuggguuuuuuuuuuuccuuuuugucuuauaccuuguuauuugaaagcagacuuaguauauaaacaacucaguguguccaugccucaauaaaguuuuauggacauugaauauuaaacuuaaaaguugauuuauuuuagccauaugggaguggguaugugugcagauagauaccuggaaaggccagaagagggagccaggugcccagaagcuccuagagucacuggcaauugggagccaucugauauggauacugguaugauauggauacugauauggauacuggaaccaaagcugggcccucuggaaaagcaacaaauacccuuaacugcagaaccaucuucccagccccugaauuguucuuuuuaauaauuuucacagguagaggaauauucugcugauuuaaaagaaaacaauuuaaaauguucaaccauuacuaguauagggacuaacaauaggcaaugaagccaaguaaggcagugcacaccuguaacuucagcacugcaggccagaggcagagucuuguucugcaugaugaggcccugugucacagugacaccuuuagcaagacgacagacaguggcggcaggaaggaguugacuucucugcuguggcauccuuuuguggcucguuuaaguauuuuuggcacugacuugcugaagaaacugggcugcuugucugaccuuucggauuuguguuuuugcugaacaguggugcgaguuccuuguucucuaguuauugaaacuuuauaaccuugaaauuauaucucaaggcuaauaacguccaaugcuauuuuaaaucccuuguuuacugucucuccauguuccuaaaucacaggugacagugccuugacaagauucacuaagcccaaacaguuugcagauacugcuuucuguuagagggcaacagaacaaacgcuuucccacuuuguuuugaaaaaucaacucauugauacugguaauuuuuuuuuauuaaagacagcuauuuuuaaacauuaaugaaguggagacauuacuguccuaaauagcaggguugccagugucugacuccucccucaggucauggugacugccugccaggguuacuguugccagaggaaauucuacucauccaccaagaagacaaugaggcucaacagggaccaagagccuucacuaauuacuggcaguggcaagaauucugacuccaaagcucacuuuguuccaucucugaguaauuguagucauuucaugguauuguacuuuaugggccuuguucauggauagaacuauuuccagucaauuuauuugaacuuuucuuuggcuccucuguaucggagugcugaguuauugugguauuuccacagauguuucuggugggugggcugaugaggaaguggcuuuugucugagagcauuuucugugggagacuuggagaaggucuuagaggaaaccgaugugauucacguggcguggaaggacagaagucuuuugccauucaacuugguaagguguaccgugaagaggcuguccuuaguuuaucaagggaauggugguucucccucugauuugucacuuugucugccacucaauuagacaucacuuuaaacacgggugcuuccuucuacaaacuacauuuaccuucauuguuugggauuaaaggugugcauuaagagagugacugaauucuagccagagggauuggugugugauaaggcuaagccaccacagcacaacuaaaaacagguuuuuccaguaaacaacacaaucucagguccacagugugaucaaauauccugcaacagccuagaauucucucuucacuaucucuuggguuauccaaacuccugacuaggucucacggucugucauacuguuggggcagcacauccagacacacagcauuugacaaagucagcccccaggaguaguuggugaauaaggaaguaguucaucuacaucuccacucucaucaccgucucggucuuucuccacugcacaugagcuuuuccuaguuuccaaaugagacucaacuucuguugcucccuucacaucccagcuuccaguacuccugagugaaguaucuucaauguaagucuugccuuugauuacaaaucaucaggcauuauauugaauccaguauuuuuaacauaagugugugucauaauugaucuguccuuucuagcuaaacccuuuccugugcuucuccuuagcaacuacaaaaccuccaauuuccugaugaauuauucuauuucauacccuggaggcuugcugacuuaguuacuuuucuguugcugggaacaggcgccaugaccaaggcaacuuacaaaagaaaacaguuucagggcucacaguuccaaagaguaaacccaugaccaucauggugggaaucguggcagcaggcugcuagauauggaggaguugggggcaucaccccauggcagacaaguucucccacacuccugcccuugggauuggcucauacacacacccccagcaccagugcuggcuccacugcgcugccucuuccaaguaaagggugguggcauggucuuuugaaaccucaaaacccacuccaugacauaccucuccuacaaagccacaccuccuaaucccccaaaacaauuccaccaccugacccuauaggggccauucucauucagaucaccacauugggugacuaauccugcaacauucaguucugaauuauuuauuccugggacccccuucugagucagcuaccaaacucugguagaacuuucugugucucauaauaacaguaguuuuauguuuucaauauuuugaggaauuuauugacaacuucauauguguauaugauacauuuuaauuugguuccccaaugagcuuuccuaucccccucauugucuccacaauugccuaugcaugggucugccccauucccuucugaguguuuaaagacucacuucugccaugagucuuuaggagcagaaaucacaucuuaguccucccgugucccacaggucuaucauggagcugccaagaaucagccagccaauuaauacugcuagauuauagacuaugugaaugaaaagcuuguuuagagauauuuugaguaaauuuuauuuuaaugauuaccuguuucgcuuuugguuuccacagauauuggcaucaaccugacagauccuauguucagaggaauuuauaggggggugcagaagcaucaaggugaaugucucuuuuacuaaggcgacgucugugaagacaaccucugcuacaagaucuuggaaagcacaauccacucuuaaagugaaaucuuaaaggacucugggcagcugagggugaaucuaaaacccagcauucagaagguagaggaaggagaauagcaaguuagaggccagccugggcuacauagugagaacuuauuuuuaaaaacaaacaaagcaaaacccucaucaucauaugccagacagaacaaucaacucagucagucaagcccugucggcaaaccaucguuuugaacaacaggccuggaacccagcgaucacuuccuaugaccaucagcuuaucaaguucuuaaacuugauggcucagugguuaagaggaccuacugcucuuacaaagguccugaguuuaguucccugaaccugcugacagugagcagcucacagcugccuauaaccccaacuccaaagccucugaugcccuuuucuggcuucugacagcaugugcguucauguucauauagcaacgugucacacacacacacacgagauagagagagagagugaauuaaaaaguaaaaauaaaucuuuuagaaaggaagaaaauguuuucagccaaggacaaaguguggugugcuguugucuuccugucuucccuacucuuuccaucacuaucuacuuagaggcccaguguauaggugggacuggacauuguacuucaccagaagcaagugguuuguauuaucauauaaguucacuuuccucuccaguccuaagaaucagcccaggaacugaugugagcauagacaagugcugcccacugggcuguugccuuagcugagagaggugacuaagcaggaaaugguggugacgcugaauuuuaaaggcaggaugucugcaauagaugugucugugcacacugccugggaacagugccuauguucuaugacaugcaaauagggagggugaaagaguuccacaccgcagagagcugagucagcaccugaccaugccaggcuucucuagcuggcuuuccugaacacaggagacaagaaaaacacauguuuucacagggcucacuguaaaacuuacucuuagggauuuuaggcauuugaaugcuaguuuuauguguuacuuauacaauaaaguuaaccguugaguaaguugccuucugcuuuccuugccuuuuuagggcuuagauuucaugcugugcuguggcauguauguaugcauguguguuuauauauauguuaggacauaaguuaugcaguagucaguuaucaccacuacugcaguuucuaaucuggcauacuugcuaugcucaguauaaguuaacuaaggugaguuuugucuuuugaauucguuauuuuuauauauuauuuuuauuauauauauguaaauagaauuugaauuuauuuccauuuacucugaaacugaaguguaacauucauaauggaguuuuuauauuuuauuuuguugcccauuauguuucuggcccuaacaguggguugggagauggcucaguguaaaggacuugcuguucaaagcaugaaguucugaguguggauccccagcacacauuaaagcuaagagcagcagcaugagucuaaccccaguggauggcaaggaaacuggaggcucccgggggcuggcugccagccagucaucugacgcagugggcuccagguucagugagagcaucaguuauauaaagccacagugauagaagaaccccucccccccccccacacacacgggcacacagacauacacggacgggcacacauggucacauacacacacgcacggacggauggacagauauggacacacacagauaggcacuuacaauuucauauacaaauacaaguuuggauauaaagcacaucaauuguaaucauugaguucaucuuuaauuuggaccuccugacuucugucauuuucuccuuuuuuguucaacaaaguaaaaguacaauuaaauuaauuauuaacuauucagcuucuugcuuuauauuuuuuuaagguuuuacaaaucuaguuucacuauuuuacaaguaacuagcacugauuaggcuguguuuuaguacaugaucauuuuugugcauuuuuacuuuaaggagagguaaaaauuauacaugcauaauuauagauaauaucucuauauuuacuagcuuuucuuaauaugugacuuuucuuacacagaugacuuacaagauguaauagagagagcuauccagauugguguuaaaaagguaacaucugaacuuuguuauuguugaauuucuuuguuuuuaaaauaaguguuaguuaaaaugccacacaguaacagcgacagccaccggcacacgcucacuucuguccuguguguaauagaaaugcauguucugucacagauagguagguugcacaguccucagggaugucaucagaaaugugacaaagugugacagaaaaaauaaaacuacaacacgugcuacucuuaaagacagccuuccauaaauguuauaaucucacuuggcauguguuggaaauaguuaucaaacacaugcaugcauuaccagaguuagcuguggguauaccaucagauaacuaagaaaacuccuuaguuuuaacaguaauaaaaggcuuacaaguuuuuagaguucuaauaagaaauugaacauuaacuagcuuaagccaaauucuucaaguaaguauuuuuuaaaauugguuguaaaaaugguagguaagcccacacaucugagaaauaaaguuauauucuauagcauauuaucaauucacuuuguagcuauugcuucuaaguuaaacacacucaguucuaaaaugugaugcuaguuaaauaaacacugcggucucuaacccuauauauugauuauucaaaaguagugagaaaggaucaaaguugcaugaacuuuuagucauauguucacucccucaugaugagucacuugaucucauguuucuucugcagacacugaaggaucaggcuccgaccuuccccaugucagcaggaguacuuuccucaguuauaauugagugcacacacacacacacacacauucucacacguaaaggauagacagaauuaauaggacagaggcagaguucacuuggacuuacugagcucauuaccagcaguuaugguguauaauuagaaguaugauuuuggcaucauaaacuuggcuucuagccccagcuuccuccuucauagcuuugaaaccugggguauuccagaucuuggcuucucauccauaaacuggauauuuuagaagugugugggaacaucaugguucccauaaagaaaaagcugcuauggguaagccuucgugauguaugugauggcauccccacugccaggucaggagacacaugccgggagggaagcccaugaaggccuagccuugccugccuuucucagguuaucuggacagggagagagaauguaaguggauuugcuuagaaacuguucuacagcauugaaguucuuaugcggguagcugguguaguuuuugagacuuagguaagguuaguaaagaauaguuuuccugauaucuuaaauuuuucuuaaaucuuauauuuuaugggcauuugaaauuuuaguugugacuguauauucccuguguagacacucaguggcuggucacucucaguagcuggucauacuauguugcuguaugacaguaucuguuccucacacacaauuccaccuuuguuuugugugcauucucuuugguguguaccuacaaugaacuaucuuuacuuuagcuuagaaauacuuagaaguauguuuuuaaaaaauaauaaucaguccuuaaaucaccuuuagaaaguaccuuacacagcacuagguucuuuaauuaugucugacagauuaguaaagauggcauucuaaccacugaaugacucuaauggcugucugaaguaugcugacuucucaagagccaugaauuccuucaucacgacacuaauguaucagcuuuuguucuuagaacccucugcuuucuuuaggauuauggccgacccucuaaaaagcuuuuuuguggguuuuaugcaauuauauauguuauucuaggaauuaaagcagaaauauuguaaauaucaacucauuucagaaaugauaaacuguaacauaaacaguauauuuuaaugagaaaauaccuauuuuccaaacaaaccuuaguggcaagggauuauguuacauucugccacguuucugaaugacugagaagaccgcugcauucccaugccuguuucccgggucagucuguugugacacuguacaucggcuagugucuggcugaccgcccuguacacuugagcuuggaugaaaguaaaaagaugaaaagccuuuugguacccuuccagagguaguuucaccuccuaaucaacacgccaguuacugauuuucauggucauuuauuucagugaacagaauuuugacuaggcagguccuuagcuauuucuguucuauaacauauaaauugcauccucaagagaccuaggccuugucgcuaauagagacaaacauguaaaugcguguuauuauguaacacaggaauccuaugggagggucuguguggacagaaaccagguagcacuguguggauugauguuccucaugaacauaaaggagcgguaguggggccagcacccugcagugaacuggaggaagggguuuggucccuggaagucagcuucuuuuccuuuuugccauuucaguuuaugaucacagguggaagucuccaagacaguaaagaugcacugcaguuggcacaaacaaaugguacccucuuauuccuuuuaccaaaacaaaugugaauuacguaauuaugaagaagucuuucucagaacugcuuaagguacaaauacagugagccugacauagaaaugacaggaauacagacugguuucaguggaacgugcuuaagaugacaaaguuuauaguagucuuugguauaucagauguuugauaaaaucuuauaauauuuagcaugauuguuauuucagaaaauaauaguaaaguuacccacauacauaauuuaucuuucagucauucuaauguaguuucuaugugcauauuuuaauguuugauaggaauuauuuuuauuuaaaauauuuuaacuuaaauugagaaggaucauuguuaguugauuuugcugacaggacccugauauagcugucucuugugaggcuaugccaguaccuggcaaauacagaaguggaugcucacagucagcuauuggauggaacacagggcccccaauggaggagcuagagaaaguacccaaggagcugaagaaggucuauaacccuauaggaggaacaacaauaugaacuaaccaguacccccagagcucgugucucuagcugcauauguagcagaagauggacuagucggccaucauugggaggagaggcccuuggucuugcaaagauuauaugccccaauacaggggaaugccagggccaggaagcaggaguaaguggguuggggaguaggguugggggaggguauaagggacuuucgggauagcauuugaauuguaaaugaagaaaauaucuaauaaaaaauucuuuaaauaaaaaaauaauuaguuaauauuauaauauuccacuguuagggcuagagagcuggcucagcaguaaagagcacuugcugcucuugcagaggacuccaguucaguucccagugcccagcagcucaaggaauauggcaucuucuucuggucuccaugggcacaguccucaacacacacuaacaaaauuaaaauaugcugcucucugggugcuacuucacgcucagacauuucaugcuuauuuaaacuccuaaaagcuuauuugacauucagauaacuuuuuuguaugcauacuuuccuagacaccuagagauuaggcauuccacguagucuuuucaaaauacagcuguguuucuuucuuuuuuucugaaaucuuaccaaaagcuguuuuuauagcaaucuuuauaaaaugcaugcuucuguucaggcuacauugccuccuaauguucaagucauggcaaugaucaucuucccaggacuucuuaaaguacaaaggaagauuuucuuccauacuuuauaaucucuaacagcugugguuugaaaacccgucccccaucuuuauuauuguucuuccuccucuucuuuuuaaaagagcugucuacugcuuccuguuaccuguguaaaagccugaggaaugaggaaggcuuucuaccuuccauggguucaguagcagguaccuguugaacuucuaaaacaaaaugaaaccaaaaaccucuuauuuuuuuuagagaaccaacccaggaugcugugcauggugcauagaagagucaagcacucacacuggcccauucucccagcccuccuggugugugugccucacuauuaaagcuaaagucuggcuuccaauagugagauuugguuuguuuauuagcaaaagagauuccccuuucaugcucuuuaagccauuccuacuauuagccuuuuaaaauuuuuaaaauaauucuucugguacacuuacacacacacaaacacacacacacacacacacacacacacacacacacacacucgcgcgcgcgcgcgcccacagaagccauagaugucagaucccuguagagacucaguuacaggcagugugagcugucugauacaggaaccaaacuccaaacuccaauccucugcaagaacaaugggcacuuuuccagucucuacugugaaccuuuuuaauggaggcacauugugguuguuauauuaaauacaugaauuguauuaccauguaaacaguaaauauaaaagauaaaauuagguuacuuuaaaaaaaucauuucacaacugggugugauggcgcagaggcagaggccagccugugaauucaaggccagccugaucuacaaagacagucuagaacagccagggcucuguuacacauagaaacccugucuuaaaaacaaaaaacaaaaccaaaaaaccaaaaacuucuauucuaagaugucugauaaauggcuagcuuuggaaagaguugaguugauuauuuuauuaauacaggaacucaguuuuuauaugcguauuccacuuuuaacuuauuuagaaauguuugaaugauauacauaauucugcaaguuugaauuguuuguaauuccaaaucaguugaaauuacuuuacuuacucauuuuuauauguuaaauauuaacauaaaugaaaaauauuccgaaaauaacccuaaaaugugguuuauuuuguuuuguuuuugcuagacauguuuuucaguacaguggggugucaccccacgagaugugaugaguuugagaaggguagcccugaucaguacuuagcaggauugcugagccuugcugagaacaacaaaggaaaaguuguugcaauaggagaauguggacuugguaagugccaaccucaucacuuaacauuaucuugaaaaaacuacuuguuauguucaaauccugaguaauuuuuauucuuuaucuuuuaaagauuuugaccgacuucaguuuugucccaaagauacucaacucaaguaaggaaauuuguugacuuugauuuuuauuuuuucaaaguaauauugauugaacauguaggguuagauaccaagguguuuuuguuuucccuggaagauaucaaaaguuaagugaaagaaaguucacacauguuugcauguaacgauaauccccaacugauuagccgcuggauaugauuugaauggugaaacagcauuuuauguuauauagacuugggcggggggguggcaacagguguaucuaugcacaaacuacccuugguccacuguaguuucuuaugggaacuacauaagaauccagaucaaauuaucucuuaauaaaucuugucauuuuggggguggggguugacaucugugccaccugagggacuucccauaucauacuuuuuagagauguuaugaacucugccucuugaacaccagguaucaguucaccuaaccuggaaaaaucagauuugcacugggacagaaacccauugucuuuaccggcuucucaggccaucuuugcacugccaugucugccuggaccagagugagcccucugagccacagacgggcaagccucgguacaugacaggugcuguuacagagcuccacagcaugucuucccauguggcuuuucuucuagaauaaguuaaaagugauucuccaauacagccugaauauugcagacucagcuuuuggauccaugaaaguacugauagugugaguucuaucuacugcuuugaagauaacuuccaucgucagucaguguuagaacucaguauguauagcagaguauagauuaugcugggucacacaucagauguccaagggccaguuucuaauagaggugaccucaguuuauccucuaagugguugcugagugccucuucagugguaagagauaggcuucauucuuuggccuuuauugacaagacaguccaaaguguaguaggcuaauaagugcuaucaggaagguaaaugcacuugaggacuuguguuccauuccuaccaccaccauaaaaaguuuuaaaaagcgccauggauaggggauggaaggacagccgucuaaaggcaggcuaagaagccuuucuaagaugacaguauaauguaggucuccucaaaagaggauucucaggaacaaacuacacugaggacacugagaagauauaucaguuggcaguuuuuacuuagauuuuaaaaugucuaaaguaugaauaaucucauuuggauuacugccacggagacagauacccagggaauuccugucccaccuggcuuccccuggcauaggcuaaccucuucuguguguacugaagauagguggcagauuagugucuuccagugugccaaaggcacauaguggcuuaugcauuggugucuaguaaagguuuaauaaggaagaagucucucucuuuguguuuccuauauggauaaaagggcuguaauuuaauauuugcuguuggacuuguuagaagaauguagaucuuggucaguucuuugugugcauguguguacacacucaugcaugugugugcauguggaggccagaugucaguccuggugucauuccccaggagcucucccucacugggaccuggggcucucuuuuacgugcuuguuggaggucaaacucaggaacuccugagugcacagcaagcacacugccgaccaagccaccucccaguccucucaucugugcuuucuguuuuccaauuuuguuguuguuguuuuugguuuuuugcgacaccaucucccuauagcucagguuggccuggaacucacuacauacacuugcuaaaauccucugccucuguguccugagugcugggauuaaaggcaugugccaccacuccuggcuucgaucuacauuuuuguagcauuuuggaaccauuaaccuacuauaugauuuguugguuuuauaaaacacauuuuuucccuuuucaaguguccaguagguaucgugugugagaaaugguaaguggguacaccuucaaugggguucaagucuucuauccguggugagcaggccugaccugcaaugugauuuaguuuugcuauucccugccugucuacauauacagcucagcguugucauuguuagcauaaggaugccacugcccaccgcucuucaguauaugauggguaaagcccaugguggcaugccuggacagacuugagugcucaaaaguuauauagcuucuaaaauacuagcaguggcuuuugagaaaugcuuuaaaaauucuaucacugugucugugcaucuguauaagggaguuagaagaggguaucagauccacuguagccacaguaacagaucguugugaaccaccaugugggugcugggaacugaauaaauacugcuccuaugcaagagcuccuagugcucuuaaccacugagccaauucuccauuccugagaagugcuuguuaaagaccaagaauggaaacaaggagagggccugagucgguuauggaaagauugucuugaaguccuagcagucugucuccugcugcccugguacacuucuuccuuucacaaggcggagcucuguucucccauauaggaggaaauauugcucugggcauuuuucuuggggcuuuaaaauacugauauuauguaggucuuuuuuaaaaaucagcuaucagacaagauuucagaaugauuccagggauauuuaagguucucuggaaaaggaucgaggccacccaggcugucagccagcugggagaggcucacagcuacugugucacucacugcguuuuggcacgucucaguccucgccaguaacagcugcucugacacugacauuucaagcuguccuuaguguugacccaagcugucagaaagcagugauucaacuggaggaaaauagagcuuugauaaaauguacagauguaagaaauuuugacaguugucaguucugcucuguaacuuguuauuugguggcugguuuuguuuguuuuccuuuuuaaaauaccaguuauuugauguuauauaccuguuauccucaguuuguacuguuggaguguuucgauuaguuuuaccacauggaaauuuucuuucuuaagauuccucuuuuauuuuugugagggggcaugcaugccaugcugugcgagugguggucccagggccacuucaugcacauaguucccaaguccuacuuugaugugggcucugggaggugaacucaggugccagccuuucuuuaccaugcagacaguguccuuccuguugagccaccuuaccacccacccaccccagcuucuuaaaugaaccauugcucuuaaccacugagcugucucuccauauccuucccucuguccccccacccccaccccacgaccucuuaaugauaucuaucuagcuuagggaucuuucuuuucuugaauuucauaaaauucucagggcacaucauauguauuuauguuauuuauuuuauuuuugguuuuucaagacgggguuucuuuguguagcccuggcuguccuggcccucacucuauagaccaggcuggccuugaacucaagccauccgccugccucugccuccagaguauugggauuaaaggugugcgccaccacugccuggcaugcuucugauaauuuuagagaauuauaucuuuggcuauucugugacagaaagcuacuuucuuauagaacuguuugguucuauaaaauugugacuuggucauguggcugggccacagaguugugcauggugaccacauggaggucauuaucugcagcguguggcugaagcuaccuguaugaucauauuuguugguauucugucuggacucuacccccacagauaccuggcaacagccagguaggccuggcccacuauaaaaggggcugcuugccccuccucucucucucucucucucuuguucucuugccucuuucccuuuguuccucauucccuucccccucucuccgggugaccauggcccaccucuacuucucuacuccccccuucucucugccucugcugcccuccuaacuccccuccccaugcccugaauaaacucuauucuauaccaucuggucccuaaggggaaagggaugccuuggcacgggcccuccgugacaccccccuucccccacacacuggauguuggcauauguacugcuuuaguggcuauggaauagguggcuaguacuuguguuuugggguuuuuuuguuuuguuuuguuuuguuuuuuguuuugaaacagguuucauaugggccugguuguccucaaacuaauuggguaguugaagaucaccuuaaacuugugaugugugucuucaccuugcgggugcugaaaucacaguccugagcuaccacgcuugcuuucaugcagugcuggagauucagcccagggcuuugugcauguuggcaaggacucugcccaucuggcaaugucccucgccacuacuaguaauuccuaaucuuuucuuucaagguuuuauguuuucuaacuugcaaacuguccucacuuuaacuaaaacaaaauuacuucagcuuauucuagcccagcagaaucugaaaaagugauuuaaaaacccaaacauuaguuaauaaagucauagaacaacaaagggcauugugaaaguuuguaauccugguaaaugaagcaucccuuucuaaaaauuaaguggcaggaaagaagcuuguguuguuaauaucugaauucacugcuuucauauugccauuuccagauaguaaaauuccuuuacucaaaaauuauuugauauaugucucaugcuaaaauaaaaauuuugguguggcaauuuuuuuugcuuugugcagauauuuugaaaaacaauuugaacugucagaacaaacacaauuaccaauguuucuucauugucgcaauucacauacugaguuuuuaggugaguuaaaaaugaaguaucauuacauuuuaaaaacuaugagucaauuaggccacuugccugaauuuucuuuuuaauucacagauauuaugagaagaaauagagaccgguauguggguggagugguaaguguacgauaauuguuuaaauaugggcuauacaaaaaugucuuugcuauuaggucagcuucagguaauucagauagcaaaaguaaaguuaucaaguuucucaguugaagggcguguaaauugcucuaagauuuaugggcaugaugguguacaaacaaguaauacuuuuaguuacauuuauuuugcuuaaaguacaagaaugaguacugaauucuacuuaggagaaacaaaugugaaucgucuuuucccacugugcaguaagccugagagcuggccuuugcuguucucuaaucaaaucgauuuucacgaugucuuagacuauuccauuguuucuuucagguuuucuuuucuuuucuuucuuucuuucuuucuuucuuucuuucuuucuuuccuuucuuucucccuuucuuucuuucuuucuuucuuucucuuucucucucucuuuucuuuccuuuuuuuuguuuuauuuguuuuuuugagacagaguuucucucucugugcagcccguuuguuuguuuguuuguuuguuuugagucaggguuucucuguauagcccuggcuguccugggaacucacucuguagaccaggcuggcuucaaacucagaaauccgccuaccucugccucccaauugcugggauuaaaggugugugccaccacugccagaccaaguuuccuuuccuaauuugcuagcugguagucguucucuucccucuaaugauggcucaucuuccgugauauauuuuccucuuaaauguuucuugugugguccuuuuaguccuuccuccugagacauuuccaauauauauucucuacucucacugcacugugacagccaugguagugacuucuagucaguuggaucaugaacuugaguagauaaucuguguuuuaaaaaugcucacguacacaaaauuucauauacaauuucaggagagguucagugaccauccuuugggaguaaagauuguuauuuaggucacaguuccauguaucaguggaagaacguuaaucuaacccuaaauuuuugcuguaauacauuucuuugcuuggauacuuuaugacauauauuccuuuuuggaauguuguggaauacauguguguuuuuaauauguuuaguguguguguguacauguacacauaugugccaugguauucguguggaggucagaauaacugcagaguuggucacgggacugaccaggcuuagcaucuucacccagucaaucaucucgcugacuguugccgucuguuuuuuacgcuuagcucugcuuggugcuacaucccacuagugauagggcugugcucuguacugcugucauguucaugcuacugugcacaucuccucuggaguuuacugacuguaauuuucccuuuagcagcuauacuuaggaauugagaaaggcuuuaauuaaugaccugggcauuacugacagcauggguuuuagcuaacguccugggcauuacugacggcauggguugucauucuggacuccacugcucacuccucuuuauuucuaaguaagucuuuacuuggaugagucuaucauuucaaaaaguuaauaccaggaacagcaaaagcaaccaaaauauuuggcuuuaauaaguugcuaaauaaaguacuauauauaguucucugaauuaguuuauaagagaucacacuuuaaauuaccuucauauuagugaagggauuuuucauuguuguuguucacuggaaauguuaagggcuuagcaccuuuaccuagugggucacccugccaguugcugacccauguguauuuuccaaggaauucuucugcuugguguuacaaaucuugcuagcagcuguauaacauaguuauccauggacagugaugugaauucauugcuaaauaagcccuacuguuaguuacugguuuugauuacacacauuaccuagagcaggagaaaauacggucucaguccuuucugccuguuuaacugaugugaauggugugacaauugcuuuuuuuaaaauuucuuuuacuuuuauuguuucuuguauauaaguucuccccaccaucucugucucccugucucugcccuccccaccccccccuuucacacacuaaggccagaagcaggcguccaauugccuggaggugcucagugugggugcugggaacugaacuccucugcaaaagcagcaagcacucuuaacugcugagucaucccucaaggccgcagcuggcaguuuaaaagcaauguucucaccacucuagcugauuaaucauuucuaaaagaaaagguguccucuaaaagagaagugcagugggauuuucagaacucugcagggaaggugauguagagauacaccuagcugcagagcagauaacuucuugcuuugugucaccagaaauaaugacagauugugauuuucaagucuggcuugaaagaaaaacauuguaggugcuacuacauuaaagaccugugaaacaacacacacauacacacauguacauauacauguauguauguauauauauauauauauauauauauauguauauauguguguguguguguauauauauauauauauauaaaucugguuuugcuuagaaagcagaccagugcuauuauaauaaaacuguauauauauaucccagcagaccgaugcuaguauaauaaaauuguauguauauaucccagcagaccgaugcuauuauaauaaaauuguauauauauaucccagcagaccgaugcuaguauaauaaaacuguauguauauaucccagcagaccgaugcuaguauaauaaaacuguauguauauaucugucuuagucaggguuucuauuccugcacaaacaucaugaccaagaaacaaguuggggaggaaaggguuuauucggcuuacacuuccaugcugcuguucaucaccaaaggaagucaggacuggaacucaaacaggucagggagcaggagcugaugcagaggccauggaggaauguucuuuacuggcuugccuccccuggcuugcucagccugcucucuuauagaacccaagauuaccagcccagagauggucccacccacaaggggccuuucccccuugaucacuaauugagaaaaugccuuacaguuggaucucauggaggcauuuccucaacugaagcuccuuucucugugguaacuccagcugugucaaguugacacaaaacuagccaguacaauugaccccuugucaacuugacacacaaacacaucacuaguaagccucaacccuuacauucuuauucauccccaaggucuaaauaacuuuaaacaucccacagucuuuacauauucuuaaaauuucaaucucuuuaaaauauccauaucauuuaaaauccaaagucuuuuuacaauuaaaagucucuuaacugugggcucuacuaaaauaguuucuuccuucaagagggaaaauaucagggcacagucacaaucaaaagcaaaagucaaucuccaaccguccaaugucugggauccaacuuacgaucuucugggcuccuccaagggcuugggucacuucuccagccaugcccuuuguagcacacgcaucauccucuaggcuccagaugccuguaauccacugcugcugcugcucuugguggucaucucaugguacuggcaucuccaaagcacugcaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacacauuaccaaguccagccacagcacaagguacaacuuuggcuauaucuggaacacagccacugugcucucagaaaacacuucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacagcaauggcccugaaaagagucuuuaauuuucccucugaaauuucacaagccaggccuccaucuucugcacuguucucaacauuaucuuccaagcuccuacaaaacaucugacagagcucuuaacaacgaauggaucuucaagcccaaaguuccaaaguccuuccacagaccuccccaaaacauggucagguuguagcaggaauaccccacucugcugguaccaauuugucuuagucaggguuucuauuccugcacaaacaucaugaccaagaaacaaguuggggaggaaaggguuuauucggcuuacacuuccaugcugcuguucaucaccaaaggaagucaggacuggaacucaaacaggucagggagcaggagcugaugcagaggccauggaggaauguucuuuacuggcuugccuccccuggcuugcucagccugcucucuuauagaacccaagauuaccagcccagagauggucccacccacaaggggccuuucccccuugaucacuaauugagaaaaugccuuacaguuggaucucauggaggcauuuccucaacugaagcuccuuucucugugguaacuccagcugugucaaguugacacaaaacuagccaguacaauaucccagcagaccgaugcuaguauaauaaaacuguauguauauaccccagcaaaccgaugcuaguauaauaaaacuguauguauauaucccagcagaccgaugcuaguauaauaaaacuguauguauauaucccaacagaccgaugcuaguauaauaaaacuguauguauauaccccagcagaccgaugcuaguauaauaaaacuguauguauauaucccagcagaccgaugcuaguauaauaaaauuguauguauauaucccagcagacccaugcuaguauaauaaaacuguauguauauaucccagcagaccgaugcuaguauaauaaaacuguauguauauaucccagcagaccgaugcuaguauaauaaaacuguauguauauaucccaacagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaucccagcagaccgaugcuauuauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccuagguccauucguuugauggcacgaaggaagcagcagcugcuuugguugacuugggccuuuauauaggauuuaaugguugguacguucucauacuguuuugguuuuccuuaauuuuuauauuaucagauucuuuaaguugucuuguuaagacuuuauuuuuauuacaguuuauauguucugcauugaucuuugggaauuuuaguaacuacuuaugaauaaauuggauaguagaugguuuucagucauuacauauuauacuguguucugauaauggaaacguguguugaagucagcaggucuucagcaauccgguuuguccucaggcuaucuugugcuguucacagauaugcguucacagcauuguaugugaugccguacacaugcuggccuugggaaaagaauauucuagggcagucauguguguauuucuuaggccacagaaguuaggaagcagguguaacguuacccugagugugagagccuguccuccgucucaucgcucagugaccuuuccucuguaacuccacacuaaaccucaaaccuccucacaagucagccagcacagcaagucagugaugguaaguuacagaagagagucuggcuugcuuucccuccucaguguugcccuucacaaugaucacuggugaccauauuguuggcauugcuuauuccuauagaucgaacccaggauuauucuaaguaacaguuaaacuuauaaauugucggggguuggggauuuagcucagugguagagcgcuugccuagcaagcgcaaggcccuggauucgguccucagcucuggaaaaaaaaaaaaaaaagacaaaauaaauugucgaacaauauaguccuccugagagaagcaguuauugcuuccucacccagucacgcuuggguaucugcugcuacccaucuguguagcauuaaauguuccuagcucugaugccucccuuugucuguguccuuaagacacacaccauacugaccccacuucauugucccccgucuuccuuacauuuugucaggacuggguucugugugguugucauuguuucuauauucccugcugcccauguggugaacugugcccccuuuuuaaaaaaagauuuauuuacuauguucugcugggggggcuuagcaguuaagagcacugacugcucuucuggagguccugaguucaaaucccagcaaccacaugguggcucacaaccacccguaaugagaacugaagacagcuauaguguauuuacauauaauaaauaaaaucuuuaaaaaaaaaaguguucugcuuauguguauaucuacacaccagaaagggacaucagaucccauuacagaugguugugagccaccauguaguugcugggaauugaacucaggaccucuggaagagcagccagugcucuugaccucugagccaucucuccagcccccacuuuuugacuucuuggaguaacucgccuuaucgaguaccuugacuucaaaacuugaagcacaggcacagugguucaacccuguaaucucaacccuggggaggcugaagcaggaggaucaugaauuagacuuuggccugggcuacacagugagucacuauugcuuuuuuuuuuuuuuuuuuuuaagauuuauuuauuauauguaagcugucuucagacaccucagaagagagcaucagaucucauuauggaugguuguuagccaccaugugguugcugggauuugaacacaggaccuucagaagagcagucagugcucuuaacugcugagucaucucucuagcccccuauuuucaacuagaugaaauacauucuagcuuucacuucuagcucugagguucucucaucuagcauagccuugagagaucagagugccuucugucugaagacauuguagucagaagucauuuucuaacugcucaguugcuuuuaucuagguuguuucucucacgugguuggucucuuuugauggggacuuucuucaaaugccagguaguccuuuuagcuggacauaguggcacauguuuauuuuacccugaagcugaagcaagauagucucacaaggcaaguuugaggacagccugggcuauauaaaauuuugucacaaauaacuuauuggaagcucuaggugaaucagucaacuggcagguuagaucacagcuggaccuuuccacagugggcucucacacaagcuucuguagagaccuuuuuggggguggaucuuuuucuagaaggguacccugugaucuuugcuaggaguaggguagggauuuguaaauguacauggaaguguccuggagcagagugagguaagagaggggacugucaguucagucuacaucuuuaaucccauguuccugcugugcugggugucccccguucccuaccuuguguuuucuucacccauccaagucacagguugguuaucuguguaccucaucauuucucugucuaaaccauuccaguucccauucccuguccuagaucugcuuucuaggcaccuacuucugggauauuucuugggugaaucuguuugcuaaucucuuucugggccuuuaacauuuaugucacuuaguacuuaaaagcuauuaaucauuucuccuuucauguuuugcuuuauuacgaugggucgggguaacaggcauggggcagugauuaucaaggagcagugaaaagaccagggcugcaggauaagaaaguagggaggaugaauacacacagcacguaggaccgggaggcagugaaguuacugucuaagagaugcgccgucgcggugaccaccuuuacaacaugggcuucggaggcagcgaugugucagaguggguuuacagauucuaacacguguaaccgcugugcugugauuuagugugugggaggcugugcuuuacuggggggugcgguaugaggguguguguggucucugcuuuguucagucucgcuagaccuaaaauuguucuaaaaugucuacagugaauuugugauuuuuuuuuaaauacaaggacaguacuucucauuacuuugaauacugauucauucuaaaacaugcuggcaaucuaaagcauuuacauucccacuugugucuugggugagcuaggucuggccauguuuucugagcaccuagcugaaaagguagcaaucauggaugccagguaaccaccagugaugcugcacaggcacagcagcauccuguucuaaccacaaaauguucacugcuuauggcugugccaucucauuaucccagagcacggccuggggccaaggccacauucaaagacuaaaguguccaugggcagugagggugcaaauauguaaguguguucuuacagggcagcgaggccggagaagcaggaguagucuguuacaguggcugaaaauaaauuagaaaagugaaaguuaacagcacccugaucauucuguuauauaaauaucuuuuuguaacuuuaaacuuuacuuaugcuaauaaaguuuauuaaaaugucaacugguaaguaugaaaaaaugauauccccuaaaagcacgaauauucaauaugccacauucuaauuccauuguuacaucagcccuuuacguuaaaggacgagcugggagcuggcaagguggcucagugguuaagugcaccugcugcccuuucagaggaccuagaucuucuagucucuggagugccuauucacacauucacauacaaugugcaugcaaugugcauacuuaaugugugacauaaguaaaaaucauguuuuuaaauguuacauaagggccaaaaguagagguugauuugaaguugaccauaauauggguucuguaaaggguaaggauauauucacuaaauaucauuuuaaaauacuauuuucaagcucucugaaaacugaagcuaacuuggaaguucugaagucaauaccuagugaaaaacuaaugauugagacagguaaguagaaaauuccagaaauucaaguuccauacugaaucagauuuuuagagguuauuauugauggaaaaguaauuacagauuauuuuuauuuucaguuuggccaaaccuuaaaccuuauaaaagaugacagaaucugugcuaacuagagucuauauuucugacuauuuaaugaaaugaguccccuaagcaguuuaagaagggcuuugagauucucuacugugguuuaauucuauagcccucugagaaaaacagcagccacuaaaaucaggugcuuuaguggaucucuuagauggacuuuagaugaucauuuuucuuaaaauaaguuuaaaagauaguacuuccaccuauccucuguaacucaaaggacugcagcuuuaaggcucuacacugagccacuguaggaaauaaaauucacuuuauuuccuuaggcagucacaacagcaacuauaguggccuuacaaugccucuguacugugcaagcuauucgcagagaaaugacagggaaacagcucaauggcagagcaucugccugguauucccaacacugggaaacaggcuaguguucaugaccgcgcuuucacauguaguacaagcaauacagagcagucuuaaaugcugaagcaugucagugauacuucuuguacaguuaggucuguuuuccccccaaagcaugucauacgcgagccaauucagaaaggaaauagaguagguaaaaaugagccuuuaaaguguagguugggacuuuaugcuucccuuagaacuguuuucuguugccuuaacuuuuguaauuuuauguuauauaccggugugauguucauuacaaagauuuagaaaagucaauuccuuaacacuuuuucucucuuuccccuaacucuagaugcaccuugguguggaguuaaaaguacacaugcuggaucaaaauacauaaacacuucauuuccuaccaaaaagaaaugggaaaacgggcacugcuuaaaagauagaaacgagcccugccacaucauguaaguuguuuugcgugaguggacuugagggcugucagagauaacugcugacugccacucagugaauggugggcaggguggaagcucucugucaucugcucagguucaggucagcucacaggagcuagcacugugguuagugauaagccguccacuggcacuugacccaaggucaaagaccauuugaauagugauuuggaaaugugugcacccuaacugcugugccaucuccuagguucccauccucuuaauccaaaugauuuuacugucucagugagaaagcuaugggucugguucuuugucauuuuguaggacaagaaaaagacucaaagcuugccacagaagugcucuacugcaccuuuccugcuacuguuuauaaccaguuagcuggccuuuaaccacgaccuggugguuaucugcauauuaaguauggacaacagcagcaaccaaggagguaacacaguucucuaaaccucacagugagaugacaagugauagcauguccuuuccucagcaccccugccccagacgcaggaauccaggaaaggauauauguagacagcugugaagacucugggcaagcaagaaaaguuggucagaucauuuaaugggcaccuauccagaauaagucuagaaucuacugguuuagucugguuugccacucugggcuugccucuaauaguuauaguuuaauagcgcagauuguuucugucagaguguaaugucuugaaaugugcccuuaaaaaaaguacuuuguaauaaguagaguauaaggcagaucuaagagucagcaggcagagaagucaucugaguuuccuuuuauauacacauuuggguuuucuuguauuuuaacaugcugguuuuggcagaguuuugaacugaugcuuuaaagccagaggcaaggacucuuuguacugcuugcuaaaauauuuuucauucuuuuugaauggaggaauuugcagauucauccagaagacauuauuucuccuaagccuuugacaguuuaaggggauccuagagaugcugagacaggaaagacaagcagcuguuuuggccacagccacuuggcagacacacugcuuggaggauguagugccaaaggauguuuucuguacugccuuaaaugcuuugaaaacucauagcuuuuggcuuaccuguaaauaugcaagacaaaauuucaaguaguuucuaauacagacuuaaaacugcaguuagcuaaacugcagaacuugggaaaaucagcacaugccagcuaaaaggaugcccgcauuucagcucugcucugcuacuuaaaauuuuugccaacgucuacuccacuaaguuuuccaucuuaacuguuuacuugccggucuuccuuuucuuuagacuauaaauuuccugaaauacaucuuggggcuccugcugugucaggaaagguacauguuacagaggcuagcuaagagaagcggguguucuuaugcucacacccccgugggaugaacuguggcaggaguuuuggauaaggagccucugcucccuggagcagacaagcagauacagucuaagacaguaagcagcuucagaggugucacucugacugggaccuuggaguuagcaacugucugcccagagggcacuaggagcaagcaggcuuugccauuguagaauuuuacuguucacuaagugugacugggagucaggucagauacagacaaacaccuugagcaaaggcagccuauagaagagcaucagcaguagcaaggaaacaauuuaccuaguguagcagaaaguaggaugaggugaguggaagagaaaucugggacagcaaagugagagcagauccuuggggcuuuuguuugccagccuuacucguauagauuucaucaugacccagagacuaaaagcaagagaauagcaauuuuguuugagcuaggaucuccuguagccagagcagcuuacaagcugcuguacagcaguaggugaccuugaaucccuaauccccugcuucuaucucccaagugaaucaccauguuuauguccauuuuuuuucaagaguuaacugucuaucauuucaauacugaaaggcaaagaaaggguagacaacacuuuaauaccugugccuaguauaaggaugucacaguaggagcuggagagauggcuuagagaauaaggcacuggagagaaccaaagauauguucccagcaccagguaucaggcagcucacaagcaccuauaacuccagcucuaggggaaucugaaucuucuggucccugcacucauguacauauguauuuacacauggacaaguacacacacacacacacaaaauugaaaaaauaaacaagugucacaauaccccagaaugcuauucuuaaaaauaacugcagcuuuauuccucaaaguacagaaaaaugcacugaauaaaaagguacuguucagguugcuggcuuacuggcuuacuaaacagugcuuuaccaagcaccggugacguuaacaaacaugagcaguaaauggcucugcugcccaagucucagcagagcagccgugcccuuggccaccguccgccagcagcagcacuacuuacagaugcagucugaguucacugcacagacugcaugugaaugucugugucacgcugaccacaaccuguaaagguccagcuaacuguaaauccucauuccuaguucuuuugaguguucacacuuaggguccucagaaugggagaaaaagcucgugaccaggaauauuuaaagguuuaauucgaacuacaaccuguauauaaccuaaugcauauauaaaaacagauaguauuacuaggaacccacugcucauuuugagcaaagaaaugagucucugagcucuucucucugcucuaaguacaagccuagagccccucccacagccacaccuaaccugucauauuuguuuguuuuauuuaaugcaugugaguacacuguagcuguuuuaagacacccagcagagugcaagagaucucauuacagaugguugugaaccaccaugugguugcugggauuugaacucaggaccucuggaauaccagucagugcucuuaacugcugagccaucucuccaguccacuugucaaggauuuagcaugcacacaaacauuccuugcugccuguuagagacuauaugaauaagcagugccuuucaaauuuuuggcccuauucucuucaauaccauuuuauucauauuacauauaaauauauauauacauacgcauauauauuuuauuuauaaauauaaaauaguuauacuaguaauaguaaaacaaauauaaaaaaaaaaacuaaauccaaaguaggaaggugccuacuuagccuguuuuacugugcagacuucauuuuacuuuuaagaugcucaugauccgggaacaaaagugcuaggaccuagaguuuuaaaggacgccuccccuauaggauaauuccauuaguggugcccuuacgugacccuguaacuuuauauuccaguuagcuccagagucuucuaguugacaguaauuggugaugcuuuccuacagacauuacugacaacuuuaguaacucauaaacuuccuuagaagaggugcuaguguaagaucuucucauguuuacauagaaaaaggugauuacauaccucuaacaauauauucugaguaaguugaucccuuguuuuuuguuuuagucaaauauuggagauaaugucagcagucagagaagaagacccacuggaauuggccaacacgcucuauaacaacaccauuaaaguguuuuuuuccugauuuguguuuccuuuuuaugauguggaauuucauuguaaaacugugaacuuuauugaggaauuuuuuccaguagcacuguacauuacaccucgaagagucaggucagcacuguuuaggcugcuuuaguuaacaauguccaccuuuuuauuguguaaucucaucagaagucugaaaggacaguuuuaugcucucacugcaaacacagugaugcuucuacuaagacuuagacagcacauccuggauuauaucaaaguuuaguugauaacaagccuauuucucaauucugucccuguuuuuugacuuuugaaccuagcucuaagcugcagcucagguuucaaguuuuuuaguugcuucuagcagguuaucuugccuuaguuuuagaagacauuuuauagccuuucuacucaagauuauuuuucuucucgucucuuauacuaaaguuccuuuauucugcauuuucauuuucccacucauuuuaaggaaaagcuagaguccagcauuagauauauuccaauuucauggaggaaucuuuggcacaauugacgcaccauaugaucauuaucucuauuaagaagcuauuuguucaaauuuugucauaaaaacgugaaaacuuuuauucuauguacaauaauguacacaaauuuaaacaggucaccaaagagaccagaaguaauuaaagagguauauuuacaguagcacaucacaguaaacggaaagcauucacaguuucaacauccauacuguuuuugugcuugguuacacacugacgugaagcauauuacuccauuuuggaugaacugaauuuuaaacaaauaccucaaugauuaguaaaugcuacuuuaaucagugucaucauuaaauucugcggcugcugcugcugcgccugugugcugaauccccccguuucuuucucuuugagcaucaucaucacagucuguacugucauccucguucaguucucggucagauccagcagcauccucucuuaaagccuccucuggguuuggauuuucauugggugcaauaaauccguuguuguuagaugcauuugaguuauccuugaucucaucuucgauguacacuuucugauggcacauuggacaaguaucuugaauguacagccauuuccgaaggcagagugcauggaaauaaugguuacacgguguuauacgagcagauguugugaacucaugauagcagauugcacagacaucaucuauuucuugcaaguggcucccuuuuaucucaggaagugaauuaauuuucuuaacagcaguucuacgauucaugaaugucuuccagccauuuuuuacuuguaaguagauguuaaaauaugcauguaggcacaucauacaagcccgaauuuuacuuccugacucaaacaucaugguauaggccccauucccaaacauuacuacuccaaauauaaauucgauaauauugcccguggagcgaacaaaguagacauagucaucaagcuuuucccagaggacguuauaguagccaucaaucaugaacagcguguagacagugagggagacgauuaccuucaagcagaguuccacacaaaaggcuguaacugcaaacagccauguauuuagugcauagugaugccaaaggacauaacugaguaagacagggagaaugaacaggcaagcagagacaaacagcacaggaaagugucuauggaaagaugacacaugggaggcacugagcgacauuaauacagggucugucaucccauggaugaaaugcaggacugcaguuaauaaaaggcacauguuucuacuuaagcgaauaagucucucuucaggucuuagcccacuuaaaccagucugaagagccaaaaugaaaaauaaaacaggagcuacaaagccaagccgccugucaucuucuucaguugauccaauaaaggccaauauuccaaggcccaaauaaugggcuauugaagaaauuacagcacucaugccuaguacaguuaguguagaaucacacccacuaauuauuagauugcaaaugacgucccagaaaucaucccaagaaauaaagaaggacucaguuucauuugccauccuuaaaauguacauuaacacuguagccugagcuguaauucuuguuagccagaagacccgaaguaugucugggaaacgaauccucuuccauguguccuccaucaguaacuguaauccauaaauucgguacauaugccucacuaacaaguacacauaccgaguagaguaguaaaaccacuuaaguuucacugccaagacaagcacuguguuaaauaugagaaucaaggacgacaugagcacuacugucucucugauguguaauggcagcucugugauuaagccaauuauaggaaccaagauauuuaaaaucauuaacugugaauagauggacugaaucugcaguaaugugacauauccaauuccaaagguuagcugcagaacgaugagugccauccacagugagggcccuuuccgaggaagcaacucgauuccaaacgcugacguguuguaggcaccauagaagucaaugugcaaagcagcauaguaauucaccaacacugaaguugcagcuaauagaaaggcugagcuguacauguaaaacuugaaaagugaucgcugugacaagaucagaacaauacuggauacaacuauaccugaggaaaaaagagaaaaggguauucgaaugaaguauuuuuaagcauguguuuuuuuaauacuagcaauuacaacuuucuuccuuuauuaugcuaucuuugccguuguaaaaccucaagacaacucaggcuuuacaggacaguaaagauuugagaagucagaguucuaaaccagagcaaacaaguacauuuuaaaaaccuuggcccuuuauuuucuggcuucuaaaguaauucugcuugucauaguauauauauacauccaugcaaaccaaaccaacuaaacacauuuuaaaaaaccuggccucuuauuuucugguuucuaaagcaauucuguuuaucauguuauauauacauccaugcaugagaugacuaaauuaucuucaggacaaaacuguaaugauauacauguacuuuuugauaauuuuuuaaacucaaaagaauacuuucuauguaaguucauaaucauuaaaaaguuuaauguaauaccaucaaaauaauaaggcuuuucagaaugaaaauuacuagacugaaaggauucuucuacuugguuucagaauccuuucaucaaguguucuuuagacaaggugaacuuuuauauggcacccuaucaccuacuuuccuuccagcugagcucaguaggcucucuguaguagauaugaauauucccuaaggguuccaacucaggcccccguacauuccuucacauuucugaaaugcucuccaaguucccuuucccuacaaacugaaucacaucuucagaaaaccaaaucauguuuuaaaggcuagcuggcuauaagcaucagccccauuauuccguguuaaguacuguaaauagucugaugaucgaucgagugccaggcaacauaugcucuucagucagcauaucuccaguacuuuuaggacauauuuagugauacugaaguuuguaauuaucuaguuaucaccccacuacauaguucugucccugccuuauaaaucaauggacugcacaaugcuguauacaaagaaagguuauguucuuaugggauacggggagaaccaacucucacuuuacagaaaacaauaccaacuccccaacuaauaagucuccaaaggaaauauucucucuggugaucuuugggaagcauuguucagguuucuuugcauuccacagcugagacacgggguuuuuuuccuuaggguccaucuuaaggguccaaggaaacccaggaguaguuuucauuagagcuuauaagggacuugcucucuuuuaaaacaccaccuuuggacacagagaauugaauuaaaccauaaccugggaauuucaguccuagacuccaguauaauauaauuacuggacuguuaauaaguucucaaggcagaaaaagaaccaagcaucaaaaucucuucaggaacuuugaauucauauaugaacugaaugcaccaaagaguucagggccuuuucaguuagaauuccaaaagcaagaaguaauaacaggaaaggagggaguccauccaugcauuuuacacuccauggcauguacucugcuuuuaggagacaaggacuugcuauguauguaguccaaacuagccuuccacuugugcccuccucccuguucccagaaggcuaagauuaaaggugugccccaacaaagugcaaacucuuuuaaguauguucauuccugacucuucugcaaacuuaugacugaaauuuagaaggaaauaaaauaccauuuacaccucuucagaucuguaaguaccuuuaaacuguucaaaagcaggcaagaaauacaguaauaaagacauuacucccuuacuucagagucuuaaguaaugaaauucuggggggaaaaaaguacuaugaaaugauguuaaucuguuagcauacuugacaaauaaauuguaccacagagaaacccuuucuaaacuuggcauugugguacuuaccuauaauccaagcccugaggacuaaggcauacguacuaugcugagcugugugagacccuaccuuaaaacaacaaaauucuaucaaacuuucauuuuagggaaaacaacagcaagaaugauauccuagcuuuuucuauucaugaaauugaauuuuaacaaguaugaucucauuaccauaugugaacauggauuuuuaaagaagugguggucuggguuuuugaagacaggucuuuccuuaggcacuaggugucccugacccacagagaucugccuaccucugcuuucagagugcugagacuaaaggcacacacuacuaaaccaaauaguaagguacaaucauuggaguucucuuguucugucuucacaucuauguccuguccuugucuagaauccaaacuuucaacuuccaaaagcuauccauagugacaggacucucuuguuuaggaaugcagugaaugacaguuuggaacuucugaauauccucaggauggagacugaguguuagagaaauacagccacuuaggccugaaaguucuggucccauuccuaccccuuuguccccuuccuacuucuaaggagggggauaauggacaaaggcucaguagcuaagccagaggugaccauuucaccaacagugcccacacaacaaagcaacaaaaccgcagcaggacucaauucugauggcuccagaaaccuuaauuuuguaguucuagagucuggaaaccugacagggcacaggcacuccucaguccucucuuucaccucuacgcccuauacaccuaccucuuccuuccgucugcccuuuguuauacauagacaaauagagacauuuccccagauucugucugcaaucuagcauugaauggaucaggaaacuugaccagagaugaaacauucuggacugaaugcagagggagagggggaggggcagacagacagacagacagacagacugacaucuacacaccguuuuucuuuuauaucacacugucuuacuggcaccaaagaggaagaacagcucuaauuucucauacauccugacauugauuaaauaugcauucauacagagacauauagacagugugcccuuugagguuuuauguuuuuaauauuagaucucuauauuuuauaacuuuuagauauuucugaggacaucucugcacaaguuguacauucagcauuaguuuauuuagaacugaucauaaauacaagauagagguccagcaugauuuuccucauauuuuuuuuuacauauuuaguacuuacaaggguuucuauaaacaauauagcaauguaaucagaguaacuacuacucaaauccuaacuuauacuuaaaauuuuccugacuacugacuaaagaacccuuccauuucuauugaccauucaggguucuucugugaaggccacuuuaccuucuguccauaugucuuacgguuuggacaaguguccuaacaaaaggcuauguugaagacuuagucccugacagguagugagggagacaacuggaucauuagaguucuaaguccagcaaugcauuacuccaugaaugcacucacugcugaauggaggagaaggaaccuagcuggagaaagcuggucacuugcaggggugggggugggaacagugggacugugaaagggaugccuuuaaagguauagcuggucuuggccccuuccugucucucugugcuuccugucugccgugagacaagcaacuuucucugccaugaccuuuggucauaaugcucugcuucaccacgggcccaaaauuaauuaaucaaguguuacagacugaaccgaggcgucaaaauaagccuuuccuacugcaaguccaucuuaagcgcucugccccaacacgaugacaacacaauauggugcuggggggcuuucccgauuugugugcaauuaauaacaaauuauuuguugguuauaaguaauauccagguuuauauccaguguuuuguuuuuuagaugcuaauuuauuaaaagguuuuuaauccuaaaaauucaauauauacucuuucuauaaauugauuauucauacagauaagaggaagggagccaguaauuuuuccauauuaaguaaauaucauauuuacuucucugaaccucaauucaauucuaccucugaaaccuaccaaguuucuauuguacuugugucuauuucugagcugugcauuuuauacuccuagucuauuuguccauccccaggguucucaaccaggauaagauuccuuccuccuugggaacacuugacaacaucuagggucggaauggcugugacaacugauguguguguuacauggacaagguauuaguggcagaagguagggagacgagaaaaaaggcuagaaaugguacucuguagauagugccccauuccuagguuuaugcuguccaaaaugucaacagagcuacugcugaggaaugucggucucuuccccugccagacacaguuacuucugcuucacuccugccuucucacaccacaggguuucacaguuguucccacugaguggaugagcuuagucaguaucaaagaaaauucucaauucuuuuacaaugaagagauucccaacuaacacacauuuagaguaugucuuaaguuggcuguuuuguuauuuucaauagugcuauaaugaauauccuugcucauaaugcaguauaaucucuaaguccucacaacuagauuugugaauuaaauguuauauaguaaaugucacuccauggccagagcuauagcucaaguggcaagaauacuuuccuccccagcacgcaugacagcuggguucaaugccuggcaucuuaugaaaccagcuacagcgguccaaccuuacagucucaucaguacugaaguagagccaagagaacccagagcucaaggucaucuucaauuuggggucagcauaggcuacaugugacccugccucaaucaauauaguuaguaucaguugacaaugccagaugguuuauacagaggugauggcuugccaaauuauaucaauuugccuauuucaaauagguaaacaccugugccaaauacuuuuaaaucacacuuugcauucuucaccgaucuaagagauaaacuauuucuuucauuaacaaugagacuaggaacuacuuuucuuuaugggccaccugaaguuuauccucacauaagccuucuuuuuaaaggacuuauacaugauagaaacauuuuccucucaauuugucauuuuuaaaagauuuuucaauaaagaagguuuuaaaaaaauuuuuuuuaaagauuuauuuauugguuauauguaaguacacuguagcugucuucagacacuccagaagagggcgucagaucucguuacggaugguuaugagccaccauguggguugcugggauuugaacuccggaccuucagaagaacagucgggugcucuuacccacugagccaucucaccagccccuaaaaauuauuuuuaaauacucaaacuuaccuuauuauauuuguaauuucucagguuuuuuuguuuuguuuuguuuuuguuuuuguuuuuuguuuuucgagacaggguuucucuguauagcccugaguguccuggaacucacuuuguagaccaggcuggccucgaacucagaaaucugccugucucugccucccgagugcugggauuaaaggcgugcaccaccaagcccggcuacaguuuucuuuuaugcuuagaauccuuugccaugucaauugccagcuuaugaguaauaaauacuauuaaaacacacucuauauuugccucuucucuucugucuuuaaguuugcuaauucgguauuacacuguuguggggugagcuuccuuuacucucuuaccacuaccuaagaaagagucuuauguucccacacaugugcauauugugugguuuucuuuauaucucuaagaggaaaggcuuuacuuucuggccuuuugaaaucucaaacuggaauuggagagauggcucagggguuaagagcucuugacugcucuuccagagguccugaguucaauucccagcaaccacaugguggcucacaaccaucuguaauggaauccaaugcccucuucugcuguguuugaagagaaguacaauguacucacauauauaaaauaaauuaaucuuaaagaaagaaagaaagaaagaaagaaagagaaagaaguagagagagagagagagagagagagaaagacagaaagaaagaaagaaaucucaagcuggccugacaccagaugcaaguguaguuguugaagcacccuguggucagaggaagaacgcugcggacacuaacucauccaauuagcaauguuugcaaaggaugcuggccgaguccugagguacacgggcuucaauaaugacaaauccccaacuagucuccacucacauuuuucauacacauacauguuacuacuucauuuaaggugauuuuuuucagcuuuuauucuuacaaacaaaaaaauuagcacaacuaguuugcuacaauuuagaaaaaucauuagaugaugaauuuagaggucauuuuuuucuuauaaaaccugacucaauauucugagauaauuuuuuucaaauaaauauuuggugauuucaaaaggaugaaauauguauaacaacguauagucuuaacugagcauuaaaauauuuucugaaaagugaucauaggaacagcuaacacaugaacaaaugcuuuaaaggguuuuuauccuaacucauuuauugcccuauaaccuccaugaaaaagaugcugugaacuuccuuagagaagcugcaccuucaaaauguaaccuccgcaggcugagugcguggaagcucacugacucuggagguggaaggcugcaggugcagagccuaauuacaaucuaccuuggaccaucuuuagcccaagucagagagaucuaacauccagugacuaacauacaaaccuuuuggaauauacuaacuuaaagccuuaguucccaacagccagagcucuagaguaccuucuucuacagacagcauccugggucuauaacaagaaccuuucagcuuugcuuucaccuaccuacuuaacauuccacuaaugguuuuuaaaguguuguguuauaaaacuuuuaucaaacuguuaccauguugaacauggaauuugggguaacgucaaucaguguucaugggccacagucaaucagauuugguuucagaauaagcuaucucuuaucccauuugagaugaguuguguuuuuauguugacaauaccaucauuguuuuuauaaagguagagaaaacaaaacuacagacucgugaaauggagcucuuccugaaauucucaaauacaaaacuucugugaagaaauaaaguauaaggagugggcgggggaacacugacuuucuuaaauguuuuuaccguaagugacuuaagaaaacuccuuucuauaaaucuaccuagugucgaguacuccaacaggaaaugcauuaaauccucagguccccccaaaguugccagaaucugcgguuauuaugccaugaagacauucaaggcaguggcuguauguacuaucucugagaugacuaugcagacuccucucgaacacagagaaugguggaaguggcuuuaauaaagaagagcagaacgacuaacuuguauccccaguagaugacacuaagcccugugcuugaagaguaucaccaccacuuuuucuuucuuguuaacuuuaaggugagcacugcggggucacagcgcuggguacugcaucuccgcacacugaggaagaacaaaagggaaccaucccugaacaccagaagccuuucuaacgcucuggcaaacaccagcugugcaccagaaaccaaacaccuaacuucuccaaccucauuuccucaccuguaaagucuaaauaacacgauccaccuuugaggagugaccgacggauuagguaaaaccugugagaaugcuuucuagcagacaaauguagaagaguuacugccaagaacaaaacugcuucuuuauugacgcuccuuuucugggagaauaaggcagcagaggcgcucgcacuucucaaggucuuggucaggaccucacuaccagguacccgcacccccaaccuuucaauagcaagaacccaccuaaaaacucaucguaaugaucucaucaacaaaaccugccaagcuguaauuaucuggaaaagaucucuuuauguguuucucacuucugguauguagcacagagagaaauagaaagugaaauauaaaauacuuuuagcacucaauccauaugaaaugaagacugaucuuucuagucucccacagaugucucaucacccugggaugguaagcuuucauagucacauccaacaccuuauuauuuacucauagaaagaguuuagggguucguuguaaguauaaccuuccucgcggugacuuuuggaaaugguuucaaggacugacauucauggcuugaguggccauuuaccucaaguacuucacgauccgguggacuccaagacacagaagugacaacguauucugcacugugaaauggguagacagggggcucaagcucuggcucaaguccaaggucacacacggcgagacccggagagcuguuuuuccagggcugucgcauaggacgcuggaagccagcagucauuccccaagagaaacagcagacagacagccgcaugcucacacagccgugcuuucuccucgcccauccaggugccaaccgagcagggcacagacccgccagcaccacucagcugucaacgcuggcacgaguaccacggguccccgcacccccgccaaaaggcccucuggggaaccagaccgugguuccccaagccgcgugccaccagugcccugccguucccgucggccugggagagggcacgccucggccagcgggcuagcccuacgccguccuuaccaaggagccggagaaagaucugaagcccgaugcagaaccggcuuuggcuggaaucguaguaggaguugaagauggcgucgaugauguagaggcagggcacccggagcgccacuucgagcgccgcccagaccugcugcugggccauccgcaccugcugcugcgggggccccaccgccgccaugagccgcugccacaccggggcugggcgggccgggccaggcagggcggcgcgggggaggcccggggccgcggccggggcgggcgccgacgaaaguggcuccgcccccggccgccuccuguccugugucccggcccggcccgccccgccgcccgcucgcgucccucgguggagcagggggcggcggcagcggcugccgggaggccucggggcgucgguguuuccggccggcuagggucuggcuccuccucccuccagcgccucccccgccagcggagccaccaucuugaccccgccugccucggccguugcugccguugcg

SEQ ID NO: 7765 - RNA, 43588 nt, Mus musculus
cacuuccgcuuuucccugggaggagccugccgcgccgucaugagucucuucaaguucguggguaagggcagguuugucuuggucgugagccucgcugacagucccggguccccuuuucgcggcauggccuuuccagggcacggaagaugcccggaggccucgcgugcuggcaaugacugaucugguucuugcuggaggaugguuucccuagugcauguucauuuaugagcauucccgggcaaugaaucauugugacuugugcuuuuuuuguguguguuuaauucaacuggaaagagaggaauagguguggggugugcuucagccguagacugaucgccuagcaugggcuaguccccgaguccucccaucucucaaaaagcaccgccccccaagccaaucacuuuucuucugucuuucgugaacucuucuacauggccggccugacagucccuccaagguaccgguucacucagucaucccuucauaccacagacaacucugggaggcuugacauugagucccgggaauguggccaaguccugcucacaggccaucuagacauaaacgggaguccucagacgggaggggguggcaaauugugucgccucgcaaguuccacgauccauccgacagcuggagagugcggcaaggauucaaaaugggggacauuguaagagucaggguuggaaggauaacuuggaacccuaaagucucgauuacuuaaauuucacuucuauugggaguggcguuccaaugaaggcuuuucagcaaaucuuugagugccaguuguacggaaagagucuugccuucugggauaccgauguggguagucucaguaugaaccucgucguuguggacuuucccugcuauuuaagggugggaagugacagggaggagguuacccugauagucguuuuguagauuuuguggcagauaaggggacgaauguaaguauuucagguuuugcaaacagggaaaagaauagaaaaagagaaaugggaugguugugcauagcauuuagcacugacuguucaugccuguugugggaagugaagacccaaagauggcagguuaagaaauaccuaggccaucuggaucuaauagauuagguccauucgugaguuaaaggacauccaaauagagacauccuccgagcacucaaaaguggaaucaggagagugguuaagguuauacaguaaaaucugagagacaccuuaagcaauauauuuucccaagacacuguauuuaaauauggaguugugagaaaucuagucgugaguuaguuuccacaccagagacgugaggccuauggccagucaaagcaaacguggggagaauguuagcagguuuuucaaaaacucugugagaaagccugaagugaagguuagguguucuggguucuugaugugaugugcuaggaagugguauguccuggagagggcacaagagcccucacuccucaccucauacugucugucccuguuccugguuguuaagagucuacgcugggcguuuccagguucgugguugcuuauccaaagaacuaaagagaagggcucacacagacuuacagaauaagugaggaaaccuuauuuuguggagcaauaauauauauuaaaaagcggaaugaaggguuuuuguuguuguuuuugagacgggguugcucuguaguucuggcuguccugaacucacucuguagaccaggcuggccucgaacacagaaauccaccugccucugccucccaagugcugggauuaaaggcgugcgccaccauugcccaguuggaaugaagguuuguuacuugcaauguuauaauacaauuuaaaauauauuuaauguuguggaucugagaguguggcagagaaugcaguuuuggguuuuuuuuuuuccuuuuugucuuauaccuuguuauuugaaagcagacuuaguauauaaacaacucaguguguccaugccucaauaaaguuuuauggacauugaauauuaaacuuaaaaguugauuuauuuuagccauaugggaguggguaugugugcagauagauaccuggaaaggccagaagagggagccaggugcccagaagcuccuagagucacuggcaauugggagccaucugauauggauacugguaugauauggauacugauauggauacuggaaccaaagcugggcccucuggaaaagcaacaaauacccuuaacugcagaaccaucuucccagccccugaauuguucuuuuuaauaauuuucacagguagaggaauauucugcugauuuaaaagaaaacaauuuaaaauguucaaccauuacuaguauagggacuaacaauaggcaaugaagccaaguaaggcagugcacaccuguaacuucagcacugcaggccagaggcagagucuuguucugcaugaugaggcccugugucacagugacaccuuuagcaagacgacagacaguggcggcaggaaggaguugacuucucugcuguggcauccuuuuguggcucguuuaaguauuuuuggcacugacuugcugaagaaacugggcugcuugucugaccuuucggauuuguguuuuugcugaacaguggugcgaguuccuuguucucuaguuauugaaacuuuauaaccuugaaauuauaucucaaggcuaauaacguccaaugcuauuuuaaaucccuuguuuacugucucuccauguuccuaaaucacaggugacagugccuugacaagauucacuaagcccaaacaguuugcagauacugcuuucuguuagagggcaacagaacaaacgcuuucccacuuuguuuugaaaaaucaacucauugauacugguaauuuuuuuuuauuaaagacagcuauuuuuaaacauuaaugaaguggagacauuacuguccuaaauagcaggguugccagugucugacuccucccucaggucauggugacugccugccaggguuacuguugccagaggaaauucuacucauccaccaagaagacaaugaggcucaacagggaccaagagccuucacuaauuacuggcaguggcaagaauucugacuccaaagcucacuuuguuccaucucugaguaauuguagucauuucaugguauuguacuuuaugggccuuguucauggauagaacuauuuccagucaauuuauuugaacuuuucuuuggcuccucuguaucggagugcugaguuauugugguauuuccacagauguuucuggugggugggcugaugaggaaguggcuuuugucugagagcauuuucugugggagacuuggagaaggucuuagaggaaaccgaugugauucacguggcguggaaggacagaagucuuuugccauucaacuugguaagguguaccgugaagaggcuguccuuaguuuaucaagggaauggugguucucccucugauuugucacuuugucugccacucaauuagacaucacuuuaaacacgggugcuuccuucuacaaacuacauuuaccuucauuguuugggauuaaaggugugcauuaagagagugacugaauucuagccagagggauuggugugugauaaggcuaagccaccacagcacaacuaaaaacagguuuuuccaguaaacaacacaaucucagguccacagugugaucaaauauccugcaacagccuagaauucucucuucacuaucucuuggguuauccaaacuccugacuaggucucacggucugucauacuguuggggcagcacauccagacacacagcauuugacaaagucagcccccaggaguaguuggugaauaaggaaguaguucaucuacaucuccacucucaucaccgucucggucuuucuccacugcacaugagcuuuuccuaguuuccaaaugagacucaacuucuguugcucccuucacaucccagcuuccaguacuccugagugaaguaucuucaauguaagucuugccuuugauuacaaaucaucaggcauuauauugaauccaguauuuuuaacauaagugugugucauaauugaucuguccuuucuagcuaaacccuuuccugugcuucuccuuagcaacuacaaaaccuccaauuuccugaugaauuauucuauuucauacccuggaggcuugcugacuuaguuacuuuucuguugcugggaacaggcgccaugaccaaggcaacuuacaaaagaaaacaguuucagggcucacaguuccaaagaguaaacccaugaccaucauggugggaaucguggcagcaggcugcuagauauggaggaguugggggcaucaccccauggcagacaaguucucccacacuccugcccuugggauuggcucauacacacacccccagcaccagugcuggcuccacugcgcugccucuuccaaguaaagggugguggcauggucuuuugaaaccucaaaacccacuccaugacauaccucuccuacaaagccacaccuccuaaucccccaaaacaauuccaccaccugacccuauaggggccauucucauucagaucaccacauugggugacuaauccugcaacauucaguucugaauuauuuauuccugggacccccuucugagucagcuaccaaacucugguagaacuuucugugucucauaauaacaguaguuuuauguuuucaauauuuugaggaauuuauugacaacuucauauguguauaugauacauuuuaauuugguuccccaaugagcuuuccuaucccccucauugucuccacaauugccuaugcaugggucugccccauucccuucugaguguuuaaagacucacuucugccaugagucuuuaggagcagaaaucacaucuuaguccucccgugucccacaggucuaucauggagcugccaagaaucagccagccaauuaauacugcuagauuauagacuaugugaaugaaaagcuuguuuagagauauuuugaguaaauuuuauuuuaaugauuaccuguuucgcuuuugguuuccacagauauuggcaucaaccugacagauccuauguucagaggaauuuauaggggggugcagaagcaucaaggugaaugucucuuuuacuaaggcgacgucugugaagacaaccucugcuacaagaucuuggaaagcacaauccacucuuaaagugaaaucuuaaaggacucugggcagcugagggugaaucuaaaacccagcauucagaagguagaggaaggagaauagcaaguuagaggccagccugggcuacauagugagaacuuauuuuuaaaaacaaacaaagcaaaacccucaucaucauaugccagacagaacaaucaacucagucagucaagcccugucggcaaaccaucguuuugaacaacaggccuggaacccagcgaucacuuccuaugaccaucagcuuaucaaguucuuaaacuugauggcucagugguuaagaggaccuacugcucuuacaaagguccugaguuuaguucccugaaccugcugacagugagcagcucacagcugccuauaaccccaacuccaaagccucugaugcccuuuucuggcuucugacagcaugugcguucauguucauauagcaacgugucacacacacacacacgagauagagagagagagugaauuaaaaaguaaaaauaaaucuuuuagaaaggaagaaaauguuuucagccaaggacaaaguguggugugcuguugucuuccugucuucccuacucuuuccaucacuaucuacuuagaggcccaguguauaggugggacuggacauuguacuucaccagaagcaagugguuuguauuaucauauaaguucacuuuccucuccaguccuaagaaucagcccaggaacugaugugagcauagacaagugcugcccacugggcuguugccuuagcugagagaggugacuaagcaggaaaugguggugacgcugaauuuuaaaggcaggaugucugcaauagaugugucugugcacacugccugggaacagugccuauguucuaugacaugcaaauagggagggugaaagaguuccacaccgcagagagcugagucagcaccugaccaugccaggcuucucuagcuggcuuuccugaacacaggagacaagaaaaacacauguuuucacagggcucacuguaaaacuuacucuuagggauuuuaggcauuugaaugcuaguuuuauguguuacuuauacaauaaaguuaaccguugaguaaguugccuucugcuuuccuugccuuuuuagggcuuagauuucaugcugugcuguggcauguauguaugcauguguguuuauauauauguuaggacauaaguuaugcaguagucaguuaucaccacuacugcaguuucuaaucuggcauacuugcuaugcucaguauaaguuaacuaaggugaguuuugucuuuugaauucguuauuuuuauauauuauuuuuauuauauauauguaaauagaauuugaauuuauuuccauuuacucugaaacugaaguguaacauucauaauggaguuuuuauauuuuauuuuguugcccauuauguuucuggcccuaacaguggguugggagauggcucaguguaaaggacuugcuguucaaagcaugaaguucugaguguggauccccagcacacauuaaagcuaagagcagcagcaugagucuaaccccaguggauggcaaggaaacuggaggcucccgggggcuggcugccagccagucaucugacgcagugggcuccagguucagugagagcaucaguuauauaaagccacagugauagaagaaccccucccccccccccacacacacgggcacacagacauacacggacgggcacacauggucacauacacacacgcacggacggauggacagauauggacacacacagauaggcacuuacaauuucauauacaaauacaaguuuggauauaaagcacaucaauuguaaucauugaguucaucuuuaauuuggaccuccugacuucugucauuuucuccuuuuuuguucaacaaaguaaaaguacaauuaaauuaauuauuaacuauucagcuucuugcuuuauauuuuuuuaagguuuuacaaaucuaguuucacuauuuuacaaguaacuagcacugauuaggcuguguuuuaguacaugaucauuuuugugcauuuuuacuuuaaggagagguaaaaauuauacaugcauaauuauagauaauaucucuauauuuacuagcuuuucuuaauaugugacuuuucuuacacagaugacuuacaagauguaauagagagagcuauccagauugguguuaaaaagguaacaucugaacuuuguuauuguugaauuucuuuguuuuuaaaauaaguguuaguuaaaaugccacacaguaacagcgacagccaccggcacacgcucacuucuguccuguguguaauagaaaugcauguucugucacagauagguagguugcacaguccucagggaugucaucagaaaugugacaaagugugacagaaaaaauaaaacuacaacacgugcuacucuuaaagacagccuuccauaaauguuauaaucucacuuggcauguguuggaaauaguuaucaaacacaugcaugcauuaccagaguuagcuguggguauaccaucagauaacuaagaaaacuccuuaguuuuaacaguaauaaaaggcuuacaaguuuuuagaguucuaauaagaaauugaacauuaacuagcuuaagccaaauucuucaaguaaguauuuuuuaaaauugguuguaaaaaugguagguaagcccacacaucugagaaauaaaguuauauucuauagcauauuaucaauucacuuuguagcuauugcuucuaaguuaaacacacucaguucuaaaaugugaugcuaguuaaauaaacacugcggucucuaacccuauauauugauuauucaaaaguagugagaaaggaucaaaguugcaugaacuuuuagucauauguucacucccucaugaugagucacuugaucucauguuucuucugcagacacugaaggaucaggcuccgaccuuccccaugucagcaggaguacuuuccucaguuauaauugagugcacacacacacacacacacauucucacacguaaaggauagacagaauuaauaggacagaggcagaguucacuuggacuuacugagcucauuaccagcaguuaugguguauaauuagaaguaugauuuuggcaucauaaacuuggcuucuagccccagcuuccuccuucauagcuuugaaaccugggguauuccagaucuuggcuucucauccauaaacuggauauuuuagaagugugugggaacaucaugguucccauaaagaaaaagcugcuauggguaagccuucgugauguaugugauggcauccccacugccaggucaggagacacaugccgggagggaagcccaugaaggccuagccuugccugccuuucucagguuaucuggacagggagagagaauguaaguggauuugcuuagaaacuguucuacagcauugaaguucuuaugcggguagcugguguaguuuuugagacuuagguaagguuaguaaagaauaguuuuccugauaucuuaaauuuuucuuaaaucuuauauuuuaugggcauuugaaauuuuaguugugacuguauauucccuguguagacacucaguggcuggucacucucaguagcuggucauacuauguugcuguaugacaguaucuguuccucacacacaauuccaccuuuguuuugugugcauucucuuugguguguaccuacaaugaacuaucuuuacuuuagcuuagaaauacuuagaaguauguuuuuaaaaaauaauaaucaguccuuaaaucaccuuuagaaaguaccuuacacagcacuagguucuuuaauuaugucugacagauuaguaaagauggcauucuaaccacugaaugacucuaauggcugucugaaguaugcugacuucucaagagccaugaauuccuucaucacgacacuaauguaucagcuuuuguucuuagaacccucugcuuucuuuaggauuauggccgacccucuaaaaagcuuuuuuguggguuuuaugcaauuauauauguuauucuaggaauuaaagcagaaauauuguaaauaucaacucauuucagaaaugauaaacuguaacauaaacaguauauuuuaaugagaaaauaccuauuuuccaaacaaaccuuaguggcaagggauuauguuacauucugccacguuucugaaugacugagaagaccgcugcauucccaugccuguuucccgggucagucuguugugacacuguacaucggcuagugucuggcugaccgcccuguacacuugagcuuggaugaaaguaaaaagaugaaaagccuuuugguacccuuccagagguaguuucaccuccuaaucaacacgccaguuacugauuuucauggucauuuauuucagugaacagaauuuugacuaggcagguccuuagcuauuucuguucuauaacauauaaauugcauccucaagagaccuaggccuugucgcuaauagagacaaacauguaaaugcguguuauuauguaacacaggaauccuaugggagggucuguguggacagaaaccagguagcacuguguggauugauguuccucaugaacauaaaggagcgguaguggggccagcacccugcagugaacuggaggaagggguuuggucccuggaagucagcuucuuuuccuuuuugccauuucaguuuaugaucacagguggaagucuccaagacaguaaagaugcacugcaguuggcacaaacaaaugguacccucuuauuccuuuuaccaaaacaaaugugaauuacguaauuaugaagaagucuuucucagaacugcuuaagguacaaauacagugagccugacauagaaaugacaggaauacagacugguuucaguggaacgugcuuaagaugacaaaguuuauaguagucuuugguauaucagauguuugauaaaaucuuauaauauuuagcaugauuguuauuucagaaaauaauaguaaaguuacccacauacauaauuuaucuuucagucauucuaauguaguuucuaugugcauauuuuaauguuugauaggaauuauuuuuauuuaaaauauuuuaacuuaaauugagaaggaucauuguuaguugauuuugcugacaggacccugauauagcugucucuugugaggcuaugccaguaccuggcaaauacagaaguggaugcucacagucagcuauuggauggaacacagggcccccaauggaggagcuagagaaaguacccaaggagcugaagaaggucuauaacccuauaggaggaacaacaauaugaacuaaccaguacccccagagcucgugucucuagcugcauauguagcagaagauggacuagucggccaucauugggaggagaggcccuuggucuugcaaagauuauaugccccaauacaggggaaugccagggccaggaagcaggaguaaguggguuggggaguaggguugggggaggguauaagggacuuucgggauagcauuugaauuguaaaugaagaaaauaucuaauaaaaaauucuuuaaauaaaaaaauaauuaguuaauauuauaauauuccacuguuagggcuagagagcuggcucagcaguaaagagcacuugcugcucuugcagaggacuccaguucaguucccagugcccagcagcucaaggaauauggcaucuucuucuggucuccaugggcacaguccucaacacacacuaacaaaauuaaaauaugcugcucucugggugcuacuucacgcucagacauuucaugcuuauuuaaacuccuaaaagcuuauuugacauucagauaacuuuuuuguaugcauacuuuccuagacaccuagagauuaggcauuccacguagucuuuucaaaauacagcuguguuucuuucuuuuuuucugaaaucuuaccaaaagcuguuuuuauagcaaucuuuauaaaaugcaugcuucuguucaggcuacauugccuccuaauguucaagucauggcaaugaucaucuucccaggacuucuuaaaguacaaaggaagauuuucuuccauacuuuauaaucucuaacagcugugguuugaaaacccgucccccaucuuuauuauuguucuuccuccucuucuuuuuaaaagagcugucuacugcuuccuguuaccuguguaaaagccugaggaaugaggaaggcuuucuaccuuccauggguucaguagcagguaccuguugaacuucuaaaacaaaaugaaaccaaaaaccucuuauuuuuuuuagagaaccaacccaggaugcugugcauggugcauagaagagucaagcacucacacuggcccauucucccagcccuccuggugugugugccucacuauuaaagcuaaagucuggcuuccaauagugagauuugguuuguuuauuagcaaaagagauuccccuuucaugcucuuuaagccauuccuacuauuagccuuuuaaaauuuuuaaaauaauucuucugguacacuuacacacacacaaacacacacacacacacacacacacacacacacacacacacucgcgcgcgcgcgcgcccacagaagccauagaugucagaucccuguagagacucaguuacaggcagugugagcugucugauacaggaaccaaacuccaaacuccaauccucugcaagaacaaugggcacuuuuccagucucuacugugaaccuuuuuaauggaggcacauugugguuguuauauuaaauacaugaauuguauuaccauguaaacaguaaauauaaaagauaaaauuagguuacuuuaaaaaaaucauuucacaacugggugugauggcgcagaggcagaggccagccugugaauucaaggccagccugaucuacaaagacagucuagaacagccagggcucuguuacacauagaaacccugucuuaaaaacaaaaaacaaaaccaaaaaaccaaaaacuucuauucuaagaugucugauaaauggcuagcuuuggaaagaguugaguugauuauuuuauuaauacaggaacucaguuuuuauaugcguauuccacuuuuaacuuauuuagaaauguuugaaugauauacauaauucugcaaguuugaauuguuuguaauuccaaaucaguugaaauuacuuuacuuacucauuuuuauauguuaaauauuaacauaaaugaaaaauauuccgaaaauaacccuaaaaugugguuuauuuuguuuuguuuuugcuagacauguuuuucaguacaguggggugucaccccacgagaugugaugaguuugagaaggguagcccugaucaguacuuagcaggauugcugagccuugcugagaacaacaaaggaaaaguuguugcaauaggagaauguggacuugguaagugccaaccucaucacuuaacauuaucuugaaaaaacuacuuguuauguucaaauccugaguaauuuuuauucuuuaucuuuuaaagauuuugaccgacuucaguuuugucccaaagauacucaacucaaguaaggaaauuuguugacuuugauuuuuauuuuuucaaaguaauauugauugaacauguaggguuagauaccaagguguuuuuguuuucccuggaagauaucaaaaguuaagugaaagaaaguucacacauguuugcauguaacgauaauccccaacugauuagccgcuggauaugauuugaauggugaaacagcauuuuauguuauauagacuugggcggggggguggcaacagguguaucuaugcacaaacuacccuugguccacuguaguuucuuaugggaacuacauaagaauccagaucaaauuaucucuuaauaaaucuugucauuuuggggguggggguugacaucugugccaccugagggacuucccauaucauacuuuuuagagauguuaugaacucugccucuugaacaccagguaucaguucaccuaaccuggaaaaaucagauuugcacugggacagaaacccauugucuuuaccggcuucucaggccaucuuugcacugccaugucugccuggaccagagugagcccucugagccacagacgggcaagccucgguacaugacaggugcuguuacagagcuccacagcaugucuucccauguggcuuuucuucuagaauaaguuaaaagugauucuccaauacagccugaauauugcagacucagcuuuuggauccaugaaaguacugauagugugaguucuaucuacugcuuugaagauaacuuccaucgucagucaguguuagaacucaguauguauagcagaguauagauuaugcugggucacacaucagauguccaagggccaguuucuaauagaggugaccucaguuuauccucuaagugguugcugagugccucuucagugguaagagauaggcuucauucuuuggccuuuauugacaagacaguccaaaguguaguaggcuaauaagugcuaucaggaagguaaaugcacuugaggacuuguguuccauuccuaccaccaccauaaaaaguuuuaaaaagcgccauggauaggggauggaaggacagccgucuaaaggcaggcuaagaagccuuucuaagaugacaguauaauguaggucuccucaaaagaggauucucaggaacaaacuacacugaggacacugagaagauauaucaguuggcaguuuuuacuuagauuuuaaaaugucuaaaguaugaauaaucucauuuggauuacugccacggagacagauacccagggaauuccugucccaccuggcuuccccuggcauaggcuaaccucuucuguguguacugaagauagguggcagauuagugucuuccagugugccaaaggcacauaguggcuuaugcauuggugucuaguaaagguuuaauaaggaagaagucucucucuuuguguuuccuauauggauaaaagggcuguaauuuaauauuugcuguuggacuuguuagaagaauguagaucuuggucaguucuuugugugcauguguguacacacucaugcaugugugugcauguggaggccagaugucaguccuggugucauuccccaggagcucucccucacugggaccuggggcucucuuuuacgugcuuguuggaggucaaacucaggaacuccugagugcacagcaagcacacugccgaccaagccaccucccaguccucucaucugugcuuucuguuuuccaauuuuguuguuguuguuuuugguuuuuugcgacaccaucucccuauagcucagguuggccuggaacucacuacauacacuugcuaaaauccucugccucuguguccugagugcugggauuaaaggcaugugccaccacuccuggcuucgaucuacauuuuuguagcauuuuggaaccauuaaccuacuauaugauuuguugguuuuauaaaacacauuuuuucccuuuucaaguguccaguagguaucgugugugagaaaugguaaguggguacaccuucaaugggguucaagucuucuauccguggugagcaggccugaccugcaaugugauuuaguuuugcuauucccugccugucuacauauacagcucagcguugucauuguuagcauaaggaugccacugcccaccgcucuucaguauaugauggguaaagcccaugguggcaugccuggacagacuugagugcucaaaaguuauauagcuucuaaaauacuagcaguggcuuuugagaaaugcuuuaaaaauucuaucacugugucugugcaucuguauaagggaguuagaagaggguaucagauccacuguagccacaguaacagaucguugugaaccaccaugugggugcugggaacugaauaaauacugcuccuaugcaagagcuccuagugcucuuaaccacugagccaauucuccauuccugagaagugcuuguuaaagaccaagaauggaaacaaggagagggccugagucgguuauggaaagauugucuugaaguccuagcagucugucuccugcugcccugguacacuucuuccuuucacaaggcggagcucuguucucccauauaggaggaaauauugcucugggcauuuuucuuggggcuuuaaaauacugauauuauguaggucuuuuuuaaaaaucagcuaucagacaagauuucagaaugauuccagggauauuuaagguucucuggaaaaggaucgaggccacccaggcugucagccagcugggagaggcucacagcuacugugucacucacugcguuuuggcacgucucaguccucgccaguaacagcugcucugacacugacauuucaagcuguccuuaguguugacccaagcugucagaaagcagugauucaacuggaggaaaauagagcuuugauaaaauguacagauguaagaaauuuugacaguugucaguucugcucuguaacuuguuauuugguggcugguuuuguuuguuuuccuuuuuaaaauaccaguuauuugauguuauauaccuguuauccucaguuuguacuguuggaguguuucgauuaguuuuaccacauggaaauuuucuuucuuaagauuccucuuuuauuuuugugagggggcaugcaugccaugcugugcgagugguggucccagggccacuucaugcacauaguucccaaguccuacuuugaugugggcucugggaggugaacucaggugccagccuuucuuuaccaugcagacaguguccuuccuguugagccaccuuaccacccacccaccccagcuucuuaaaugaaccauugcucuuaaccacugagcugucucuccauauccuucccucuguccccccacccccaccccacgaccucuuaaugauaucuaucuagcuuagggaucuuucuuuucuugaauuucauaaaauucucagggcacaucauauguauuuauguuauuuauuuuauuuuugguuuuucaagacgggguuucuuuguguagcccuggcuguccuggcccucacucuauagaccaggcuggccuugaacucaagccauccgccugccucugccuccagaguauugggauuaaaggugugcgccaccacugccuggcaugcuucugauaauuuuagagaauuauaucuuuggcuauucugugacagaaagcuacuuucuuauagaacuguuugguucuauaaaauugugacuuggucauguggcugggccacagaguugugcauggugaccacauggaggucauuaucugcagcguguggcugaagcuaccuguaugaucauauuuguugguauucugucuggacucuacccccacagauaccuggcaacagccagguaggccuggcccacuauaaaaggggcugcuugccccuccucucucucucucucucucuuguucucuugccucuuucccuuuguuccucauucccuucccccucucuccgggugaccauggcccaccucuacuucucuacuccccccuucucucugccucugcugcccuccuaacuccccuccccaugcccugaauaaacucuauucuauaccaucuggucccuaaggggaaagggaugccuuggcacgggcccuccgugacaccccccuucccccacacacuggauguuggcauauguacugcuuuaguggcuauggaauagguggcuaguacuuguguuuugggguuuuuuuguuuuguuuuguuuuguuuuuuguuuugaaacagguuucauaugggccugguuguccucaaacuaauuggguaguugaagaucaccuuaaacuugugaugugugucuucaccuugcgggugcugaaaucacaguccugagcuaccacgcuugcuuucaugcagugcuggagauucagcccagggcuuugugcauguuggcaaggacucugcccaucuggcaaugucccucgccacuacuaguaauuccuaaucuuuucuuucaagguuuuauguuuucuaacuugcaaacuguccucacuuuaacuaaaacaaaauuacuucagcuuauucuagcccagcagaaucugaaaaagugauuuaaaaacccaaacauuaguuaauaaagucauagaacaacaaagggcauugugaaaguuuguaauccugguaaaugaagcaucccuuucuaaaaauuaaguggcaggaaagaagcuuguguuguuaauaucugaauucacugcuuucauauugccauuuccagauaguaaaauuccuuuacucaaaaauuauuugauauaugucucaugcuaaaauaaaaauuuugguguggcaauuuuuuuugcuuugugcagauauuuugaaaaacaauuugaacugucagaacaaacacaauuaccaauguuucuucauugucgcaauucacauacugaguuuuuaggugaguuaaaaaugaaguaucauuacauuuuaaaaacuaugagucaauuaggccacuugccugaauuuucuuuuuaauucacagauauuaugagaagaaauagagaccgguauguggguggagugguaaguguacgauaauuguuuaaauaugggcuauacaaaaaugucuuugcuauuaggucagcuucagguaauucagauagcaaaaguaaaguuaucaaguuucucaguugaagggcguguaaauugcucuaagauuuaugggcaugaugguguacaaacaaguaauacuuuuaguuacauuuauuuugcuuaaaguacaagaaugaguacugaauucuacuuaggagaaacaaaugugaaucgucuuuucccacugugcaguaagccugagagcuggccuuugcuguucucuaaucaaaucgauuuucacgaugucuuagacuauuccauuguuucuuucagguuuucuuuucuuuucuuucuuucuuucuuucuuucuuucuuucuuucuuuccuuucuuucucccuuucuuucuuucuuucuuucuuucucuuucucucucucuuuucuuuccuuuuuuuuguuuuauuuguuuuuuugagacagaguuucucucucugugcagcccguuuguuuguuuguuuguuuguuuugagucaggguuucucuguauagcccuggcuguccugggaacucacucuguagaccaggcuggcuucaaacucagaaauccgccuaccucugccucccaauugcugggauuaaaggugugugccaccacugccagaccaaguuuccuuuccuaauuugcuagcugguagucguucucuucccucuaaugauggcucaucuuccgugauauauuuuccucuuaaauguuucuugugugguccuuuuaguccuuccuccugagacauuuccaauauauauucucuacucucacugcacugugacagccaugguagugacuucuagucaguuggaucaugaacuugaguagauaaucuguguuuuaaaaaugcucacguacacaaaauuucauauacaauuucaggagagguucagugaccauccuuugggaguaaagauuguuauuuaggucacaguuccauguaucaguggaagaacguuaaucuaacccuaaauuuuugcuguaauacauuucuuugcuuggauacuuuaugacauauauuccuuuuuggaauguuguggaauacauguguguuuuuaauauguuuaguguguguguguacauguacacauaugugccaugguauucguguggaggucagaauaacugcagaguuggucacgggacugaccaggcuuagcaucuucacccagucaaucaucucgcugacuguugccgucuguuuuuuacgcuuagcucugcuuggugcuacaucccacuagugauagggcugugcucuguacugcugucauguucaugcuacugugcacaucuccucuggaguuuacugacuguaauuuucccuuuagcagcuauacuuaggaauugagaaaggcuuuaauuaaugaccugggcauuacugacagcauggguuuuagcuaacguccugggcauuacugacggcauggguugucauucuggacuccacugcucacuccucuuuauuucuaaguaagucuuuacuuggaugagucuaucauuucaaaaaguuaauaccaggaacagcaaaagcaaccaaaauauuuggcuuuaauaaguugcuaaauaaaguacuauauauaguucucugaauuaguuuauaagagaucacacuuuaaauuaccuucauauuagugaagggauuuuucauuguuguuguucacuggaaauguuaagggcuuagcaccuuuaccuagugggucacccugccaguugcugacccauguguauuuuccaaggaauucuucugcuugguguuacaaaucuugcuagcagcuguauaacauaguuauccauggacagugaugugaauucauugcuaaauaagcccuacuguuaguuacugguuuugauuacacacauuaccuagagcaggagaaaauacggucucaguccuuucugccuguuuaacugaugugaauggugugacaauugcuuuuuuuaaaauuucuuuuacuuuuauuguuucuuguauauaaguucuccccaccaucucugucucccugucucugcccuccccaccccccccuuucacacacuaaggccagaagcaggcguccaauugccuggaggugcucagugugggugcugggaacugaacuccucugcaaaagcagcaagcacucuuaacugcugagucaucccucaaggccgcagcuggcaguuuaaaagcaauguucucaccacucuagcugauuaaucauuucuaaaagaaaagguguccucuaaaagagaagugcagugggauuuucagaacucugcagggaaggugauguagagauacaccuagcugcagagcagauaacuucuugcuuugugucaccagaaauaaugacagauugugauuuucaagucuggcuugaaagaaaaacauuguaggugcuacuacauuaaagaccugugaaacaacacacacauacacacauguacauauacauguauguauguauauauauauauauauauauauauauguauauauguguguguguguguauauauauauauauauauaaaucugguuuugcuuagaaagcagaccagugcuauuauaauaaaacuguauauauauaucccagcagaccgaugcuaguauaauaaaauuguauguauauaucccagcagaccgaugcuauuauaauaaaauuguauauauauaucccagcagaccgaugcuaguauaauaaaacuguauguauauaucccagcagaccgaugcuaguauaauaaaacuguauguauauaucugucuuagucaggguuucuauuccugcacaaacaucaugaccaagaaacaaguuggggaggaaaggguuuauucggcuuacacuuccaugcugcuguucaucaccaaaggaagucaggacuggaacucaaacaggucagggagcaggagcugaugcagaggccauggaggaauguucuuuacuggcuugccuccccuggcuugcucagccugcucucuuauagaacccaagauuaccagcccagagauggucccacccacaaggggccuuucccccuugaucacuaauugagaaaaugccuuacaguuggaucucauggaggcauuuccucaacugaagcuccuuucucugugguaacuccagcugugucaaguugacacaaaacuagccaguacaauugaccccuugucaacuugacacacaaacacaucacuaguaagccucaacccuuacauucuuauucauccccaaggucuaaauaacuuuaaacaucccacagucuuuacauauucuuaaaauuucaaucucuuuaaaauauccauaucauuuaaaauccaaagucuuuuuacaauuaaaagucucuuaacugugggcucuacuaaaauaguuucuuccuucaagagggaaaauaucagggcacagucacaaucaaaagcaaaagucaaucuccaaccguccaaugucugggauccaacuuacgaucuucugggcuccuccaagggcuugggucacuucuccagccaugcccuuuguagcacacgcaucauccucuaggcuccagaugccuguaauccacugcugcugcugcucuugguggucaucucaugguacuggcaucuccaaagcacugcaugaccccuucaguccugggccaucaauugcaacugaggcugcacuuucaccaauggccuuccauggccucucacagugccaagccucagcugcucugcucaacuccuucaugccuucaaaaccaguaccaccugggugacccuuacacauuaccaaguccagccacagcacaagguacaacuuuggcuauaucuggaacacagccacugugcucucagaaaacacuucccagaagaugucaccucaaugaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaacuacagaaucuucacaaucaaaacagcaauggcccugaaaagagucuuuaauuuucccucugaaauuucacaagccaggccuccaucuucugcacuguucucaacauuaucuuccaagcuccuacaaaacaucugacagagcucuuaacaacgaauggaucuucaagcccaaaguuccaaaguccuuccacagaccuccccaaaacauggucagguuguagcaggaauaccccacucugcugguaccaauuugucuuagucaggguuucuauuccugcacaaacaucaugaccaagaaacaaguuggggaggaaaggguuuauucggcuuacacuuccaugcugcuguucaucaccaaaggaagucaggacuggaacucaaacaggucagggagcaggagcugaugcagaggccauggaggaauguucuuuacuggcuugccuccccuggcuugcucagccugcucucuuauagaacccaagauuaccagcccagagauggucccacccacaaggggccuuucccccuugaucacuaauugagaaaaugccuuacaguuggaucucauggaggcauuuccucaacugaagcuccuuucucugugguaacuccagcugugucaaguugacacaaaacuagccaguacaauaucccagcagaccgaugcuaguauaauaaaacuguauguauauaccccagcaaaccgaugcuaguauaauaaaacuguauguauauaucccagcagaccgaugcuaguauaauaaaacuguauguauauaucccaacagaccgaugcuaguauaauaaaacuguauguauauaccccagcagaccgaugcuaguauaauaaaacuguauguauauaucccagcagaccgaugcuaguauaauaaaauuguauguauauaucccagcagacccaugcuaguauaauaaaacuguauguauauaucccagcagaccgaugcuaguauaauaaaacuguauguauauaucccagcagaccgaugcuaguauaauaaaacuguauguauauaucccaacagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaucccagcagaccgaugcuauuauaauaaaacuguauguauauaucccagcagaccgaugcuaguauaauaaaacuguauguauauaccccagcagaccgaugcuaguauaauaaaacuguauguauauaccccagcagaccgaugcuaguauaauaaaacuguauguauauaucccagcagaccgaugcuaguauaauaaaacuguauguauauaucccagcagaccgaugcuaguauaauaaaacuguauguauauaccccagcagaccgaugcuaguauaauaaaacuguauguauauaucccagcagaccgaugcuaguauaauaaaacuguauguauauaccccuagguccauucguuugauggcacgaaggaagcagcagcugcuuugguugacuugggccuuuauauaggauuuaaugguugguacguucucauacuguuuugguuuuccuuaauuuuuauauuaucagauucuuuaaguugucuuguuaagacuuuauuuuuauuacaguuuauauguucugcauugaucuuugggaauuuuaguaacuacuuaugaauaaauuggauaguagaugguuuucagucauuacauauuauacuguguucugauaauggaaacguguguugaagucagcaggucuucagcaauccgguuuguccucaggcuaucuugugcuguucacagauaugcguucacagcauuguaugugaugccguacacaugcuggccuugggaaaagaauauucuagggcagucauguguguauuucuuaggccacagaaguuaggaagcagguguaacguuacccugagugugagagccuguccuccgucucaucgcucagugaccuuuccucuguaacuccacacuaaaccucaaaccuccucacaagucagccagcacagcaagucagugaugguaaguuacagaagagagucuggcuugcuuucccuccucaguguugcccuucacaaugaucacuggugaccauauuguuggcauugcuuauuccuauagaucgaacccaggauuauucuaaguaacaguuaaacuuauaaauugucggggguuggggauuuagcucagugguagagcgcuugccuagcaagcgcaaggcccuggauucgguccucagcucuggaaaaaaaaaaaaaaaagacaaaauaaauugucgaacaauauaguccuccugagagaagcaguuauugcuuccucacccagucacgcuuggguaucugcugcuacccaucuguguagcauuaaauguuccuagcucugaugccucccuuugucuguguccuuaagacacacaccauacugaccccacuucauugucccccgucuuccuuacauuuugucaggacuggguucugugugguugucauuguuucuauauucccugcugcccauguggugaacugugcccccuuuuuaaaaaaagauuuauuuacuauguucugcugggggggcuuagcaguuaagagcacugacugcucuucuggagguccugaguucaaaucccagcaaccacaugguggcucacaaccacccguaaugagaacugaagacagcuauaguguauuuacauauaauaaauaaaaucuuuaaaaaaaaaaguguucugcuuauguguauaucuacacaccagaaagggacaucagaucccauuacagaugguugugagccaccauguaguugcugggaauugaacucaggaccucuggaagagcagccagugcucuugaccucugagccaucucuccagcccccacuuuuugacuucuuggaguaacucgccuuaucgaguaccuugacuucaaaacuugaagcacaggcacagugguucaacccuguaaucucaacccuggggaggcugaagcaggaggaucaugaauuagacuuuggccugggcuacacagugagucacuauugcuuuuuuuuuuuuuuuuuuuuaagauuuauuuauuauauguaagcugucuucagacaccucagaagagagcaucagaucucauuauggaugguuguuagccaccaugugguugcugggauuugaacacaggaccuucagaagagcagucagugcucuuaacugcugagucaucucucuagcccccuauuuucaacuagaugaaauacauucuagcuuucacuucuagcucugagguucucucaucuagcauagccuugagagaucagagugccuucugucugaagacauuguagucagaagucauuuucuaacugcucaguugcuuuuaucuagguuguuucucucacgugguuggucucuuuugauggggacuuucuucaaaugccagguaguccuuuuagcuggacauaguggcacauguuuauuuuacccugaagcugaagcaagauagucucacaaggcaaguuugaggacagccugggcuauauaaaauuuugucacaaauaacuuauuggaagcucuaggugaaucagucaacuggcagguuagaucacagcuggaccuuuccacagugggcucucacacaagcuucuguagagaccuuuuuggggguggaucuuuuucuagaaggguacccugugaucuuugcuaggaguaggguagggauuuguaaauguacauggaaguguccuggagcagagugagguaagagaggggacugucaguucagucuacaucuuuaaucccauguuccugcugugcugggugucccccguucccuaccuuguguuuucuucacccauccaagucacagguugguuaucuguguaccucaucauuucucugucuaaaccauuccaguucccauucccuguccuagaucugcuuucuaggcaccuacuucugggauauuucuugggugaaucuguuugcuaaucucuuucugggccuuuaacauuuaugucacuuaguacuuaaaagcuauuaaucauuucuccuuucauguuuugcuuuauuacgaugggucgggguaacaggcauggggcagugauuaucaaggagcagugaaaagaccagggcugcaggauaagaaaguagggaggaugaauacacacagcacguaggaccgggaggcagugaaguuacugucuaagagaugcgccgucgcggugaccaccuuuacaacaugggcuucggaggcagcgaugugucagaguggguuuacagauucuaacacguguaaccgcugugcugugauuuagugugugggaggcugugcuuuacuggggggugcgguaugaggguguguguggucucugcuuuguucagucucgcuagaccuaaaauuguucuaaaaugucuacagugaauuugugauuuuuuuuuaaauacaaggacaguacuucucauuacuuugaauacugauucauucuaaaacaugcuggcaaucuaaagcauuuacauucccacuugugucuugggugagcuaggucuggccauguuuucugagcaccuagcugaaaagguagcaaucauggaugccagguaaccaccagugaugcugcacaggcacagcagcauccuguucuaaccacaaaauguucacugcuuauggcugugccaucucauuaucccagagcacggccuggggccaaggccacauucaaagacuaaaguguccaugggcagugagggugcaaauauguaaguguguucuuacagggcagcgaggccggagaagcaggaguagucuguuacaguggcugaaaauaaauuagaaaagugaaaguuaacagcacccugaucauucuguuauauaaauaucuuuuuguaacuuuaaacuuuacuuaugcuaauaaaguuuauuaaaaugucaacugguaaguaugaaaaaaugauauccccuaaaagcacgaauauucaauaugccacauucuaauuccauuguuacaucagcccuuuacguuaaaggacgagcugggagcuggcaagguggcucagugguuaagugcaccugcugcccuuucagaggaccuagaucuucuagucucuggagugccuauucacacauucacauacaaugugcaugcaaugugcauacuuaaugugugacauaaguaaaaaucauguuuuuaaauguuacauaagggccaaaaguagagguugauuugaaguugaccauaauauggguucuguaaaggguaaggauauauucacuaaauaucauuuuaaaauacuauuuucaagcucucugaaaacugaagcuaacuuggaaguucugaagucaauaccuagugaaaaacuaaugauugagacagguaaguagaaaauuccagaaauucaaguuccauacugaaucagauuuuuagagguuauuauugauggaaaaguaauuacagauuauuuuuauuuucaguuuggccaaaccuuaaaccuuauaaaagaugacagaaucugugcuaacuagagucuauauuucugacuauuuaaugaaaugaguccccuaagcaguuuaagaagggcuuugagauucucuacugugguuuaauucuauagcccucugagaaaaacagcagccacuaaaaucaggugcuuuaguggaucucuuagauggacuuuagaugaucauuuuucuuaaaauaaguuuaaaagauaguacuuccaccuauccucuguaacucaaaggacugcagcuuuaaggcucuacacugagccacuguaggaaauaaaauucacuuuauuuccuuaggcagucacaacagcaacuauaguggccuuacaaugccucuguacugugcaagcuauucgcagagaaaugacagggaaacagcucaauggcagagcaucugccugguauucccaacacugggaaacaggcuaguguucaugaccgcgcuuucacauguaguacaagcaauacagagcagucuuaaaugcugaagcaugucagugauacuucuuguacaguuaggucuguuuuccccccaaagcaugucauacgcgagccaauucagaaaggaaauagaguagguaaaaaugagccuuuaaaguguagguugggacuuuaugcuucccuuagaacuguuuucuguugccuuaacuuuuguaauuuuauguuauauaccggugugauguucauuacaaagauuuagaaaagucaauuccuuaacacuuuuucucucuuuccccuaacucuagaugcaccuugguguggaguuaaaaguacacaugcuggaucaaaauacauaaacacuucauuuccuaccaaaaagaaaugggaaaacgggcacugcuuaaaagauagaaacgagcccugccacaucauguaaguuguuuugcgugaguggacuugagggcugucagagauaacugcugacugccacucagugaauggugggcaggguggaagcucucugucaucugcucagguucaggucagcucacaggagcuagcacugugguuagugauaagccguccacuggcacuugacccaaggucaaagaccauuugaauagugauuuggaaaugugugcacccuaacugcugugccaucuccuagguucccauccucuuaauccaaaugauuuuacugucucagugagaaagcuaugggucugguucuuugucauuuuguaggacaagaaaaagacucaaagcuugccacagaagugcucuacugcaccuuuccugcuacuguuuauaaccaguuagcuggccuuuaaccacgaccuggugguuaucugcauauuaaguauggacaacagcagcaaccaaggagguaacacaguucucuaaaccucacagugagaugacaagugauagcauguccuuuccucagcaccccugccccagacgcaggaauccaggaaaggauauauguagacagcugugaagacucugggcaagcaagaaaaguuggucagaucauuuaaugggcaccuauccagaauaagucuagaaucuacugguuuagucugguuugccacucugggcuugccucuaauaguuauaguuuaauagcgcagauuguuucugucagaguguaaugucuugaaaugugcccuuaaaaaaaguacuuuguaauaaguagaguauaaggcagaucuaagagucagcaggcagagaagucaucugaguuuccuuuuauauacacauuuggguuuucuuguauuuuaacaugcugguuuuggcagaguuuugaacugaugcuuuaaagccagaggcaaggacucuuuguacugcuugcuaaaauauuuuucauucuuuuugaauggaggaauuugcagauucauccagaagacauuauuucuccuaagccuuugacaguuuaaggggauccuagagaugcugagacaggaaagacaagcagcuguuuuggccacagccacuuggcagacacacugcuuggaggauguagugccaaaggauguuuucuguacugccuuaaaugcuuugaaaacucauagcuuuuggcuuaccuguaaauaugcaagacaaaauuucaaguaguuucuaauacagacuuaaaacugcaguuagcuaaacugcagaacuugggaaaaucagcacaugccagcuaaaaggaugcccgcauuucagcucugcucugcuacuuaaaauuuuugccaacgucuacuccacuaaguuuuccaucuuaacuguuuacuugccggucuuccuuuucuuuagacuauaaauuuccugaaauacaucuuggggcuccugcugugucaggaaagguacauguuacagaggcuagcuaagagaagcggguguucuuaugcucacacccccgugggaugaacuguggcaggaguuuuggauaaggagccucugcucccuggagcagacaagcagauacagucuaagacaguaagcagcuucagaggugucacucugacugggaccuuggaguuagcaacugucugcccagagggcacuaggagcaagcaggcuuugccauuguagaauuuuacuguucacuaagugugacugggagucaggucagauacagacaaacaccuugagcaaaggcagccuauagaagagcaucagcaguagcaaggaaacaauuuaccuaguguagcagaaaguaggaugaggugaguggaagagaaaucugggacagcaaagugagagcagauccuuggggcuuuuguuugccagccuuacucguauagauuucaucaugacccagagacuaaaagcaagagaauagcaauuuuguuugagcuaggaucuccuguagccagagcagcuuacaagcugcuguacagcaguaggugaccuugaaucccuaauccccugcuucuaucucccaagugaaucaccauguuuauguccauuuuuuuucaagaguuaacugucuaucauuucaauacugaaaggcaaagaaaggguagacaacacuuuaauaccugugccuaguauaaggaugucacaguaggagcuggagagauggcuuagagaauaaggcacuggagagaaccaaagauauguucccagcaccagguaucaggcagcucacaagcaccuauaacuccagcucuaggggaaucugaaucuucuggucccugcacucauguacauauguauuuacacauggacaaguacacacacacacacacaaaauugaaaaaauaaacaagugucacaauaccccagaaugcuauucuuaaaaauaacugcagcuuuauuccucaaaguacagaaaaaugcacugaauaaaaagguacuguucagguugcuggcuuacuggcuuacuaaacagugcuuuaccaagcaccggugacguuaacaaacaugagcaguaaauggcucugcugcccaagucucagcagagcagccgugcccuuggccaccguccgccagcagcagcacuacuuacagaugcagucugaguucacugcacagacugcaugugaaugucugugucacgcugaccacaaccuguaaagguccagcuaacuguaaauccucauuccuaguucuuuugaguguucacacuuaggguccucagaaugggagaaaaagcucgugaccaggaauauuuaaagguuuaauucgaacuacaaccuguauauaaccuaaugcauauauaaaaacagauaguauuacuaggaacccacugcucauuuugagcaaagaaaugagucucugagcucuucucucugcucuaaguacaagccuagagccccucccacagccacaccuaaccugucauauuuguuuguuuuauuuaaugcaugugaguacacuguagcuguuuuaagacacccagcagagugcaagagaucucauuacagaugguugugaaccaccaugugguugcugggauuugaacucaggaccucuggaauaccagucagugcucuuaacugcugagccaucucuccaguccacuugucaaggauuuagcaugcacacaaacauuccuugcugccuguuagagacuauaugaauaagcagugccuuucaaauuuuuggcccuauucucuucaauaccauuuuauucauauuacauauaaauauauauauacauacgcauauauauuuuauuuauaaauauaaaauaguuauacuaguaauaguaaaacaaauauaaaaaaaaaaacuaaauccaaaguaggaaggugccuacuuagccuguuuuacugugcagacuucauuuuacuuuuaagaugcucaugauccgggaacaaaagugcuaggaccuagaguuuuaaaggacgccuccccuauaggauaauuccauuaguggugcccuuacgugacccuguaacuuuauauuccaguuagcuccagagucuucuaguugacaguaauuggugaugcuuuccuacagacauuacugacaacuuuaguaacucauaaacuuccuuagaagaggugcuaguguaagaucuucucauguuuacauagaaaaaggugauuacauaccucuaacaauauauucugaguaaguugaucccuuguuuuuuguuuuagucaaauauuggagauaaugucagcagucagagaagaagacccacuggaauuggccaacacgcucuauaacaacaccauuaaaguguuuuuuuccugauuuguguuuccuuuuuaugauguggaauuucauuguaaaacugugaacuuuauugaggaauuuuuuccaguagcacuguacauuacaccucgaagagucaggucagcacuguuuaggcugcuuuaguuaacaauguccaccuuuuuauuguguaaucucaucagaagucugaaaggacaguuuuaugcucucacugcaaacacagugaugcuucuacuaagacuuagacagcacauccuggauuauaucaaaguuuaguugauaacaagccuauuucucaauucugucccuguuuuuugacuuuugaaccuagcucuaagcugcagcucagguuucaaguuuuuuaguugcuucuagcagguuaucuugccuuaguuuuagaagacauuuuauagccuuucuacucaagauuauuuuucuucucgucucuuauacuaaaguuccuuuauucugcauuuucauuuucccacucauuuuaaggaaaagcuagaguccagcauuagauauauuccaauuucauggaggaaucuuuggcacaauugacgcaccauaugaucauuaucucuauuaagaagcuauuuguucaaauuuugucauaaaaacgugaaaacuuuuauucuauguacaauaauguacacaaauuuaaacaggucaccaaagagaccagaaguaauuaaagagguauauuuacaguagcacaucacaguaaacggaaagcauucacaguuucaacauccauacuguuuuugugcuugguuacacacugacgugaagcauauuacuccauuuuggaugaacugaauuuuaaacaaauaccucaaugauuaguaaaugcuacuuuaaucagugucaucauuaaauucugcggcugcugcugcugcgccugugugcugaauccccccguuucuuucucuuugagcaucaucaucacagucuguacugucauccucguucaguucucggucagauccagcagcauccucucuuaaagccuccucuggguuuggauuuucauugggugcaauaaauccguuguuguuagaugcauuugaguuauccuugaucucaucuucgauguacacuuucugauggcacauuggacaaguaucuugaauguacagccauuuccgaaggcagagugcauggaaauaaugguuacacgguguuauacgagcagauguugugaacucaugauagcagauugcacagacaucaucuauuucuugcaaguggcucccuuuuaucucaggaagugaauuaauuuucuuaacagcaguucuacgauucaugaaugucuuccagccauuuuuuacuuguaaguagauguuaaaauaugcauguaggcacaucauacaagcccgaauuuuacuuccugacucaaacaucaugguauaggccccauucccaaacauuacuacuccaaauauaaauucgauaauauugcccguggagcgaacaaaguagacauagucaucaagcuuuucccagaggacguuauaguagccaucaaucaugaacagcguguagacagugagggagacgauuaccuucaagcagaguuccacacaaaaggcuguaacugcaaacagccauguauuuagugcauagugaugccaaaggacauaacugaguaagacagggagaaugaacaggcaagcagagacaaacagcacaggaaagugucuauggaaagaugacacaugggaggcacugagcgacauuaauacagggucugucaucccauggaugaaaugcaggacugcaguuaauaaaaggcacauguuucuacuuaagcgaauaagucucucuucaggucuuagcccacuuaaaccagucugaagagccaaaaugaaaaauaaaacaggagcuacaaagccaagccgccugucaucuucuucaguugauccaauaaaggccaauauuccaaggcccaaauaaugggcuauugaagaaauuacagcacucaugccuaguacaguuaguguagaaucacacccacuaauuauuagauugcaaaugacgucccagaaaucaucccaagaaauaaagaaggacucaguuucauuugccauccuuaaaauguacauuaacacuguagccugagcuguaauucuuguuagccagaagacccgaaguaugucugggaaacgaauccucuuccauguguccuccaucaguaacuguaauccauaaauucgguacauaugccucacuaacaaguacacauaccgaguagaguaguaaaaccacuuaaguuucacugccaagacaagcacuguguuaaauaugagaaucaaggacgacaugagcacuacugucucucugauguguaauggcagcucugugauuaagccaauuauaggaaccaagauauuuaaaaucauuaacugugaauagauggacugaaucugcaguaaugugacauauccaauuccaaagguuagcugcagaacgaugagugccauccacagugagggcccuuuccgaggaagcaacucgauuccaaacgcugacguguuguaggcaccauagaagucaaugugcaaagcagcauaguaauucaccaacacugaaguugcagcuaauagaaaggcugagcuguacauguaaaacuugaaaagugaucgcugugacaagaucagaacaauacuggauacaacuauaccugaggaaaaaagagaaaaggguauucgaaugaaguauuuuuaagcauguguuuuuuuaauacuagcaauuacaacuuucuuccuuuauuaugcuaucuuugccguuguaaaaccucaagacaacucaggcuuuacaggacaguaaagauuugagaagucagaguucuaaaccagagcaaacaaguacauuuuaaaaaccuuggcccuuuauuuucuggcuucuaaaguaauucugcuugucauaguauauauauacauccaugcaaaccaaaccaacuaaacacauuuuaaaaaaccuggccucuuauuuucugguuucuaaagcaauucuguuuaucauguuauauauacauccaugcaugagaugacuaaauuaucuucaggacaaaacuguaaugauauacauguacuuuuugauaauuuuuuaaacucaaaagaauacuuucuauguaaguucauaaucauuaaaaaguuuaauguaauaccaucaaaauaauaaggcuuuucagaaugaaaauuacuagacugaaaggauucuucuacuugguuucagaauccuuucaucaaguguucuuuagacaaggugaacuuuuauauggcacccuaucaccuacuuuccuuccagcugagcucaguaggcucucuguaguagauaugaauauucccuaaggguuccaacucaggcccccguacauuccuucacauuucugaaaugcucuccaaguucccuuucccuacaaacugaaucacaucuucagaaaaccaaaucauguuuuaaaggcuagcuggcuauaagcaucagccccauuauuccguguuaaguacuguaaauagucugaugaucgaucgagugccaggcaacauaugcucuucagucagcauaucuccaguacuuuuaggacauauuuagugauacugaaguuuguaauuaucuaguuaucaccccacuacauaguucugucccugccuuauaaaucaauggacugcacaaugcuguauacaaagaaagguuauguucuuaugggauacggggagaaccaacucucacuuuacagaaaacaauaccaacuccccaacuaauaagucuccaaaggaaauauucucucuggugaucuuugggaagcauuguucagguuucuuugcauuccacagcugagacacgggguuuuuuuccuuaggguccaucuuaaggguccaaggaaacccaggaguaguuuucauuagagcuuauaagggacuugcucucuuuuaaaacaccaccuuuggacacagagaauugaauuaaaccauaaccugggaauuucaguccuagacuccaguauaauauaauuacuggacuguuaauaaguucucaaggcagaaaaagaaccaagcaucaaaaucucuucaggaacuuugaauucauauaugaacugaaugcaccaaagaguucagggccuuuucaguuagaauuccaaaagcaagaaguaauaacaggaaaggagggaguccauccaugcauuuuacacuccauggcauguacucugcuuuuaggagacaaggacuugcuauguauguaguccaaacuagccuuccacuugugcccuccucccuguucccagaaggcuaagauuaaaggugugccccaacaaagugcaaacucuuuuaaguauguucauuccugacucuucugcaaacuuaugacugaaauuuagaaggaaauaaaauaccauuuacaccucuucagaucuguaaguaccuuuaaacuguucaaaagcaggcaagaaauacaguaauaaagacauuacucccuuacuucagagucuuaaguaaugaaauucuggggggaaaaaaguacuaugaaaugauguuaaucuguuagcauacuugacaaauaaauuguaccacagagaaacccuuucuaaacuuggcauugugguacuuaccuauaauccaagcccugaggacuaaggcauacguacuaugcugagcugugugagacccuaccuuaaaacaacaaaauucuaucaaacuuucauuuuagggaaaacaacagcaagaaugauauccuagcuuuuucuauucaugaaauugaauuuuaacaaguaugaucucauuaccauaugugaacauggauuuuuaaagaagugguggucuggguuuuugaagacaggucuuuccuuaggcacuaggugucccugacccacagagaucugccuaccucugcuuucagagugcugagacuaaaggcacacacuacuaaaccaaauaguaagguacaaucauuggaguucucuuguucugucuucacaucuauguccuguccuugucuagaauccaaacuuucaacuuccaaaagcuauccauagugacaggacucucuuguuuaggaaugcagugaaugacaguuuggaacuucugaauauccucaggauggagacugaguguuagagaaauacagccacuuaggccugaaaguucuggucccauuccuaccccuuuguccccuuccuacuucuaaggagggggauaauggacaaaggcucaguagcuaagccagaggugaccauuucaccaacagugcccacacaacaaagcaacaaaaccgcagcaggacucaauucugauggcuccagaaaccuuaauuuuguaguucuagagucuggaaaccugacagggcacaggcacuccucaguccucucuuucaccucuacgcccuauacaccuaccucuuccuuccgucugcccuuuguuauacauagacaaauagagacauuuccccagauucugucugcaaucuagcauugaauggaucaggaaacuugaccagagaugaaacauucuggacugaaugcagagggagagggggaggggcagacagacagacagacagacagacugacaucuacacaccguuuuucuuuuauaucacacugucuuacuggcaccaaagaggaagaacagcucuaauuucucauacauccugacauugauuaaauaugcauucauacagagacauauagacagugugcccuuugagguuuuauguuuuuaauauuagaucucuauauuuuauaacuuuuagauauuucugaggacaucucugcacaaguuguacauucagcauuaguuuauuuagaacugaucauaaauacaagauagagguccagcaugauuuuccucauauuuuuuuuuacauauuuaguacuuacaaggguuucuauaaacaauauagcaauguaaucagaguaacuacuacucaaauccuaacuuauacuuaaaauuuuccugacuacugacuaaagaacccuuccauuucuauugaccauucaggguucuucugugaaggccacuuuaccuucuguccauaugucuuacgguuuggacaaguguccuaacaaaaggcuauguugaagacuuagucccugacagguagugagggagacaacuggaucauuagaguucuaaguccagcaaugcauuacuccaugaaugcacucacugcugaauggaggagaaggaaccuagcuggagaaagcuggucacuugcaggggugggggugggaacagugggacugugaaagggaugccuuuaaagguauagcuggucuuggccccuuccugucucucugugcuuccugucugccgugagacaagcaacuuucucugccaugaccuuuggucauaaugcucugcuucaccacgggcccaaaauuaauuaaucaaguguuacagacugaaccgaggcgucaaaauaagccuuuccuacugcaaguccaucuuaagcgcucugccccaacacgaugacaacacaauauggugcuggggggcuuucccgauuugugugcaauuaauaacaaauuauuuguugguuauaaguaauauccagguuuauauccaguguuuuguuuuuuagaugcuaauuuauuaaaagguuuuuaauccuaaaaauucaauauauacucuuucuauaaauugauuauucauacagauaagaggaagggagccaguaauuuuuccauauuaaguaaauaucauauuuacuucucugaaccucaauucaauucuaccucugaaaccuaccaaguuucuauuguacuugugucuauuucugagcugugcauuuuauacuccuagucuauuuguccauccccaggguucucaaccaggauaagauuccuuccuccuugggaacacuugacaacaucuagggucggaauggcugugacaacugauguguguguuacauggacaagguauuaguggcagaagguagggagacgagaaaaaaggcuagaaaugguacucuguagauagugccccauuccuagguuuaugcuguccaaaaugucaacagagcuacugcugaggaaugucggucucuuccccugccagacacaguuacuucugcuucacuccugccuucucacaccacaggguuucacaguuguucccacugaguggaugagcuuagucaguaucaaagaaaauucucaauucuuuuacaaugaagagauucccaacuaacacacauuuagaguaugucuuaaguuggcuguuuuguuauuuucaauagugcuauaaugaauauccuugcucauaaugcaguauaaucucuaaguccucacaacuagauuugugaauuaaauguuauauaguaaaugucacuccauggccagagcuauagcucaaguggcaagaauacuuuccuccccagcacgcaugacagcuggguucaaugccuggcaucuuaugaaaccagcuacagcgguccaaccuuacagucucaucaguacugaaguagagccaagagaacccagagcucaaggucaucuucaauuuggggucagcauaggcuacaugugacccugccucaaucaauauaguuaguaucaguugacaaugccagaugguuuauacagaggugauggcuugccaaauuauaucaauuugccuauuucaaauagguaaacaccugugccaaauacuuuuaaaucacacuuugcauucuucaccgaucuaagagauaaacuauuucuuucauuaacaaugagacuaggaacuacuuuucuuuaugggccaccugaaguuuauccucacauaagccuucuuuuuaaaggacuuauacaugauagaaacauuuuccucucaauuugucauuuuuaaaagauuuuucaauaaagaagguuuuaaaaaaauuuuuuuuaaagauuuauuuauugguuauauguaaguacacuguagcugucuucagacacuccagaagagggcgucagaucucguuacggaugguuaugagccaccauguggguugcugggauuugaacuccggaccuucagaagaacagucgggugcucuuacccacugagccaucucaccagccccuaaaaauuauuuuuaaauacucaaacuuaccuuauuauauuuguaauuucucagguuuuuuuguuuuguuuuguuuuuguuuuuguuuuuuguuuuucgagacaggguuucucuguauagcccugaguguccuggaacucacuuuguagaccaggcuggccucgaacucagaaaucugccugucucugccucccgagugcugggauuaaaggcgugcaccaccaagcccggcuacaguuuucuuuuaugcuuagaauccuuugccaugucaauugccagcuuaugaguaauaaauacuauuaaaacacacucuauauuugccucuucucuucugucuuuaaguuugcuaauucgguauuacacuguuguggggugagcuuccuuuacucucuuaccacuaccuaagaaagagucuuauguucccacacaugugcauauugugugguuuucuuuauaucucuaagaggaaaggcuuuacuuucuggccuuuugaaaucucaaacuggaauuggagagauggcucagggguuaagagcucuugacugcucuuccagagguccugaguucaauucccagcaaccacaugguggcucacaaccaucuguaauggaauccaaugcccucuucugcuguguuugaagagaaguacaauguacucacauauauaaaauaaauuaaucuuaaagaaagaaagaaagaaagaaagaaagagaaagaaguagagagagagagagagagagagagaaagacagaaagaaagaaagaaaucucaagcuggccugacaccagaugcaaguguaguuguugaagcacccuguggucagaggaagaacgcugcggacacuaacucauccaauuagcaauguuugcaaaggaugcuggccgaguccugagguacacgggcuucaauaaugacaaauccccaacuagucuccacucacauuuuucauacacauacauguuacuacuucauuuaaggugauuuuuuucagcuuuuauucuuacaaacaaaaaaauuagcacaacuaguuugcuacaauuuagaaaaaucauuagaugaugaauuuagaggucauuuuuuucuuauaaaaccugacucaauauucugagauaauuuuuuucaaauaaauauuuggugauuucaaaaggaugaaauauguauaacaacguauagucuuaacugagcauuaaaauauuuucugaaaagugaucauaggaacagcuaacacaugaacaaaugcuuuaaaggguuuuuauccuaacucauuuauugcccuauaaccuccaugaaaaagaugcugugaacuuccuuagagaagcugcaccuucaaaauguaaccuccgcaggcugagugcguggaagcucacugacucuggagguggaaggcugcaggugcagagccuaauuacaaucuaccuuggaccaucuuuagcccaagucagagagaucuaacauccagugacuaacauacaaaccuuuuggaauauacuaacuuaaagccuuaguucccaacagccagagcucuagaguaccuucuucuacagacagcauccugggucuauaacaagaaccuuucagcuuugcuuucaccuaccuacuuaacauuccacuaaugguuuuuaaaguguuguguuauaaaacuuuuaucaaacuguuaccauguugaacauggaauuugggguaacgucaaucaguguucaugggccacagucaaucagauuugguuucagaauaagcuaucucuuaucccauuugagaugaguuguguuuuuauguugacaauaccaucauuguuuuuauaaagguagagaaaacaaaacuacagacucgugaaauggagcucuuccugaaauucucaaauacaaaacuucugugaagaaauaaaguauaaggagugggcgggggaacacugacuuucuuaaauguuuuuaccguaagugacuuaagaaaacuccuuucuauaaaucuaccuagugucgaguacuccaacaggaaaugcauuaaauccucagguccccccaaaguugccagaaucugcgguuauuaugccaugaagacauucaaggcaguggcuguauguacuaucucugagaugacuaugcagacuccucucgaacacagagaaugguggaaguggcuuuaauaaagaagagcagaacgacuaacuuguauccccaguagaugacacuaagcccugugcuugaagaguaucaccaccacuuuuucuuucuuguuaacuuuaaggugagcacugcggggucacagcgcuggguacugcaucuccgcacacugaggaagaacaaaagggaaccaucccugaacaccagaagccuuucuaacgcucuggcaaacaccagcugugcaccagaaaccaaacaccuaacuucuccaaccucauuuccucaccuguaaagucuaaauaacacgauccaccuuugaggagugaccgacggauuagguaaaaccugugagaaugcuuucuagcagacaaauguagaagaguuacugccaagaacaaaacugcuucuuuauugacgcuccuuuucugggagaauaaggcagcagaggcgcucgcacuucucaaggucuuggucaggaccucacuaccagguacccgcacccccaaccuuucaauagcaagaacccaccuaaaaacucaucguaaugaucucaucaacaaaaccugccaagcuguaauuaucuggaaaagaucucuuuauguguuucucacuucugguauguagcacagagagaaauagaaagugaaauauaaaauacuuuuagcacuca

SEQ ID NO: 7766 - RNA, 581 nt, Mus musculus
cuuuuuuuuuaauuuuaucugcauuuauuuuaugcugaauuuauucccgggccaugaguuuuuguuucuucaguuucuucugggauaucuuuuucuucugugcagccuccucuucuggcuuuggaaugaucuguuccuucucagugaggaucaucucaauguggcagggggagcucauguauggguuaauccggccaugagcucuguagguucgucggcacaucuuaggugccuuguucaccuggauguguucaaugacucucggcauuuuuaagcacgugcagcagaaauucagcacucuuuuuuggccaccgacccuguguccagccccacuguuuggccugggcacaccuaccgaccccaccauuauaccgccggaauggcacacauugcuucuuuaaagugacauccuucagauacuugguggcuuuacggauaugcauacccuugauggccugggcaguuucccggguguucuuaaagugaacgagaagguuugacccucuugauuugcaugauuuugugggguuuucugggucaaaagaguagcaaaccaucuuggcaggugaccucuggccgcu

SEQ ID NO: 7767 - RNA, 17533 nt, Mus musculus
cggucccugggcugggccgagcccgccgggcggcugaagcgcguggggccggguugcgagcggggcgcgcagcgguuacucugguuacuguccgcgagggaugcuggggacccggcgggcaggagccuucgccucgcucugaaggacgcucauccgagacagccauucacucucgaggaaggcaagugucggucggacagguucccggccgugacuucggggcuugcuugaggaggaaucuccaagggagggcugagcugccaggcugccgccgcgcuucgggacgccguggccaucuuuuguuggagaaggcugccggggcaguguugcuaagggcagcuuucccagcacccagauccuucuacgcucccgacuccuuccuaccgagcaccugcugcuggugacaaaagaccguuuacagccaggcgagcggacaucgaaguauacagccacauucgcaccccucagcccaauagagaggcccguguccaucaguuggcugaaugaagaaguguguaaucaggagccguugggguaggcaggcuuuaaaugcugccuuuuaagaucuggacaacuuaagauacauuugcacucucaaugauuucaaaaauugaucacaucugacucgugauccugaaacuauuuauuggaagaaguucgaccgguugccccgaaccccuuugagaacuacauuuuggggacauuuuaaucacugaagaccuuccgaggaaaaaagacccccccaagagacccccaaaacacaaaauccucagccuuggcuggugccaccaaagaagccuuuugagccauguggacuuuucuuggcauugcuaccuucaccuauuuuuauaagaaaugcggggaugucacccuggccaacaaggagcuccugcugugcgugcugguguuccugucgcugggccuggugcucuccuaccgcugucgccaucgacacgggggccuccuuggccgccaucagagcggcgcccaguucgcugccuucucggauauucucucugcuuugccucuuauuggcuucuucugggccaagucaccugaaucagaaaagaaagaacagcuggaguccaagaagguaugccugaugccacagugggcaaaugaaugggaucguauuuuaaacuucagaucgaggucacugaaguuuaugguuucuuuaaaagucacgaaagugguggcuuagaagcgucaguguucucauuugauugcguuucuuaaaguucuggacuguguuguggcugugcucuuagggaagaugaaaagcauuuguugugugaaccucagggauuggguguugauuuugguaggaaauguuagaauuucauuugggagacagacucacuguggcuuuuaauuuaaaaucccuggguaaggaugauuuuuguuccugacaagggagaauuuguguggcagguaaggcuacuuauaaaugugauggcagacaguggaaagugacagcaauuugaaaagcaauaaagaugccuaacacuuuaaaguuuugggcagaaauccgucccccacuaucuauugaagcaauuagucagcgcaguccgcuccuaaguugagucagagcugaaugacaggcuuacguuagagacuggaucuuuaaauauuuguggugccauuaauuacuucgagggaaugauggggccagugguaggugaugagagaggaacagggcggcaagucagaucacguaggaccuacuagccagggauaugugaacuuuucccuuaagagcguuggaaagauagaguaacaaugcuugauuucuacaaaaguaagaauaaauaauguuugggaacuacauugcaguacacagccgugcaagaagggacauugcugugaugcugaagcuggguguccagugugcaugagagagaguggccaggaugaguuacccaccuagcaguauagacuuuggggucugcuuucuuuaauaaaguccauaguacaaauuagcaaaggugguagaagaaaagaacuugguucagaguuuuaguuuaguucugccacuuguugcuguaauacuuuggggaugguuugauuucugucaaaaucagguuccuguuagcuuagaugagggugguaccaccgucgcugguacucagggaaugaaguaaguucauguuugcagaauggccggugcucaaccaucuaauaaguaacuaagcuguugacacuagucuaaagauggcauucucuguuggggguagggaggaugcucgacugguuucauuuugggacugcuucaggcuuucuccuuaccuggaaaccagagagccagcugcuggcaugaguucugcucagugcucaccgcuguguacguggacagucacaaguugugggaggccugcaccuguagcugcucaguguagaguugaguaguucaguuauaggauugguccugguucuguauucgaaucucacuguagauaugcacaggguuaggccucauguggauuuccaaauauguccauauaacauuuucuaacuacuguguccagaaaaaggaauauguauauuuuauugggcuauauacauuuuuuuuuagucaguauuuugauccugauuauauaugguuuggacuuaaaaauauaccauggauaugauuuacucauguuuguggggggaggggagucuagcuuuugcucaagguguaaaagucggguguguuuaugugcgaguuaaugguuuaugucgacagauuuggaagaaugauaaucauuuuuguuaaacagugcagaaaagaaaucggucuuucagaaacgacauuaacaggagcagcuaccucagugucgaccucguucgugacggacccggaagugaucaucgugggaucuggugugcuuggaucugccuuggcagcaguucucuccagagauggaagaaaggugacggucaucgagagagauuuaaaagagcccgacaggauaguuggggagcugcugcagccaggaggcuaccguguucuccaggagcugggccuuggagguaggcucauuugguguugaggaguuguguaaauacucgcucuucacucuggacuguucuggccucccacccacccucucucccucccuuccuuauaauaagcuuuacaugaacuaaaaacuuucugugacaaugagagcggaggaggaaagagccguaucauugugugagaagaggcuacccagacagagugagauagugaaaugcccuaaaccgucacggcagcaaugaagacgcucagcucaguaaccagaacugucauuuacaugguguggaacacacuccugggggaugcuguucccgccggucuuaaguacgucuuccauucauuuaggaaauacuuauuuacugcugucuuugagcgagguguucugcugaguaaguaccaagauggacuagugauuaagacaggcauccuugagaaguagcacagaagguccuuagcuguaaggugagccccaucuggaggaggucagaagagguuggugggugcccuggaauguacugauagggaacauugaacugugguccucugaucagccagcugagaccucugcugagaaacauuuguuuguuuguuuuugguuuuucgagacaggguuuuucuguguugccuuggcuguccuggaacucacucuguagaccaggcuggccuugaacuccgaaaucugccugccucugccucccaagugcugggauuaaaggcgugugcuaccaugcccggcugagaaacauuuuuaaugguggaaaacagagagggugaauaugaggacagcggagauucauuugauacaagaauauuuuuauggccauguaugauaaaguagggagaagcugaugauguggcugagagugacaaauauauauauguauuuuaaagauuuauuuaugugaguacacugucacugucuucagacacaccagaagagggcaucagaucccauuacagaugguugugagccaccauguaguugcugggaauugaacucagguccucuggaagagcagucaagugaucuuaaaugcugagccauuucuccaucuggacaaauacauuuuuuaaggggauagauuugcugaguuccauaauuguauugucaagguacaugaguucaacuaucacauuaugccuuauaaacacauaacaacuguuauaugucagugauaaguauaaaaauaagcacauauucuuucuccugaaauggcauccccauuguuaucaggcaagaggagacaggagacagguagggcgagcucaggguuuuguugccuggagaccgacuuuaaucaccacagaggcuggcugagagugguccuucaacaaagacugaaaacacugacagguggccuucgucccacuuucugaggcuacaucccaguggauguuaaagaggaugugcuaaaggacaaacauuuuuuuuuaaaaguagaugaaauauaugaagauuguagaggcuagcguaaaaucagaaagcgugggcuagggagucggggaguggggauuguuuucaguggugagaaguuaccucagagaaguuaccucagcaaagaaguggagggaagugagccuuggagagaccaggagaggacaaagucugggccuagcuuucgcuuucugugaagagccaccaagccugcuggaccuuccuguugucgauggaggaaaagccagcuaaagaagggggcuccuagggagugaggggaagccccugggaaguuucauguuuuaaaaggguaaucaagaagacaaucugagaguauagccugaguagagagaagaccauggguuagggccgagccaggaggagguuauccagaugcuauuggaggaucaguaacagcugaugacuuggacugcagucaaaguagugcaggcgugaaagucugcugaugaaucaggugucaggugugagaaaggcaaggccaguaggacuugcagaggcuaacugcugccaggaagccugggacggagcucugggccaugaaaguacagaggucagugaggcaaugggagaccagugggccaugaaagaagcaaagugacuucuugcucuugagccacacacaggacaaacguacauaccuggaggaaaaacacgcauacauguaaaauacagauacauaguaaacuaggaguuuaucuugaugcuggaacaaacccccagcuuuguccccacgccccagagggaauuugaaggcaugugccgccacgccagacauguucugguuugaugacggacucuguauagcuuccuauggaucauugcuacacuugcugcucauuacuuacucugucuuaacgcuuuuccuuuguaaguguuauguguaaugguaauacuuuguuuccucugauauuuuuccuaaaacacuaauugccauugauuuuuaaauuuucagauuuuuaauugguucuuuaaaaauguccucuuuugccuuguacuuuuguuacuacuuauagugucuuaaagguaaaaacgccauuuuuacacaagcccaaugcauacucugcuuuuugcuuuucuguuugauauacuaaaauuacucuauaguguaucaugaaucaguguucauauacacugggaaccauuagcaguuaggaaauguccucauugguuggggaaagcuacuuugucauacacugaauuuuuuuuuuaaagauuuauuuauuauuauauguaaguacacuguaacugucuucagacacuccagaaaagggagucagaucuuguuacagaugguugugagccaccaugugguugcugggauuugaacucuggaccuuuggaagagcagucgggugcucuuacccacugagccaucucaccagcccaauacacugaauuuuuauguauagauugggaccuuuaaaguaguuuuaacaguauuguguuuucucuuuucccuuccuuccuuuuuuucuccuccacccccuuccuguggcaaauauacuuguuucuacauuggggcacaugguaagaaggcccgcauguuuucuguaucuuaauggacagcagauucacucaggacaggguuguggcugauuuccugucaagcggucacagauaugaaugacugugcuguuaaccugaaguguaucuguggguuugucuuguacaaaccuucuaagauuuguguaaucgcgguaccaguucagguccccagcuggucuuacagcuuuguagagcggagccucaguugcacugugucuuuuccuugguaauucucagcauacuaauaaaacuguuugaauugaacuuuucugcagauacaguagaaggucucaaugcccaucauauacauggcuacauaguucaugacuaugaaagcagaucugaaguucaaauuccguacccacugucagaaaccaaccaagugcagaguggaauugcuuuucaccauggccgauucaucaugagucuccggaaagcagcuauggcagagcccaaguaagaccacagcuuuaauacauaaugcugaaggcucaaaccuggguccuccugugaggauuaguggcuaagaggacuuucuuuucuuuuuuucuucuuuuuaaaaagccaaacuucuuuuaaagauuuauuuacuuauuuuauguaugugaguacacaacaguuguuuucagacacaccagaagagggcaucagaucccauuacagaugguugugagccaccaugugguugcugggaauugaacucaugacgucuggaagagcagucagugcucuuaaccacugagccaucucucuagcccggcuuucuguucuugcagagccuggaguuugauucuuagcacccacaucagauugcucacaacccucuguagcuccaguuugagaggaucaaaugcucuccucugccuuccucagacaucuguacacaagcacgcacaaauagaaagaaaauguuuuacgcaagggaaauuacaucaguauucaugaaaauuuuuguuaugguccaaauggcauaggcaugauaaagaaccuauaaguaaaauauguucagugucuguguaaaaacuguuuuacuuuaagugagaacuaggcgaugaucauuuaauuggaauuuagagggcuguguaagugcuguaaccuaaggcaugugcccaugugugcccauuugagucuuguguuugugguuguuacaccuuuucuagagagaacagaagacaagaagaaaucccuguuccacuuacccugaggacguagucugacaggauuggcuacuugucuugauuauuaauuguguauuagccucucguccuuuaacaauaauuacggaaguuuuaaauaugagagcacucauguugacacaaacccacguguugacaaaguaaaagucaguggacuuuuccuuggggcugaaauguccgguguucauggaagcagggugggaaaggccucagauagauggaugcguguauaaagaugaaaacuguugauccucugauggauaugacuacuuuucacauuugccauaugccaucuuauuuuuaaaaaacauaacuauuuuuucaaaauuucauacaugcauaauuguauuuuuaucuuuuuuuaauccuaauucuugucagaucuaccccaccauggccuuaucuccucccucugcccgguuugauuuuuuuuuuuuuuuuuuauaugucuuacugagugcaacugugcuacuuauauacucauggguaggaggauguccacuggagcguggucagccugucacaucccuaaacugucuguguagggacuuucacagcucaagugugcuacuccagccauguguuucuguucauccuuuaguguaaaguuuauagaagguguugugcuucaguuacuagaggaagaugaugcuguaaucggcgugcaauacaaggacaaggagacuggggacaccaaggugagaguugguaaaaaacgucaucucuucccauuguugcagaugggcucuuuuccugccccuuuaaaauucuucauuaccuuguguuugugugagugugugccaguguguguaugggggugggguggggggaagguuagagaaccauauuuguucaggagugucucuccugcagcuguuuuaccaaacacauuguuauagucacaacuaggaaaacaaugaaaauaacuauaaaauaguuucuaguuuguuaguguuggucgauuaaggaggaggcaauggacuguucuccagggucaccccuuccuagagacuggggugugauaggguuaccugguuucucgcucacaguguaagacugacacauugucagguguauaaagaugcugcuucuaucuagccacucauuaaacagcaccgagggaaguaaugucauuuuauaaugaaccuggguaguucuuggaguuuguggugaggcccagucuuuuguggccaugugagccuuugucgguuaugguggagaguuuaauggcagagguacaaagagaccuccagggacucaggaucaggccuccauugucuuccaccucugugagaguguauuauguuuagauauuuuccuguuggcuguagaagcacggguaacugaccggguggcccuccugcucuccucuguuacaggagcuccacgccccgcucaccguuguugcggauggacucuucuccaaguucaggaagagccucaucuccaguaaagucuccguuucuucccacuucguuggcuuccuuaugaagguauggaggaguauauguaguuggagaaaaacaaaagcaacuggggguuugagaacuaugaaaguauuuucuuuuuuaggaugcaccacaguuuaaacccaauuuugcggagcuuguucuggucaaccccaguccaguucucaucuaccagauuucuuccagugaaacuaggguacuuguugauauucggggagaauugccaagaaaccuaagagaauacauggcugaacaaauuuacccacaguuaccugguaagaaauaggguuucacccugauuauaauuuacggucuaaagcuaaucucacaaaaaccucuuuccaguuuugcugaaagcauugucuagaugagacucagugauaagcguaccuguuuguguguagcguguauuuccugugaucccacacuuaguagaugguuaaagucaugugguuuucccugucuccucucaugaauuugacucguuucuuccucucgucucuuguuguguucagcuguacauguuauuucugucuauuuccccuuagauuccuuuguuauuccuuaacuuguauaaggaggugcuuaauggauaguuuuauuaauaaaguagguaauuggugauuuauugcagggaacuauggaauagcuaccauacacauacuguuaagaauuguuuuauaguugaugaggagaugugugcuaauuugagacugaaaugcuuacaccauuuauuugggugaugggauuaauugcagagcaccugaaggagucauuucuggaggccucucagaauggucgucugcggaccaugccggccagcuuccuuccuccuuccucagugaacaaacgagguaucuuuuagcauuauuuuaaaacgccgccauuacuucagcuggcaugauugaauuuguaaucuggcauaaaguugaagcagagaguuggcuaccuuggccagaaagagugggaggaguguugguucccauaauaaguucccgacauggaagcuuugggguacaauuauuauuuguagaggacgccguggcagucacugggaguacagcaaggaaguuaaauguugccugcuggcuuggagggaaccgugguguuuaggagcaugcaguugacuucauggggcacugauaacaguuccaguaaaacugcauuauggaagccgggcauggugccgcacgccuuuaaucccagcagucgggaggcagaggcagguggauuucugaguucgaggcuagccuggucuacaaagugaguuccaggacagccaggguuauacagagaaacccugucuugaaaaaccaaaaaaacaacccaaaaccaauuaaccaaacaaaacccccugcaucuaugguagcauggagucacuguuuggggcguccgaggcugggagcgggguucugcaguagaaguguggcuggggaggacauugcuuggguaugaaggugaucagugggagcagggacugaauaggaacagggucugcagaaccugcucccaggcugccugagacacaguaguauuucuaggagcgccaggagaucccuguaacuggcauuuuuggcaggugucaguagugauugauagcuggcauauaguuguguuuuaaauguauauuuuaaaggcuuauuacuuguuuggagacagggucucacuguggacugaaacuuacguagaucagucugaccucagauuuacagagaucaccagucucuguucuuagugcuggaguugugccuggcuaagaauuuguuuuuacuuacauguguauuugccauguuuauguaacaccucagaggcuagggcaucagcauccccgggacuggagcuacagaugguccugauguggguauugggaagcacacuuagauccucuggaggaguagcacacacuccuaccugcuaagccaucucuccucugccucucccuccccacuacccccuuuucuuuuugagaaaaggucuuaacggcccagacugaaaccagacggcugaggaugaccucggucaucuguccugccucugcucucaagagcugagauuauaggcacacaccacaugcagggcagcguauguguuuaauauuuuuaauacuuaauuuuauccuauauaggcacuggaacuuaaggguuuuuuguuuguuuguuuuuuggcaucagcuuuguugagauccuaaguuuuucaguucagccacagaaagcagauuuaauuagaguuuacucuuggcuaucuuaucuccugucaaucacagguuuguuagcacuaacguuuugucuccaagcuguucaggauuucauagucuuaguucucuuuccgcaggcguccuuauucugggagaugcguauaaccugaggcacccucuuacugguggaggaaugacaguugcuuuaaaagauauaaaauuguggagacaacuguuaaaagacauuccugaccuuuaugaugaugcugcuauuuuccagguaagagucuagaguuuuccucccacggaauggcucaaaauacaucuguugaugaaugagcagacugggagcccagugggaaucuaugcgugugugcgcgugggggggcuuaugguucauaaugguccuuagucuuauucagguauaagcuugacuuucaaacugcauuuuuauugucuaugguuuagcauauguacagcagauuggcccagcccacucuucucugagcuauaagguuagcuucaaagucauguggcccauugcccugaaagaguguggcacuauuaccugcagauaggccuugggacagauaacuuuuugaggagaugauaaacauuuacuuaagcuuuuuucccuccugacuuguaauaaaugauauucuucauuuuuaggccaaaaaaucauucuuuuggucaagaaaaaggacccauuccuuuguugugaauguauuggcucaggccuuguaugaauuauuuucagcuacagaugguaaguauagauaguuuuaagugaaaugacuuguagacuuuuaaguuuucucagauaagggaccuacauuaccaaaguuaguaaaguaguuagucuauaaccacacaucaccugacuacccacugccaugugguaguucuuguggugucucaguguugagaacaaaauaaaagggacgccugaggugggccugggggaagugggggaggaaaaggggccuaagguccggccagagcuccugugcucugggcaggcagacacaggcagagcugcugggcacuuuuccacagggcccagggugagcaugccugacccacgugguggggguggaaaaggggcagccgccgaccacaccccccccccccugcccggagcuaccuugcuagcaccccaggguugcagaagagagggaauagaggaagacguucccaacacugaccagggugcgcagcgggccuugauggagcagagcagaggcucugugguuuaagagccuuauuauagaaaugcaggggaaagagagaggguaggagagagaaaagagaaaagagaggaacuggggaggugguagagguaacuggggaggaguuuagccugaaggucagaagcuugggccauugcuuacaugacuacugaccaugcuucucuugugggggcugugggagguuguaucuuagguaggggcuggaguuccaggagcaugagggaaccccuaucgugucauguagguagauuaugaccauugggguucagaccucagcucgacuggagaccagccugcaauuccccacaucucagcaucauguauccgcccaccacuucuucugggggcuguuggcauuccuuagaaaacacccguagcaguauuucaggaagguauuuguuugaguccucugguccaggcuagagcauauauggccucgcgugguauaauguuggugaaaggccuuucuggccagcuuuggggaggagaagcagugugguugaguuucuuuggaagcauuauuuacagcaugaauaggcgccucuagccgagguuggagcuccuuuccugcuacugugaacaagaggcucgcauugcaaauagccaugugcauugcucuguuugcuccguuauagacaaguuggccauucuagguucaacauucauaauaaugaaaauguaaaauucuaagcuagaugugguggugcaugcugcuucuccuagcagccaggaagcugaggcaggacgauugggagaguagccugagcuacauacauaguaagaucuuauuucaaaacaaaugauacucuagcaucugcaccccuccccaauccauguauuaaacuugcaaaguaaaaaaaaaauauuuaaagaaacagacaaaaauagguaaacaucugagaugcuucaagcuccuugguugaguuucuuggugcccauuagcagagaaagugggacugcuucucauagacuccagcuauccaucuguccccucuugcuaaacucauucauugugaucuaagaccaaucuggacgaaauggaauggaaguuaaaguggacuaauaagaggaagagaguucuaaguuuugaguuuuucuaagcuauugucuguugcaguaaauauuaauuggagcuuucuaccccaucuuacauuuaguucccaaauaaaagacacaaagccuuucuauuuauaauaagccuuaaagcccuagagcugggcaguuaucguucucugcuauuuugucuacuucgcugucauuaaccccgagauaucacuugcuauguacugccugagucacuccuacuccgaacuggccagcccucgaggccacgagcuuauaauucacauaccccauggugccuuuuuccuuucuccucucuccuugaucuguuucagcccugccuaccucucuacugcccagccacaggcuauaggcauuuuuacucaacuaauaguuuuaaauuaaggagcaagguuugcacaacaaaaguuggcauaugugagaauucacuugucuagcccuugggauauagaauuuaacauuaugauacauagcagcagaccaaagcucaacacauaucaaagcugccaacaguguuaaagugaaugacagaugugggaggaaagaacuuuauaggauaaaaacauaccacguuucauccuuacaaauaaccccgguaagaaaagucugccacuaacuucaguucuucaaaguauguuuuauacauauauggaagugccauaaugaaccucuuacuuuauccagcuuaagaaaacuaaauguuuuaucauaaccccccccccccccaaaaaaaaagaaagaaaaagaaaagucuagccaugguagccuuuaaucccagcacucaggaggcaggggcaggcagaucucugugaguuugaggccagccugguuuacacagugaguuccagaacagucagggcuauguagagagacccccguuucaaacaagacaaaacaaaucaaaacaauuaaaaaaauucguuaauaauuuaaaaagacuuuaauaggaaaaucuaggcacuuuaagaaaagaacccugacucuaaacuguuaaaugguuguuuguuaugcuguucugaaggcuucaaaaugcaugaaaaaguuccauggauauagauucacucacugcuugauggccuggugcagacagcauggguuaggcaucucagaaccugggcauuuuguuagaguuauguucuuauauauaagagcuuacaaaguauuugaugucauuuaacuuagaacaaaaucauacguaauuuaaaaguaacuuguaaguauuagaaaauagaaacagaucauucauacuauuuuaacccugagagcacugaucuggaaaugugaaggaacucuugguuggggaauucuaggacuguuuuuuguuuguuuguuuuuguuuuuugagauggaguuucccaggcugucccagaacccacucuguagaccaggcuggccccaaacuuagaaacccaccugccucugccucccaagugcugggauuaaaggcaugugccaccauugcccggcucuaggacuguuaagauaauaauuucuguuuuguuuuagauuccuugcaucagcuccgaaaagcuugcuuucuguauuuuaaacuugguggagagugugugaccgguccuguuggguugcuuucaauguaaguucuaagagcagaagggaaaugcucaguuuauugaaucuuuaucccuuggacauuaaguuagauucuguuucccauucaugccccagucacaaguggccccaagaagcagugauggcucaguagguaccaguguuugcugccugaguuuggcauacuuaguuugagcccuagaaccuguguagacggauggauggacuacagaguuguccucugauugccacaugugugcuauguauguagugugcgcccugcccccagguguuauguacaugugugugugcgcacacuaacacaagagaaaggauuuaaaaagcagccuugggaaaugaacacuggucagcacaacccugugcuguccuccugaugcagacacacugagaacuggccgacugaguaacauugaugguugguuuucaccugugauguuaucgcuugucuggcccacaggaaccaagaauaacagagaacucugaauugaaauauuaaucuugcaggcuugaaauuuaguaguaguuuugcuaaugcaaacauauacucgggaagucugggaaggucaaggcacugaguacagaucuacagucagaagaucaguucugaugccaaacccagacugcagcaggcuucauuuuggaucucaaagauuagugguagaaaacagcaggaaaaauaagacuuaagagcgagcauggucaccagcuucucaaagcgcucauuucuucuaaguaguuuuuuuuuuuuuuuuaaucaucuuaaagcuaauucuugucauugaauguaacaggcagaugagcuugcuaaguccucacauguagagugcaugaaacuuuuauuggugauacacuugaaccuuugugacuaauucuauuuaaccauguuucuuuccuauuacagauugucuccucacccucugguguugauucgacacuucuuuuccguugcaaucuacgccacguauuucugcuucaaaucagagccgugggcuacaaaaccacgggcccuuuucaguagcggugcuguacuguacaaagcguguucuauccuauuuccacucaucuauucagaaaugaaguaucugguucauugaaagggaguccacgugcagucaagucccuuggggcuugaagaggauguauauagcauagaacugugucacuuccacaguggacuugaggaccaagcuuguguauaagcauguaaauauaagccuuacuuuacaguugaaaaugaaggucagagaagcuagauguuuaaaaggaugauuguuucuacaaaucagugcuaacacucaaguuuuucuuuugauuucaguauuuggggugacucauugggacaagccaauaaaaugaagagugaacucuuauguucuuuugguuuuuguuguagacaucuuuauauagcuucauggucccagaaaaagauaacccaagugggauagaaagcgguuguuaaaccugacaguaucuaguccuuauuguguguuuguaugugcucgggcaugccucagugugauacacuacguucaugugggggcugagguugacauugucgucuuuacucucacgucacaguguauauuugaggcaggucucuugcucagccuggagcccuaggcagcuuguauuuucuccgcuacuucuaaccacaggagcccuacuagcuacagguucaggcagacuccugccaugucucauccuagcagaugacagcucccuugagcaggaauuuccauguagaaccaaguuaugaguuugagggguuuuuuguuuguuuuucgagacaggguuucucuguguagcccuggcuguccuggaacucacuuuguagaccaggcuggccuuguacucagagaucugccugccucugccucccaagugcugggauuaaaggcgugcaccaccacgccuggcagaguuugaguuuuaaaaguuuaucacuaaaccuuuacagccccaccccuggucccuacugccuccuauggcuaacagcuuuguugucuggcuugggcagaagcagcuagaagagcagagcauguaggacacgaguuuacugcugggcucucaauggaccauacagaccuacaguggaugaagcaucacccccaccccagucugucgcaggguuucuuacaggguauccguuuucaucacaagcagggcaacucaguacuagcaaugcuguuuuacugaaggucuggaguugcacaaacagauccuuagaacauaagauggaauggcuucauccaucaguuauacugagcauuuaaaagaggcaaguacaaaacaguucugcaucuacaugauaaaaauuccuuacgaugccaugauuuagacaguugagagccacuuuccuuagaauggcugguucccacagaggaggaaaaugcacguugcaugaggagucaaguaucuuucucacguccaaguucauucuagucauagaacauccugucacuggagcaggagaaagaagucacaggacuguucggaauucaucaaaaaugaaguuaggcacaugggcuucagccaccuggaauaguaagcagaagugaaaccacaucauuggcgcucaggaaauucaguuuuacagagggaauucaagaggugaaaaugucuguuggaggaaggugaagcacuggaaggagcugaggcgcauagggaaacgagacaacccuuucauugcugguagcugguuuuaauguuuccuuacugugcacaugacaacaccugaggggggagg

SEQ ID NO: 7768 - RNA, 17533 nt, Mus musculus
ccuccccccucagguguugucaugugcacaguaaggaaacauuaaaaccagcuaccagcaaugaaaggguugucucguuucccuaugcgccucagcuccuuccagugcuucaccuuccuccaacagacauuuucaccucuugaauucccucuguaaaacugaauuuccugagcgccaaugaugugguuucacuucugcuuacuauuccagguggcugaagcccaugugccuaacuucauuuuugaugaauuccgaacaguccugugacuucuuucuccugcuccagugacaggauguucuaugacuagaaugaacuuggacgugagaaagauacuugacuccucaugcaacgugcauuuuccuccucugugggaaccagccauucuaaggaaaguggcucucaacugucuaaaucauggcaucguaaggaauuuuuaucauguagaugcagaacuguuuuguacuugccucuuuuaaaugcucaguauaacugauggaugaagccauuccaucuuauguucuaaggaucuguuugugcaacuccagaccuucaguaaaacagcauugcuaguacugaguugcccugcuugugaugaaaacggauacccuguaagaaacccugcgacagacuggggugggggugaugcuucauccacuguaggucuguaugguccauugagagcccagcaguaaacucguguccuacaugcucugcucuucuagcugcuucugcccaagccagacaacaaagcuguuagccauaggaggcaguagggaccagggguggggcuguaaagguuuagugauaaacuuuuaaaacucaaacucugccaggcgugguggugcacgccuuuaaucccagcacuugggaggcagaggcaggcagaucucugaguacaaggccagccuggucuacaaagugaguuccaggacagccagggcuacacagagaaacccugucucgaaaaacaaacaaaaaaccccucaaacucauaacuugguucuacauggaaauuccugcucaagggagcugucaucugcuaggaugagacauggcaggagucugccugaaccuguagcuaguagggcuccugugguuagaaguagcggagaaaauacaagcugccuagggcuccaggcugagcaagagaccugccucaaauauacacugugacgugagaguaaagacgacaaugucaaccucagcccccacaugaacguaguguaucacacugaggcaugcccgagcacauacaaacacacaauaaggacuagauacugucagguuuaacaaccgcuuucuaucccacuuggguuaucuuuuucugggaccaugaagcuauauaaagaugucuacaacaaaaaccaaaagaacauaagaguucacucuucauuuuauuggcuugucccaaugagucaccccaaauacugaaaucaaaagaaaaacuugaguguuagcacugauuuguagaaacaaucauccuuuuaaacaucuagcuucucugaccuucauuuucaacuguaaaguaaggcuuauauuuacaugcuuauacacaagcuugguccucaaguccacuguggaagugacacaguucuaugcuauauacauccucuucaagccccaagggacuugacugcacguggacucccuuucaaugaaccagauacuucauuucugaauagaugaguggaaauaggauagaacacgcuuuguacaguacagcaccgcuacugaaaagggcccgugguuuuguagcccacggcucugauuugaagcagaaauacguggcguagauugcaacggaaaagaagugucgaaucaacaccagagggugaggagacaaucuguaauaggaaagaaacaugguuaaauagaauuagucacaaagguucaaguguaucaccaauaaaaguuucaugcacucuacaugugaggacuuagcaagcucaucugccuguuacauucaaugacaagaauuagcuuuaagaugauuaaaaaaaaaaaaaaaacuacuuagaagaaaugagcgcuuugagaagcuggugaccaugcucgcucuuaagucuuauuuuuccugcuguuuucuaccacuaaucuuugagauccaaaaugaagccugcugcagucuggguuuggcaucagaacugaucuucugacuguagaucuguacucagugccuugaccuucccagacuucccgaguauauguuugcauuagcaaaacuacuacuaaauuucaagccugcaagauuaauauuucaauucagaguucucuguuauucuugguuccugugggccagacaagcgauaacaucacaggugaaaaccaaccaucaauguuacucagucggccaguucucagugugucugcaucaggaggacagcacaggguugugcugaccaguguucauuucccaaggcugcuuuuuaaauccuuucucuuguguuagugugcgcacacacacauguacauaacaccugggggcagggcgcacacuacauacauagcacacauguggcaaucagaggacaacucuguaguccauccauccgucuacacagguucuagggcucaaacuaaguaugccaaacucaggcagcaaacacugguaccuacugagccaucacugcuucuuggggccacuugugacuggggcaugaaugggaaacagaaucuaacuuaauguccaagggauaaagauucaauaaacugagcauuucccuucugcucuuagaacuuacauugaaagcaacccaacaggaccggucacacacucuccaccaaguuuaaaauacagaaagcaagcuuuucggagcugaugcaaggaaucuaaaacaaaacagaaauuauuaucuuaacaguccuagagccgggcaaugguggcacaugccuuuaaucccagcacuugggaggcagaggcagguggguuucuaaguuuggggccagccuggucuacagaguggguucugggacagccugggaaacuccaucucaaaaaacaaaaacaaacaaacaaaaaacaguccuagaauuccccaaccaagaguuccuucacauuuccagaucagugcucucaggguuaaaauaguaugaaugaucuguuucuauuuucuaauacuuacaaguuacuuuuaaauuacguaugauuuuguucuaaguuaaaugacaucaaauacuuuguaagcucuuauauauaagaacauaacucuaacaaaaugcccagguucugagaugccuaacccaugcugucugcaccaggccaucaagcagugagugaaucuauauccauggaacuuuuucaugcauuuugaagccuucagaacagcauaacaaacaaccauuuaacaguuuagagucaggguucuuuucuuaaagugccuagauuuuccuauuaaagucuuuuuaaauuauuaacgaauuuuuuuaauuguuuugauuuguuuugucuuguuugaaacgggggucucucuacauagcccugacuguucuggaacucacuguguaaaccaggcuggccucaaacucacagagaucugccugccccugccuccugagugcugggauuaaaggcuaccauggcuagacuuuucuuuuucuuucuuuuuuuuugggggggggggggguuaugauaaaacauuuaguuuucuuaagcuggauaaaguaagagguucauuauggcacuuccauauauguauaaaacauacuuugaagaacugaaguuaguggcagacuuuucuuaccgggguuauuuguaaggaugaaacgugguauguuuuuauccuauaaaguucuuuccucccacaucugucauucacuuuaacacuguuggcagcuuugauauguguugagcuuuggucugcugcuauguaucauaauguuaaauucuauaucccaagggcuagacaagugaauucucacauaugccaacuuuuguugugcaaaccuugcuccuuaauuuaaaacuauuaguugaguaaaaaugccuauagccuguggcugggcaguagagagguaggcagggcugaaacagaucaaggagagaggagaaaggaaaaaggcaccaugggguaugugaauuauaagcucguggccucgagggcuggccaguucggaguaggagugacucaggcaguacauagcaagugauaucucgggguuaaugacagcgaaguagacaaaauagcagagaacgauaacugcccagcucuagggcuuuaaggcuuauuauaaauagaaaggcuuugugucuuuuauuugggaacuaaauguaagaugggguagaaagcuccaauuaauauuuacugcaacagacaauagcuuagaaaaacucaaaacuuagaacucucuuccucuuauuaguccacuuuaacuuccauuccauuucguccagauuggucuuagaucacaaugaaugaguuuagcaagaggggacagauggauagcuggagucuaugagaagcagucccacuuucucugcuaaugggcaccaagaaacucaaccaaggagcuugaagcaucucagauguuuaccuauuuuugucuguuucuuuaaauauuuuuuuuuuacuuugcaaguuuaauacauggauuggggaggggugcagaugcuagaguaucauuuguuuugaaauaagaucuuacuauguauguagcucaggcuacucucccaaucguccugccucagcuuccuggcugcuaggagaagcagcaugcaccaccacaucuagcuuagaauuuuacauuuucauuauuaugaauguugaaccuagaauggccaacuugucuauaacggagcaaacagagcaaugcacauggcuauuugcaaugcgagccucuuguucacaguagcaggaaaggagcuccaaccucggcuagaggcgccuauucaugcuguaaauaaugcuuccaaagaaacucaaccacacugcuucuccuccccaaagcuggccagaaaggccuuucaccaacauuauaccacgcgaggccauauaugcucuagccuggaccagaggacucaaacaaauaccuuccugaaauacugcuacggguguuuucuaaggaaugccaacagcccccagaagaaguggugggcggauacaugaugcugagauguggggaauugcaggcuggucuccagucgagcugaggucugaaccccaauggucauaaucuaccuacaugacacgauagggguucccucaugcuccuggaacuccagccccuaccuaagauacaaccucccacagcccccacaagagaagcauggucaguagucauguaagcaauggcccaagcuucugaccuucaggcuaaacuccuccccaguuaccucuaccaccuccccaguuccucucuuuucucuuuucucucuccuacccucucucuuuccccugcauuucuauaauaaggcucuuaaaccacagagccucugcucugcuccaucaaggcccgcugcgcacccuggucaguguugggaacgucuuccucuauucccucucuucugcaacccuggggugcuagcaagguagcuccgggcagggggggggggguguggucggcggcugccccuuuuccacccccaccacgugggucaggcaugcucacccugggcccuguggaaaagugcccagcagcucugccugugucugccugcccagagcacaggagcucuggccggaccuuaggccccuuuuccucccccacuucccccaggcccaccucaggcgucccuuuuauuuuguucucaacacugagacaccacaagaacuaccacauggcaguggguagucaggugaugugugguuauagacuaacuacuuuacuaacuuugguaauguaggucccuuaucugagaaaacuuaaaagucuacaagucauuucacuuaaaacuaucuauacuuaccaucuguagcugaaaauaauucauacaaggccugagccaauacauucacaacaaaggaauggguccuuuuucuugaccaaaagaaugauuuuuuggccuaaaaaugaagaauaucauuuauuacaagucaggagggaaaaaagcuuaaguaaauguuuaucaucuccucaaaaaguuaucugucccaaggccuaucugcagguaauagugccacacucuuucagggcaaugggccacaugacuuugaagcuaaccuuauagcucagagaagagugggcugggccaaucugcuguacauaugcuaaaccauagacaauaaaaaugcaguuugaaagucaagcuuauaccugaauaagacuaaggaccauuaugaaccauaagcccccccacgcgcacacacgcauagauucccacugggcucccagucugcucauucaucaacagauguauuuugagccauuccgugggaggaaaacucuagacucuuaccuggaaaauagcagcaucaucauaaaggucaggaaugucuuuuaacaguugucuccacaauuuuauaucuuuuaaagcaacugucauuccuccaccaguaagagggugccucagguuauacgcaucucccagaauaaggacgccugcggaaagagaacuaagacuaugaaauccugaacagcuuggagacaaaacguuagugcuaacaaaccugugauugacaggagauaagauagccaagaguaaacucuaauuaaaucugcuuucuguggcugaacugaaaaacuuaggaucucaacaaagcugaugccaaaaaacaaacaaacaaaaaacccuuaaguuccagugccuauauaggauaaaauuaaguauuaaaaauauuaaacacauacgcugcccugcauguggugugugccuauaaucucagcucuugagagcagaggcaggacagaugaccgaggucauccucagccgucugguuucagucugggccguuaagaccuuuucucaaaaagaaaaggggguaguggggagggagaggcagaggagagauggcuuagcagguaggagugugugcuacuccuccagaggaucuaagugugcuucccaauacccacaucaggaccaucuguagcuccagucccggggaugcugaugcccuagccucugagguguuacauaaacauggcaaauacacauguaaguaaaaacaaauucuuagccaggcacaacuccagcacuaagaacagagacuggugaucucuguaaaucugaggucagacugaucuacguaaguuucaguccacagugagacccugucuccaaacaaguaauaagccuuuaaaauauacauuuaaaacacaacuauaugccagcuaucaaucacuacugacaccugccaaaaaugccaguuacagggaucuccuggcgcuccuagaaauacuacugugucucaggcagccugggagcagguucugcagacccuguuccuauucagucccugcucccacugaucaccuucauacccaagcaauguccuccccagccacacuucuacugcagaaccccgcucccagccucggacgccccaaacagugacuccaugcuaccauagaugcaggggguuuuguuugguuaauugguuuuggguuguuuuuuugguuuuucaagacaggguuucucuguauaacccuggcuguccuggaacucacuuuguagaccaggcuagccucgaacucagaaauccaccugccucugccucccgacugcugggauuaaaggcgugcggcaccaugcccggcuuccauaaugcaguuuuacuggaacuguuaucagugccccaugaagucaacugcaugcuccuaaacaccacgguucccuccaagccagcaggcaacauuuaacuuccuugcuguacucccagugacugccacggcguccucuacaaauaauaauuguaccccaaagcuuccaugucgggaacuuauuaugggaaccaacacuccucccacucuuucuggccaagguagccaacucucugcuucaacuuuaugccagauuacaaauucaaucaugccagcugaaguaauggcggcguuuuaaaauaaugcuaaaagauaccucguuuguucacugaggaaggaggaaggaagcuggccggcaugguccgcagacgaccauucugagaggccuccagaaaugacuccuucaggugcucugcaauuaaucccaucacccaaauaaaugguguaagcauuucagucucaaauuagcacacaucuccucaucaacuauaaaacaauucuuaacaguauguguaugguagcuauuccauaguucccugcaauaaaucaccaauuaccuacuuuauuaauaaaacuauccauuaagcaccuccuuauacaaguuaaggaauaacaaaggaaucuaaggggaaauagacagaaauaacauguacagcugaacacaacaagagacgagaggaagaaacgagucaaauucaugagaggagacagggaaaaccacaugacuuuaaccaucuacuaagugugggaucacaggaaauacacgcuacacacaaacagguacgcuuaucacugagucucaucuagacaaugcuuucagcaaaacuggaaagagguuuuugugagauuagcuuuagaccguaaauuauaaucagggugaaacccuauuucuuaccagguaacuguggguaaauuuguucagccauguauucucuuagguuucuuggcaauucuccccgaauaucaacaaguacccuaguuucacuggaagaaaucugguagaugagaacuggacugggguugaccagaacaagcuccgcaaaauuggguuuaaacuguggugcauccuaaaaaagaaaauacuuucauaguucucaaacccccaguugcuuuuguuuuucuccaacuacauauacuccuccauaccuucauaaggaagccaacgaagugggaagaaacggagacuuuacuggagaugaggcucuuccugaacuuggagaagaguccauccgcaacaacggugagcggggcguggagcuccuguaacagaggagagcaggagggccacccggucaguuacccgugcuucuacagccaacaggaaaauaucuaaacauaauacacucucacagagguggaagacaauggaggccugauccugagucccuggaggucucuuuguaccucugccauuaaacucuccaccauaaccgacaaaggcucacauggccacaaaagacugggccucaccacaaacuccaagaacuacccagguucauuauaaaaugacauuacuucccucggugcuguuuaaugaguggcuagauagaagcagcaucuuuauacaccugacaaugugucagucuuacacugugagcgagaaaccagguaacccuaucacaccccagucucuaggaaggggugacccuggagaacaguccauugccuccuccuuaaucgaccaacacuaacaaacuagaaacuauuuuauaguuauuuucauuguuuuccuaguugugacuauaacaauguguuugguaaaacagcugcaggagagacacuccugaacaaauaugguucucuaaccuuccccccaccccacccccauacacacacuggcacacacucacacaaacacaagguaaugaagaauuuuaaaggggcaggaaaagagcccaucugcaacaaugggaagagaugacguuuuuuaccaacucucaccuugguguccccagucuccuuguccuuguauugcacgccgauuacagcaucaucuuccucuaguaacugaagcacaacaccuucuauaaacuuuacacuaaaggaugaacagaaacacauggcuggaguagcacacuugagcugugaaagucccuacacagacaguuuagggaugugacaggcugaccacgcuccaguggacauccuccuacccaugaguauauaaguagcacaguugcacucaguaagacauauaaaaaaaaaaaaaaaaaaucaaaccgggcagagggaggagauaaggccauggugggguagaucugacaagaauuaggauuaaaaaaagauaaaaauacaauuaugcauguaugaaauuuugaaaaaauaguuauguuuuuuaaaaauaagauggcauauggcaaaugugaaaaguagucauauccaucagaggaucaacaguuuucaucuuuauacacgcauccaucuaucugaggccuuucccacccugcuuccaugaacaccggacauuucagccccaaggaaaaguccacugacuuuuacuuugucaacacguggguuugugucaacaugagugcucucauauuuaaaacuuccguaauuauuguuaaaggacgagaggcuaauacacaauuaauaaucaagacaaguagccaauccugucagacuacguccucaggguaaguggaacagggauuucuucuugucuucuguucucucuagaaaagguguaacaaccacaaacacaagacucaaaugggcacacaugggcacaugccuuagguuacagcacuuacacagcccucuaaauuccaauuaaaugaucaucgccuaguucucacuuaaaguaaaacaguuuuuacacagacacugaacauauuuuacuuauagguucuuuaucaugccuaugccauuuggaccauaacaaaaauuuucaugaauacugauguaauuucccuugcguaaaacauuuucuuucuauuugugcgugcuuguguacagaugucugaggaaggcagaggagagcauuugauccucucaaacuggagcuacagaggguugugagcaaucugaugugggugcuaagaaucaaacuccaggcucugcaagaacagaaagccgggcuagagagauggcucagugguuaagagcacugacugcucuuccagacgucaugaguucaauucccagcaaccacaugguggcucacaaccaucuguaaugggaucugaugcccucuucuggugugucugaaaacaacuguuguguacucacauacauaaaauaaguaaauaaaucuuuaaaagaaguuuggcuuuuuaaaaagaagaaaaaaagaaaagaaaguccucuuagccacuaauccucacaggaggacccagguuugagccuucagcauuauguauuaaagcuguggucuuacuugggcucugccauagcugcuuuccggagacucaugaugaaucggccauggugaaaagcaauuccacucugcacuugguugguuucugacaguggguacggaauuugaacuucagaucugcuuucauagucaugaacuauguagccauguauaugaugggcauugagaccuucuacuguaucugcagaaaaguucaauucaaacaguuuuauuaguaugcugagaauuaccaaggaaaagacacagugcaacugaggcuccgcucuacaaagcuguaagaccagcuggggaccugaacugguaccgcgauuacacaaaucuuagaagguuuguacaagacaaacccacagauacacuucagguuaacagcacagucauucauaucugugaccgcuugacaggaaaucagccacaacccuguccugagugaaucugcuguccauuaagauacagaaaacaugcgggccuucuuaccaugugccccaauguagaaacaaguauauuugccacaggaaggggguggaggagaaaaaaaggaaggaagggaaaagagaaaacacaauacuguuaaaacuacuuuaaaggucccaaucuauacauaaaaauucaguguauugggcuggugagauggcucaguggguaagagcacccgacugcucuuccaaagguccagaguucaaaucccagcaaccacaugguggcucacaaccaucuguaacaagaucugacucccuuuucuggagugucugaagacaguuacaguguacuuacauauaauaauaaauaaaucuuuaaaaaaaaaauucaguguaugacaaaguagcuuuccccaaccaaugaggacauuuccuaacugcuaaugguucccaguguauaugaacacugauucaugauacacuauagaguaauuuuaguauaucaaacagaaaagcaaaaagcagaguaugcauugggcuuguguaaaaauggcguuuuuaccuuuaagacacuauaaguaguaacaaaaguacaaggcaaaagaggacauuuuuaaagaaccaauuaaaaaucugaaaauuuaaaaaucaauggcaauuaguguuuuaggaaaaauaucagaggaaacaaaguauuaccauuacacauaacacuuacaaaggaaaagcguuaagacagaguaaguaaugagcagcaaguguagcaaugauccauaggaagcuauacagaguccgucaucaaaccagaacaugucuggcguggcggcacaugccuucaaauucccucuggggcguggggacaaagcuggggguuuguuccagcaucaagauaaacuccuaguuuacuauguaucuguauuuuacauguaugcguguuuuuccuccagguauguacguuuguccuguguguggcucaagagcaagaagucacuuugcuucuuucauggcccacuggucucccauugccucacugaccucuguacuuucauggcccagagcuccgucccaggcuuccuggcagcaguuagccucugcaaguccuacuggccuugccuuucucacaccugacaccugauucaucagcagacuuucacgccugcacuacuuugacugcaguccaagucaucagcuguuacugauccuccaauagcaucuggauaaccuccuccuggcucggcccuaacccauggucuucucucuacucaggcuauacucucagauugucuucuugauuacccuuuuaaaacaugaaacuucccaggggcuuccccucacucccuaggagcccccuucuuuagcuggcuuuuccuccaucgacaacaggaagguccagcaggcuugguggcucuucacagaaagcgaaagcuaggcccagacuuuguccucuccuggucucuccaaggcucacuucccuccacuucuuugcugagguaacuucucugagguaacuucucaccacugaaaacaauccccacuccccgacucccuagcccacgcuuucugauuuuacgcuagccucuacaaucuucauauauuucaucuacuuuuaaaaaaaaauguuuguccuuuagcacauccucuuuaacauccacugggauguagccucagaaagugggacgaaggccaccugucaguguuuucagucuuuguugaaggaccacucucagccagccucuguggugauuaaagucggucuccaggcaacaaaacccugagcucgcccuaccugucuccugucuccucuugccugauaacaauggggaugccauuucaggagaaagaauaugugcuuauuuuuauacuuaucacugacauauaacaguuguuauguguuuauaaggcauaaugugauaguugaacucauguaccuugacaauacaauuauggaacucagcaaaucuauccccuuaaaaaauguauuuguccagauggagaaauggcucagcauuuaagaucacuugacugcucuuccagaggaccugaguucaauucccagcaacuacaugguggcucacaaccaucuguaaugggaucugaugcccucuucuggugugucugaagacagugacaguguacucacauaaauaaaucuuuaaaauacauauauauauuugucacucucagccacaucaucagcuucucccuacuuuaucauacauggccauaaaaauauucuuguaucaaaugaaucuccgcuguccucauauucacccucucuguuuuccaccauuaaaaauguuucucagccgggcaugguagcacacgccuuuaaucccagcacuugggaggcagaggcaggcagauuucggaguucaaggccagccuggucuacagagugaguuccaggacagccaaggcaacacagaaaaacccugucucgaaaaaccaaaaacaaacaaacaaauguuucucagcagaggucucagcuggcugaucagaggaccacaguucaauguucccuaucaguacauuccagggcacccaccaaccucuucugaccuccuccagauggggcucaccuuacagcuaaggaccuucugugcuacuucucaaggaugccugucuuaaucacuaguccaucuugguacuuacucagcagaacaccucgcucaaagacagcaguaaauaaguauuuccuaaaugaauggaagacguacuuaagaccggcgggaacagcaucccccaggaguguguuccacaccauguaaaugacaguucugguuacugagcugagcgucuucauugcugccgugacgguuuagggcauuucacuaucucacucugucuggguagccucuucucacacaaugauacggcucuuuccuccuccgcucucauugucacagaaaguuuuuaguucauguaaagcuuauuauaaggaagggagggagagagggugggugggaggccagaacaguccagagugaagagcgaguauuuacacaacuccucaacaccaaaugagccuaccuccaaggcccagcuccuggagaacacgguagccuccuggcugcagcagcuccccaacuauccugucgggcucuuuuaaaucucucucgaugaccgucaccuuucuuccaucucuggagagaacugcugccaaggcagauccaagcacaccagaucccacgaugaucacuuccggguccgucacgaacgaggucgacacugagguagcugcuccuguuaaugucguuucugaaagaccgauuucuuuucugcacuguuuaacaaaaaugauuaucauucuuccaaaucugucgacauaaaccauuaacucgcacauaaacacacccgacuuuuacaccuugagcaaaagcuagacuccccuccccccacaaacaugaguaaaucauauccaugguauauuuuuaaguccaaaccauauauaaucaggaucaaaauacugacuaaaaaaaaauguauauagcccaauaaaauauacauauuccuuuuucuggacacaguaguuagaaaauguuauauggacauauuuggaaauccacaugaggccuaacccugugcauaucuacagugagauucgaauacagaaccaggaccaauccuauaacugaacuacucaacucuacacugagcagcuacaggugcaggccucccacaacuugugacuguccacguacacagcggugagcacugagcagaacucaugccagcagcuggcucucugguuuccagguaaggagaaagccugaagcagucccaaaaugaaaccagucgagcauccucccuacccccaacagagaaugccaucuuuagacuagugucaacagcuuaguuacuuauuagaugguugagcaccggccauucugcaaacaugaacuuacuucauucccugaguaccagcgacggugguaccacccucaucuaagcuaacaggaaccugauuuugacagaaaucaaaccauccccaaaguauuacagcaacaaguggcagaacuaaacuaaaacucugaaccaaguucuuuucuucuaccaccuuugcuaauuuguacuauggacuuuauuaaagaaagcagaccccaaagucuauacugcuagguggguaacucauccuggccacucucucucaugcacacuggacacccagcuucagcaucacagcaaugucccuucuugcacggcuguguacugcaauguaguucccaaacauuauuuauucuuacuuuuguagaaaucaagcauuguuacucuaucuuuccaacgcucuuaagggaaaaguucacauaucccuggcuaguagguccuacgugaucugacuugccgcccuguuccucucucaucaccuaccacuggccccaucauucccucgaaguaauuaauggcaccacaaauauuuaaagauccagucucuaacguaagccugucauucagcucugacucaacuuaggagcggacugcgcugacuaauugcuucaauagauagugggggacggauuucugcccaaaacuuuaaaguguuaggcaucuuuauugcuuuucaaauugcugucacuuuccacugucugccaucacauuuauaaguagccuuaccugccacacaaauucucccuugucaggaacaaaaaucauccuuacccagggauuuuaaauuaaaagccacagugagucugucucccaaaugaaauucuaacauuuccuaccaaaaucaacacccaaucccugagguucacacaacaaaugcuuuucaucuucccuaagagcacagccacaacacaguccagaacuuuaagaaacgcaaucaaaugagaacacugacgcuucuaagccaccacuuucgugacuuuuaaagaaaccauaaacuucagugaccucgaucugaaguuuaaaauacgaucccauucauuugcccacuguggcaucaggcauaccuucuuggacuccagcuguucuuucuuuucugauucaggugacuuggcccagaagaagccaauaagaggcaaagcagagagaauauccgagaaggcagcgaacugggcgccgcucugauggcggccaaggaggcccccgugucgauggcgacagcgguaggagagcaccaggcccagcgacaggaacaccagcacgcacagcaggagcuccuuguuggccagggugacauccccgcauuucuuauaaaaauaggugaagguagcaaugccaagaaaaguccacauggcucaaaaggcuucuuugguggcaccagccaaggcugaggauuuuguguuuugggggucucuugggggggucuuuuuuccucggaaggucuucagugauuaaaauguccccaaaauguaguucucaaagggguucggggcaaccggucgaacuucuuccaauaaauaguuucaggaucacgagucagaugugaucaauuuuugaaaucauugagagugcaaauguaucuuaaguuguccagaucuuaaaaggcagcauuuaaagccugccuaccccaacggcuccugauuacacacuucuucauucagccaacugauggacacgggccucucuauugggcugaggggugcgaauguggcuguauacuucgauguccgcucgccuggcuguaaacggucuuuugucaccagcagcaggugcucgguaggaaggagucgggagcguagaaggaucugggugcugggaaagcugcccuuagcaacacugccccggcagccuucuccaacaaaagauggccacggcgucccgaagcgcggcggcagccuggcagcucagcccucccuuggagauuccuccucaagcaagccccgaagucacggccgggaaccuguccgaccgacacuugccuuccucgagagugaauggcugucucggaugagcguccuucagagcgaggcgaaggcuccugcccgccggguccccagcaucccucgcggacaguaaccagaguaaccgcugcgcgccccgcucgcaacccggccccacgcgcuucagccgcccggcgggcucggcccagcccagggaccg
